United States Patent 9,328,346 (POLYCOMB-ASSOCIATED NON-CODING RNAS) - sequence listing, part 50

SEQ ID NO: 9094 - RNA, 8482 nt, Mus musculus
aggcccuacagaaggauguggaagaauuucugagcccacugcugggaaagacaccuaucacccagguuaaugaggugacagguacucuucgaaucaagggcuacuuugaugagcaacuuaaagccuggcuucuugagaaaggcuucugaggccugauggucagcccuguggcagugcucgcgacagacuggccuccagagaggagguggauuugagucucuggaaugggauacaaaaaucagggcuuaaguacuuaggaugaaagggcuuugagauaaggccuugcuuucauaaaguacaaguagaccuguguguccauguguccacuugagagcugucccaacaugggaggccauagcaacaaucaagcuaucaaaagcagauauuaacugcuguauagauaaucucuugugcauuguguggaagcauccccugucaaucaaaagcugauggccagugagcugaggcaggacuagaaggcgggacaucugacagggagauucacccuggacuuggaggaagcaggauguagcaaacugaggagaggaaacucaccagccauguggcaggcguagucucguuuaaauggguuaaauggguuaugaacuagugggagcaagucuaguuuacggccauaagcauugcacauacaaaugcgccuguaagucauaauucaggaacugggcugagcaccaguggaaaagccugagauuacaaacugcugucccauuauaaacuuaauacauuuccuauuguuugcuguucuggaagcgaccacccaacccuguucuggaggcuucacagcauagacccaucaaggaaucaauccuugaccuagagcuccugcuauaggccgggcgugguggaagcuauggaacagaagacaguacagcaaaaagacauggacgggaguggaugagacaagcaauaucuuagguucugagugcuguacuagguaggguuggggaaucacccugugaccuguaaucaacuauacaggggugugaagacaaaaugcagaccuuucacuucuggcgcccaccucaccagccacauguccaacccaccauuaaacuggcuaaacaauguuaaacgguguucagaaccugccuacccugugugaccucagaccuaagguagcuagcgguagcaaccucccagugcucucuaguugcugaucucagcacccucaucccaggaaccacaggccgguccauucuuaggucuguagacuaagagcccagcccuacccuaggugacacguucuaccaaucauuaaugcaaguuuuuauugagcuguauauacaauuuaagcuauuaaaauuuauacaauauuuacaaauuaaauaaucaucugaaacucuccagaaacuccuguaacacaaaaccaaaagaaggaagcagcagcuaggccuuggcucccuaggccuggccuggcccggcccggcccagagcuuguucuaaacugcgaaguccagguaccuagccccacaccugcuccuccuuccuggggucaagcauucaaauucagaagacaaaauuuaagcccaaagccaguagguacagaauaguuccaauccugacgacaucccacagguuggagguggccugccuuggguucuggggagcagugguuuaaggagcagcacacacccuuagccaggcccaccaggcaguggcugcugggugauauggggaaagagcuggggaggggcagggcagggucccucggugcugcccgccugugccccacccccaggcacuccuuucccugaguugugugguugccaguaagacauggaaaugccacagggcuucggggggcacagccaccaucacaaagggguucugggaagacugggcuagaggaaagagacugguaccagucuuggcaggaggguggggcaagguccuggucugucuucagccccucuggguuuccacaguugggaacagaagcuaauacuguucggcacugcagcauggucccauacucacaagcagggcuuggaggggcuucaccuucucccagaaagcauggaagagaaggcuuaccagagauucagcuucuacuuugaaggccccaguugaacauggcagaaguggagggagguuagagcugaccaguaucuccauggcugccaggggcacuggggauggaucgacuggaagcccagacacuucuccuugauccucagagauccugccaagucuuucucaacuggggcuauuacucccuggugcaagcagagagggagcuggcacuugauggcaggacguguuccagugagggccacucaagagaacagggccaggucugggcagugucagugggcaacaggggacuccagcuucugcaggcgacgccggcggaguucugcagcaucaggcucuccauccucgggaagcuccucuacaaugcccacugacucaggagcuagaaggagaggucagaggugaagcccagagaacccuucaucccaccccuagagguuccucacuuaccaggaggcuuuucugcuucaggaauugguggggaagcucccggagacgggguaggagccucagagcugggggcgcugguggaaggggcagcagauaccacuguagaggcagucucuucagugggguucacugaaguagcuggccuggggggccugccaagagaagggacaagaggccugaccuuggccuucugggcugcacagauucuccuacgacccacccaccaccaugagccuugcaggacaagcucuaaggcaagcuauccuugaguccuugugacgaguaaguauaagugaauaggcggauuggauuaucagguagagcaaugaaagggucgaguaauucguccccgaggauucugaaucacuugcaggcagacagcugacacuuuccuauuagucuucagucuccagugauaggguaggcacugagcaggucagaaggcuaaagccuuggacuccggcuuccuaccaggccucugcacaugucacgugacuagggauuugauuucuauucuaauauacaagucuucaggcaagugaugagacuagcacuuaagcaugggucaagcuggcuucaggugacugugaucugcucccucagcgugucagcccuggcagccgugaggugaugaguuguagcagcgaaugucaaaaauaauuugagcuuagaaaaaaacaaguaaauuucacagccagcucacuaauaaauugauccuccauggcugugcagaugcacuuccugaaugaaggaugaaagcagguagaguggccaagagcuccugugcacgccuguagacagguggccugaauacagggugcaugggaaacaugucgcaugggaaagaugucaaaaccacaugggaccuuuuuggagcgcuacugaauguggcaugcguaccccagggaagccagcacagugagguacugguugauuugaagcauggcagcauccaguaguguguguauguugcgcagacucugcagccgggccuccaggugcugccgcucauggcccucuagugcucgcagcuccucugggguuaggccagcaaagcccgcagggggcacaggcauuggggggaaggcuggcaggagauacagaggucaggcugagcuaccugggccucagcucuccaccccagauaucccagagaguggccaacuuaccaaaagguggaggcagaggcauacccauccaaggaggagggaaagggaagccgggggcaggaccagccucugggccagguacagacccaggugcuggggcagaaguacuggugccagcagcuguggugguggcugcuccacuaggccgagaaacggcuggcaaaugcaaaauggaagucagucuccuggucuccagauccgacugccaccccccagcugccuuggcaugcacaaggcucaccuguacugguggguggaggggccgcagccucuccugagcuugggggaggcgggacagguggaaagggacccauugggggccacagugggaacaugccuggaggaaaaggaggcaggaggcccugggggacugcagagaaacaaacaguagugagaagaggcugggcugacagucucaccccaggcagugcgcuuggcuacuaggagaucuccuccacucuggcaggcccugcuuaccacucaucauuugucuauuucucaucuucucaccccuuccuacccagaaugagcuucucggggauuccccagcacugucgguacccagccgagggcaaguaccugaggacaaagaagguccucugugggcaaaugaagggccacuuacaauuagggggcuguggcagcagcgguuggggaugaggggcggggggugguccuuggucagcaggcucaggaggugguggugacugggcuggcaacgaugcccgcaggacauccaugcggcaugucgggcaggucugcugucucuggaaccaggagcgcaggcagcugggaguaagaucaggcagcggucagcagguccccaugagccugugcccacgaugcaggucucccagaccuucucccaccucgugugaaagaugugguugcaaggcaaucucuuagcaccagucaccauuucuucucugcagaugaugcagacauuauccauugccuggagcuccucggggguggcaucuggguaccugguuaagauggcagaguccaugucaagaccagaacuggaagcacggggaccucggaguuugggaguagccagaacaagcccacuuacaguguguucauguugcggauggcucggcgagacaugauggcaucugucacagcuuucuugaacugccugaagagacaagucagugagugaaagaagacaugggagagaccagucugaggaaguaagggacaaggcuggacucaccucauggccagguacaugggccuaauggcaaagagugggaaugugugcaccuugaucaugauggucaugaaggccauguacagcaggaccuugaugaagccugaggaggaaagggagagcgcagcuggccauagggcuggcagacacaccgacggaugcugcuguggaccggaagaggccuaggaauccguuaccuguaaacagcuccguguagagcauguauacagccuuguugucccagggguucucgcucuggagguccacggagugcagcacauacuugaugaagaugguaagcaccauggucaucagaauggcguacuggagggagggacaggagauggaugugaguaccagcuuccccuugcucuagccaagcuaggcuucaagacagaggugcagugauaccaacacaggcugcagacacagcugggguccucccagucugggacgaaagcaacugacucuaccuccaaagcauuaacugucaccuaugaacacagcacagggcccagcaugugguaagcacucagcagaugugagcugggacacgucuccugggugaucuacccaacaguuuucucuuuuccauucaugacaucagccuccaggaaggcuugcuaagguacuuggucaagaaucuucuacacgacaccagccuuccuuuguguccuucugcaauagccuagaagucuaugaggguggccaggacaagauggcagaggcucccugguggccaguaaguggguagagacauggcaggcccucagaagcacuugugggguugcucacagcacacgcaggaccagcucagcuucuucccccaagccaguuuuaccucaaagccaaauaccagcugcacagaagccccacgggucaggaugcugugauaagcguggcugacgaagaggaaguccaggauacccaggagaaacaugagagcuguggagacccccaaagggagggaaucgaggucagcagaggccugacaaucacuuccugcuccacgacaaucccaccccauggcgauuggccccaccaucuacuuaaauguguacaccuaagccgaauccucugggaacuacuuuugcccaggcaggguguuggggcaacccaggcccaggggagaaggcagagagcugagugcccaggcaguuaagaagcccuggaguggaacagaguagagacuaugcaaauuaacuucuuaaauuaucuuuccugugcagcuguggauggaggggcagccagggcucuggguaguggcucauagguuuugacuuuucagucuacuccucaguggccucuuuucccucaagucacccccaccucuucaaugagucucacuuacagacgaugcggcaguggaagagccaggagauguuggggcugcguuccaucugaggcagagagggacaccaucaagaugguugggguugccccauaccccaauccacuggcaugcccaucagccacucccaacucacaaaguccacacggucuucagccaaccaauggaaacauuugaggaagaggagcagcguaaagagcgccacaaagcgagggcugaagucaucccgaaaaacggugaaggccaaacaagucucaguaacagcguaccaggaccguuccagaaggugcuguggggugagaaguggaugauaugaaaaccaaucauuuggguacccuccucugaacccuguccuuuggggccaccaacauauuaccuccaucucugcugcccucagcugcccgaagaacaccuugcccaucaccuugcccaagaggaagacaaggacaaaggccuggauguacaggaccugggggugaggaaaggucgugguuugagguuauuuucugcuuuccccugccuggggcuaaucauucugacagguccccaagacugucauagauaauuccaagucaggcggcccagggcuauuucucuccuacuucuaugacauguagccccacuucugccccuccuucccuccccgggcauuccuucuucccugagcccugaacucacugccaugcuggggcuggacuuggucaaauacacuacagugggguagaacugguguuugagguaguaggcaugagccaccacugccccgguuagcgccaggcuggccgccaucaucacugcggugcggaacaucgcccuggcccagagaccugcacaaggaaaaugacauuugugauauccacacuauguaaaccuagcacagucccuggcagaguguaagggcaaacacucauuucaccuugacagccauuagauucaaaacagcauauacucccuguuucacaaacgagaaacuaggacucaaagggguuagaggcucacacugaugcaaggccuagaacuuggaucaaucucguuucaaaucuagggcucuuccacgcugucugccaaggcgccuccucuagggagucacugaggcaaaguuaggaggaggggggcugccaccgcugacccucugaaggagcugggaugauaggcuuuagaggcagguucgcugggcccgccagggguggaggaggcaaggugcagagggcacagcuugagaaggcgacacaaccagugacagcugugccaggguggucagcgcagacgcgcgcccaucgggguacgucagucuggaacccugcccccccccccgcccccagcaguguccacucugagaaccggagaaacggccgaccgccagggugcggcggcggggcugagaaccagucaggucgccucacagucgcgcaccugugaacgcuaggaguugcgaaccucgcaggcggggcccggccucuggaacgguggccgcgccgccgccuaaggucuccagccaucugacaggccgaaaacuggcggccgaacgcagcggggcgggcugaucgcagugaccccaaaggacaagguccuagacgccgaccccccaaccccaaucaggaccaggcccacucaccaggagcccagcgccgcgagcacgcucaaucaccgcgacugcggcagccgcuccgguuaacaacacuccccacccccugcgaaccggaacuucggggguaagacaccucacuuccggcggcgcggggcgcggcggaguggaccguaccaaguucucuuugcgcgcuccgaucucgccugcgcuucuggggcccgugcgcgagcaaccggaacgagcgagagcugugacguguggucgcgaccaggagagcagcgggaaagggcugaagcccgccacuugcuagucgccguuguagaaucaccacccuaaacuccuccaagacuccggcucucaaugugccuggaagauggggcguuccgcgggccgagccauuuggacggggggcaggagcgagcaagggccagacuuuaugucaggcaugaaagaaauaaaauguguaagcgccucauuccagggauagcuacgacacgguaagaaguuaagugcuucucggaaaaaaauagcggugcagaaaacagauauaggucuucccagguuaccuccccccaacgcagguuguguaggagugaguuuguucccguggcuaccgccgauugguugcgauaaaguuacgcggaccaaugaga

SEQ ID NO: 9095 - RNA, 1683 nt, Mus musculus
aagaagucuggacacaguggcuuuauuagcauggcaggguggcaauaggacuuaggaauuggcauuggggcccuucuucuucccaaaggugggcacaacauugacaaagcgccgguuguacugcauucgccucuuggcccggccugucuucuucuucuucuuuuccuguuuggccaccugaggaaaggaaggacugaucagacccugggugaccucucccaugccugcccaccagcuucucuccauaagagaacacagacgggaaauccaaaggccuucacuuggcugugauagaaagaaacaaaguccaaacaccaaucacucaccuugggagucugaccucucacuuuuccagcccgagccagggaaccgugaacuuuaccuguguuagggguggggaaagggaucagguuaaguagcaaggucacgcccagagcaacucuuccucccucaacucuugagcuuuuuaaugacaaguugggcccaacaaagaaugaaaguugcacaggcuuagagacagggucacaacauagcuguccacgucuugucuuccacuucaagucacaaccaguuugugcagugcugagagcugacagauacuaaggcaaggacucuaaaaaccaauccauacucuuagcuaacauucuacacacagagcaaagacaggaggagcacacugagaaccuaauaacaagacuuuaauuauuauuacuuuccuuuugcuuuuuuccuagacagagcuccucuguguagcccugguuggccuggaauucacagugauccgauugcgucacugccucccuaccaccagguuuuaguggggauacugaaaaccagacuuaacuaucacuacgaucuaaagucccuagaaggcacaaguauacuaucagagaaaggaccuaucacaugguuuaccuacagacauuccauuagcucugaaaaaaagcacucaccucccagcaugcggccugcuacuuccagaguggucagggccucuacgccacacuggccuaggguggccucauccuccagcggcgagccugccagaagcacgacuugaucuucgggggcaaugccuuccagggaggccacaugauccuuaaggaaaaaaaggagcaauguuuauaaguagacaaacuuuccccgugggccuggagguaaaggagugcaguuaggaaucagggaucaguacauacuuacuuugaucugggcgaccgucuccuggccggucaccucgaggguguguaguuccugggcgcggacaaagagcugcauguuggcuacugaaggaagaaaggcuugugagugaugauagggagcagcccaggagaaaggucgcgguacgguaaucaaggcgggggauugcgcggucucccaugcggaaggccaggcucgccggggacccggauggagacggagcgaaggccgcagaaccgcccuuguacuuugccuuccccgcacccucugagcccguagaccgcuggcuaccgagcgcuccuggcccagcagucccccgugucucaccuagcccgcggacgccgcugcugcuaccgcgaagauggagucaagaaagaggaagaagugggggcgcgcacguccucaccgccugcugcgugugacgucacugcagcgcgaccgcgcggaucgcuggugguuuguaccgcccaccgccgucccagcccg

SEQ ID NO: 9096 - RNA, 22126 nt, Mus musculus
gcgccgcacccggaagagacguggcagcggagggauaaucaggccggaccugaagggagcggagcugcagcuaccggaguuggugagcucaguccccggccuuccgcgcuuuucauuaccguacgcaccggucacgaucggcaucgcggagguucgcggacauccagaauguggucggccagcugggggcgggucaagagggggugggucuugggggcggggcuggugguauuggagcugugcagagaucuggcgagggccuuccugggucuugauggaaugaagggucggucguuugugguacgaucuguacaggagacguggcuuuacccaugcuaaggcauuaugcuagaauuugguguugggacuggugugagacgggacugagagauuuaaaagaagagaacuggguuggugaaaacaaacuggcagccaccaaaaccuggcuuccugcuaacugauuucaccccaccacacccuccaggaucggucaugggacuuugcaagugccccaagaggaaggugacgaaccuguucugcuucgaacaccgaguuaacgucugcgagcacugccuaguagccaaucacgccaagguggggcguuuagagcagugucugagcagggcgggugggugggcagacaagauugccuacuucuaaauccauguggggaccuaugcuagacuguaagcuccacaagggcaagaacauggggugugaugcgcucugcuaugccuucaguagcugcucaauaaauggucacucaauaaauggaacagaugaaaugaugagucugaugagagaaaacgaggcauuugagccuuggaguggugugugcaucguggagccuggggcaccaguugugacaucucucucccacuccagugcaucgugcaguccuacuugcaguggcuacaagauagugacuacaaccccaauugccgccugugcaacacaccccuggccagucgggagaccacccgucuuguuugcuauggugaggccugggaaggggucagggcagccccaggauccagcuuggauacagguuugauagcaucuuucaagaagcaagacagugagucccucaagcguggaggucagagccucagauccugauuccuuuagguaccguccuguuuuauaaagccucagcaagccuuuucucuucguaggccuuagaaucuucccugaaaguuagagcuucuccuuccugcucugccagucugggagagcuagagaugacuaugagcuguggcugggagaaagauccacuuuaggggauguuacugaccccgauacuguacccagaggaagcuauccauguuacaguuugcugggagucgguagucagagccuaguauaaaaaaaagccucagcuuagcuuguucaaggugcugguccaaaagggggcagcuccaccugaauuucuccaugugaaauuauguguccacucauacagauguauguguugguuaguacuugugggugaguagaugggugaugaguguuugugagcacauaucccaugggaugcaugaugacaugaagguggggaguguuaggggauauguguuacagauguguacauguaugacuacuaguguacuuugagggaauggcucucaaguuugcuuguguauuuauaagcacuguguauuugccucuggauaucugcauguaucagugucugggaagcuuuccugauaguguucuuguauguagguuuguuuuguuuuguuuuguuugagacugggauuguggggcugaccuugaaaucuuacuccugccuccaccucccaagugcuaggauuaggcacugccagccugaaacuauuguuguguagucauuagcccaaggagugugauuuuaggccagagaagacucuugaaaggguggaagguauuuucuuccuucccagucacaccuucucaugggcuggucacauggguagacucuaccuugcuuugguucaguggcauuugcaagaagccuuagggacccggaguagggagaaaaggaauggcccugggcaucagcacauauauccacaauccauuccugcagugagcugggccuuggggguaugggauugcuagaccaaggauaagagcucgaagacuugccucucucaugucuguccuuuuuuauuucaugggucccaagaucucuuucauugggccuguaucaaugaacgugcugcccagcuaccacgaaacacagcgccugcaggcuaccagugccccagcuguaauggccccaucuuccccccagccaaccucgcuggcccaguggcuucagcacugagagaaaagcuagccacagucaacugggcccgggcaggacugggccucccucuggugagagucucucugucugucugaccaucuguuugugcugaccucuccugaggcagauuggauggguuagcagcaggagugggcagacugcugacggagauuccuuucugcagaucgaugaggugauaagcccagagcccgagccccucaauuccucagacuucucugauugguccagcuuuaaugguaagugguggccuccaucugcugucugaaccuugccucccugcuccacugagagaucgcucuuuccacagccaccaccaccucugugcaagaggagagagccagcacuccaucugcgccugcuuucuauagccaggcuccccgcccuccucccuccccaagccgucccgagcagcacacagucauacacauggggaguacugaagcccuggcacacggugagcugggcaaucuucccagacagagaguagaaagcaguggcugguuuggguggcaugagcucagagccccuuauggggugguucuuccucacuccaagguccugaggugcucuguuaggcuggggagggcaggagguccuuuaugccaccuccacccaugccacaggaucaguuugucugagccuguuguugcugguguuucugucucuacagccccaaggaaaguauaugacacacgggaugaugaccggacagcaggcauucauggagacugugaugaugacaaauaccgccgccggccugcucugggcuggcuggcccagcugcucagguacacagagacacaagggugggaucucagaaaggagaggcccacgauggauaauuugaugacaguggaacuuguucuggggccuaacaaacacucaguaccagggcuaaagugaggcccuggcucgacaggcggcucuaguguguuguguccuucccagggacucugccuuuuccuccuauaggcgguguggacuuggguucugaggccccuuccugcugugguggcuuuucuuuucuuucuuuuuuauuuauuuauuuauuuauuuuuuuuuuuuuuuugguuuuucgagacaggguuucucuauguagccugacuguccuggaacucacucuguagaccaggcuggccucgaacugggaaauucaccugccucugucucccaagugcugggauuaaaagcgugugccaccaccccaggcuucaccuggcuuuucuaagcgucucccauguuuaacauauucaggcuuccagcaugguuugugucccacuaacucaagcuucauaacccaauaugauggcgaggacaggcgcacagggugaccagccccaguccacaaggguaggacccagaguagcccacaagaguagggacccagggccugaccugacuuuucucucauuccucuuaggagccgggcugggucccggaagcggccacugacucugcuccagcgggcagggcugcugcuccuguuggggcugcugggcuuccuggcacuccucgcccucaugucucggcucggccgggcugcagcagacagugaucccaaucuggacccgcucaugaacccucacauccguguagguccuuccugagcccuugcuuguguuugggccagcuuaggaccuggaguccuggggagagaagguggggaggcuugaggccuuucucuacuccucucccucaguccugagacacuaagauccccugggccaagucaguuggaggcugaggcugcaaggccagguguguagcccuuuugaucaaauuggucuucaccugcuugccucugaggcuccauccuucuacuucaacccucagaggagcagacaggugcaaauaaacaacagacuuuauuaaaccuucugaagcagcuuuuuccaucucccgucuuaguccuguccccaauccccaggccucagugucucuccucucgguaauugauggccagaaacuccaggcacaggcgguugaagaacauggcuccauugaggacuggguagaggagacaauccaucaucagcucaacauuuuuguccccuccuugccaugucucggggucucaaagcucccccuccugguagcacaccuccccacucacucagaauggucaaagcaaagcaucuaagaaacuugucaccggucaucucugcguagagugaccccauggcagcccagccgaugcugaucaccugggagaacugggagaccaauccaaugggagaguggccccaugacauaacaaacacucccaucagccccaugauuuuuccccagccagcccuugagccccaccccagaccuacuaucaguacaaccguguaacggaagcucauguggucguaguuguggaugacacagaaguugugaacaucacuagcaaagacacccauguguaugaagaagaguauaagugcggcuacagugagcaucagucccggagggaagcauaacacagcuaugcggucccgccaccgcauccuggucacagccugcucucaagucagagccagaaacuggggcaaguggucaccguccagagccaacaaaauccugccaugcucggguguucuguuggaaacagcaguguauuccagagugaggaaggcauuggagagggcaagguucuagaauguagccugauuccaacaaacagaaugugucuggggauugaggcuguucauuguggaaggauggucaaaaugugcugaguggcaggagccugugguggaaggaagggauagcagcccacgccauucaauccucuacacugugggcagcucaguauucccucggguuauugaacagggaacaggcucaggaagguggaagggcaugucccagcuccacaaacaagguuuaggcagaugauuaaggccuagaugaauagccaaaggcuuuuccaagcaaaggaaggcuuuggccacauccuaggcucuaauugaagcacuagacuuaacacaacauguuaccacaaacuucaaugagcagagucuggaaauuaaucuaaauuuuccuuuucuuuagauaguauucugggaugacuacagaguaauucccccaaugccagcgccuucccccucucaguucuggccaccagauuuccuaggaaaccagaaacagcagaaacuuguuuucccuccagucaggucgccagccuugucuaagcucugugguguuaguggugcuugucgccgggguucugugcacguccuuucugucucucugcagugcuaguugguauacucccaaggcccaaguaucuuuauagcaugaaagauaaauaggguuuucaagaucacauuuaacuaguacuaauuaaccuaggguugguuuuguuugagauaaggucucauuaggcagcccuggaacucauuuuuguagacaaggcuggccucgaacucacagagauuuaccugccuggaucaaaggauugugccacuaugcccagccucauuuauuuuagugugggugaagugaagagugugugcauugccacaaugcauauaugauggucagaggacaacuuucaggaauccacucuugacugcuaagccgucucuccagcccuuuuguuuauucagcuuuugggagaguuuuuacauagcccaggcugcuucaaacuuacaaggaugaccgugaccuucuccugaucacuugccuggcccacaauguucuaggcaggugcacaucaguacaccuggguuuuauuuucauuuugauuuuuuuuccuguauggaugaguauuuugccugcaugcacauguauuccugcuccccauggagaccaaaaagauacuggaucccccccccccccaggguguuacagacaguugugagcuuggggauugaaccugggucaucaggaagagcagcaagugaaaccaucucuccagcucaaauucacuuucuuaaagcuucgugggcugagauccucagauguacaguuucuaaauagcccccuggauaagaaggcaagaaaauguuuugguccaagacaagugaauacaugaucccuuuagucugugacaagagcaaccaugcaugucaggcugagaagcaggcuguggacaugguagcacagacuuuuagucccagcacucaggaagcagagguggcuggaucucugaguuugaggccagccuggucuacaauaaugaguuucaggucagccaaaguuagagugagaugaugccucaaagaggaagaaagagagagaaaagaaaggaaggguuugagcuggcacagggugaacugcucuugcacuuugguuuccagcaucaugacggguagcucacacaugagcuguaacuacagcucugaguuauccccuggucucugcacacauaaauacacauauaauacugggggccggacagauggcgauuuaauaccauucagaacuguuuuuagcuaggcaguggagcuggugacaguguuaucacaugccuuuagucucaacacuugggaggcagacagguucuacacuaggaccaguuccaggacagucagggcuaagcagagaaaccgucuugaaaaaaauaaaaauaaaaaguauaccauuuagauuuuuuuuuaacuccuaauuuucagauaaaaacaguguuuggucugcugaaacuccuggcagcccagcacccuaucagcccauccucgguaacguuuacaguacaucauuaguaaagucucauuuucuucuauuuaacuccacauauaaucugaccucauccccucuuaagagcuucgucuuuuuuuuuuuuuuuuuuuuuuuuuuuuuugagacaggguuucucuguguagcccuggcuguccuggaacucauggaacucacucuguagaccaggcuggcuggccucgaacucagaaauucaccugccucugccucccaagugcugggauuaaaggugugcgccacuacgcccugcugagagcuucguuuuaugccuacaucuuuaaaacuuccgaauuauccucaaucccaacugcucacguaucacauuucacuaacuucuuaagauuaacaucuuaaauucucuaaguagaauaaaguuucucauauugaaugacuccuuggagacagaaccuugggaaacacugcguuaaagccauauugcaggcuacuaaauggacguuugaaccuugcagacccccccugugacgcauauucgaucuucugcaagucucuuuccugugcggaugcaggauugggacgccacgauucacccaaguagcacagcaaaaucacagaaacucaacgauccagaaguucagugaaaccucugugcuccagaaggacaagcgcaagacggaacuuuagucucacauauccuacagcugcagaggaacguuucaccugaaggaccgccugguuguagcaaguuucugguccccggaagugcaucuguucccuccccugccucaccccuuugaguugagguuggagcuauggcggcugcggcagcuguggggccuggccuaggguccgggccuggagacuccccagaaggucccgaggcggacgcuccggagcgucggcggaaggcucacgggaugcugaagcuuuacuacggccucucggagggggagguggcggggcaucccgcagggccugacccucuggacccaaccgaucucaauggggcgcacuucgacccggaaguuuaucuugacaaggugugugugugaaauggggcggguccagaccccaaauaucuuggacccuagaucuuacucccgauuugguugcuguggugacggcagcgggguuuauaagaggacagcccuuacuaggcaauagaggcagaucuggaggccaagggagccugggccugacuugaggucacacugggucugaggucucggugcuggcucgugguagugggugugaccaugcucuugacaggcgcuaggcagggccuagguugacuuuaaacuaagccagaagaccaugaacgcugacaaaucccaaauugggucuaaccugugaagugugcuacuuaaagugugccacuuauggaauuccugauaagggugggauuggaguugucuugcacugaaauccaacuaacguaaagcaggguagcaggacgugagugagcacuaacgcugacuguuccuaccugcuucucuagcugcguagagaauguccucuggcccagcugauggacagugagacggacaugguacggcagauccgggcucuagacagcgacaugcagacccuggucuaugagaacuacaacaaguucaucucagcuacaggugaccccacugggacacacuccucagucuuacaccacccccaccagguccucaccccguguuaagaaaaacagggauuaaaggaaagagacccagauuacaauugggucccaaccuuaauccacugcugcugaagugaugacuccugugggggugggguuuguccaaaggaccagcgcugggaaggaagaaugaaaugcagugaguuucucugcagcacuuaggaagcaccagcguuucaguaagcuuuagcuuuguuuguuuauuuauauugugcacaugcauaugugugggacacaacauuugugugggggucagaagacaacuuucaggagucuguauucuccuuccaccaugagggugccagggauugaagucagguuaucaggcuuggugacaaacacauuugccugcuacuaagccaucucaaagucaauuaaaauuuuuguuaaaaauguuauuagugguaacuuuuguuucuggucagucugccuucagagcagauuugccacucucucccccucugucuguauccucauuccuuaagauuuacuaauaguuuuuggguccaggagucaccccacaaaccacaugaacaccaaucucagucacauaggcacgguuauugagugcacaccccaagacuaauugauuagggcaacagcucacagauucgggagcugacagccacauaccuguacacuguccggggucagacuuuauaaggaaaaagccauaaugagcucauaagcagauacagggugggcugcagggugggcagccuuuuuucaaguguguuaguaguuuagacauucuggucaaacuaaccccuugucuagcuuggcucugaguaaaggccaugguuggggaaucuaccuuggcuuugccugaaggccacagcuggggaauuuccaaggcaaguaauaagccucuccauucgauauauggccagcccgacuucagucugagcagacuauuuuacugugucugcugcuuuuugugucagcaguaugggauggcuggcaggccugaagcaaauggcuauaggcaugccaaggaccagggcagggaagcaggcagcagcagcagaaauuaauuauguguguguggggugggguagggguggauauguacagguauccacagaucccccagagcugaaguuagagucaguugugagccuacugacacggaugcuggggauuaaaucaggucuucuacaagagcaguacacucucagcugucuucuacaagagcaguacacucucagcuguugagccaucucgccagucccacuacuagauaguucagcucuccucacacuaccuaccaucugucugccuuucaggcgaugcacuugauguuuguauaguaaccuuaaaccacauguccaggaggcagaccauagugaauguucacaucugugggguuguaucuucauggggcagugcucugccagauguucacaucugugggguuaugucuucacggggcacagugcucugccagugccuuggugguggcugugguacauccuugcuguucuuuuaucucauuugaaccugauucagugaguaagugcuggucuguuaaugcuagcuucaagauggaaaaaagagagugauuucuuuguagaggaauuuuccauaggaauuuugccaguauuacacguucucauuuguuggaauauauauaguauuugacauguauuuguuauguaauauagauggcuugaauuguuuuguacuuuuuucuaaggagcaaaucauaaaguggguguuaggagagcugagguugcugaccugcaagcacuacagaguuuuacguuuacucaagaauaugcuggcacuggccauagaugccuguacuucagaggccaagcaaggaaggcugccaugagcuugagaccagccugggcugcaugagaccagccugggcugcaugagaccagccugggcugcaugagaccagccugggcggcauagcaguaaauuugacauagcagaagaucugggugugguagcacaugcuuuaaucccagcagucagagugaguucuaggccaguccagucuacaaagggaggacagcuggggcuacacggagaaaccuugacucaaaaacacaaacaaauaacucccuccccaaaaaaagaaagaaaaagggagcagaagaaagaguagaaugagcaaacguaaagaugggccacuugagcuuguccagugugaagggaaggaagugaaagggaaagcggaacaaacuggguaaugaaacacacauaaucccaacagcggagaggcagaggcagacaagagacugugucgcaaaacucagcuaauagguuauguguacauaugugccagaaugugggcuggggguguacuuuaauagcaaaaugcuccuucagcaugcagaaacuggguuaggucccugcuuuugcaguuucagaaacccagcuuggauggcucagcagguugugcuuguugugaguucagucccugggacccaugugguagaacgagaaaaccaacucccuuacguuguccucugaccuccaugugaguaacaugacaugaauaggugcugacaugcacacagcacccuacccaaugaguaaacuaucauugaaaugaaaaauaagcucauguaaagauguccugccucacugauuaggaagauaggacgucucugcacacccaguaggauugccauaacuacguaacauguugguugggauguggaggauacauaaccugaugaaguagcagugggaacacagagcugugucucuccugcagaaaagcuuugcuagccgucaaaaggcuaaacggaauuaucuccagagcagcaauuucacuccugguaauaugacauuacuauuauauaauaugauaaugauuauauauauguguguguguguguguguguguguguguguguguguguguauuguguauaagcaagcagcuccuguaaucccuucauguuagaaacaaaggcagggggauugcuguaauuucaacacuagccuagcgcauuuaucucaaauccuacacaaacaaacaaagaacaaagggugcuggggaggcucggugagcgaggugcuugcugugcaaaccugagaccugaguucagauucucaacaccuaugugaaaaagaaaagcacuccagaggcagagaucuuucugaguuugaggccagcauggucuauauggugaauucuaagucagccagggaaacauaaugagaaccugucuccaacaaacaaacagaaaaaaguguggcaguacacaugugaaacuccagucugugaagggaacagguuuaucccugggcuuccuggaugaccagccagcugaggugaaauggcaagaucuaggucauugagagaccccgucugucaaaagcaagcuggggaaggaaggcuggagagaugcuacaggagucugcucuaucaacagacugcauuucagauccuaggcagcccgcagaugccugucccucugucuuacagggaucggucucuccaucuggccucuggccaccugcacacauaugugcacacaaacacacacagacaaaagaggaugacaccuuuccucagcuucugccuuccacguguguaugcguggugaggacaucccacucggaugugcauagaucauguacucugcgugccucuauguacucacauguauacacacacaaauuaaaaaacaaaacacagccgggcgugguggcacacgccuuuaaucccagcacuugggaggcagaggcaggcggauuucugaguucgagaccagccuggucuacaaagugaguuccaggacagccagggcuauacagaaaaauccugucucgaaaaaccaacaaaaaccaaaaaacuaaaaaaacaaacaaaacacugaaaacauguucauaccgaacuucauacacaauuuuuguagccaaaaaguagaagcaauccaaauagcugucaacuguauaaguggauaaauaaaugaugugacccaacaauaguguuacuuaggccuaaaacagugagacagacugaguuuagcagaagauggcaggcaggacugagugugguggagcaugccuuuaacccuagcacgcaggaagcagaggcggggguuuugagccagucagagcuucauagugagaugcuauuucaaaaagaaaaaaggagaaaaugaauguguuguauugaucuaccuaccuuccuuccuuccuuccuuccuuccuuccuuccuuccuuuuugagacaguuuuuccuggaacucacucuuuagaccaggccggccaccacgcccagcuuuuuugguuuuucaagacaggguuucucuguguagcccuggcuguccuggaacucacucuguagaccucgaacucagaaauccgccugccucugccucccaagugcugggauuaaaggcuugcaccaccacugcccagcacuuucccuccaaucucacccuccagucucacccucuucccuccacaccagggacacggguacucagggcuugcugcaccaacauaaacaucuuaugugccaaggccccgcccauuucagucacaucauugguaucagugagaguuguaccucugccuuagucguuuccauuucccucgcucaacucuugcccaucuagacaccauucgaaagaugaagaaugacuuccggaagauggaagaugagauggaccggcuggccaccaacauggcagugaucaccaacuucagcgcacggaucagcgccacgcuacaggaccgacacgagcgcaucaccaagcuagcagguaggcucugugcuggccaggcccugcagccagccacccugagcucugcagcucacgugcccuuccugucuccuagggguacaugcacuacugcggaagcugcaguuccuuuuugagcugccuucgcgccucaccaaguguguggagcugggugccuaugggcaggcagugcgcuaucagggucgugccagggccgugcugcagcaguaccagcaccugcccuccuuccgugccauacaggaugacugccaggucaucacagcucgcuuggcccagcagcugcggcagcgcuucaggugugguuuccgggccuggucauuguucuccaaacacaucgagugccccccacauuuuuuccucccuugcagcccacaagcuguccucacugcaucucugucacuacagggaaggcugcucaggugccccggagcaggccgaguguguggagcugcugcuggcccugggcgagccagcugaggagcugugcgaggaguuccuggcgcaugcgcggggacggcuggaggaagaacugagcagccuggaggccgaacuggggcccuccccuccagcaccugauguguuagaguucaccgaccgugguggcaaugguuuuguagguggccucugccagguggcagcagccuaccaagagcuguuugcugcucagggcccugcuggugcggagaagcuggcagccuuugcgcaggagcugggcggccgcuacuuugcacugguugagcggcggcuggcacaggagcagggugguagugacaacucacugcuggugcgggcacuagaucgcuuccaccggcgccugcgagcaccuggggcccugcuggccgcugcugggcuuucagagucagccacagagauuguggagcgaguggcccgggagcgccugagccaccaucugcagggucugaaggcugccuuccugagcucccugacggauguucgccaggcccuggcagcaccucgccuagcggggaaggagggccccagccuggcugaguugcuggccaauguggccagcuccauccuaagccacaucaagacgucacuggcuucugugcaucucuuuaccgccaaggagguguccuucuccaauaagcccuacuucaggguaugcuguccuuuggcuuugcuuauucguucugcugacuggcccuccagcagccuuuuacuaguguuuggggagcccugggacaugucaccagccccacacaauacugucucaaguacucugcguguggagucacauucucaggaggcagucuggaggagaaaaugcuaugcagccgggcuaaagcuagaaggguaccagggaccucacugcugccagccuuaccaccgaggcucggaagcagggugggguggccuguggaggaggguuaaggcaaagagggaggaauagcccugugcucugacuuugcugagccucuccauccuaugagaaaggacgugguaaaucugggcuucccuucacagggcgaguucugcagccagggaguucgugagggccucaucguggguuucauccgcuccaugugccagacagcccagagcuucugugacagcccuggagaaaagggaggugccacgccgccugcccugcuccugcugcucucucgccucugccuggauuaugagacagccaccaucuccuacauccucacacucacugaugaacaguuucuggugcaggugaaguggcucaggagaggggaaagggcaugaugcugucaacacaggaaccagacugguggucugcacucaucucagccucaguuucccaagauuugcucaccuccucauugguggugguuucuggucugucucuaauaccugcaaccuuuguccucugcuuuugugacuuaggaccagucucccguuacacccgugagcacacugugugcagaggccagagagacagcacggcggcugcugacucacuaugugaaggugcaaggccuggucauaucccagaugcuacguaagaguguggagacccgggacuggcucaguacucuggagccuaggaacgugcgugcugucaugaagcgugugguggaggacacuacagcuauugauguccaggugcugccacaggccggcugcuggaaccccaaugcaugcuggauuccaaggaccaagacaaaaggggucuggcuguacccaugucgugccacuagaagccucauuucauaccugugggaugugcaggcccaaagucacccaaaaagcugaagcagggaugagcuaaaaacuggguuucagacuagguuuucccugccuugcucccacuccccugauuguguagguggugaccauaccuaggauucuucaaccagcagagaggggagguuuugucaguaaccaugcucugaccuugcagcgcaucuuuucucccccagguggggcuccuguaugaagaggguguccggaaggcccagagcagugacucaagcaaaaggacuuucucuguguacagcagcucccggcagcagggccgcuaugcacccagcuacacacccaggucaggcugcuaggagccucccugagagacagaagagggaggcugggcagaguggccucucacucuuucuuucccccuuccagugcucccauggacacaaaccuccugagcaauauucagaagcuguucucugaacggaucgauguguucagccccguggaauucaacaaggucugaaguaccuucuccucuacaucccaggggaaggguggcucccacacuaacccagagagcccuaggaccacaucugagcagaauuaaagaucacuuuacguaaucucugucucuagguccagagcaaaaccaccuuguccacacuuuacucuccaaacuagucuuuagucaucggggguucccacucauaucuugaucucugccccuccgaagcccaagcucagcaauaucuuuccuccauuuuacuuuguagucaguggugacugcugcccaucguauucaugaggccccaucucugaucugaccaccgggguuuaccugcccucgccuuuaugguggcaacauugcauuguucccuucuuagcugagcccuagaaauuucugucuuuaucucccuugccucugcucagaauuuggauguauccuccuccccaaaagacggcaauccugagcugcaucccuguguccaccugcaggugucggugcugacuggcaucauuaagaucagcuugaagacacuacuggagugugugcgccuacgcaccuuugggcgcuuugggcugcagcaggugcagguggacugccacuuccugcagcuuuacuuguggcgcuuuguggcugaugaggagcuagugcaccugcugcuggacgaaguaguagccucagcugcucugcgcugucccgacccagugcccauggaaccuaguguugucgaggucaucugcgagcgcggcuagaaucugccaacgagucgcguaguagcccuaucgcccuguccucccugugcccuguucucauccuagaggcccuuccccgcuggcggguucauggauccuucuaauaaacuuauguguccuccuccuuccucuugccugcaggggcgggacccgcccggguuggguuucagugccgaagcuucugaggcgccagcauggggcccgccucccagcgcugauuggcuacugugcugggcccagggugggcagagggcgcguccauuuaaagaucaaugaacaagagcagcagcuuuuccaccuccgugucugaugcagagccauaacccggcauggggcgguuuguguuuccuugaucgacuuuugugaaccauuguuccccggcaaagcagagaucaugacuucucgugaggccucccaggccccacuggaauucggggggccguuggguaaaugggaagguuugggguggaggcugaccugaugccacuuaacgggagcaggauaggauacgagcucuauagaaggcucggagcagaaggauccggugcgcgggugucggggugucugcagaagaggagggagugcugacagcagcacagcggggaguuuguguaaugaaagacaguugggagagcaggauggucuuugggaaugccagagggcagaggaacaagaugaaaauuaagauaggaguauggcgcugggaaacugcuaagcaggcaggugacucaaggcgcccgaggacuugagagagcucuugggagcagucacgcuacacaguggcccucuuuccaggcgucgcggcuuuacugauccugcugccugccaccauguuccaccugcuccuggcggcucgcucgggcccggcgcgccuccuggcccuaccggccuaucugccugggcuggaggagcuguggagcccaugggcucugcugcuauuguucaucuggcucggccugcagguggcgcucuauuugcugccugcacgcaaggugugugaucuguuuuaacacaccagggaggagggugcagggagggcuggagccugggaagucauccccagcucuuauaaaaccugcccuguacccgcagguggccgaaggccuggaacugaaggacaagagucgccugcgcuacccuauuaauggugacugggguuccccccccucccugaaucgcaguuaacauggguugggguggguuccaaggguggugggagguuuauggaccagcucugaugacauguuugugcccuuaugggaaccucgccgugcaucuaccucuuuugcuacuacucagcuccaggccaauggccaauguucucccagaacugcguguguguguguguguguguguguguguguguguuggcuuuggaaguaugcaagccaccccagggcucacucugugcugugguucaggcuuccaggcucuggugcuaacagcccuguugauggggcugggggugucaguggggcugccccugggggcacucccuggaaugcuccugcccuuggccuuugcgaccacucucaccagcuuuaucuucagccuccuccucuaugcgaaggcuuugguagcuccugccucagcccuggcuccugggggaaacucaggugagaagggucccagugagguagggaugagguaggugggaugcaugcauaccuggugugccuucaccuucuguuguuccccaggaaauuccauguaugacuucuuucuuggacgggagcugaacccucgccucgguuccuuugacuucaaauauuucugugagcugagaccuggccucauuggcuggguaugcugacaugcuggacuuaauucugcuggacuugggccaggagaagagcagagugggcuagcauugcugggugggcagcaaucauucauucauucauuugccaauauguugcuguguuaugaaccuaugguuuugcuuuaauagaacaagaggguuuuuaauauaaaaucuugagagagagagagagagagcgcgcgcauuuggcuuauguacauaaagcccuagauuccaacccuagcaccacaaaacuaaaucuauaccacagugaugacaggcuguaugggggagcaaagcaggcagcgagcugggaaagcaggugcagcuucggauguagcggccaaauauaaaaucaacuucaaagacagcuaaggagaagcuugaaggaccaggcaacugccuccagggauugucagauuuaacaccuuguuugucauugguggccuugacaacaggccagcuguucuuguguuaagaucacauguacaugggguacaugggugguggccaagagcuccaaaggggcucaggcaagguccugccuucacuguagaggcaggagugcccauguccacugaaucugaguuuggauuugguuuaguuuugaaacaggucucacucggauaguccagacuagucucaaaaucaagguuccuucuacuucccucagcuaaucaaguaacuaggauuacaguuacuacaaucccaccaggccuagucccaacauuaaucggagacuggccugucaacauauaugccagaauauaagguuauuuucucacucauaaaacaggauugaaugaaauuuucuucuacaauuuccugugagggcuggguguaguagggcaugccuuugaucccagcacuccagaggcaauagcaggcagaucucugugaguucaaggccagccuggucuauaugguuccaaaucaaccaaagcuacuuagugaaacucucucucucucucucucucucucucucucucacucucucucucaagaaaauaccacaucaguauuacugaagaaacuacacuauucaggccacuggagcuacuagaaagagagucuaaagccaggcagugguggugcacacccuuaauccagcacuuuggcagagacagguggaucucugaguucgaagcuagccuggucuacagaaaaaguuucaggacagcgagggauacacaaagaaacccugacuuauuuauauuuuuuaaagauguauuugauuuauaugaguacacuguagcuguuuccagacacaccagaagagggcaucagaucucuuuacagaugguugugagccaccaugugguuacugggaauugagcucaugaucuuuggaagagcagucagugcucuuauccacugagccaucucuccagcccaccccuuuuaaaaaaauauuuauuuauuuauuaaaguacacuguagcuaucuuuagacacucuagaagagggcgacagaacuuguuauggaugguugugaaccaccaugugguugcugggaauuaaacucaugaccuuuggaagaggucaucucuccagccccaaacucugacuuauaaagaagaugacaaaaaggaggaggaggaggggggccaggugguggugucgcacgccuuuaaucccagcacuugggaggcagagacagguggauuucugaguucgaggccagccuggucuacaaagugaguuccaggacagccaagacuauacagagaaacccugucucggaaaaaaaaaaaaaaaaaaaagggaggaggaggaggaagaggguacaaaauuuagguucauaauaagccaauucuuagcucuacaaacauauuaguguuccaacaagaacucaaggcggggcccugauuacuccuguuuccauauggcaguggggacgugaguuuuagcaaagagacauauucugcccaagugauaaagcucagauuccaaggcaggaguuuuaagucaaggcagagucgcaauccagugugucucgaguacacgaccuggauccauucaacaugugagcgggcagcuggaaggagggcgaggucggcacuguucuacccagaugcuccacuucagacaauggcccuguccucacuuccuuuagguuuucauuaaccuggcccugcugaugcaggaggcagagcuucgggggaguccuucccuggcuauguggcuggucaauggcuuccaguugcuguaugugggugaugcccucugguaugaggugagacuggauuggagagcaagaggcaagcaggggaucuugaggaugucaucuggacuaagccaguaucugggucauguuccugcaggagucuguccucaccaccauggacauaauacaugaugguuuuggcuucaugcuggucuuuggagaucuagcuuggguaccauucaccuacagccugcaggcccaguuccuguuguaccauccacagccucugggguugcccauggccuugcucaucugccuccuuaagggucaguaggagggcccuucauuuccccuuccccuucuauucaugcuuuauucaguaccccucagguagggccuaggcucugacgcuucucuaaagcuggaagccagcuccuggguaucauagcagagccugggauuuggacaggcuuuggucaggguuaggcaaaaggcugggacuccuaccucaccaccugcucguaccguaccuucccucaguuauugguuacuacaucuuccgaggggccaacucccagaaaaacacauucaggaagaauccuucugaccccagcguggcugguaagcugggucucuuagagguuaugggugagaugaaccaggaaggcucugugguuccguuucauuagcuguauuucuaggucuugagaccaucccgacugccacggggaggcagcugcuggugucuggguggugggguaugguucgacaccccaacuaccugggagaucucaucauggcucuggcauggucuuugcccuguggugaguggguuuuggaguaggucggugugccuggugggaggacugacuaaucaguuaauggagguggacacaaaaccuaugacccgacacccugugugccaucagcugugaaagcuuuuauaugaaaugggugcuagugccugaucaugcagccccuucccaccagggcuaucccaugggucccuucccuccagggcuaucccaugggucccuucccuccagggcuaucccaugggucccuucccuccagggcuaucccaucugcugcccuacuucuacguccucuacuucacugcacugcuggugcaccgcgaggccagagaugagcagcagugccuccaaaaguauggccgugccuggcaggaguacugcaagcgugugccuuaccgaaucauacccuaugucuacugaagcagguccaccuaagagguugaaagcaagaggaagccacugcuuccagaaggaaaguauuuuucccuguugaauaaauguuuucaaccuuuc

SEQ ID NO: 9097 - RNA, 6799 nt, Mus musculus
ugccuuuugcuagcuagacguaaagccugugacaacaaaagcggaugguccgccuccggccugugucacuuccgcuuucucgcuagcaaggcgggcaauuugaacguuugaagcagcaaaguucccgguuggcgcgagccugaguaggcgaccgcggcggagacugagcccgaccguacacauggcggagcggcgaacacgaucaggaggggcugcccagcggucuggugagcacgggagcaguggagcgggguuguuuggggaacaaaacuuggcucccgguggaagacgccccaaagggguaguuggaaaacgacuuuugcuuuuccgaacucgucaagcaucuuguuucguuuguuugucgccuuuucuucgagcaaaguuuugcucaccaucaaacguguuuuccuuuccagggcccaggacuucacuuacuaagccuucgaagucguccaagcggaaaucuggcucagaucucccgaacucguucucugaaaucuggccgagggugaguuccuggucccccagguguugggguuggguuugugcgcugcguauucagaugcuaauuucuaugccuagguauccuuaguccggcuaacuagcaccuccgggcucacuguuguuuuuuuuuuuuuaaaucaucucugauugguugauaaagagcugaucagccuauggcugggcaggagaggacagaggaggcgggacaucagcgcccauugaggcguccggaagagucuagggagagagaagugggagagggggaggcgcggagagagcaggugguuucacucuaaggucaagaggagggagagagcagucaugagggcacacauggaccagauugagucagaguaagacugagauucagguagaggaccgugugacugguagauaggcagccugagaggguuagaguagcucagaaccugcccaacauagugccagcagccuuugaauaacagcucuguguccuuuacucaggagguaguggcguuggggggaagaaaugcccugcaguuauuugggagcaagggagucaaaaaacucccgcccaaugcuuccacaguuggugcccaacauggugcaagaacuuacaaacuuagaaccaggcuuagaggcugagaagucuuggauagaagauaaggaaaacuuuucucagcaacacccccaaaguacuuuuuuuuuuuuuccucgagacaacguuucucuguauagcccuggcuguccuggaacucacuuacuuaguagaccuggccggcuucgaacucaaagauccaccuuccucugccucccaagugcugggauuaaaggcgugcaccaccacugcccggcucccaaaguacuuuuacacugaccuagagggcuuugaacuauuguaaagcucauggauaauacuuucuuuuaccccccccagacaacuccagcggucccagucagaaaggccaucgucuugaagaagaucguagcucaugcaguagaggugaggggcugagagaaggcuuugggagugagaugucaaaacugggcuuagcuauugauugaucaguugaugucaucccuacaggucccagauguccacacgguucgaagaaguccuagggugaguucaguucuguuuauuucuguuuauuuguguaggauuuacccuuagaggguaggcauacacuucuacccaggcaacugcuucauggcuugucaguuuaggucucaguguauaacacuguuuccugaacuggaaguuacgguagaccagacuggccucaaauucauagagauccaccugcaccagucucugcagauagauucaaaucuuagagaugggcaugcuaccaggacugacuguaguuaccagucuuguuuccugccuaugggugucauucauuucuuuuuuuuuuuggguuuuuuuguuuuguuuuguuuuguuccccagagcugaaaaccacugagcuaaauccccaaccccaaccccucauuucuaguucuuuaugcucugaacauucucacuauuuuucuuaaaaaguuaugguuuaaccacugggcuucuguagacuguuuugccacuguuuuguugugauguugugauggcgcacgccuuuagucgcaagauuugggaggcagaggcaggcggaucucggaguuuuaggccagccugguccacagagugauaagguuguuuugcugaguguuuauuuauguuuuguuuguuuguuuguuuguuuuaugguuauagaaugaguuauguguaggggcuggaaagaugguucuggguaaaagcaguuuucagauuccaucagauggacccuacacaccuacagcuucaguuugagaguauccaacgcccucuuccggacacaugcauacgcaguguaaaaggugcugggugcuggugcacaccuuuaauuccagcacucagaaggcagaggcaaguggaucucuuuugacuuauaggcuagcuuggucuacagagugaguuccaagacagccaggguuaccuguggccaagccuggcccugaauuuaguaugugcguaaagcugguuuugaauuccugauuuuucaaucucccaaguguacccaguggugcuuugcucucugaccaggguuguguugcuggcuggcuuugguacucuuccugccugguauuucucaguguccugggaauugcagacgugaggcaaauugccaguuugauuuguuauucugauguguguggugcuggagaucuaucccagggcaguacuaagcagguacccugcuguugagauaaucccagccaucuugugaugguggagguggguuuucaaguccuagaacuugcuuugaagaccaggcaggccucaaacucaccgagauucaacccccacccuagugcuaggguuaaaggcaugcacuaccccaccuagcuucccaaccagcuuuuaaccaaaguacugacauaauaaagccgaaguauuguagaaagguuucucugugaaugacgucauuggaguccuaggaccaaugaggagaguuaagauggugaaggcccaacuaagauggugguggccccggugugguggcgcacgccuaaaaucccagcacucgggaggcagaggcaggcggauuucugaguucaaggccagccuggucuacaaagugagcuccgggacagccagggcuauacagagaaacccugucucgaaaaaacaacaacaacaaaacaacaacaacaaaaaaaagaacacagugaggaacacucggggucagaagacagaaucagcugggugguggcagugguggugcacaccuuuauuccugcacuuggggggcagaggcagaaggaucucugaguugcaggccagccagggcugcagaacaaaauucuccagagcuuauggccaggaaaucucugaugacuuccuuguauuagagcacagugccccucccugaguuuguccuuugacgaguuuacuaggucuucagcucuugaaaaguaguugccauguuucacguccacucugagccugcagugugcagggcucugcuggacgugugggcuuugacagugaucaggcgguguccugacccucagcucaccugucuggaugggugaaugacguaacagaccaacugcagacagcuagagugugguccuagguaaaagacagcguugggaugguaggguugcagaggggcugggcugcgcugggcugggcuggaucucagguauggagagccucccuggggaggagcugugugaccugaguggggugugaagaaccaguaccuuagccucaagugcauaugucagguuaagcuuuugcucuugacagcugugccauggcuccacuggccgugggucaaagcccuucugauggccguguacauggaggugguagugugguggacuguaauacacagggcgguagcucuguucuagcuucgccugcagucucuggaucaucacuuccugaccucagccacucuggcccauuuuguuccuugacccugacugaaacaccugucuucaaggcuuuuguauuggcucaccccccgcuccgccccgcccaacccagaacgcaguuacucuagauguccacacagcucagcuccacgccuucacaccacagcucgugucuccuccucagugagacuacaaucccaaccugccccaaguuuuguucuacagccagcaacuccgagccuucugccucugccccccacguacagggauaaaggugugcgccaccacugccaccacccagcggauucugcccucugaccccagugcuccuugcuguguuccuuuuuaaaaaaaaauaauuucuuuuuaaagauuuauuuaugugaguuagcugucuucagacacaccagaagagggcaucagaugguugugagccaccaugugguugcugggauuugaacucuggaccucuggaagagcagucagugcucuuaacugcugagccacgucuucaguccccucauuauguucuugucgcuacaacgggagggagcacugaagugccacuagguggcuuuuuguuucccuugauguauuugcaguacccaaaacagucccugguauaggacaggucaccaauagauacuuggccaaaugaacaguuuugaaaaaucucuagcaguuacauagcagauggcccauaaagggugagccuggauacaggcaaaguaauuaggaggcuaucaagccaguuuagaccugcugagauuuuacaucagcuaacaggugguagcuauauaccagacacaucuggugguagcagcagcagauauaaucaucacaaguguaacuccucucucucuuccugacagugggcaugggaugcagggcucgugcauugugggccuguguucaauggcugcgcuuguugcuuaaaaucuaucauggccuggggauggagcugcacucacagcacaguguuugcugaacuuggacaagguccugcacuccagcccuacaacaugaaguacaaagcaacaguagaaacuccguguguccuguaggcagucuuuccauccugaaccccucgcucacgagacuucucuccuguccugauacagaucucuuuuauuuuggaaaaagagaacaacccuccgcucaagguacccacgaaagaagaccucuucaagacuuguagugucccugguacucccuccagcacccccgugcuguacacucagaauguugagccugacucuggagaagcagagcuggacagcagagaccuggaaaugucucagaaagucaggcggucguacagucggcuacagagccuugguugugccucaaccuccaccccuggccgccgauccuucuuuggcuuugagggaccugacgacuugccuggagucucaccugucguguguucaaaguuaaucgagaccccaaagguaccugcaaaggacuugguuccggcuagaacgaaggacuugguuccagauaguacgaaggacuugguuccggcuagaacgcucccuggaaucucucccccaguugugaaagagaaacgaaagaagaagguuccugaaauccuggugaguggggccagacuucucugacucuuggugggaaggcaaugucugaggugugggucuagugcucuggccaacauggcugcucuucccucccacucaugugcccucauuucuuuccaccagaaaucagagcuggauaagugggcuguggccaugaaugcugaauuugaagcugccgagcaguuugagcuucugauugaaugagaugaacugggaugcccgucauuaaguggggugaccuggcuggcucuccccucuuccuguacauauugccuuuugaguagagcaggauauguggggucccuuucacuagccuuguuacccagaaagguauugcuggccucuuguuauauugugucuccuugcccuggacugucuaccucuacagcguuggggaugagaauccacugcucugaaccggaacugucagaaacaggguuagccaugggcugucucugcuguugcauucagccaccaaccagcagagagguuuuguguucugcuuugguucuguagaguugagagaucucaaagaccagggagacaguuaaaugcuugagggaggauuuuuacauugagucucuggaguccaggauaugaacgggaggaagcauaauugguuuuuaacacagugacuuauguaggaacugguccgugucugugcucugcuguugacauuggugaacggggugcugcugcuuacagcaaaguggguacacuugauagcgugggccucggaugcaccaguguaagcuuuauagucucugcuuugaccucuuuccucgcccacaucuguuucuuugaauacaagcuguguggccucagcccuagacaccaugucaccucaucucucaccuacuagacagcuuuugcugugagcuuaaaacuauugcucucaugugagaccaaccauuccuggggguugcugggaacaaaaguggauguaucauggcuucuaagguuccuuccugccugccaccucucaaucaugguaaaagcugugguuuaaaggccauuggccuuccaaccuuuacaguucacgagagcagaagcuguggggaaugagagcucagguaagcuccugcuccaccaggguggcuuaguggaucacuccugcaggcucaguccucacccguuccugaaucaugcugaauugcuaccaucacugcagaccuaccugccugugaggaacuagugugcagccuaagggcaagguggcuugaucucaaauaaacuguguagaaguuucuacguuu

SEQ ID NO: 9098 - RNA, 10809 nt, Mus musculus
agggcuguuuccacaggaugcacugggugaaaauacuagggguggccuuaggggcugcugcgcucuuggggcuggggaucauccuugggcacuuugccauccccaaagcaacuaguccucugaccuccagcacuucagacucccaggaccuggaccuggcgauccuugacuccguaaugggacaacuagaugccagcaggauccgagagaaccuucggugagaaguaggucugcucaaacaaaucccuguuagcuagccagaggcuuccacugauacauuccacucuccccugcgcacccugcagagaacucuccaaggaaccacacguggccaccagcccucgggacgaagcccuggugcagcugcugcuggggcgcuggaaggauacagcgacugggcuggacucagccaagaccuaugaguauaggguccugcucuccuuccccaacgcagagcagccuaacagcguggaagucggugaggucaaguccgggaaugucgggggggggggggugagagcgcugcgcugccgggugcagugcugacucugucuucucacucagugggccccaauggaacaaccuuccacuccuuccaacccuucgagaagaaucugaccggggagcaggcggggcccaauguauugcaaccuuaugcugccuacgcucccccugggacuccaaaggugagcuggggacccccuccccccacauacuacgauauucuagcucuccuugguucucucccuccucacucggaagcaggggcaucugaggaguucuucaaguggagccucaaacccccuccacugaucuugcccagguuguuuauuccuauccuccaucagucaugguggucccugcccaaagccuuguaugggacacgagauagagaagaggguaaccaccuuuaagguacauacagcuuuggguaaggugaggagacaggaacaaaauucuuguggcugcuacuccaucuuuguaccccuuuguuaccugccuuugggcaaaccuggcugcaaauaucugcuuuccggaucagggccuccuugucuaugccaaccaagguucagaagaggacuuuaaggaguuagagacucagggaaucaaccucgagggcaccaucgcucugacucgcuacgggggcguaggacguggggccaaggugaguagcauucaccaggcagggaucugggugaagggccagcaguggacaggacaucaggaggaaggggauagagaggaagcagcugggguggaaagagguggagcauuagugucaccugauaccacaggggccagcaggagaggcaagaaccgaggcucuugauucuguuuguuuuguuuuuuguuugagacaggguuucucuguauagcccuggcuguccuggaacucacucuguagaccaggcuggccucgaacucagaaauccaccugccuuugccucccaagugcugggauuaaaggcgugcacuaccacugcccggccuuauuuuuuuuuuuuaaaugauaaaggaccucagauguuuguuuugugugucugucuaugugccugucugugcauguuuauauuguguggguacauuuaguggccagaagaggaugucugaucccuuugagauguaguuacaaguuacaacauucaucuuuuuuauuauuggugguguuuuuguuguuguuugucuguuuguuuguugagacaaggucucucucuauagcccugacuaucuuggaacuuucuguguagacuaggcucuccucuaauucacagagaucuaccugccucugcccccugaguacuaggauacaagguauacaaaacuguaccagcaauaugguuuguuuuuguuuuuguuuuuuguauuugacuuacuuuaccuagcucaacauuuuaagguuucuugagguuguuugaaaacuuuauuccuucucuuuuuccccccucccuuucuugcucuugcucuggccucgcgcacucuggcacccgcucccuccccucccucugagggacuuuauauuccuucccaagguggaggagcaccccacuguugcacuggggguugcucaguugguagagugguuucuuggcaugcacaaggcccucccuaaauucuagucccagcagcccauaaaacuggauguccuagcaguggggagggggaggcaggaggaucagaaguucaaagccaucgcuggauacuuagagaguuuguggccagcuacauuacauaaaacccugucuccaaauauaucuauauaucuucuuauuuauccauucauacacugguacaccgauggacauuugggcugcucucauuuugcauucugagacuaaugcugcugugaagggugaacaucuuuuguuugagacugagucucccucuguaggccuggcuuagccucaacugcacaacaguccuucugcuucugcuucccaagugcugggauugcgggcuuuagccaccagagacgacuuacaucucacucuuuuguauaccugcauaguauuccaccacaggauaccuaguggcccaagaaguucugucauaacugucuugggcaaacauuaucuugcucaugggaagacagcaauuuugauuuccauguagagaaaggaggaaguauagggcauguccccaucugucacuuacacauaacuugcucugccuucucuaggccauuaaugcugccaaacauggaguugucggagugcugguguacacggacccuggugauaucaaugacgggaagagcuugccuaaugaaaccuucccaaacuccuggcggcugccuccuucugguguggagcgaggcuccuacuaugaguauuuuggggacccucugacccccuaccuuccagcccaccccucuucuuuccgccuggauccucacaacaccucaggauuucccccgauucccacccagccuaucggcuuugaggaugcaagagaucugcucuggugagcuugugcccagugcguccugacccuagacaccuguagaugccgaaaucacccucacagacacucucuccuccccaguaaccucaccggaaccucugccccugccuucuggcagggggcccugggcugugaguacaagcugggacccggcuuugagccgaauggaagcuucccugcugggaggugaggcagggcaucucucuucccucccuucccccaauucccuucuucccuugauaccuccuuauccaacauuccuucuucccucuucaagguggucucccagcccuuuccaaaauggcuuagucuuugggggucccucacugaaaggaaguggcccaccagaccccacggggucucccugccccucacacccacuucccaauucagcuacuacaugcugaauugaacaugcuccaggaccugggcagugcacuucuggccacugucagcuuccucaucugagcauccuggcuaaaagguguccccucuucccaagcuaaggagacuuccaacccaaagagagagcaagcuuugcuuccugccuuucuugguccugcugggcaaguagcugauggggucaccuucccucucuugacuucaguuuccucugagucugauaggaggacaggagagggcuuaaguucuaauuacauccuucaucccaccccuagugaggugaaagugaguguccacaacaggcuggagcugaggaccucuuccaauguccugggcaucauccagggggcuguggagccuggugagccuguuuguacugagccccgccauucuugagucuuccuggguccugcccugguuacagcccacuuuggccugccugcccucugcuguccccucucugucccucugacucugguccucccuucagaucgauacgugaucuacggaaaccaccgggacagcuggguacauggggcgguggaccccagcaguggcacugcuguccucuuggagaucucucgaguccuggggaccuugcuaaagaagggugaggccaugcucuccucugguuacucccccagaagccccagagucauuuccugcccauuucuuuuguuuccuucaucuccagggcucacuugaaccaggcaugagcccuggaggcauuaguaccugggugccagccccuggccuugggagccucggagcuuauuaacagauaauugauagaugcagccauccccaggagucuccuauguguccugggaaagucaggccccacaggcugugagcaugauccguccaggcuuugcucauagagugcuuugcuuuguaagccaagccuauccauuuuggugacauuccagcacuagagacccucaagagaaggagugcuggauccucagagcaagggaucauagcuagagcagaagcugagcaucuagggacagucaagguaacgagaggagagggcagaaaggagguugagggcuucugucucugggcuagaagacauggaaugagaugaacuggaggacuguuagcaaugauggaaggccagauguggccaaaaccagcagaggagggcagguggucagcugggagcagcagguagaucgcuggaggacugugugccagucuagccuacuugggagaguuucaggccauggagcccucaucucaacaaacaaacaaaaaaaccaagggguuacuuggauauagccaaucuuuuucuuaugcauuuauuauaacuuaaucucucagguauagaaagaaucuaaauaauggauuuucuauguagauugucagauauuacuaauaaauaguauggaguguaggccuucuagaaaugaaaaagaugccaggcaguggcgcacgccuuuaaucccagcacuugggaggcagaggcagguggauuucugaguuccaggacagccugguuuacagagugaguuccaggacagccagggcuacacagagaaacccugucuugaaacaccaaaacaaaacaaaaacaaaacaaaaacaacaacaacaaaacaacaacaacaacaacaacaaaaaaaaaaaaccaaaguaagaaccaaauaauagaucagaugauccagcuacagccagaagugcaacaaaacagggagcacggagcugaaggagcacagagcugauaaggggcaagcaucagagucucaggguuguggcuggggacagugggcugguagccuggagauggaagccaggcugcuggaugcuguaggagguguguguguguggggggaggggggggcugguuaauucaugugccccuggaacguaugcugucuggauuugaaccuggcugugcugccuacuggcuaugaccuugggcaagacauuuaacuuaguuaauucguuggcuccguuucuucaacugugaaguggaaagacacuuccuuucuuucuuucuuucuuucuuucuuucuuucuuucuuucuuucuuucuuucuuucuuucuuucuuucuuuccuuccuuccuuccuuccuuccuuccuuccuuccuucuuucuuucuuucuuucuuucuuucuuuggguuuuuugagacaggguuucucuguauagcccuggcuguccuggaacucacuuuguagaccaggcuggccuugaacucagaaauccuucugccucugccucccgagugcugggauuaaaggugugcgccaccaugcccggccggacacuuuauuuuuauuuuauguguauggguacuuugcuuccccccccuucuuuuuuaagauuuaauuaucguauguaugugaguacacuguagcuucagaugcaccagaagagggcauuggaucccauuacaggugguugugagccaccauguggaagagaagucagugcuuuuaaccacugagccgucucuccagcccgguacucugcuuuuaugacuguuuaccaugugcaugcaguacuguuggagaacagaagagaguguugcauccccuggaacuggagguuggaagucucucugugggugcuuggaguagaaccuggguccucugcaagagcaucucucugggcuccccucccccacgcacacggugcucuuguaagguugacuugggauaaaacuauuuggcaacuaccaauguacuaucaacuaauguuuccugggauguuuagagacuaaggauagagaaucaacucaaagcaagucuaccauagaacagagaggagguagggcauucaggucaaaagagacccaaugacccaaggauuuccaggguacaguguguugaaaguggggggcuagaaagaggacugucuccuggaaggcuggcagaagggugccaggugguguggucugaccaucuuuucacuccucccucccuuccauauccccagccuacucccuaagucucccugggucggaggacccugcccucuucaugacuucuuuucuucaggcaccuggcgaccccgcagguccaucauauuugccagcuggggagcagaggaauucggacucauuggcucuacagaauuuacagaggugaguggacuccacggaguggggaguccuuggauggagcagcaguggauugaugucacuucuccucccucccacccuccucuggcacaggaguuucucagcaagcugcaggagcgcacgguggccuacaucaauguggacaucucuguuuucuguaugggaggcuuggccagcugggcacgggcugggaaagggagggguuggcucugaacaggccucccugcuuccuuccacagccaaugcuacccuccgggcacagggaacaccuccuguacaaagugugaucuucucugccaccaaagaggugcaaagggguagggggggacuauguaguauagggugggcaggacuggagcccgcaggucacagcugaucuggagaguggggucugcuagagacccaucugguuguugaggcuggguuuuccuagcuaucagauguuccucucuguaccagaucagugcaccaggcuccaguggccucaguaucuaugacaacuggauccgauauaccaaccgcacuaguccaguauauggacugguucccaggugagcccagaaaccagacagguagggggcccacaggcccagcauguccaccuggcacccuccagagucugucuucuucccuucucuagccugggcacacugggcgcuggcagugacuaugccgcauucguucacuuccugggcaucacguccauggaccuugccuacaccuaugaccgggugaguagagucuuccauaccacucccucuccggcacugcugcgucagguaucaggggaagaucuaguccagacggguucugguucauucacucagugucuuaguuuuguuuccuguugcugugagaaaauacucugacaaaggcaacucuaaggaggaagggcacaaguuuaguucuaguccaucauagcaggggucacagugguggggguucccgagaacugagggcaucacacucagucagagcagaaagcagcaagcagaggcucagucagguuccucaucccugaccugggaacggcgcuagccgcagugcaguccuugacaggagucaacucaggacucccacaccaagucucccgcagaggagauggauuugcuccagagggacagaggucagggaauaagagacaaagacaggagauggaugagggagaagggggagguguauuuauucuggaggacaaacgacugucuuuggauggagaggagucagauauggcccauaggcaaauggugguuuauaaauguaaaaggggaaacccuguguuaggaugggguguugaauuuuaauugggcguguuaacuagguaagucaaagggggcuuuugauugcuggacuucaauguuuugguagcuggacagccucagaaggagggauuggccaaauaaggggauagaucucuguggcuagcuucaggaauauaaucuaacaguuuuuagcaaggcagagggaauuagggagaagggcaagacuugcucuagcuggccagagucccuucuguccucccaccucaauaaauguacucaagauagacucccacugauaugccccuaagccauccagauuuagacacuuccuuacugagacuccaucccagauguuucuagauuguaucagauugacaauuaaaacuaccuaucagcacuggacaagacaggcuggcuuuccuaggccucagagcaucuguuucugcucaucaaacacuugcauugguuguauugcaguuccaccuuacucauucuacaauguugucacgucauguuaugucuuaggcaggacaaggaaaagacugcugucaaucaguuguaggauggcagugacuaugaagaacugaguauggaaauacuugugcuggugucagcacuaagcgagacuuguuagggaaagauucauacguuuggggauugaggugggacuccagugcauccagccuguaccucuaaccucuagaguggaugcuuuaaaucccuuuucccccuggcugugcugcucuuggauggaggagcugggauucccauguuugauuccaaagccccaggcuucucugccuuucugucugggcgugcgauaccaggcagguuagccccuagcccucaguuccuccucuggaguggaaguucugaagcccacaguucacaccguggguacccagcucucccaccgcaagccuaccucuucuuuauuccucuagagcaagaccucggccaggaucuaccccaccuaccacacagcauuugauacauuugauuauguggagaaguuucuggacccuggugaggaggggacaggggcauucugaagcugacagaaggaugggcugaagaugcagcccuggccuuggguccccuccuagguuucagcagccaccaagcuguggcccggacugcugggagcgugcuucuccggcucagugacagccucuuccugccccucaaugucagugacuauagugagacacuacagaguuuccugcaggcugcucaagaggcccuuggcacccaguuagagaaacagaacaucagccuggguacgcacaccccaacauggagucucggggaacccuguauccccagguagggcuaagccauguguuccccacucagggccuuuggugacugcaguggcgaacuuuaaggcugcagcugcauccuugggugagcacaucuugacccugcagaagagcagcccugagugagugucagcagagggcaggugucugggagggggcaccuggcaugcauggagcuggcagcugaacugcuggcuugcagugaagugacgcacacgcucuucaguccucugcagguacgaauggucaaugaccagcugaugcucuuagaacgggcauuccugaacccaagggcuuucccagaggagaggcacuacaggugagccuaugccaaagcucuggggaggagggguggagcgauggcccccuccccagagcuuuccugugucacuaugcaauccacuucacugauggcuggggacugaggcccagccugcacugcuguaagcccuugcauucagagagcagacccaaguugcaugcuacgugucgacaaugcugaguuccagguaaccucucacugacccucugcucgccaucucuccucagccacgugcucugggcgcccaacacggccucuguagacacauucccaggucuggccaacgcuuaugccaaggcccaggaaaucaacuccggaucugaagcuugggcugaaguacagaggcagcuuagcauuguaguaacggcccuggagggugcggcagccacccugguaccuguggcugaccucugacccagcccugucccuugggcuuuuucuugcaccucucacaccuguauguuccagucuuuccugaggccaggaguagguagaucagcaaacacucaagcuuuuaaagcaacagcuggggucccugcaguuaaggacaccugcucacgguagugggugaaacuggggcccaaaguaguguagagucuagcccauuguucagccugcuuucuucuuccccugcacucucucuccccucuuuuuuuuuuuugguuuuucgagacaggguuucucuguguagcccuggcuguccuggaacucacucuguagaccaggcuggccucgaacucagaaauccaccugccucugccucccgagugcugggauuuaaaggcgugcgccacuacgcccgguuucucucuccccucuuaacccucaaauaaaugaagucuaaaaguuccuguuauuguuuggagaucauaaugaguuccuuuuauuguuugggaauuaugaaaaagaagccaggugcucugacccaggccuugugggagacgagacccucucaagcugcagagccaggucugugaaugucaccuuccucagccaugaccacaucuuccagggugugucccugcaacuuauuccccacuaauaugugguaggcaccagggggugggaguccuuccucagaguauugaccccucaggaauacaacucugucuuuauccaaggucaguccaugggccuggcacaggucccgugcuuccuggaguccauccagggccagaaaguguucuaugaaguccaaaggcaaggucugucccuuaggagugcucagggcacgggacaggcgggcuagagcuuugcggcgggcauacccaauguguuccugcacugcgcagcucuguagguaggguaaggugcgaagcaggcgaaacagucgggcaugguugucuucccggaaggcagcgucaacagccaacgccgccugaaggggugggcaggcacgcagggcagcaggcagcuguagaaccuccugcagggcuuccacagaaccu

SEQ ID NO: 9099 - RNA, 2295 nt, Mus musculus
agggagaagggggagguguauuuauucuggaggacaaacgacugucuuuggauggagaggagucagauauggcccauaggcaaauggugguuuauaaauguaaaaggggaaacccuguguuaggaugggguguugaauuuuaauugggcguguuaacuagguaagucaaagggggcuuuugauugcuggacuucaauguuuugguagcuggacagccucagaaggagggauuggccaaauaaggggauagaucucuguggcuagcuucaggaauauaaucuaacaguuuuuagcaaggcagagggaauuagggagaagggcaagacuugcucuagcuggccagagucccuucuguccucccaccucaauaaauguacucaagauagacucccacugauaugccccuaagccauccagauuuagacacuuccuuacugagacuccaucccagauguuucuagauuguaucagauugacaauuaaaacuaccuaucagcacuggacaagacaggcuggcuuuccuaggccucagagcaucuguuucugcucaucaaacacuugcauugguuguauugcaguuccaccuuacucauucuacaauguugucacgucauguuaugucuuaggcaggacaaggaaaagacugcugucaaucaguuguaggauggcagugacuaugaagaacugaguauggaaauacuugugcuggugucagcacuaagcgagacuuguuagggaaagauucauacguuuggggauugaggugggacuccagugcauccagccuguaccucuaaccucuagaguggaugcuuuaaaucccuuuucccccuggcugugcugcucuuggauggaggagcugggauucccauguuugauuccaaagccccaggcuucucugccuuucugucugggcgugcgauaccaggcagguuagccccuagcccucaguuccuccucuggaguggaaguucugaagcccacaguucacaccguggguacccagcucucccaccgcaagccuaccucuucuuuauuccucuagagcaagaccucggccaggaucuaccccaccuaccacacagcauuugauacauuugauuauguggagaaguuucuggacccuggugaggaggggacaggggcauucugaagcugacagaaggaugggcugaagaugcagcccuggccuuggguccccuccuagguuucagcagccaccaagcuguggcccggacugcugggagcgugcuucuccggcucagugacagccucuuccugccccucaaugucagugacuauagugagacacuacagaguuuccugcaggcugcucaagaggcccuuggcacccaguuagagaaacagaacaucagccuggguacgcacaccccaacauggagucucggggaacccuguauccccagguagggcuaagccauguguuccccacucagggccuuuggugacugcaguggcgaacuuuaaggcugcagcugcauccuugggugagcacaucuugacccugcagaagagcagcccugagugagugucagcagagggcaggugucugggagggggcaccuggcaugcauggagcuggcagcugaacugcuggcuugcagugaagugacgcacacgcucuucaguccucugcagguacgaauggucaaugaccagcugaugcucuuagaacgggcauuccugaacccaagggcuuucccagaggagaggcacuacaggugagccuaugccaaagcucuggggaggagggguggagcgauggcccccuccccagagcuuuccugugucacuaugcaauccacuucacugauggcuggggacugaggcccagccugcacugcuguaagcccuugcauucagagagcagacccaaguugcaugcuacgugucgacaaugcugaguuccagguaaccucucacugacccucugcucgccaucucuccucagccacgugcucugggcgcccaacacggccucuguagacacauucccaggucuggccaacgcuuaugccaaggcccaggaaaucaacuccggaucugaagcuugggcugaaguacagaggcagcuuagcauuguaguaacggcccuggagggugcggcagccacccugguaccuguggcugaccucugacccagcccugucccuugggcuuuuucuugcaccucucacaccuguauguuccagucuuuccugaggccaggaguagguagaucagcaaacacucaagcuuuuaaagcaacagcuggggucccugcaguuaaggaca

SEQ ID NO: 9100 - RNA, 7771 nt, Mus musculus
uacuggaaagucuuggggguuguuuguucauuuugucuuuuguaauucauacugaugaaggcagguguuccucuagauaauuggcaaccccuucucagaaaccucucuuuuccuccuugacucccucuuucaaugccuccuccuauaggaaggcugcuugguuacuugcagauggacccagcgagcccugcccugagcuuccaugcucugcccauuccuuagcaggggaggacuaaaccaguucuuccuccgcucugcucuguccccucuggacucagcuuccaggugagugcuaaagucagugacucacaaauggcucagccaggaacugggugaagagugcuuuauucucacugcuggaccgaggcgaggcgacaccuaggacccuggcagcagcagguagucccucccagcccagccuuuccuuuuggcauggcagcugcaggccacuuugggagacagggugacagcccucacccgggggagcagcaaugggcaguaauagcagcagcaggucauggugggguugggaguguuagucuggccagcuggugcucaucccucuggcuggugucugaugaggacagggaccuggggacacugaagaagcucagucggcaguaaagacacgacuggaaaugucaucaaggagccagucgaugccaggcagcaggucuuccccugugacagcacugcagcccuggaugcgccagugguggcugcggauggaguccagcuccagggccuggggacagaaaggaccgguggaaccagcaggccucagcuuguccuuuccagucacccaguggguggcucugaagcuacauacucgugccaccgucagugacauaaaaccagcaugggcugcugagugugugacaggaccaggcauuuugcagggaccacagaaauaauuccaucucuugcaaaggcauccugauccagaggcucuacaaccuccccgaucacacagcagggaaaaaggugacagcgagacucuaaauaaagccagguguggaggggugcaccuacaauacaguaguacacugggguaggggggcaagagggaucaaaccuguauuaaacaaucaaaacucaagauucuaagccugcuggagugacaguuaagauacaccaugguucccagacugggucaacaugacacgcaauccuggcuuguuuaccuacuaugugacauugggcaggcaaccuaacuugucugcugcacccucuguaaggugacagauccucccucaugagauuauuguacaguggucaagaaugacaccugugaacccacacagggaccauggcaaugggaagacuccuugcagucuggcuggagaauccugugaaaugaccuaguuacaggucugccuucucccagacuguggggcauucuauguuauuaaucaucaaaccccaggacccccuccuaggucuugccacacagcaggagcuaaucauggcguuuaaugccaauuauuagccaggcauauaggcgcauucuugaaauuccaggcaggaggacugcugcugaguuugagaccagccugggcuacaugguguguucuaggacagccuagguuauagaaacugggaucagaaauaaacaauuaagaugggucugggguguagcucaguuagcagugcuugccuggcaugcacagcuaugggagcagucaccagcacugcagacacuggccgugguggugcacaccuguaaucccaaguacuucagagguggaggcaggaggacgaguaaguaguucaaagccauccucagcuuccuaguaagugugaaaccugcuagggcuaccaaaacccaguuucaaaaaaccaagaaacaguaaaauuaaaaagaaucgaguccuaaagacccuucaucucacucaguaggccugcaccagggccugacucaccuccugaauagcauuacaggacagugcuccaggcagguccugcuuguuggcaaagaugaggaggguugcuccagccaggcgcuagggaaagagaagauggguugggggugggggagguuuagcauacggcuugaucccuucuaaaccagccacgagguugguggucagcacacagggucaggaacagagcuccagguuguugaggcccagaaggguuaggcaguggacggggcuaugaugcuauaucacaguggccaucucucucuuccaagccuguuuucucuuccguagucaucccccagcccucuguaacucuggccgugugcagaaaacauaagugugcuggaggcugcccuggggacucugggauauaaccaccugccccuccuaguucacagaauccuuaaaucuuacuuccagccgcauuuacugccgcauugcugucucucucuacuucuuccccuugauguguuugucuuuggaaccucuccuugugcacagagaaguccagcuucugagccuaggccugcugggcccugacucagcagugaccugucuagaccuuuucaauaccggggggugggggagccugaagucauaccaguggcaugugucucugugagccuacagucccaugcauuccugugguucccacacagccauuagcaacucccucuuacccucucaaaagagcccuggccuuccacuaacugaaauguggcaccaugauccaaguucugggacagacagagcacauuaauggagaaauagcagcauccaaauaaaacuagcagcuuaagaaaauuccugagcauggcucaauggugcucaacuauaauccuagcacucaggagccuaaggcaggaagagagagaguuuggagccagccuggacuacauagggaaaccugaucucaaacacccacccucacccugcugccaaacaaacccaaaacaacaaacaaaacaacaaacagaagcccugcccagauaaauaagaagccaauaaugaaggagugcggugguauacaccuggaaugauguguggcacacacaucauuuggcaaguagaggcagguggaucaggaguucagggacagugucagccaguugaggccagccugagauacagaguaaaacuguugucaacaagacaagucuuuugguccagacaagaaauggcaagauuagccuaauuauuacuuuaggaauguggaaguuaaggcucagagcggucaugugucuuccugaacccacacaacaagguucgguuccugugcaagcuucacugccucccugagcuuggcccuagccuugcggcagcccugcaacaaugagaccgagacucaguggcgaaucaguaaaggcagagaugugcauccaagucucagccuggggcccagugagagaacggacccacucccuccccaagugccccaguaaauccuggcacuuguggcgggugucuggccuagcugcagguggaagccuggggcacaccuccuccaccaguaggcucugcagcucucgcugacaguccugcaugcgcuggcggucggcgcuguccaccacccagaugaggccauccgugcucucaaaguaguuccuccaguaggagcgcagagacuucuggccaccuacaucccagauguucagcuugaaucugggaaggaaggggcgaugaaggucaggcugcuccugcccucccagccuccucccagccccacaauggcccucggugacccuacucacccgcggugcuccagggucuugauguugaagcccagugucggggagaugguguccacgucuucuccauugaacuucuugaggaugguuguuuugccagcguuguccaagccacuggggcacaaaggcuaaggagaggucucugaguucuguuggaggacaugucaucacacuaccacccuccuagggacuaguacuuuccuacuguauguagaagcaaguugagcacgugccugacccauaacuggcuugagauaaauguagaaguaugaaaauggaauucuaucauguugaccaacucaaaauaacuuaauuuacgcaucaaauauugagugccuauuaagugccaggcccccucugauguugggggacaaacucaucacccuuaugaagcuuaaacacuagcaaaagucuaaguaauggggcuggagagauggcucagcaguaaagagcacauguugcucuuauagaagaccuggguucaguucccagcauccaccuggugguucacaaccaaaugcugaccucugugggcaccagccacucaccccaguguacagacaaaguucucacauccauaaauaaguguuaaaaaauuaaagacuagggcuggugagauggcucaguggguaagagcacccgacugcucuuccgaagguccggaguucaaaucccagcaaccacaugguggcucacaaccauccguaaggagaucugacgcccucuucuggagugucugaagacagcuacaguguacuuacauauaauaaauaaauaaaucuuuaaaaaaaaaaaauuaaagacuaaauaaagcagaagagaagguuggguacuuggaaccagugaaggacauuccuggaaggaauggcuuucaacuuaagauaccagacaaggcucuguggggucuugaggcccaaaacagaugggcccagccuucugaaggaccaaguaaagggcaaguaucuagagguggcaaccaccuucaucugucucuggaaugauccacagccuccguugcagagaacaagccaauaggugagcucaaccgcaggugagacuguggggcagccaaagccugagcggaggggagaagggacaggcucuacauuuaggaccucuuccuacucacuugacucuggcucugugacucccaccuuugagaggcacgggugaauaccuuccaccuucugcagcccaacucucaccuuggaaagccagcagauugucuugucaauccaacaacauccacucuuccaucccuucuccucucaucaccaaacucucgccucacgccucgagugcugcgcacuacugcagcagaaccugucuccacccacucccccaccaucugcugagucggccacagcuuccucuggggugcauccugggaacagguguuauacuccauuguaccaacuuccaucuuuuggcuuguauuguuuuuguuuguuuguuuguuuucuuuuguuuuguuuuuuuugucuggaacucuauguaacgcaaacuggccucaaacuugucaaaguucuccagccucugccucuugagugccagaacuacaggcauguaacaccauguuggacuuuuccugcauuuugguuuuuuuuuuuuuugagacaaggucuauguagccuuggccggccuggaacuugcucuguagaccggguuggacucaagcccguagauucaccugccuuuaccuucugaacgcuggcauucgagguguucgauaccaugcucauuuuuuguuugcuuagaauauuuugaguuuuugccuacacgaggaccucaggacugaaguuacacaaggcugugaagcaccaaguggguacugggcacugaaccccuguucccugguucuucaccacugcaccaguuuuacuuagccucuugcuuucuacaggucuacuguuagcagacuggcuccugaugcuuccugaagccucacuuugccagguaggucuccgaagacccccuuacugcucuccacuggccggguggcccagcuucugcucugcuccgggcgcugcugcucuuuccuuggcccucucccagaccccauccuguuacccucaucugacuucacacaagcgucuacaccugggucucagcacuccccagcugggccaucccaugaucguuucuaggcugauggcugcuaccuaccugcccaacagucaggguuggugucuucccagggacaugcgucucucaucucagcaaguggcuccuuguccuucugaacacucuggccagagaccaguucaugcuuggcuacaucucccucauugucuucucccauucagcagcaagucauaauacucuccuacuaccaccauggucuaagccaccauccugugcucccuucauaguccagcugccuaaauggccccagcccaugggcucucccucucuccagcucuuuccuucucaaccuuucuugaacaugccugucuuauccuccuccagggccuucgcacuugcagguccucugcuuacguuuucccagcucucucuaccuccuuguggacucuauucuucucauccuacacuacauaucuuacuugcuuuaucaauuuuuucuccccuuucaucacagaauaucugaaaugaagccuuuuucgcuucccuguuuuaccgaauucccuaacauaggugcuuggaggucaucuaaugagugucuuucucagaauugucuaaaacacgcacgagugguaaaguucuacgugcacauuaaauuuccuuuucucccucugcuacuuuguggaucgcagaugccuagguggcccggcacagugcaagacgggugaugcaggugccaguuaaugcggugaaaggucgcugguggccuuaagugacagcgggaccuguggccaaccgaguccacgccuacucgcaggagccuaggcgguccucgagacccugggauuccgacccuaagggaagcgccaaggccuacacccguagaugaaggggagggggucagcgccagggaggagcagggcccacgcucgggccagcccgaggcagcgugacguccgagucaccaccacugcgucgcgccucgcagugauacuggagucccaagucuaggccgggccuugagaccaccgggcugccuucugcacgccaacccccaccccgcagagugguacggcccuccccggccccgcgccgagcagugguagcgccgcgugcgugacgcaccaccggcaauagguacccacggcggccgcgcccccccacgcccggcuccgcccacccggcgggccccgcuacccucgcgaccgcucuagcgcucggaggauacagcaugagcagccgcagcucucgcucuuucugcuucaucuucuucagaauggucagaagccccaugaucccguagcccccucccggccgccguuucuucuagucccgggaccccgcucccgucuccuauuggccagccuggcgcuuguggccgcccucguugucacgugaccacaggagugcagggcgucgcccccuagaggcgcugcggcgacuuugaagccugcugcguuaacccuugucgggaaggcagaggguugguggggacaagggagaagucccuaagccuuccgacuccgaggccucggucggaugccagacagaggcugacuuucucgagcaguaucucgucuggguagggaguagccgcgaagagauucugagcuaggagucggaaucugguuccacaaagagcugacgaaucauccggggacuguaauacgguucccaccagugcaucuugugacuuccauucauuuaccagugacggaaaaccguugguccugguccgggacucugucggaaauggcucugugcguucacuugaggaugaugacucccccuaggggccauuucuaaaugugcggacaguauggccuccuuggguuguuuagaguuccaagcuccccgcaaugcagggaccagacccgcacaaaggauugagugcuaucuaggacccuaucagguugagacgcucuaucccaacuguuaggauaaaacuggcagggcagagccugucucaaaaaacaacgauaaaaaaccugaagcccaccuggugcuuagccucauggc

SEQ ID NO: 9101 - RNA, 1391 nt, Mus musculus
cucaagcauugcuugcuuuauugaggacaggagcgaaggagaauguagcaaggagacugcugagagggccaaccucaucuucacagacgauaaagagggucagagccccgaguuugagauacccaugacaugucaguggcaggaccggagccugagcccuucggggacuaguagcgggagaaacggcacauaucacacuggcaggcccuugcaguaaagaucucaagcuccccacgcugguuccccacgcacugcagccacacccucaccuguuggaggaggacccaaguuuguucccauuccaccccacccucacgcccccaucagguucgaaccccuggguccucacccucacaccuggucagguucgggccccuggggguccccacccuuauggcccggucagguucgggccccugggggaccccacccuuacaccccggucagguucgggccccuggguccccacccucauaccuggucagguucgggcuccuggguccccacccucacaccaggucagguucggaccccuggguccccacccucacgcuccaucaggcucaggccccuggguccccacccucacgcuccaucaggcucaggccccuuaccuuucugaggcugcugauggugcagcacugggaggaagaggugauguugugccgauagccacuggccaccagcacagaguaccgggaagggaaagcacuagacucacaguguccuacacaggccugugccacgugggagcccuggcaagugccgaggcgaucacugcgcaccgucacauugaaggcuggaagcagagaagggagcagccggugaaggccgugcuggccggguuacccguccauccgcuccccaagcagaguuacucacggugcaaguggcagccugggauggcugucucugggcuaugcccuucagugacugccaggcccagcaggcaaaggagcaagacucguggugccaugggcaucugcaaaggacugggugggaagggaagucuuugaaguugugccucuccaccagcaagccaggcuucugggucuccuuauuggugaggugugcuggguaguggucuuuaucaucucugccuuugguaggaaugugugugugugggggggguugcuucccugccucagcuacucuggaagggugugaauagccacuuauaugucauccuaugcauucuccccuggaauguccucaccaucugcgguacauaucaauuuccccaucuaugugccacuuuggcuacaaggcccuggcccaccaccccacccucccuggcuccaccccucccuuccuggccccaccuccucagccucagcagcuuaccaguccaacagcaacugaagacuccuggugccuccugcuggucucca

SEQ ID NO: 9102 - RNA, 8332 nt, Mus musculus
ggaggugcgggccgggagggggggaggugacuugaugucauccugagcagcugggcggcgggugccggugcgcagcgagccggggcucccgcugcgcugcaccgcgcugaucugagucccgggauaucugccgagggucgcgugcugccggggcccagcccagagcccaccgagugcccgaccccuuuuggggcugagcugggggcaugcuccagcacccccagagccugggagcgaacccaggagcgccgccgcccagccccagcgccccgagcggcagaaccaccgcuaaggacccuugaaccgucgucucuuccaccgaggcaaccucuagggucggcgaccaaagucuggguuucugagaagugaguguguaccccaauaccacauugagguuuggagaccaggaaggagcgggauaugaggagagaugcuagggucugaaagggggugcacgagaacaggacccucauuuuuugggugagugcacugagacaggagacauuaguggagcuggagucacacugcuguaaggaucuggggaugcuaauagaguccccauccugaguaguagccauaggccguauuuggggaggggcuacuuuagagcuugggccuggaagaagggaggggcaugguugcgcccuuguuuuggggucuagcgagggaaggagggaaaagaaguaagggagcaacugcaccacgcgggcugucuuuggaaagaaccgaccugcucucugugucucuccugcugaccuuucuaaccugacuucucagaagagccagcgugggaacccugacuggaacucuucuggauccccaggaaagaccugagccauugccuuucuaccuuaccugcccccccaggacugggcaguugccagaggcccugggggggucaggacuguggccgugccucccccacccccugaaacaugcuggacaggaugggucccaguuaguguguguggccucauucaacuuacuccagacccacaaggagcccccugggcucugaaagauugacccguguuguccacuggccauggagacgaagcugcccccugcgagcacccccacaagccccuccuccccagggcugucuccagugccaccaccagacaagguggauggcuucucccgcaggucccuccgcagggcccggccccgucgcucacacagcucuucucaguuccgcuaucagagcaaccagcaagagcucacuccacugccccugcucaaaggugagcuguuguugguugccaggguacccagaaggaagcaagguaggggaggaccaagggagaagcagaggucugguagaguuuggaucucuuuuaggcuaggaacuccacuggaacugacccccaaucuccaggccucugcugacgcauggccugacuggccugucaucucuggagguggggcaucuggaaguggugccaggggcaggcaagggccaaggguggggcacacagccuagguuucaggaggcuccuaucaguccagccagcugccuagguccugggguaggugcuuggcaugaugcccugugaucacuaaaucccaccccccacuuccuggcccgauuucuacuuuuggcuccauguguugagggagguaagugucuggggagggguggggaaugcuugcauacccaggguugugaucuugcuuuaaagucaugaggucucugauccuggauuagaagagaggaccacuuuuuccccucagccucccgggagugaaggaugggacuagaauuguuugcuagcuguaccagaguaccuuguaugggggcagcugaagcuuccuggaaagucagccugagggagguggagauccaucccguccagagcccuuggcggcuagauccaggaggucucccugucccuccccgcagaugugccagccucugaguugcaugaguugcugagccggaaacuggcccaauguggggugauguuugacuucuuggacugcguggcugaccucaaggggaaggaggugaagcgugcagcccucaaugaacugguggaauguguggguugcacccggggugugcucaucgagcccgucuacccagacaucauccgcaugguaagcacugcccagccucgcucggggaacaagaauucucucaggcuaccucugggacccgugugggaggaauaagugcauacacuucagcuuggucgcaggcgcgugcucccacuuccacugggucucacugcugcccgacaccgucucgggauuuccucucccuguugucccuauacuugagugagcugggccuaggguaccuguccucugggccacuugucuuccauggucugacucaggcaugggcuauucuaagaaacccucucgcccagucugaucagaaacgcuugggcucugaaugccugggcuguccacugcuuucaaccuuaccaucacugcugaaccacauccacacacggaugugucaagccacccuugggucuccagcccuugacuugcaugagcuugguguuuagaugaagauuguccagaggagcaaguugccugcugggaagugggucaguccagaauuggaugagggcuggugguaaaacucagugcaaggccucagguucaagcucuaugugcucauuguacuuagaaagugcuuggccaugcuaggcagugguggcgcacgccuuuaaucccagaacuuuggagguggaggcagguggauaucugaguucgaggucagccuggucuacagagagaguuccaggauagccagagcucuguuccacagauaaaacccuaucucaacaaacaaaaacaagacaagacaaaacaaugacaaagaaaauaagugcuuagccugauguugugugccuguuauccuaguuacauagaaggcggaggcaagaaggccacaaacucauuaccugucugggauauagagaacuucgagaguucccaaaacuccuguuucuauggucucguccuuaaaaacccucccuuuccccuacuagauaucaguaaauaucuuccggacccugccacccagcgagaacccugaguuugacccugaagaagaugagcccaaccuugagcccucguggccacaucugcaggugugaagggcuggggagcagggucugcauuucggaguagauuggagagcuaugggagacccugacgguuggcugagagcugcaggguaggggaagugggacagacuguagccaaacucacuguuugcucugucucccacccccagcugguauaugaguuuuuccugcguuucuuggagaguccagauuuccagcccucuguggccaagagauacguggaucaaaaguuuguccuaauggugacuuggggagcccaggcugggugguaccauacagcaggcacaugccaucugagggacgugggauaggaugcggagaaauggguugauaucugacuuuaucuuacccugacccucgguccugcagcuccuggagcuauuugacagcgaggacccccgggaacgugaguaccucaagaccaucuugcaucggguguacggcaaguuccugggucuccgggccuacauccgcaaacagugcaaccacaucuuccuccggugcguugcucugccugcccagaagagaucugggagggaggcggggaagaagggaccugcugagcugcccaggcuguuuguuuaucaaguucugggugugcaauguaguauugauuaucugaagccugugaaagcagagaauaaguauucauuuccguuuacagaggagaaaauagaggccagaugagaagacuguaggaagauagaagccaguuaagcaguuuagagggaccaggguagcccagagggaugcagggauguaggaucugaccagccuggccuauaaugaccuacacacauguucugaacacuacauccacuggacauggggcgccccugugacugaguaguugauaccauggcugucuauuugaguuugguuccaggauuugggugaacuugggaaagcccuugaaguucuccucuugcuucauccuuuggucacauggccugugcuaguguggggccauucuccagaugaagccagaugagccuccaagguaccuggcguagcuccuggccugagauggggccucuaaaacauuagcuguuguuccuagugauaaacuagaagagcccugacccauguucuucagaagcucagaguccauuagcuuccccacuuauuaacuuugaggugaggagccuuuagcuagagucucaacuucaucucuguaauggcuuucauaggcccuagcgccuagggggaucuugagaauuacagugcaggguagagguguuugccuuugcuuugguugacugcaugacaguugaaagaccuaggcugggugccugcugacuggcuggacauuggguaagaagugcuagggaccugaagaaaugagcuggggcuaucucagggaagagaugcugagcugggacugacaguggcuaagaugccuggucugggaaagauauuuugcgaguggauguggacucaaugggggcugguuuggggcaucaggaagggagcacuccuguggggacaguuggacaguuguguggggugagucaggauugcuggcaggaagggugauggagagcuggaccugucccaaagcucccacccuccagagucaucuguucuccugcagguucaucuacgagcuggaacacuucaaugguguggcugagcucuuagagaucuuaggaagguaauucucccugggcuuuggcuggagcugggguuucugguaggagggacugggggccugcuuggcugagcccugcuccucuuuucuguccacuccaaagcaucaucaauggcuuugcgcugccccugaagacugagcacaagcaguuccugguucgaguccugauccccuugcacucugucaagucacuaucuguuuuucaugcucaggugagcccaggccuggccuugcagcagcagcagcagcauuugcagacacucagggcugacugcagggccaggaagucaacuugacacuuacuggauccuguucucaccccugaggcccuacuaauucaguguccucuaccugagagcugaccucacacaccagcccugugccucuccagcacucagagcgggguuccuuguagguccagggcggcaguaagugcucagggaacaggagugugaaggcaguacugagcagaugucuggcccuggcaucauguccuaggcagcuaguucuuggcuccuggccccuccugaccuuggcuacuucuuuccacccuggcccugcagcuggcauacuguguggugcaguuccuggagaaggaugcaaccuugacagagcaugugaguaccuuggagggaaggugggacccucacucuucgggucugaccccuucucccuccuauagguuauccgggggcuucucaaauacuggccuaaaaccugcacccagaaggagguaugaagggcucucacaacccugacaguaguggggagggcucagcuuccagaaggcgagcagguguguacuuuaggggaaugugagcugcugcccugcccucuccccaggugauguuccugggggagauggaagagauucuugaugucaucgagcccucccaguuugugaagauccaggagccccucuucaagcagguggcucgcugugucuccagcccccauuuccagguaugugacaaagggaggugggaucagggcaggggcacagcuuggcaaggauucucaguuacccuaacagagccccuucuccucucagcuuuuuuucuagcccuaggccugauaacagggagaugauggauggccuugggguccugagcccuagggccagacuuuagauauauaucucacugguucgagccuuggagccuugggacucacuuaucuaagucuaaguggauuuccaugacuauaaaaugggccaauagacccuucauguugacaggaacaagagcucauaguuguaaacacaccagggaaacugacccaaagccggcugcagaauugucagccccucuccuucuuuccugguaacgccagacuucaccggucccuacuuucuggccagaagguuuaguuccccaugcuguucuaugcucacucccaucccuaggagccauaaccugguggaaguuuguucuuccucaugauggcucugggauuucacuuuaaaaacaccugacaacagcuggcggagacgggugcucucaccccacucccauagcagacaaccgaggccaagaagcugaaugccucgcauggccacacacgugcagugggcucuggaggagucaggacuacccgucuggaaagccagggccuuuucucuccuccauuugauuucuccagugggucagauaagcccucaggaugggguguggagguuaggggaucuggguucgaagguaaggagaaaaaacagacuuugcacacccaaaagccacuaccaggcccucuuuccugccucaccugccuagguugcagagcgggcucuguauuucuggaacaaugaguacauccugagccucauugaggacaacugccacacugugcugccugcgguauuugggacccucuaccaaguguccaaggagcacuggaaucagugaguccccgagcuuuccucccccuuggagauaacaccacagcuagugcagcccccggggcucuccuagcugugagcaaaagucggcaugucagagggaggugaaagcagggaggagaaugggcagugcucugggaccggcucgugaaucuccucacaccucucuuugcuaugucagaaccaucgugucccugaucuacaacgugcucaagacuuucauggagaugaacggaaagcuguuugacgagcucacagccuccuacaagcuggaaaaacaacagugaguaccggguggggggcccugccgcugaggacggacagaguggggggcuagcugcugacgagggacagagaagaggggaucaggcacucaggcugcagggagaauggagaggacccauccgggugugcuccgcccauccugugucuguccugugugagugcgcugcccauggcacaccagccacucuuuucagcacccaugcccacuggcugccagcuccccuguaccgaucgaugccucagucaggacagcucaggacccaguucuuccucuccuuucucuccucacaucuuuucuaagcugaggguucccauggaguccuaaucacuuuacaguggggugacagugaaggagguuagacagcuggcagccagaagaggaagagcugccucacccucucuccccagggagcagcagaaggcccaggagcggcaggagcuauggcgaggcuuggaggaacugcggcuacgccggcuacaggggacccaaggggccaaggaagcccccgucccacggccuacgccccagguggcugccagugggggucagagcuagauacaccuagaacaggagaugcuaaacccagagcuaucagccccuccaucccucugcccaggggcccagugaggcccacgccuccccguggccuugccggaguggcucuaggacucccuaccagccccgugggaacagcuuucacggagggggaaacaagaaggcaagaugguagucuuggcagcagaacucucaggccuuuguggcaagauucuggcaagacuagaccagggcaaguaugcaacugggaagcugccaucagggauccuccccugcccuacacagccaggcuccaggcggcagcuaggccucuaccccugcucccagccuggggcauggacacucagcgccuggccagggccuuccucauccccaccaugggggcacagucuauuuauucugcccagcucacccccaacaagaccuuguccagggacauucuccuauccucucccuggcccugacucccuuauccccuuuuuauuuauugggcagggggaggggugagggcacaggcaagaagauucacauuguccuggggugaggggggaggucacaguaaucauggucugcccccuucaccuggcugggggcagauuuaauaaagagcgaaacucaagcauugcuugcuuuauugaggacaggagcgaaggagaauguagcaaggagacugcugagagggccaaccucaucuucacagacgauaaagagggucagagccccgaguuugagauacccaugacaugucaguggcaggaccggagccugagcccuucggggacuaguagcgggagaaacggcacauaucacacuggcaggcccuugcaguaaagaucuca

SEQ ID NO: 9103 - RNA, 20670 nt, Mus musculus
cguccgggggcgcggccuggcgcugagagaagcggcggggcgaaccgggggcucuagugaacagcacagccggaccgagaucgccggcugucggccagcggaagcggcucgggcccggcgguccccgagaugucacgauggcuguggccauggucgaacugugugaaagagcgugucugccgcuacuugcuacagcacuacuugggucacuucuuucaggagcaccucagccuggaccagcucagccuggaucuguacaagggcagcguugcccugcgggauauucaccuggaaaccugggugaggaggcagggcagaggugggaugguguggagagagggagcacgggccagcgaaggguccucgcggaagguuugggcuggaggacaggcaccguguuuggagaggccagugggucucgaccgccuccgccaggcccccuggcuggcccgucaccacuuaaccagaagcuaggagagaagucucugucuucaccucucuaggagagacagacuaggaagugagguguuacuuuaaaaaaaaaaaugucaccaucaucauacggaguuugggagagcugcuuggggaaggggauucccgggagcuaggggagcagagagauguuguggggagccaggcaguaacaagagcuggaacuaggguagucagggaggcuuuggggguguuaagagcccugccaggggcaccuguagaaagauguguccugaccuccucaccccaugauccugggcauaagggguggagaucgcccccggauguggaugucaacaacagcgucacugccuucuguguugauccacaccucgugugacuguugcugcucucuacuuccugcuuuugggagagugggaggggccuagcuuggguuuagggaaggacuuggucucuggcaucucuaccuggagggcagcccuccaggagagguguagagguuuagcuucaggcuagcuggggugggggaugggaggagaagcugggccugaugcucaggaggucugaggccuaggguauggaguugagcaggaggcuggggguggcaggugaggggcauugacucacagcugauggcugggaguagccaaggagccaccaauuagaggcuccagcuaagggcugguauggggucauccuagcuccaagagcaguagaaugggcauguggcagggcuggccucuuucucuuuucuagcuggccuaugggucugcagcuucacuuagaaagagcuagaggugagccaugccuuugggaacaaauauggguugaagagaugguggcaucuucuaauggccugguauaagaggugucugaccuucgccucuuaaaccgcucagaaaaauauccaacaucuggguguucccuuuuuuuuuuuuuuugcuuucagccagaaugccuucucaguccacucucuuguuucuuuuuuuuuugggagggggggcuguccagggcccuggcuguuuucuagccucucccagacagcccaggcaccucacuuaagcccaccccucucugcucuucacccuacaacccuaccuugaaggcauuccaagcaacuacaugguccaaggaccaaguugagcccuucccagccucagcuuuccugguaccuggagugacuaagacaaaugccuaggccucaguguccccaucaauagaagaggaagguugacucaaccucugcuugccucuggcucuggccuuguuuguuuauccgugggcucagcggguguuuaccgaguacuacccagagcaccuggguucuuagggagaagacuagugacucauggccucaggcguucccaggccgacagggauacaaacccagcacagcauccccuuccuaugucuugauuguauagcucuacugugggucuaggacuggggucauuuggccuuggaucaaucccucuccuggaccuaaccuugaacucugccugucuaggaugaagauguguuacuugcugcucuugacuaggucucucugcuucuucucaugccuggggugggccagcauccuacuuccuccaccuggcugcuuccuccucacucuggcucaccuuuggggugcugcuggguuauaugcagguucugcucacccuugccuagugcucagugacuccgagucagagccuggcauucugagacccuggcuacaaccuagccaggcugggagacgaaggcacucauuaucuaucccugcagccucugguugccacauagaaggugcucagaaucucguauaccauguagcccagguuggccucuagcucagcauauacagcuuugaccuccugaucuucuggccuuugcuucccuagugucaggaccacggugagccucaccacauccaguuguacucugcuggagauggaacccagggcuuacugcauguugggcaagcacuuaaccaacuguauaccaggcuggccuagaucuccagacaguccaccugccuaugcuuccugagcacuggggcuaaaggcaugcaggcuaccacaccccgcaguaaauagaguuuugaagcaaacauaagaaggaaacuucuuagcuggcccaaagggcugagcacugucuagugagacagaaacaggucagggccuaagggaaggccuuguaaguagcagaaagaaggaugaccaugccaagagugcucuccaagacaguggcugugugagacuguggcagguagccauauucagagucuuggugagcugauuuuuauuucccuugccucuuacccagucugugaacgaguuuuugaggucaauggagucaccacuggaacugguggaaggcuuugugagcuccaucgagguggcuguccccugggcugcacuucucacugaccacugcacugugugugugucaggccuucagcuuacccugcagccccgccaggguucaggugagagcaggguaagaccacaggggaggcaguugcuggggaugggcccaggagagucggggcccuuuuauccugacucccuuguucuuuuccacaggaccaggggcugcggacucucagaguugggccucaugcaugaccacaagcuugcagcuggcucaagagugccuucgggaaggguugccagaacccucagaaccaccacagccccuggaggggcuggaaauguuugcacagaccauugagacuggugagcaggucccuacugcuaggcuguucuugggcccuccagucuacaggacagggaccucagauaguaauacgguggccaccuuccuacccaggcuggcaggaacuugccuugcuucccaaugccccaccuaacucuagacacccucccucccucccugccugccugccuuccuuccuuccuuccuuccuuccuuccuuccacagugcuccggaggaucaaggugaccuuccugaacacuguugugaggguggagcauucacugggugaugaggaucgaaguguggcuguggagguccgagugcagagguaaggaguacaggggaauggcaggagacaacugccucuucccccucuccuagccaggcuccugggaagggacaggcuugacuuggguugggcauuggugagauuugggaagugggcuauguugggagccugaacuguguauagacauaaaaucacuuagaucuuaaaaacuuugagacucagaaccaaaggcugguugagccuccaagacggaagccagguuccucaguuccauguugcugggacagcucuaaagagggggcuucuagccugggguugucuggacaaggccgggcccuucacucugcagacuggaguacugugacgaagcagugcgggaccccagccaggccccaccuguggacgugcaccagccgccugccuuccugcacaagcugcugcagcugaguggggucugccuauacuuugaggagcugcccucccaggcagacccaccacagccaccucugcaaaucggcagcugcacgggguacguggagcucauggugaggcugaagcagaacgaggccuuuccaggccccaaggugagucccagccauggggaacuugauccguagggcuggaaagacagcucagggguucagagcacuggcuguucuuucagagguccugaguucaauucccagcaaccacaugguggcuuacaacccuguauaauggaaucugaugcccucuucuggugugucugaagacagcuacaguguacuaaauaaauaaaucuaagaaauaaaacaauaagauaaguaaaucuuuaaaaaagaaagaaaggaaggaagaaaggaaagcaagcgaguguuugacccauguuggaucuguucccagaaguguugauugacaccaggccccaguggggagagccaguauggcagaucauccuauaaucccagcauuugggagccuaguggaagguugccuuaaguucaacuccagaguaauuccaguucuuacaguagagauuacuaucuuuuuggcaacuggaaaaacagacucugaaaaaucaaguuggccaagaccauucaacugcuugguagcaaguuuagcaguacaaccaguguccccagaguacgggcagguaggcugccauuugggcuggguggcauauaaaggcuccauggcuguccacuugguccccaguuggagguaucaggacaacugggaucccugcaccugcuuuugaccccgcgucagcuccagcagcuccagaggcugcucagugccgucaaccuugcaggugaggcugcugggugcugggcgcaggggagcagacgggcggucucgggacagccaggcaggcugugcugaaaugucuuccccacagacccugcaggccuggccgacaagcugaacaagagccguccacugggugcugaggacuuguggcucauugagcaagaucugaaccagcagcugcaggcgggugcuguggcugagucccucagccuguaccccaucaccaacccccucaauuuggacagcacgggugggugccaggcccuuuccaauugaaggggcauuugugucaguggaaaagcugaggggccaaaccugucuguuucugacugccccucaccucaccccccagaccucuucuucuccauggccggccucacaagcagugugacaucggcugucucugagcucuccguguacagcguagaccugggcuccucuguucacagcaacauggccuuccaccgacccucaaccccaccccacucgggugguaagucagugacucucagagauguuuacuucaggagcgagguguggcggaaggagccucaggacaguggguggauagaagcaggaggcuccagccaugccuguagacccaccgacagugggguuccucaguguccuaacuugccaguggaagcuggggaggcgaaauaauacacagucuagguuucuuagugagugcuuucgggacucggauccccuuucuacagaacacgcaugguaagaccaggcuguacguuuuagugaacaggcaguguguaggucagaggcugguaugagugcuuugucauaucaacugacccuucuagcaccuucaggauuaaacugagccuugucccagggucuagcaugcaagaagaauuuggugucacccugaugaacuugccuucacgacccaugugauacgacagauuuagcaucccacaguccagcuuagccagacuguauuauuucuucucaaaaaaacccaaaaaacaaacaaaaaaaaacuauuguuuuuuuuugagacaggguuucucuauguagcccuugcuguccuggaauucauucuguagaccaggcuguccuggaacucagacauccaccugccucugccucccaaguguugggauuaaaggcguuugccaccacugcccagccuagccagggugccuucaaccccugcucaguggccagcugugacugcacuaagacaccaaggaugcccuauugaagccucuguucccucaggcaagauggccccaacuccccuucuggacaccacacgcccugacucacuggugaagaugaccuugggcggugugagcuugaccuugcugcagacugcuuccccgucuucaggaccaucugaccuccccacccacuuuuuugcugaguucgaugcugccaaagaugggccauucggcucccgggacuucucccaucucaggccacgcuuccagagggccugcccuuguagccacguccgguaugcacuacagcccgagccagggacuuacggggaauacccaaagcccacgacccacccgcugaaacuuguguccuugcccucagguuaacuggcacagccgugcagcuguccugggagcugcgcacgggcagccacagccggaggacaagcagcaccgaagugcacuuuggacagcuggaggugcuggagugccuauggcccagggcugccacagagccagaguacacggaggugaggacagaggaagggcaggccuggguuccuuccggugggugucgggccagccugaccuuguuugccguggguuucccuugcagauccugagcuuccccagucacucuggcuccgaagccucagcccgacccugcgcccaucugcgccacacacagaccauucgccgggugcucaagguaagccagagcgcuggcugccauggccaggcugugucucccucccuccaggggcucuggcaggccuguccccguucugaccuugcuaugauuguagccugcuaucccuuucccugcccguguugagcaccagcauacgacaaaaaugugagugugugugagcaugugagugugugugagcaugugagugugugugagcaugugagugugugucagcaugugagugugugucagcaugugagugugugugagcaugugagugugguagcaugugagugugugucagcaugugagugugugucagcaugugagugugugugagcaugugagugugugucagcaugugagugugugucagcaugugagugugugagcaugugagugugugugagcaugugagugugugugagcaugugagugugugucagcaugugagugugugucagcaugugagugugugugagcaugugagugugugucagcaugugagugugugugagcaugugagugugguagcaugugagugugugucagcaugugagugugucagcaugugagugugugugagcaugugagugugugucagcaugugagugugugucagcaugugagugugugucagcaugugagugugugucagcaugugagugugugugagcaugugagugugguagcaugugagugugugucagcaugugagugagugucagcaugugagugugugugagcaugugagugagugucagcaugugaguaugugucagcaugugagugugugugagcaugugagugugguagcaugugagugugguagcaugugagugugugucagcaugugagugugugugagcaugugagugugugugagcaugugagugugugguagcaugugagugugguagcaugugagugugguagcaugugagugugguagcaugugagugugguagcacaggccuuguagcccugugggcucagcguuugagaagcugaggcaagaagacaagucaaggccaggcaaccuaagucaaucaaucuaacgaauuccuguaucaaaauaagaaguaauaagggggggcuggagagauggcucaguggguaagagcauccgacugcucuuccaaagguccugaguucaaaucccagcaaccacaugguggcucacaaccauccguaaugagaucugacacccucuucuggagugucugaagacagcuacaguguacuuacauauaauuaauaaauaaauaaauacacaaauaaaucuuaaaaacaaaagaagaagaaguaauaaaggagcugugcaguggcgcuguggucccugucacugcaggguuuacaaccccuucugaccccgauguggcuccugacccagcuccuucccaccgcugggaaggaggccuaggaacuuugguuauggaagcugcuuccuccccuguccuugcucacccuugcugaccuauucacauuaccccuaacuagagccggucccggcgcuccacugccugccauugucacucagaacugucccuggaccuggccgacuuccaaucugauguggagcuggggucccuggaccgccuugcugccuuguuccgucaagucaccacacccucugagccaccugcuggccuacuagugagaugcccugcugauucugugcuggggugggaagugggcacuuaagcucugucaguccccuguggcagcucugacccccccgcccuuccacagacagagcccccacaggccacugagcugcagacaguguuucgucucucagcaccccgggccacccugaggcuacgcuuccccaucccagaccuacggccugaccgggaccccugggcuggccaggcugugcgggcugagcagcugcgacuggagcugagugagccccaguuccgcucagagcucaacagugggccuggccccccagcuccuacccgccuggaacuuacuugcucagaccugcaagguaauccugucuaggaaacagcuggggugggccccaggacaggugucccuuuuuaucccagggacacggaugugacucugggggagcaauggugaggaacagggaagaggcagcuaugaggcccuguccuuucuguccccuccaggaaucuacgaagauggagagaagccaccaguccccugccugcgggucuccaaagcucugaaucccaggagcacugaggccaaguacuuucuaccucaguaaguggagugccggaagggguggcuggagaggggagaucuuuugguguugguggcagggcaccaauaggccuguguccuggcaggguaguggugacccugaacccccaguccaguggcacacagugggagacagccuaugagaaaggccgggaucuagagcuguccaccgagaguccgugugagcuacagcaaccugagcccucgcccuucuccuccaagcggaccauguacgagacugaggaaguaagggccccugacuuucccacugugggcaccauuuaugggacugggcuguggcaggggcagcagcugagaggagucucuucuauucugggcaccaagggacucuguagggagggaaguaccugagaauaggcccuuccguaccaagaccagauccuggcuaugucagcaccuaacauagugguacacuugggucucaggauccuccucugaaguugaagguuggggguggggggggcacggcaccuggggcccuagacgugcuucacccccagguggcuuguguguuuccuccugcaauugcugucuugaaggcuauugugaagaugacagagauucacauucaugaagucuuuaggguagggagggauucuaggguacucugucccauauaaauauaacccacccugggagagagagaaagacugauggaugcauggaugccaaaaucuucaauucugaagccagaaacaggccaaggcugaccuuugucaccugucuagauggugaucccuggagacccugaagagaugaggacauuccagagccggacacuggcacugucccgcuguacucuggaugugaucaugcccagugcccacaucuuccugcccaguaaggaggucuacgaaaguaucuacaacagguggagacauggagccaggcugggccgggcagggccaggcuggaggugcugaccucugaccucugcuguugcuguucuccugucaggaucaauaacgaccugcucaugugggagccugcagaccugcuucccacauccagcgcugcugcucggccgccuggcucuucgggguucaagaugugcaagucagccuucaagcuagguaugagaagaacacuggcuggacgggaagggggagugcaggucuggcggggcggggccuucccuccacaucuccuucccacccagccacuuacucacucagacucggauucagaugaagaagacgcccaguucuucucgauggcaucaggugucccccagacaccugccccagaaccuucccgucgucagucccagaguaccuucuccacacuggugacagugcugaagggucggaucacugcgcucugugaggcuaaggugaggcagcccggaguggggugagcuuccaacuccagaguuccccuuguagagccacacaagccugccagcuucaacuuaggaaccaggggagcagaaagcuuaaagggccagcagcacccauugccacagccugccucccgauucacugcccaucaaccaccauagcugucagccacuucccaaguuuuucucuguaaagcacaagggcucccggugcagcuggguccuucuucuguaagaagcacguggugcggggcuggugagauggcucagcgguuaagagcauugacugcucuuccgcaggucccgaguucaaaucccagcaaccacaugguggcucacaaccaucuauaaugagaucugagacccucuucuggggugucugaagacagcuacaguguacuuacauauaauaaauaaauaaaucuuaaaaaaaacagaagcacguggugcaaaccuccagugauaucugaaaggagcugaggcugccucaggcugggaugguaaggugucaggggugcuggaugcagcggugaaacugagcaugcgcacaucugcaggaugagacagggaagcggcuggaugucacucacggggagcugguacuagauguggagcaaggcaccaucuucagcguagcccaguaccguggccaaccagggcuuggcuacuucugccuggaagcugaaaaggccaaacucuaccaucgagguaugggagucacugaaacauacaucaaacugggcaggggguuucaggagggcggugugcugggaguacggugcucagcagcuucagccaggcucacaggacuucuucucagcggccauugaagacuaccugcuacccacucauuuggaagugcccagcuuugcuccccccgcucagcuggcuccaaccaucuacccaucagaggaaggggugacugagcgaggaaccuugggccgcaagggccaggguccccccaugcugucugcagcuguccguauccaccuggacccucacaagaaugucaagguacaggcuccucggcugcucacaugcgugacuuaggccacuuccuccucugcacacuggagcuggccucucaccuuccugccuaacugcacuucccucuccaggaauuuuuggugacaguacggcugcacaaagccacucuacgccacuacauggccccaccugaacagagcuggcacucccaggugagcaaaggcaccugggaagucauguugcccuggaacuacaaacugauuugggcaaacaggugaaacaugggcugaggcaaccaguguggaaaauaugggcuggacuagagcugaccuuggccagagcuccugauaagggcggugguagacagcuggcaggcaacagguggggugccagcugggccagggacuggacaggaagguguuagaggaggucacucuguccccuccccacacacacuucuuccuccggccugugcagcuccuggacuucuuggaugugcuggaugacccugugcugggauaccugcccccaaccgucaucacuguccugcacacacaucucuucuccugcgcuguggacuacagguaccggcgggggcucggggaagcgggaucacaggccagccuuacagggaagaagccugcuccagcccaagucugccccucaggccccucuaccucccugugcguguccuggucacugcugagaccuucacccucuccagcaacauugucauggacacguccaccuuccugcucagguaugcaggcugccccuaggccugguccaucccacucccagcugacuuccugcugccugucuagccaggaccccauguucucauguccuuagggaugcaagcugucuucacuuccaccccaaaucagucuuguaaccucacccugggaguuccacaaagcaugcaggacaagaagcuagaacacagugcuuagcuaggugcaacccggcauggggcucagcuccacacggcacuggauaggaaggagggagcuaugccuacuguaaccauaauuguaaaagcuggucgguaguuauguggucccagcugaagcuagagcauucugccuggacaacuuauuaagacugucucaaaaaguaggaagagauguagcucagguuagaccauguaccugaugaggacaaggcccuguguugggucccuaggacgagauggauggaugcauaaacagagaccaugcugcaggggcugggaagggcaccuccaugcacugaaguacaagugcaauacgagaauuagaaguauuuugaguaucuuuaagucccaagagagugaguaguguccccuguguccccccauguccccugugcugaggccaacaaagucucagcacuguagcaucuuaggcacuuggaccucccugcccaucaccuccaggaccccuuguaccccuuugcccagcuaccacugagcugccgccugcaguggcuccugggcccuucucagcccuguuccccaccagguucauccuugaugacuccgcucuguaccugucugacaagugugagguggagagccuggaucugcggcgaggugggcagggccugggucgggcucccccacacugaggguaucacgcaggccugcucucauacacauacaugcaugugugugcgcacauccacacagcuggugaugggcagggcaggggcaggguggacagagaccgugaggucucuguucucugccucagauuaugucuguguccuggauauugaccuccuggaacuugucaucaaaaccuggaagggcagcacugagggcagacugguaaguaugaggccaccaggagucgggagaaucguggcugucacccugcuugcccuugccugcuggguuucuccaggagagagccaugucccuguugaguguccuuccaacccacugagggcaaccugcaggcaggacagagguggcccagggagacugccacuuuggagccccgguucucucaucuuuguuaugagauaacaguuccugcaucacuaggcugcaguggggcagggaugggugggugagccguacuccaucagucuggaaugucuacauauuuggguggugagguacugccucagcugacuagacaagggaauauccccuugcucuccccccauccgugugggagacagaguugagauacccugugggaagggcagccugguuugugggggcuccugugccaaugccaugcccaccgcccacagagccagccucuguuugagcugcgcugcuccaacaacguggugcacgugcauagcugugcugacuccugcgcccugcuggucaaccugcuccaguaccuaaccagcucgggugaccugcaccccccaccccggccccccagcccuacagagaucgcuggccagaagguacaggugaggccuggccacgcaggcuaccagagcucggccaggccccucucuuuacacacacccaaggccuggauuggaggagcccuggagcuaccccucccuccggugcucaauccugccccuucccuuuccugccccagcuuucggagagcccugccucccugcccucaugccuaccuguggagacagcccucaucaaccaacgagaccugacugacgcccuucuggauacugaacggcgcggccugcaggagcuggcccagucaucgggucagugagaguacccuagggguagcaggcccaaacagguccccucagccauaucucacacuggccucugucucccacagguggcccacuuccucaggccucucccgucuccgucuaucuguucccaggugaacggaguggggcccaggccccuuugccuccuccuggggccucuucucauaccuuggguucuaaggcaaaggaacaugaaaacgaagaggaaggggacggagacacccuggacagugaugaguucugcauccuugacgccccuggccuaggcauugcgguguguguguugggaugggggcucuuggguaggaggagcagccuuggcucuugacuugaaggaacagauggaacagcccagaggaggagacacaguauguuacacagagauaggaggauagaagaagaggggccagguagcagaagggagggcugugcagugcagucaauguccaagcucaccgaagcuccagguaacaggcccagcaagagacuccugagucugagcaggaaggacugcucagacaugguggcugggcugguaguggaguggggggcauaaaggcaggugcugggcugagcauguugucacacgccuuugcucggcucuuuccuggcagccucgagacggggagcccaucgugacacagcugcauccaggccccaucaucgugcacgacggucacuucucccagccccugggaagcacugaccugcugcgcgcuccugcccacuucccagugcccagcagccgugugguacuacgggaggucuccuucaucuggcaccucuauggggguagagacuuuggccuucaccccacuuacagguuagaggcauguagguagcagcuggugggguuagacuucgggcauagccuagcuacgaccucaggccuccugcaucacccacccugacccugagugggcuagaaggcccucgcugaggcuguagauagcagguguuuccucagagucagcuuucccccugugucuuuuucacagagcaagaguaggccucacaggccccagggucucaccuucccgcuccucuggucccaaccguccccagaacuccuggcguacccaggguggcauuggacggcaacaccagguccucauggagauccagcucagcaaagugaguggcugagcugggggcggacacagaagugaggcucuggggagagagaccacaucagcuagcaccgggcagugggguaugcugaggacagauuccagaggaauuggauagcaggagccacagguuccaggcuaugucacacgugaauaagagacucguccaaaggguuugagcccaaaagggguacuucucagagcucugcugcugaggaggcacggagacaaaugacagaacacgcaaggcuguuguaguaggggggcuccagacaccgcacccuaggagguaggagccagaaacuucaggaagaagcgugaugagacaggugggggcugcugggugggggccagugagucacacgguaaacaagucauggccccuguaggacagagcccagagcauguccuccuguaguuauggagcacggcuuagagaggcuggggcccuccugggcagacagaagguauuuagagacggugagguguggaaggggcguccacagagccucacaagcugggccucugcacuuucaguggagcauaggcugugggaggcuuagguggguuggggcaggccaaguucaguacagcuagauugguggcaauugguugagcugugucagugcccaagcauuucccacccauagaggugggacagggacaggaagguucucugggaaggaagggaccucagccagaccuccccguccuucuugggccugguucccaacucaggccucauccacccgcaggugagcuuccagcaugaaguguacccagaagagucggccauagcugggggccugggccaggagcuggacgagcgaccacugucgcgccaggugcucauuguucaagagcuagagauccgagaccggcuggccaccuccaagaucaacaaguuucuucauuugcacacgagugagcggcugccacggcgcacacacuccaacaugguaagagugcaucugguaugggcagccuccuucccauagcgccccugaaggugugugugaaggacaggguugauggcagucaggaauggggcucccaaggcccagcagacacccaguuuauccucugcccuuagcuuaccaucaaggcacugcauguggcucccaccagcagcgucggagggccggagugcugucuucgagucuccaugaugccucugaggcucaauguggaccaggugaguagaucaucaaaggcagaggccagccagagcccuuccccauugccaggcccuggaucugacccagaacucucccuacaggaugcccucuucuuccucaaggacuuuuucaccagccuagcagccaguaucaaccccauggucccaggggacacuucugagggugagagaccaggccagggaggggagucuagauccuggcugcccuacauccucuguuccauccuugaucugugaccuuuguuccugcagcuccccgagagacccacagccggcccggcagcccccaggaagggcagucugaggacacagagacagccagcaacccaccggaagcuccaggcaguagccacagcuccucugaccagcagccuaucuacuucagguaagguagaggggcgcugggccaggcugucugaaaaccuggccaguggccaguuagagaccagggggucuccucucccuucuuuccccuucagggaguuccgcuucacaucugaggugcccaucugccuggauuaccauggcaagcaugucacuguggaccagguggugagugguucuaucgggcaggcugugugagcugccgucaggguccagugucugggaccaggauucacaguguguaucccaaaacauagccacacacccuguucucccucccaacagggcacuuucaugggacuccuaaucggccuggcccagcucaacugcucagagcugaagcucaagaggcucugcugccggcaugggugagcucccagccccuguggggagagucgacagccuucccucugccuuuucucauggguuguauggcuuuguccaaauccucacucuucuucucaggccucuguaguuucucuguaguaggcuuuuguugcuccacagcacuggguaagacccuggggugaauaggugcucacacuugucuuagagguaccuagucacacugcgccugggcccugucacguccuucuaggcuccuggguguggacaaggugcugugcuaugcccucaaugaauggcugcaggacauccguaagaaccagcugcccggccugcugggaggcgugggccccaugcacucgguugugcagcucugugagugucugccuugagagcucugcuuuguuuaggugggagguuuuuacagaacaaauauggaccaagggaaguaagaaagcuccccaaagugggagggguucccagggaagacuacccuuuuugaaauaauuuuauuuacuuugugugugccguagaguacauacggacgucagagggcggcuuacagaugcucuccucacacucugcgagcccucaguagugaacacaggucagcagaccuguggcagcaccucuaccugcugagccauccugcuggcuauuuuuuuaaaacuagagucucacuauguagcucugucuguccuggaacucacuguuccuggacucagagaguccaccugccucugccuuccaaugcuggggucacagggcacuggcacccuguuuuccuuuugagcccaggcuggcaccacaggcaugcaacagcauaccuggccugugcuuucaagccugaggacuuuugaaauugcacuuggaugcagguacugugccacgcaccuguaauccaagcgcuggggaagcacggacgguaggguugcuucuuacuuaguucaagaacacaaaagcaaccugaauagggcccggggaaagcuacuuagcaagauucuguuuuaacaaaaaaauuaagggaagagaaacuggacuggcaccaggcagugguggcacaggccuuuaaccccaguacuugggaggcagaggcaggcggauuucugagaucgaggccagcauggucuacaaagugaguuccaggacagccagagcuacacagagaaacccugucucaagaauaggaaggaaggaaggaaggaaggaaggaaggaaggaaggaaggaaggaaggaaggaaggaaggaaggaaagaaggaaggaaagaaggaagggagggaaggaaggaaggaaaagaaauuggauugggaaagggucguugggcagagaagaaaagccagggcaggcuuggccucucugauaauccugucuucuaguccaaggguuccgggaccugcuguggcuacccaucgagcaguacaggaaagaugggcgccucauucgggggcugcagcguggggcugccuccuuugggucauccacagccucugcugcucuggaacugagcaacaggcugguccaggccauccaggugagugcagggccggaacaggaaauagauacccuugucccugggcucccgacucugucugcacagucccccugaaagccgaaacuugaaaaggcugggcacaguuaaagccacaugccauggaggcucccaugguggagccaaagugcaucugggccgucagaaccgaccaugucacaugcuccagcugccuggaagugaugcguguccagggagcagacgcagagacccaucccaguuaguucuuccagguucuguguuucacugagccccagagaccacccccuaccaaagcccuggucuucaggggagugauugaguccugggguaggacugggugugucugcggguauguggaaacacugcaucaagagagcuuugagcucagcccucagaggggagggcagaguuccaggggucugcagugggagggggcacaggccagagggguggugggcagaaggcucuauuguucugauaacuguacaggggugcccucuaguggggaacuagacagcuccggcaggugucagcaugcccagccuaggugggaggcccacaggaaaguuuuccagugccuucaaccaugaccaccucacccagcccaaaagacuuuucucuucuuccucuucuucuuccucuuucuccuccucuuccuucuccuccucucccuccuucuucuuucuuauuuauucuuugugugugugccauggcuuguauuugaggucagacaauuuuugggacucaguccucucuaccaugugagucucuaggguuggggauugauuucaggucaccucacagcaaaugccuugaccuugggagccaucuuaccagcccuggaaggguguauaaaugucuccuucaguuaaggagguccuuugaagagguggagagguggcccagcaguuaaggcugaagcugcucucgcagaggcuuggggcucaguuucuagcgcuuuauggguggcuguaacuccagcgccaaaggauccagugcccucuucuggccuccagggguacugcaucacuuggaaucacacacaaauuaaaauaaaugaauauuuaacaaaaauguaggaaguucucuucgguaggugaugggaggggagugggggggugaggcaaagacuggcugggacaggaauagucaugcuggaaggucugguccccaggguggccugcaagggaaggccacccugccaucauccaacccugguguccuucaggcuacagcugagacaguguaugacauccuguccccggcuucuccugucucccgaucccuacaagacaagcgcucuucgcggaagcuacgcagaggucaacaaccugcugaccuccgggaaggcauggcuaaggcuuaugaugcuguucgagaggugaggaccacccuagacccacuugcaggugcccccaugcccaccccucauucucacugaccucugaccuccacaggguauccuggauacagcucaaaccaucugugauguggcauccaggggccaugagcagaagggacugacaggugccguggggggugugauccgacagcuccccccaaccgugguaaaaccaauaaucguagcaacagaggcaacauccaacgugcuagggggcaugcguaaccagauccuuccagaugcgcacaaggaccaugcucucaaguggcgauuggaggaggcccaggacugacugcaggcacccaagauccacccacugucccaacaugcucaccguguccagccagccacaguggugccaccagcucccuguuuuccugauugcugugacccacagcuaggccaccagguccuucaaaggauggccacugugaaggauaccugcccagccugcuuguugccaacuggccgagagaguggggccucccggcuuuggggccucugcccugucugugcacuuucaucuggggagaaaggacauugcuucucccugcuaccugggcccacacugcugccuuguuccagaaugaggauggaggcuuuuggacccauggaccccacucagccaagugucucuccgugucucacggggaggugggggauagaugccaugugggucgguguauuuuuaagaucucugagcgugugggucagugucugcaugaaguggaauaaacuugcccaccgccagcccaggccacguccagguccucuguaccugugagacccca

SEQ ID NO: 9104 - RNA, 7814 nt, Mus musculus
uggcugcggugccuuggcaaccgcaccuguuuugcuccgccccucgagggauggcucguggaaguguggcggucgcgggugccagagucuggcgucgagauguacuaagucugagcaccaucuagcacgugugggcuuccggacacccccaaguacuucagcugcgcuccccaacugcaguguuuccgcuggcuaggaacucccaaaagcaucgggagccucacccuuuggucuuuuagcgacucuggagagggacaggacagcgggaauagggaaagccgagggaguacaggacaccgggaagaggaauaucgguaaggaaggaggaagagugcgcugggacuccacucagacugaugggagagggacacggcaauggaaacaauugacgugaccuagcggggaguuuucaccaaggcggugccagcugcggaaugggguaaaaaguugcagcuuucuggcuagaugaguuuggaggaagugaaaucggaaauacccuuuguaaggaagaggggcaguguugagcaacaaugaaauguugugggaacuuaggggaaauuaaaagccccaaaauuuccgcuuuccugucagggacaccaccaguaccaucucuuguuccguucugagucccaaccuguuuccaguugguagcuguuccccaccaucauaccuggccacaccuaagcccccuuggcugugucugcuggugucuagugggugaugucagagauuuggggacuaugauuguuagguaacuaauaucaggucacccaaguggcaggaggaucuaagggccauuggagaagucuaaaaggcaccggaggaguuguuuagcacacaguuguggucucaacuguuuggaaagguuggaggaucacuugaacccaucgauuugaggccagccucgacaacagacgcugucuuaaaagaaaaaaaaaaaaagacaaaauauuuaucgaugaggcuaaauucauagcuuagugguagaagcacuugcuuagcgugcacaagccaguagggcccauccccaacagcacuagagccaacagaaaaucaugggaacuugaaagccuuggaucccacuugaaaacuuugauuuggaagccugugagcuagacaccuaugugggguuaggcggggagaaaacagugggaucucacaggaagaaagagccguguguauauugagggaucucagucaagugggauccagagaaggcaaggugggaagguucagagaucauugccagagacaagcaaaucccagccugccugcaggcucugggccaggcuucuucuuugaucuggaguuucuccuuuuuuguguggugggggggguauugugagugugccauuuggugagugugcuaugggggugugagugugcuaugggggggugggaugagugugcuaugggggggugaguaugcuaugggggggugagugugccauggggaggcaaguguacuuugguggagggggugagugugccacgggggggagggggaugagugugccaugggggagucaaguguaccaugguggagggggugagugugccaugggggagucaaguguaccaugguggagggguugagugugccaugauacaagucagaagacaacuuucuggaguucccuguugaggcuagacuuugauucuuccucccagccccaugcucccaggaauaagacucagacuaauaauguauuuacaaagaucuaggccauaagcuaggcucuucucugacuagaucauagcuaaauagaacccauuuauaguaaccuacauucugccuuggcugguuaccugugcucagguagcaugcuccuuacaucuuccuggcaaaucucccaccuccuccucucucagaauucuuucuccuccauauguuccaccuucuauuuccuucuuaagccauaggccauaggcguuuuaguuaacaggcaaggcaugcauaugcuucauagcuguuccucuacaacucucuccuucuaccaugugggcccuggaucaacagcccugacaaguguguuguccuacugagcugucccgacaacccucaucucauuagccuucuuuccauccaucacaauaaggcgcagaagucacgggcccccauuuuuaggaagaagcucuuggacaggggcugugaccaucagcugugugccaacucgugacaggagccucaggcaagcccaguccagaccuuggccagccuuggacgcuaaaugauuucugccuccuacgcagccuagaugaggguccgccccggagauguaauuucagggcugguucagagaagagccggaggcagaggauccuaaaugaggugguuguuuagccgucuggauaacuacaugauacugugucuccagcaacacucagacugaccggucauggucuucacgucuccccagaguccugugugcugagaaaacccagccccagaaaacagaaaacaaaaugucccuggguuauuuauaaaugagaugagaugugugcguccacucagcuuuguccaaggaacugagagggccagaagggcuccucacccuuccucuuucccucccucacugaggcucaaggggcccagaaauuaauucccuacuuccccggguccuggguaccuuccuaccuuguaaugucccagauugcaaaacuccuaauuucccucccauuuuugaguagggcacuugcuguuugguggcaaggcguagaaagugaacaagccaugcacuguugguuucucugcuguuuggccuucugucugccgagucacaaacagaugggcaagagucaaggauuugcuuagcucguaaacugcccacugccagugauguuugcacacacaccacacacacccacacacacacacacacacacacacacacacacuguuaggacaagcauuguccccagcagaaaucucccacuuccuugccuucagucuccuugguccccuauugcccugaucuaagaaaguauuuuugggcugguccugguggcaccugcuuuuaaugcuggcauucagaaggcaaaggcaggcaggucucugugaguuccaggcaagccuggucuacagaguaagugccaagauagccagagcugcacagaagagaaaaaaaguguuugccaaaucccuaaagacaaauuuuauuuugaaaacaacguuguauguuguguauguguguguauauguguuguauauguguuguauaugucugcagugccauuggaggccagagaguaucagaucccccgggaugagaguucaagcuacuugugagcuaucguguggaugcuaggacucaaacccuggaccucuuaaggaguacccaguacuuaacugcugagcccaucucaucagguccagcuuccucugccccgccccccuccuuuuugagauguggucucacucuguaguccuggccuaacacuauguagaccagguugguccccaacucagagauuggcucucucugcuuccugagugccgagauuaaagguauauaucaccauaucaggcuuacuaaagacaacuuuuaaaaaaguagaggagguuuucuccaaauauggcaaaagaauuggacuggggaaagcccgaaacacaggcuucucccuggcugaguaguggcucauucuuuccacuuaggaagucuguucagaagcacagauuugcucccacaguuaggaguagauuuggcagcggaccaguucuauuaaaaaggaaacagggcugggaaaugguuugguugcuaagagcacuugccaugcaagcaugaagaccuaaguucaaauccccagcuccucguauaaagccuguaacuccagagcugugauagcaaagacagccuggcuucaaguuccgcaagagacucugcuucaagggauugagauucuccucgagccucucugagcgcacacaaacacagccgucuaacaccgcaaaccauggauccgggugugcuugcauuuacccuuacucccagccagaggcaggugcguuucugugaguucaaggccagccuggucuacauagugagcugaagaccagcccgaauuaugugaugagacugaucucuguauccaaaaagaggggguggggguggggguggggucuguucuuccuccacagguuggguuuuccagugcugguuggauucuugguuguucucaaauacuaguaaggaaaaagucugagcacccagggugucaggugauuugccuuaagaaacacaggccugaaggaaaaauuagaccuuuggaaucugaacuacuuagacucuggcccaucccaccagcaagguccugcaggcggaagggcagagguuuagagccucuuucgaaagaacaggcuagaggggucgcugcccuguggcucaccagcugcuuagugcuuuacaccuuaggcuugccccugccccaggugaugccuguaccugacgcugugcacaugugagcacgcugugccugugccucgagaggcugaggucuagauuccucugagugcuuuuaguuaggcgacaguucaggguucaaguugcucaguuaguggagggcucgccucauacaacaugacuuccugcacaccagcgcuguacauaaagcagacgugaagauggacuuggaagguggaggcaggaagaucaggaauucaggguuacccuuggcuaccuaugaaguucaaaaccagcauucacuuagauaggaucgugagaucuaucuuaaaaaaagaacaaagccaacccaaaaccacuuaagugacaggcuaaaguuaaauauuaggccucuggcugcugaagcaggagcaacagcugaaccugaguuaggugcggcaugugucacccuaaacuaaggacacuggccagccugcaggaaagggaacaauagaggagggcaggauccugggguccuguuaauuuacaugauaagauagauggugacuguagggguuaugguaguccacaccuaugaucccaguuuauuggaggcugaggcaagaagauggaagaguuucaggcuagcauggacuacauagcaagauucugucucaaaaaaaaaaauuguacguauguauuauguauguauacacacacacaaaugaagugcaggggugacuucccagcuuggcuccaaguugcuuaguccaucauauuuaagcauggccauucauuaacuuccucauguucccuccgggcgcuuugaaggguggcucuggccuguggcuugaggagcucauggagucagucucgguccucucggcugggucuccgugaucauggauuuucugucccaucccuuccaaagucagggcuacacugagcuuccucgugaggaauagagagaagcuguguuuccagccaugugacgcagagccuggacccccugcagcaagugcgggggggcccugcccuguggcucucacacccgccccagagccuggacccccugcagcaagugcggcccgggcucucacacccgccccucgcccccagaggcuaggcuguguaagcuaccgugcugccucuccauggacuuaacacucccuccccucauuccuucagagacucuucccugccggagaugugagguggcucaugacaguccuugcugugguccuaacagaaccuuccucugacaggaucgucuuuauccugcucugaaguacaggcaguggugacaucugagagagaggacacugcaaccuuccaccaaggccacguguguccaucucuuggcucacuccuaggacguguugggacaucccaaagacgggcgcagagggacccugccuagagacaaagucgggcugaggucugcuuauuucuucugaguccugacuccucuaucuacaaccagccccagaaucacuuucuugcccuuuugguccuugaggccgguggguuagcauugccaaguguuuccacgaucccugagccuugggguacacagcccaccuaggacugaacacacuguggauucucccugacuguuagaagccacaccuuucuuuccauaaggccauugucucuucaggcugcugggccacauuagcucuuuuguuuauacaguggauugauuuuauuuucugacagcaucuuacuagguaccccuggcuggccuaaaacacuaagaagaccaggcuggucuugaacucacagaucagccugccucugucuccuaaguucucagacuaaagaaggcacgugccaccacaucuggcucuauuuuuuaauuugugaaagaggagcuuacuccguagcuucacuggcccagaguccacagugaugguccugccucugccuccugaacuguggaauuacaaguaugcagcaccacacccaacugguuuugaagucuuuccauucaguucugcaagguagcccaagcuugccuugaauuucucugccugggcucccaggauacugggguuacaaacaggaguggccgagaguggcgucugugaacuuccacagauuucucuagcuggacagagaaggaagucagaaauucaaagcaggaaaaagagacacugugugccagugacucaggccuaggagcccagcuaccugggagacugacgcaaaaaggccacaaauucaaggucagccagccugggcagccugucucaaaccgaaaguaaggcuggcucaguggggaaaggcacuugcugugcaaaccugaggacuuauguucaagcccagauccauugguagaaggagaggauugacucuuaaaagcuguccucuagcagggcagugguggcgcacgccuuuaaucccagaacuuggggggcaaaaacugguggauuucugaguuugaggccagccugauuuacagagugaguuccaggacagccagggcuauacagagaaaccuuaucuugaaaaaacaaacaaacaaacaaacaaacaaaaagcuguccucuaacagcuggcacacacacaaccccgccuccccccccccacacacacucacacacacucucacaguaauaguaaccagugaauaaaaacuaaagggcugaagagacagcucagagguaaagaacauuuuuuacucuugcagaggagcugaguucugucgccagcacccacauggcaagucagaaccaucuauaacuccauuuuccaggguaugugacacccucucuggcuuccugguacccaggguaugcagacaacauacaugcacacaaaacccauacauauaaaauauuuuuuguuuguuuguuuuuguuuguuuguuuguuuguuuugguuuuucgagacaggguuucucuguguagcccuggcuguccuggcacucacuuuguagaccaggcuggccucgaacucagaaaucugccugccucugccucccgagugcugggauuaaaggagugcgccaccacgcccggcuuauauaaaauauuuuuuuagaaaauuaaaaguaaguaaaagauaaagaguggguagcuguguagcugaguggccaucugguaugcagaaggccucaaguucaaccccuacugcugcaagcuggccggggcacucagugacuucuagaagccgacugugaauugagaacuagacuugugaauugagaacaggguugcaucaguggggcggaccuacauuuggcaacuuugugguuguguaaggguaucauauuuucuuaggagauacauguugaaaauuuucauggugaagggucaugaccuguaugcuggucucuaguaguucgggaaaagugugcgugagggagaggggaagcagauguuacccuagaaugccagcuguccacgaauccaaauaaaggguccaugguug

SEQ ID NO: 9105 - RNA, 23413 nt, Mus musculus
ucuucccccgccuccucucgggccagccucgaggcggcggccagcgugcgggaacgccgggcuccggcuuauuauaaaggggcggcucgacgagguucgcgcgacccucggcagagggcgcugucgugguccucacgccggcccucgagccugcgccugcgcggugcgggcagcgccccgcccccugccccucugcccuccgccggccggccggccccuccucggccgcgcgccccagucccgcucagccaccgcuccguccuguagcagccagccccgucuccggcaucauguucagcugggugagcaaggaugcccgccgcaagaaggagccggagcucuuccagacgguggccgaggggcugcggcagcuguacgcgcagaagcugcugccgcuggaggagcacuaucgcuuccacgaguuccacucgcccgcgcuggaggacgcugacuucgacaacaagccgauggugcuccuggucggccaguacagcaccggcaagaccaccuucauccgccaccugaucgagcaggacuucccggggaugcgcaucgggccggagcccaccaccgacuccuucaucgcggucaugcacggccccaccgagggcguggugcccggcaacgcgcucgucguggacccgcggcgccccuuccgcaagcucaacgccuucggcaacgccuuccucaacagguacccaccccuugccccccagcgcgaggauaccaaaggccuccggagccauugcccccagccggccuuugucuccgagagcccccgccagacccuaggcgaccacucccagggacaccggcuuugcugcgucccacuaacuacccgagagaaguuagagacuaggcaucguccacucuucuggcuucugucauucccagaaccuuccagguuuucaguuuaacucucacauccuccugcagaccccagaccuacuucccacagagcggggggcugcugugagaagaugaaccauugcuguccccccuuucuuguuccucauucuggaggcacccagcucauucucaugaaucccccuccuccucugggguccguuuuuaaaguguguguccugggaaaccucgagacuuagauguuccuuuugcuagugugucacucucugcgucacaucuccagggaccagugguuuuguguaggaagggcgcggaggcuaugcuuuggucugcugauuugggggcagcccccuuugaaggcaggggaugaaggagucccaacaccccuccuaaaagcagcacuuacgugaaugccaaaccagccaggaguacaggagacaacccugucucaaacacaacaaaacaaaaaaagcuuaagucaguguugccucaggagacuucagggacuucagggggugguaacacuguggcuccugaaaugaccagacccauagucuaggauagauuggauagacuucgugugucuccuggagucucagcuuaaccaguucccggugaguuagagucagccccucaggaugcuaugaaugaaucacaguggccugccugaggagcucuuaacacccaggaucuuuaagggcauuggggcaucccagacuccucccacaggagguaugacaggacucacagacccugcccucucugcucccucuuucaaggagugacucuacaugccuuucgacuucugcauucugccuaggggaacagccuuggaaagaaugugaauccugcuuuccaggucuccgcccugugugagcacauuccucuguagacacuguccggcccaacagggcgggccagcuuguucuagagcaagcuugcugccaggccugccuccuuucaaggagcugaucuuuaacguccuuuugucccuucuaggcaauuucagccuaucuuguuuuaugauaauggugugugcuugacagccuggguuguauacuaugcucaaguccccuuagccuggagccuuugccuaaggauguuugagcuuugccgccccuguagguaggccauuggcucagauugcaguuggugggagccuuuggucuugagagaaguuuggcugcugggcuaaggaguucguucaugcuuuaggucucugccucaggagagacuggaagacuugcuguuccaacugcugcugccuuccucugucuucaccucacugugagggcagaccucuugugaaaugaggaacuuggcaccuucucaguuucccaccuguggaaauucagaacuuaaagggcuagaggaccgcccacaccaucccaguagcccccagcucacucaguaacucaugaauccuagguccugcugaacugucaagguuaauaaggcuguguacccuguacacucacuacuaccucuguccucccaaaagaaacaacuuaggaggucuggccugggguacagggauccaagaacuauacauccauuuccuucuugccaccaccaauuccagagggucucuaaaugcuggugaaguccaagaccggagcugugucaggaugugccucuggccagggagggcacaacaaagggggcuuuucucuggcugauacagcuuuuccuggaacucuuaaagggacccauugagucaugaacuugauuuauuagccccccccccccagggcugcucagagauagugagaggaacaaauggagacaggcauaaagcaaucccaaaagggguuugugaacgccccugcuugcuuagcuggacccacccacuaguccuaaggacucaacuccccaucccuguuccuagggagacauccuuacagccucuugccuuucuugugguccccuuaccgggccuugcggaguaguggguucucauggaccugcagaugugccuaugggaccucuuugugucuguuacuucucagcgccagcuccacuuccacucuggcuuucuuucacucucucuccauugaguagaggauuucuucccaggcaaggggaauugagguguggugugcagugacuuacagcacugggcucugcuacacuuggacacagugcuuuuuuucccuuuggccugcuguccccggcccauggggagacucaccaucauaacuugggguguggagccacaggagacacucacuuacuugcuccccacuggggaaagcccaguuuuaagccuguaucuggcagaccuugcgucuguauuuucuuugcucagagagcuuuuuaaaggagcccuuucucuguccacuaaagaaccccacccuuuacaucagcugauagcugcucugagcuguucugcuaaacuccuagcucaacauggaacucugauaugcagcuaagcccuuacccaggguucacuaauaucccucuguuggcuuucucuuccuaggcugguuuugacuuugaaagaguggugugucuguaccccuuccacagcgcugacuacugcuggcucauugcagcuucaagcagcuggcuccagcagcagggacugugggcaugcucagugggaaggugaagaccugaguucagaguuccagcacccuuuaaauauuguacauacuggaacuguuuuugcaagccuguaaucccagcacagggguuggaguaggguagcaaaaagaagagaucccgguacacccuggggcccaccagccagugagccuagcugaauccgugggagguucugucuaagugagguagaggaagacacuugaggcuguucucuagcccccguguaccucugcccacacacagaaagagaccacgcuucuuuuagugugggggaguuuagcuagaugguuggaguuucuuuuuuaucgauguuguuauuauuuugcuuuguuucauuuuucgagggucucuacauaacccuggcuguccuggaacucaacuauguagaccuggccagccucacagagaucgccugccucugccucccuaguucugggauuaaaggcaugcgccgucaugcccaccuuuguuacugguuucuuuuacauuuauuuauucugugcaagcauaguugcugcagcacuuauggucagcggaugguguggagcagccuucucccuccaccguguggcucugaacauugaacugaggucauagggcuccguggcgaguguccugcccacugagcagcaucucccuggcccacugaaacagggucauucuguguagaccaugcuggccuggaacuuaauuagcauugauccuccugccucugcuuccuaagugcugggacauuaggugugcaccaccauacccagguuaaaguuuuaagguggaauugcaaguucucagugucaggcgucugucuuccuuuagaacugaagcacaauccgagcucauauggcuuucucuaacaagucagcgucugggaagcugaacucuugaacucugggagaagagggggacagcgagggaaggacuguagcucuaaagcuggacacuucugauagugauuccaguucauuuguccagagggaggagggggagaaaagcccucccuugauaccuggauuagugccugucccacccuuauguaucucuggcguugcuguccugcagguucaugugugcacagcugcccaacccaguacuggacagcaucagcaucauugacacuccugggauccugucuggggagaagcagcgcaucagccgagguaacgggcucugcuggagagccacgccccaugcugcccugggcuucuuccagccccgggcuuuaaacacuguaguguguucagaugacagacuucuuaccucauaccucaucuacacaguggugaccugaggggccacagcugccucgcuguggucaggugaccggaauaguccagcuaagaucacaggugcuuuuggacccaggaggcuuagaucuccggcugugaagcaaaguagcaggaaauggccugaugcuaaguaccccagucagugcugauugcccccuggacuccuugucucuguuugcacgggaacaguuugccucccaguaucauguaaguuccuaguaaguucagccagugugugcaccagccaggcaagaggagaaacuugccauacugugcaugcagccuucucgggcccagcgcaggugggaauuugcuuacauuugcuuagcccuugcuagucagcaggcucccaggccuggcccuagugcagggguuuuccugcuaggccccagugccuuggccaguccaguuguuucaacucugaccagcuuuugccauguuuuuaaaaauugucucauauauuacuuuccaaccacaguuuccccuuucuccucuccucgaaguccccuccccauguccccuuuuccccagauccacucuucuuuuuggggggcgggguaaggggguucaagacaggguuuuucuguaguccugaaacuugcuuuguagaccagacuggccucaaauucacagaguuugccucugccucccaagugcugggauuaauggcgugcgccaccacaccuagccuuuugccauguuuuuuuuuaagugaaauagaacuuuauuuccauaaacauaaagauaacaccuuuuaaaaguacuuaaaagaggcagggaggacuguggguauaguucaguuguccgccuagcaugcagaagcccuguguucaauccccaggacagcaugaacuaagugugguagcacaugccucuaauuccaucacaugggcaggaauagaggcaagagggucagucauuucugaaggguccauuacacagcaagucuaggcuggccuagguuacaugaaacccuugucucaaaaacaaaacaagacccccaucucagaggggcuggagccucaagauguaucccagcacugagcacacagaccagggcccccuaccucccauguguuugucacauugcgcgaaguccugguucaggaugacccugucuuuguuuuaucucuggaccuuuuagagggauggucaccagcauuagguugaaaugccuucuaggagaagaucaaggucuggccagaugugguuagccacugcaaaggagcaaauaaaauaaagagccuuucuggagaugcagcuuauggagagagcacugaccuagaauacacagggcucugaguucaauccccaguacugccacagagagagaauaauagacagacagacaaacagacagacagacagagagagacagugacagcacacacacacacacaagccagcauauaaagggaucacacaccucgugaccuaaguugaauccuugaaauccauaucauggaagauguaaaccaguucccacaagcauccucugaccuacaugugugugcuggaguguucacacgcacauuuguagaugucauuuagaagucugaaagaaagaaaagagaaaaauacaagagcuuaguauagcagcucuaaucucuacauucaugaaguugaggcaggaggauucuguccauucucaaacucuacaaacaccagugguucuaguuuguuuuucauuaacuuacucuuuccuuuggcccuugcccuauggugggggauguuaagccagcagccugccaccgagcgccucugcugucgcuguacuaggcgugggcucucuccucuuuucuacagucgugggggccccagccagcaugguguugcaucagacuuacagugcaguaagcugacugucucuaaucagguuagaagcugcuagaucagcuuuuacuuuugagacagggucucauggugcccaagcugaccuccaacucuuucuccaucugucucaccgucucgaaugccaggauugcaugugggccucaugacugccucccauuaagcuuucaggcucacccacucuugaugagugacuuuuuuggaaguucagagguauagauuuugggauccuuugcaaaaaagcaggggccacguuucuucuugcagcucuucuagucuguuucuaagagacugcguacugagcaggugguauaagccuguaaccccagugacugaggaggaugggaaacaucgcaggcuuaaggccugccugggcuacagagcgagcucacagcacaucagugagaacuuguccccacauaaaaguuagaaggugguugggagaugaaucaguuggugaagugccugccacacaagcuugcgccuguaaagcuggguauggcuguacaugccacuaaccgcaggacuggacaacagagguaggagccuggggcucacuggccagcuagucuaguuaaguagugaguuccagcuucagggagagacccuguugccaaaccaacaaaggaagagcucugauacugaccccggccccacauauauacagacucauuaacguguauacacacacagaaggaaggaagacuaaaaacaauauuggcagauagagccuuugaccagcaugcauggggccucagguucaagucucgucaccaaggugaaaagaaaaucaaaagcgugggaagcagugcaccuuucuuuucuuuuuuuuuuuggagccagggucucacuaugccguccuggcugucaucaaacugucucuccccagagcuaggauuaggauuacagcuguaugccaccacgccuggcaugcaucacacuuuccuuuauccuucuuuccuuccuuccuuccuucccuccuuccuuccuuccuuccuuccuuccuuucuuucuuucuuuuuuuugcuggaaugccauuacucaggggccuucagggcugaaguugggauguuggaggggaaagguuugggguccuuguuguccuuguaugcuuauaaaaugacccaaaguaacucaucaaagccagaggagagcuagaaaauccaaguacauuucucuuaaauaagagaagugcgggaggcgcccauccagccugcccugggcggaggugagcggccauuguuugaggcccacagacuuaucuuuuggcugaaccagacuccagccggcuagcuguguggugagaacacagccucagauaagcgacaauaguucacccucaaaggcuuaucuggccagagcucugcuguuugugccgccuucgggcuuggagaaagggaugggguagggaggguuuaagguuccgguggcccuugugagcuccugaaaaggagcggcuguucugcagcgugucccagcgugguucaucugcucugcugacugugccguccucagugugcccaggcaagagcagcuuggacuuuaugcccugggauccccagcgggccacuggggccacaggaguguggccuuucacagugcuuucuguuaggagagacaugacaggaucuaaacuuucuugcuaucugagaaaaccacccaagggaugcuuuaugaaugugcugugauggaacccagugccuccagcgugcugggccagugcugugaccauugagucacccccacccccacccuaccucugcagcauuucaacuggggcuauagaggauaccagcauacuuagacuggacaugcucagggagccugcaagugacaugacacccuaggccuguggcuugcugugccucccagguggcaaaggagucccugcaaccagguuguucuguauuugagaagaccaagaucaaccaguuuuucuaaaccauuuuccuccauaguucuguaguccccaauuaaaugucccccaauuaggaacugggggugaacuuuuuaugguggugaguaagaugucacuggcuuguggaugagggcggaccccucucaggccccacccaccagucggguccuuccuuguguacacagggaacccgagugggagaguaugcuccuguucccgagcagaaagcaggugugucccucucaggaagguaggucccgaggagcucgggucuacacagauggcagccuugccgcagucuguaguugaucuuugggaaauacaauaucccccagaggucgcuuguacuugagcagagguugccaacucuggggucauucccacucuugcuuucccacuccccuccugacuuuuuauccuuccccccauggucccucaugugcaggaaauucaaucuagagagauaagugggacuggcauagaccacgguggucaaacucccugacucugcuagagacccuugauaauugugccccuuuggggucccaggcucacuugccuggccugcuaaccugcugcugcuugagagauaacauucucuugugucagcagggaacaguggccucuaggagcaccauuuguuccugagugcuacccgugugacugauaaagggauucaaagggcauccagggcugugugaggcuggugcccugggcuuccaggaucauuaccaugacauagucccaccaugccuaggauuggggucuucuuguguaaguccucugugggcaguggcagugaacgugccaguguucuuugucaucauugucacuauaugacuguggccggaaguguaacuuuugugccuugcuugacccccaaaaaauaauaucaacaaagagaguauggcuucagcguggguuaacaaguagcauccugucuggccuggugccugccuucuugcuagcauugccucgucugugugccucacuguuuuuuucuguagcccuguauagguggaagccaguguuuuucugauggggagcuccaucugaggagauaagccugggggacucaaacuggagggggcucucugcacacugcaguguagcucagagaaacugucggaauggacucugaacuggggucagacccuggugaggcuguugcuaagcuggccuucuuggaaacaggcaaccaagggcugacccuaguccagaaaaggaguaaggcuuugauagcucuccuguuaucuuuugucuucccucugugccuugccucuagccagauaccaacccaggccauccagggaaagcuuacagagcucggggccagucgggcgggccagcucccuggguuuucucugccuuccuacccgauguccugguuccagacuccaccgaagcuauccucuuccuagagguuggauggaacuuguggcccagacucccauucaugcauucuggaggccaggaccagaaggagggcuacacccugaguagcuuuucugaggugcuugcauagacucgcuccagcucaggcucaggcuauuuaguagacaagaucucagggaucaguguggagccgggcucaguacuguacccugguuucacaguggcuaccacauaggacaacacagguuuagcuuccaagucaguacugcaggagccaagugaccagaacacacgguccucuuagaguugcugauaacugugcuagggacuucuguaugcugggcucuuagcuaaugcuuggcacauaauuaagugugcaaaaugaauaucugccaguuaaugaugagacuaaaaaccccaggguuucccagacuucacuguuuuauaaguaaugucuccgaggcaccuuaggcaauacugccucagcggggcuucuacucagacuccucaauccccugagagcugacugggcucaaagccuucaacccccauccugcccugucucccccucucuaggcaagcuuguugcuuuggccucgcucucugcugugggcgcgcagacucugccuguggaggcgucguaccaggcugugcuggccuuggcaccuguuucucaggcugccagucggugguagacuagggagcagcuggcccgagugccugcaaggguuggguuucuauuugggguccgcagcccucuucacgcccuagaagcugcccuugccugcacauccaucagaugugagccucuugggcccaguacaaaugccucagacaaaugggagcaaacauugacaaagugcugguggucuaucgggcccgcacugcaccauugacaaagugcugguggucuguugggcccgcacugcaccauugacaaagugcugguggucugcggggcccgcacugcacccaagccuccagcagccuccuggugggaaccugcucuuuccaugucauagagaagggccuggggauucagagaggauacgugaccugcuggaguggcccagaugccuccugaguguagggaguugaaggcugaaauguggggugggcccaacuggagugucugacuuccuccaaacccuuuaccaucacuuacuccauuauauuguagguguguuauaccuauuuagggccagguuacauguugaagaaucguuuugugcaacagccauauccccugcuacuaggauagagagcauccuuugaacuggaaaaguucccugugcagucccucucccuaucccgggaacucauuugucuuugaagcuuaagcuugccucuuccagaauguuucugaagugggugaggucagacaguauagacccuuugguacuguucauuuucuuugauggaccugacccuugugcgagucauccauguuuaaggagguugggguuugugccuuucagaagugcuuguuucuggggauggagucagauccuaaagcuuccuguucuucagagaggcucugacugacggguggaccacaucgaagcccuuaggcugcucucggggagggguggcuuccccucuugucauugcugucauuuuagaaggaagucugggcuauccaccguggguccaaagcacucuugaaucaagcugccaggaacaucuguguacuggaccuggcuuuuguuucccuagggcaaaugccuaggggcggaggccccuugcuuagccucugugcuauuuggagugauccuuccuuaaguuaaccaggaggaauccucucugugacuugucccaagucugggcuccugucuccagggccagugccauuggaaacugugauguagcucuuuggugagaaagagugagacccgugcaguuugaaugacaggaaacaagaguguaugggaaacaaacacuccauuguuuuauguucuagaaaucuuuggaauguaugaagcagcuuucccuggcugauggaacuaccuguguucguucaaagggugcugcugcgggguggggugcuucaucacagccccggcucccaccucugacccccucuugucagcuuccugacaacuaacuuguaggcgggccagcagcaccugguuggauuugggcucccuucgcacaguagcgggccugagggaggcuugcuccugggcccgcuucgguuccugucagcucucagcacugcacuuccgugaggcuccacuguggugcuccucucuacucccuaaccacggcuguaauuuuguuguuuuuuuuuuuuuuuuuucuuuuuuuugguuuuucgagacaggguuucucuguguagcccuggcugaccuggaacucacucuguaaaccagacuggccucgaacucagaaauccaccugccucugccucccaagugcugggauuaaaggcgugcaccaccacugcccagugguuuuuaauuuuucaaaguuauuauuuuauguauguguugccuguaugcauguuucuguaacaugcuuggugcccuuggagcccagaagaagguauuggaccuauuggaacugggguuauggcugccaugugggugcugggaaaggaaccuggaucuuuugggagaacagcugguccucuccacugcugagccaucucuccaaccccgaguuuucauuuuuuaugacaggaucgucucuggauggcaucagcuugccguggacuaagugcuagaacuguagggugugcgccaccacgucugucuuauguuugcaguuuuguuuuuaaaggcagaauaucagcccuguguguggccacaggccuuuaaucccaggacucaggagacagaggcuggaggaccucugugcucaaggccagccuggucuacauagugaauuccaggacagccacauagugagacccugucuuagaaacaaacaggauaucauacagccugugcuggcccuaacuucuuauuucuccacugaugaccuugaaugccugauucuucugccucuacuuuucaagugcugggacuagaaauacacauuaucauacuugaauuuccuuuauuuucuaauuuuggagaaauguaccuacuauauaagcuguaccguuucccaccgucuuggagagcagugggguuuggugccgcugcacugcugugagccaucacacuguuccauuuucccaaaaccuuucagucagcacugccaccuugccuuccacccuggcccuggccccagugucuucucugcaucgcccccuggcuuccucauaggugggccuggcugcuggggcuugucauacaguuguucacauggccacuccuuccuuaucugagaugucucugguccccacugaagucccucccccugcaggugggcuucuccgucucgucuauccucucaagcugugugcucuguauccuugguggaaacugguguccgcucucucuagccagacgguggugcagggugccccuguuagauacucuuucccucugugugugcacacagcuaccuuuauguuguugugugggugggacggacacgcacccugcggccugcuguuuugccagcucugucaccagcuugaacuccucaccgagagccgggagucugcuuuugugacugcguggcucuccugggcuccauguccauugccacccuuuggcguccagggcuccuggaaaccaguguccucucucuaaauccacauaagacaccugaguguaaugagggacaaucgguucaauagugccagaugggccugcggguggccuacagucauagagucacaugccugugucaacauggcugcaguccuuuggguaaucagugauguguuuggucacccagagugcucucuuuucacccaaagcguguuucccaccagagggaaaagguuuggggccauagucggucgggcuuggaaggugaccucagaaaaaucaagcaugguagcucuuaucugcaaucccgccccucaggaggcagaggcaggagaauugccaccauuugaagccugcuuggaauauggaguaauagccugucuuuuuuuuuuuuuuuuuuuuuuuuaaagauuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagcccaagccugucuuaaacuccaaaaauaauuaaccgggaaggucccuucaccgccugagaaagaagaagagacuuaaugaagcugaacaugauggcucaugcuuuuaauuccuguauuugagaggcagaggcaggugaaucucugaauuugaugccagccuggucuccuagugaguuccaggccagccagggcuacacagugagacucuguccccuagaaaaaggaaaagcaaacccaacccagcuaacugcagugcugcggagaaccaggcgggcgggcgggagggccaggggaagggccuccucccaucgcucucauucaguguucccuucccccaccagaggggaaaggauuggggccauagugcucagggcuugggaaggugaccucagcuucccugcugaaggccugacugccuagccaaagccaacaggacugguggugcuuggccuggaguuucccuguucgcaggaacugggguuuggccucgcugcugccccugcugugugagguagcuucagcuuuggauggggccaaaugggcugagugggaaggagcagagccucucuuuggugagcaggagugucaguuccugagucagcacuucuucagcagugcuguguuccuagaacucacguacaaggaaggccucagggccccggacaggcucugggcucagcugggguacagcucagagcccugggcagcagcugccucuccuggccucugcuucccgcuaugcugcugcucuagaccuucccuucugguuuucugcugacagcucacuccuccgguguccacucccugcucccagccagcugcagggagcaaggagggccuuguacuuuggaacuggcuggcuguacuggcugcugaaaugcagugugaccuggcccucccugugcacugauaccugaagcucugacacugaaccagccgcacaccgacugcagcucaguguaccuccgccuucaagguagccucaauuggcugacuaaugugcccccaaguuccugugugucaagaauguagaggucagaagacaaccuuguagagaaggguucucucuccaccuucacaugggucccaaagaucaaauucacugccaggcucguauggaaagcacccagaucagcugagccaucucauuggcuuuguucuucuuaauuguuuccugguauugccuggaauugaacccagaacuuuguuuuugcuuggccugucuagccuagcaccuucgaagugccaccaccccagcuuuauacacagggugggggaacauugagugguacccccccuagcuguacagugcagcaucagcaggccuugaugaacggggugguggggaauccugugccagcauguguaguccuggacacuguccuuuccucgggacuucccccuacagucagucugucugucugucugucugucugucugucugucuccugcaucugaagauugcacgucagcccuccugagguugggcuuggaguaguuuucccagugcuagagcgguuugugaggcaagaguuuggcuggaccagccuguuccagacugucuucucucugaguugcuucccuggcucaucuuuuggggucuuggcaacuuucugggaaguacuaagugguucucagagggcuggccuacauuuggggugaccuggaaccugugaacauucaguaagugacaggaaacuuaguccaggcaaagagaaggacaguguucagauuccgcggagaggucaggcugucaugaggcucugcgcagcuguuuccagucuucccagcucugcuugugcuccugacgggcaggcaggggucucaaauuugggagcagugggagagagcagcagggaagcacaguugucagacaggguccagaagucccugagcuacguuuacguggaaagcgaccagcucugcaaugucggccgugccacuucccuucuugccgcccaggcuaugacucccuccaguaccugccgucccaguccucaggaagaaaacugcgagacucacacuuaaguuuuauuuacuuguguguggagccacagagcaguuguggagaccaagaagacagcuuucugugcuugccccucuuccuuccucuggguucccgggaucgugucagcagcaugaacagcaagugcuuuuacacacaaaccgucuugcuggcccgaaaucauacuuuuuggggguguaggggggaugagggguauuuuguucaaaacaguugcaugucacuuaugcuguccuugaauguguucuguagccaagggugaccuugaucuuucuuucuuuuuuuuuuaaagauuuauuuauuauuauacauaaguacacuguagcugucuucugacacaccagaagagggcgucagaucucauuacaggugguugugagccaccaugugguugcugggauuugaacucaggaccuucagaagagcagucagugcucuuaaccgcugagccaucucaccagcccaaccuugaucuuucugccucugcuuuccaagauuuccaguauguaccaaccaccaugccuggcuaauaguacugucagucauuaauggggaaauucaguuaugucucugucauagaugucuuagauggcaaaggucacuuuaauugggaugggaaacagcacagaguaagguucaggacuagagucagcaacuuggcuuuagagacgcauuuaagaccuacacaaaagggaaguggucugugguacuuuugagggcuuguuggagaacaaaagucagcaaaccuuuuccuugaauuaguauugucagcuauguagagcuuuuaguuucugcugcaacaaucaaacucagcuauuacagacaaaaguuggcguagccauguaaaugagugccuuuguuucaauaaaacuuuauucauacaagcaaaugauaggccaguuuugguccugagcuuaccagccccuauuguagaaaaugagcaaggcuuguacaaggaucugauguuuagacaccagauagauggcagcugcugauugcugcugcuuauugucacugcgcuguucggggcacagagcuggcggguuucucugugccugugucacugugcugagugagcuguuaaguauaaacuaguagcaugcuuuggcugagcaucugugcaugucauguggguaaaaauaccccuugaggcaagaaagaccgugagugugcggugagcgugccuuugggcuguauaguaguguucagaucagagcauuuuaggaauuuacaaaauaaccuccggccuagaacuuccagccacacuggugcucggaagcacuggagcagccugggccuuggagucguguugagcccucuccugauccucccucagguuaugacuuugcggcuguccuugagugguucgcagagcguguggaccgcaucaucuuguuguucgacgcccacaagcuggacaucucagacgaguucucagaagucaucaaggcccucaaaaaucacgaggacaagauccguguggugcugaacaaggcugaucagaucgagacgcagcagcugaugcgaguauacggggcccucauguggucccuggggaagaucaucaacacccccgagguggucagagucuacaucggcuccuucuggucacacccacugcucaucccugacaaccggaagcucuucgaggcagaggagcaggaccucuucaaagacauccagucucugccgagaaacgccgcccucaggaagcucaaugaccucaucaagcgggccaggcuggccaagguaggccaugggcucugcggcuggcaucuggggccaagguagccaugggcucugcggcuggcaucuggggccaagguagccaugggcucugcggcuggcaucuggggccaagguagccaugggcucugcggcuggcaucuggggccaagguagccaugggcucugcggcuggcaucuggggccaagguaggccaugggcgcugcaacaucacuuuaucuguguguccuauguacccacugugcagccugugacucacuaagguccuuuacuugggucaucugagccuguucuuucugaggcuuaugccuuaccuagaucagagagugcggagaacaugcauaccccuuagaaauaccaaacaagaagugacuacagaagaaaggaggacacggcaagugggaugugcuggccugcuuggcuucaacaaaccccugggguauauugcagucuaguguucucagcuuggcacggaacaguguggacuuacuuggguagggagugacacacagccuccauucaagccuucauggaagaacaaugcacauacaaagaagcauugguuauuugguauugcucaguaggcacaggcuuccgccugaguggaggucugcggagccauccuggugggaugggauuugggaggccuccguaggacaugcuggguaagcugggacaggaaguagcgagagaaaagaugguaccagucgguggcccagaaagugcuggaugcuaccguccagaucccuggaggcugcugucugcacaggccauauaaacaccuauucccauuugugggagcucaggcggggcccagguccaauaccagcuucugaggcgcuugaagcccaggaaccuuaguggccacuaagccugcaugagagcucagaauggccagagcuaggaagugaagaucagugccaccaguggacuuaggggaggaggcucugcauuguggcuugcccagauagucacugggagggacuguuccaguaauggcucaggugaccccuuugaacaugaaggucugacauggaguggaugcuaggguagugcaccaguccagacaguuagcaggguucccacugacccuucagcugcuuagacauaguucaguuucuucaaaaaauggacggacucuaagcagaugccacaaugaacccaucaucagacuacucuggaugcugaggcaggaggaucccuugaacaguuugagacuagucugaacaacauagcaagacauggucucaaaacacaaaaguagguucucgccuggccccucucuggaaaggggcuggccuucagcucagaagaccuguccuaugagguacccugucuccaggauagcaucucaaagucggggguguuuacaacugacugggucgcauagagugggagagauagccaccaagugccuauggccacugacacaauccccucaaggccagagaaggugcuucccagccaucccguccccacugcuguuugcagugcggaggcugcugucccuacacuagaucccaggcccccaccucugcucaaggccagucauggaauauuugggggugccuuggucaggaaaccaaggcugauguuuuguccuuuacuacugccaaguaucagccauugucacucucaaguaccuggccagguggcagccagccuauggcauuucccaucgucuuuacaggguccuaggcugggggguuuucaguaucuccaaaagucuagacauguauggccaccuugugagcugagcaguucugagaaaggaacucaaugagaauaucaugagaauuggcccaggguccuagggaacugucaggcagcacucaacucucacagccacaggccucacgccuggaaccucuggucuccaguguccuccucacugcucuuagcccucugccugcuuuuccuggagggaaaguaacuccuuggcuuaggcagacagaggugugacugagcuuguaugaucugccugccauagcuuucuuggaagaaccaaguugccaaccccaggauugaaaaggacugccccgggcugagcagggagcaguggguguguugaggggagcucuggauggaauuuccccaucuugagucauccuggccuguuuugauggcacauggcauaucacucaagugggauucuacuugggacuucccauguacuguacagauauaugucuggcagaggcucauucacaacuuucuauggcucugcaauguguugcuuuuauuaucgggagggggcagcucggggagaaaacaggcagaacugcguuguaguccacucucugcaguccucacauaguucuugacaaaccucugagccuccucugaccacaguagauuuggaugcaugagaagggagugccucuaagcacccaucuuaugacagacucuagagucguugucucuagaaugucaccaugacuuguacaagaauggguuggagagaugacucagcaguuagcagcacucaggcucaagucccagcacccccaacugucuguaacuuuagcuccaggggauccagaacccucacacaggcauacauguagucaaaacagcaauauacaaagaagauagacagacagacagauagauagauaguuuuugccaggccagugguggcacacaccuuuaaucccaguacuugaaaagcagaggcaggaggauuucugaguuugaggccagcauugucaacagagugaguucuaagacagcaagggcuacccuguuuugaaaaacaaaaacaagaaggaguguccaucuucugugccguguuagaggcacccuuuccuccccugcccgagcacugagcuugaggcacuggaggccuugacagcccugagggcagcgugccaagcaagucccugaugcccacugcuuccucccucagguccaugccuacaucaucagcucccucaagaaggagaugcccaauguuuucgggaaagagagcaagaagaaagagcuggugaacaaccugggagagaucuaccagaagaucgagcgggagcaccagaucuccuccggcgacuucccaagccugcguaagaugcagguacagucaccaggccagccugcccggggcuggguacccagcucuauagaacagggccucuacaaaaggaagcagcuggguuagucaccaguucccuaucugagucagaguugaccuaggucgagacacugacacgaaaaaggggaauguggugacucagcuuugggguggggcauggcuguuggugaaucuucauagcccagcagggauagugcaguugugaccucacgcagagugaggagcucaggccuguggcacuagcucaguagccugaacugguagguggaagccccacuccccugcuuggauagucuagcucagucuggagucuggaagacugccccaucuaggccucuccuuccuucuacacucacaggaacuccugcagacccaggacuucagcaaguuccaggccuugaagcccaagcugcuggauacaguggaugauaugcuggccaacgauauagcucggcugauggugauggugcgccaggaggagucccugaugcccucacaggcugugaaggguggugcuuuugauggcaccaugaaugggcccuuugggcauggcuacggcgagggggcuggcgagggcauugaugauguugaguggguaguuggcaaggacaagcccaccuaugaugagaucuucuacacacugucuccugucaacggcaagaucacaggugcuaaugccaagaaggagauggugaaguccaagcugcccaacacagugcuggggaagaucuggaaguuggcagauguggacaaggauggccugcuggaugacgaggaguuugcccuggccaaccaccuuaucaaggugaagcuagagggccacgagcugcccgcugaccuuccuccacaucucauuccacccuccaaacggaggcacgagugacuuccaugccugagauacccuacaacccccagggcugcugccacuuucuacccaccagcuccuugucugcccaggugggcuggggccuggaggggcagaaauugggggagggaaagggucaccauuuuucaagguccauaaagacugagcgguguuuccucagcucuugaauaggaaaaccaccaucuuucuuuuaaagcuguuccgggguucagcgggaggcaugggugaugcuuggauaugaacagugggauuuugugcacaggaaccaugauauuuuuaauauauaacauuagaggcagccuucuuucuugccucuucugucugacagccccacacucauccucuccccuauccaagccaggcaccucuccaccccacccuggcaccccugugcccgaugccccagggcuguguaagcaggaggucccugcuccuucagcuuguuuuuagacuggggcucccucaagggcagcagguuguuuccugcuagccguguucugugcuccaguccucugcugugcuguggggugcacaccuuacucuguccacauccccugacaccccagccagcacagcagccacagguagaagacccaaccacuguuauuuguuguggaggcaggaggaguugcgagacaguccaugacgucuaggaaaaugcauaagcuacuuaguguucuguagugacacuugauacuugaccaagacuuugaguaacuuacaucacucguucaaaacugugauuuuugucuccucuuuccuauacuccagccuuggagcauuuccaccccagagccagcauagagcugacauccuagggcuugaguuugcuuucuggcugaggggaggucaucccagcuucugcucagaggggucugaaauguagcccccccacccccgccccaaggucaaccuuuauggcagcuuccuggagccccucucugccuugggacaggcaguaggcccugugaccugggguggucuggggcugguaagaggaagccuguggcucuggccuggguguaguguccaugcagcacgacaggggaaaacccagccccuucccucgcccugucauuuccuuccucuccuccucugcugagccaaggaggucuggguguccugagagccccagacugagcaguaagaagccugagcuagcaaaugaccacuuuagucaccccacuguagccuggggacccggacacauccuguggccagugguuggcugucagggugggcuuuccacugagcuggguagggcauugcagccugcuccucugacacuguaggugggcuucagggagcugccugccaaccccccagcacuguucugggcccugcugagggugagcuccagccuggccuguuaccucccugccucagcccuccacuccuuggcugagggugagagagaugucauccucagcuguagagggaguggccgaaugaagacugguucucgcauuaaaggaaguuuaauugugccaaagccu

SEQ ID NO: 9106 - RNA, 19212 nt, Mus musculus
cgccuucccaccuucaccuucagccgcggcucccauuggccggcgcgcaccugcccguccgucgggggcgggcuuggagggcggggcgggcgaccaggugaaggagcgcggguggcgaccgaggaaggugacagcggggagggcgggagggaggggggaagccgcgcagaacgagccacgggaccacagacggaccgccgggcggacggacggacggggcaugcgggcggccuggcucuagcccggguuucggggcuccagcggcagccauggagcagcggcugcgugcgcuggagcagcugguacggggcgaagcugguggcagcccagggcucgacggccuccuggaucugcugcugggggugcaccaagagcucagcagcgccccccugcgccgggagcguaacguggcgcaguuucugagcuggggugagugguccgggcaacacccgggaagggaagcuggagggacgacaacaccuggagcuuugugcccccagaccuuuucccgggaguggcauauuccugaaacuuccucauugugcuguaucuaacgcuugccguuggucuccacagcccgcucgcucaccugcaccuuacuucaaacucccagagacagguacauaagguacacuucccacauacccugcuacagaccccagacauguugccaauacacaucuuucacaacggucaccucaugcucuaccuagaacauacauuuaggcggacaccguuuugugugacauaaacauacagacuuucucuauuuccuccguucuucaagaggacgggcacuuuguucuaggaccccucucaccugucacacacucaaaaguccucguccuucaccuugcagacaagucuccuuacuucaaucccuagccgggaccaagaaccaaccucaaccccuuuggaggauuuggggucuuguuagaagugguuuuauuugauucgucugaauccuugggaauggcugacuuagggugauccuaaacccaaugugggcacuggacacaucuggccaggcuuuggugaggagggcaugggaauugggccugaaacaugggguguuuacccuguaggcgaucagaguucuuggugcuccugagcuaugggcagacacaaggcuaggccaaauauggaugggggucuaccagccaguccugccauuucuuucuggggugagagcaguuagacggcccugcccccguugccugccuguuucucugugacucuucuguguuuuacaagugucugauuugucaucacucccacaugacaccuguaccugggugugugcauguggcacauguguguguguuuacacauauguguguuucucccugccugccucuggcaccucugcuugggaccccaacacagggcaugucuguugacuucucccgagguaacuccaaggccgggugugacucacgccucuccugccccaacuugucccugcuccugcccagagcccccaccccuucuggcaagacaaagguauuaggcauccuguccaggagguuggaucugggcaccaaguuuggccaauguggcugguggucaccucugauauuucugcaggcuggcagcugcuccucccuggcuccaugcauaaaccugggaagagacaauuaauuucuguagugagguuugcacaccucccccgcuguggggguucugccugauaaaccuguggaacagcucucugucccacccacaggcccgcccagcuggcagggaguuuaccuucuggcagggggaaacugaggcaaggugccagaucguagaugucccccaguccucacuggucacuccugucuucaucauuucccaagacucggugcccuucccccuggccuacagccacuucaguuauggggagagccugggagugguuggaccuagcccuugcggagguggugguagggcaaacagacugugaugcgggaggagguuccugccuguauaagccccauccagagagggagguagggcucuaaguggcagggcuaucaagccuggaaggaauccugugugcucacacccucaggugcuggcauugggcaccaggugaaguuuuuggcccuguuugagugucuugugaguaccugagcaggcugguaucuguuccugacccagaggccccacuuggggaacacagagccugucuuucuggagcacuguagaaaguguccucccugcccccaggggcuaccccaggccucaccuccagccagauugcucugugcuacaggguccccagacccaggcccacaguuccugaguggcagagaaacuuucuggggacaaagaaugucaccuauccaguuucccagauaggccccugggcuggccuugaggggucaaaggcugugaacuaggggugagaguggugucuuuauugucucuaggguauuaggccccuggcuaaagaagaccacaaggucccucugugccucauaaagagacuacuuggagucuagagcccaggaagguucugaggcuaggugguccacugagucaggacccucaccaugcuuguaucaugaccaaauagucccugcuucucaucugucccucagcuggguugucucugggagagucaccccuauccuaaccucaugggagauuguaaggaaaaaaaaacccucgcuguccgcucuguccccucagccagccccuuuguaacaaaagugaaagagcugcgucuacagagagaugacuuugagaucuugaaggugauuggcagaggggccuuuggggagguaaguaagccuuggggugggugaggaggaggggccuugcacuuggucuggucuagaccaggccuugcuucauccccucagguugccguggugaggcagaggggcaguggccagaucuuugccaugaagaugcugcauaagugggagaugcugaagagggcugaggucaguuuggggucaaguguacacugcaaauggguaggugaagguaugcuugcugccaggagaaggggcggggccacucugaagaaucacccgucucuuacccuucacagugaacuuuacuuaaaaugaagggauuguccuauucuuuuuauggaaauaaugaggcccaauaccagaaagccugggcucagguucguccaaggcuaccccagccugggguugagcagagcuguuccuuugaucagagucucuaggcuuuuguguucuccauucccugagcuacuaaagggggaguucccgggagcugaccccauuguccccccugcucuucaaaccugcuucagacggccuguuuccgggaggagcgagauguucuagugaagggagacagccgcugggugacugcucugcacuacgccuuccaggaugaagaguaccuggugaggaucuuugaguaguggaggagccuugccagggauaaaagaaaaggccgcucuuucaccaucuccuggccuacacccuccuuccuuagcucugcuuaagagcuggccacuuccugggcauggugggacacaccuuuuaauccuagcacuugggaggaagagacagucagaucucugugaguucaaggauagucuguucuacauagugaguuccaggacagccagaacuacauuguaagacccucucaaaaaaaaagaaaaaaaaaaaaaaaggagcuagccucagggaugcugcuuagccuuggcuucucagagccccccaagagccaaugugaggucgacaggugcucucauucugagucugacucuuggcucuacacacugcccuccaguaccuggugauggacuacuaugcuggcggggaccuucucacgcugcugagccgcuuugaggaccgccucccaccugagcuggcccaguucuaucuggcugagaugguucuggccauccacucacugcaccagcugggcuauguccacagguggggccccaagcugugucacuucccagucuuccucccuaaagcccugugggagggcuugccagugugccuaucuuacaguugaggaagucagagcucagagcagguaagccccuggcucaaaccuacccaacucaugguggcagaggagugauguguuacccauucaggggacaucugacuccugcacccccaacgugcacacacacaggaauaugaaugagcauguaugcacaggaaaaugugugagcauuacacacacaggagcauugugagcauguacacacacaggagcaugugugagcguguacacacaggugcaugugugagcguguacacgggacaggagcauguauaagcaugcaucaggcucaugucugaacacacacacacacacaccaagcccucacucuuccaccauccuucagggaugugaagccugacaacauccugcuggacaugaauggccacauccgccuggcagacuuuggcuccugccugcgucucaacaacaauggcaugguaaggaacccaccuagaauugagccgaggauacagccaagugcagggacaucggguuccagguagggguuccuggagaguagggugcuggcuccaguccuguggccucauggugccaacaccccuaacacagguggauucaucagucgcaguugggaccccggacuacaucucuccugagauccuacaggccauggaggaaggcaagggccacuacggcccacagugugacugguggucacugggagucugcgccuaugagcugcucuuuggggaaacacccuuuuaugcagaaucucugguagaaaccuacggcaagaucaugaaccacgaggucugacuguguggcccggggaccccuacauugugugauugcagguaacuucagaccagcuggacuuugagccugaccugcaccuccuuugacccacaggaccaccuccaguucccugcugaugugacugaugugccugcuagugcccaggaccugauccgacagcugcugugccgucaggaggagcggcugggccguggugggcuggacgacuuccggaagcaccccuucuuugaaggggucgauugggagaggcuugcaaccagcacagcgccauacaucccugagcuucgagggccgauggacaccuccaacuucgacguggaugaugauacccucaaccguccagugagugacagaugucucuauaagaggcuuggcuuggcccucugagcuauaggaacccccgauguucucuagagcagcuaaaaggcuucgaggcucaugagaguuagagcuugccguggcuggcucacuggcgugguggauuguaccaagugaaagcccuuugaccuuaguuguuauccuauaaaccguaguucauguauaagaggaaauucaugccggguggugguggcucacaccuuuaaucccagcacuugggaggcagaggcagacagauuucugaguucuagaccagccuggucuacagagcgaguuccaggacagucagggcuacacagagaaacccugucucaaaaaaaaaaaaaaaaaaaaaagaggaaauucccugcagccucuuggagaccuugaauucaaaggcucaugggaguuguggucccuuuugaugggggcuguguuauuccccaguaugcaccccaguaaaugucuaguucaugggccucucugguucucacuuggucuguggcucugacucuccuucccacuucuguaggagacgcugccaccauccucccauggugccuucucaggccaccaccugccauuuguuggcuucacuuacaccucaggcaggugagucugguccucauagcugcugggaagcuagggacauguguggcucauuacagccccgugggaagggacugaauggcuucagcauugacagucacuccucaguccucagggucaaccagagucauggauggcucugccccugggacaugugacuguacugugugacagacuuuugaaugcacuagauucauagcagaggcuguggagagccucuccuguccagccucauugaccuuuguaaaaugggugggagcauuauugccucaaauuggguuguccugagacucgagagagacauggguggaagugguggaagucaugcucugauggugcccugaggggcgaugggacauuggauguagagcagcaggcucaucucaccuuguuaacuugcuugauuucuuucuuuacauuaauuuaugcauaauaauaccucugugcauauggcaugauguaccacagugcacugguagagggcagagaacaauuuccagucaguucucuccauccaccuugugggucccagggauggaaucgggugcucaggcaacuggcgcccuuaaccagcugguacagcucacuggccccuggggagccuucacaugagccuuguugguuuugauugguugguggguggguugguuggauuuuugagacaggguuucucuguguagaccuggcuguccuagaacuugaucuguagaccaggcuggccuugaacuuagagaugcaccugccucugccuccugaguucugggauuaaaggugugugccaccacugcugggcgaggccuuguuaccuccacuuuccuguuagaaaacugcaguuuggauuacccauugcuguccaaggucacuuguauagccccaaaggcaggguguggucuagugcuucucuucucagcauggagcccaggaccugggucuggaucgaugugccaggguguuucuuggauggauggacaguugguccaugaggaugguuuucugcuaacuguguuccuuuguccccucucagccccuuugaugugcagagcucagagcuaauggcugccccagaggggacgccccacuguguggagcaggugaaaguggagcucagccacaagugucaagguacaggggcagcugggccaggcugagacugucaggccaggaugagggguagauugcugaaggccuggcuacucacccagaggcccuucucuugccagagccccugcauggcccauuacagccccaggagcuugugcggcuucagaaggaaguacagguucuucaggagaaacuggcagguaucaguuuccuguuccuagaacagcuuagcuccuuccugggucccagcucugucuccugcucuguaugugcugugugauuguggggaaguagaccuucucugugcagaaaguccucugagauccuacacacagaaugccuggcugagguggaguuguccugugugcgagucucaaugacuguuucugacagagacacugagggacagcaaggccucccucucacaaacugauggccuccaugcuagaagcccagccccaaacauccaacuacaacaggagaaggaccgccuccagcaggugagcacuaggugaggugagugaguggccuaggguuccgcgucccugaggucagcgcucugacuuggcuuuguccuucuuacccugguccucaggagcugacugaagcucaggcagcauugcgagugcaggaugcugagcugugccaagcgcagaaccggcaggaagaauuccugcagaggcugugggaagcccaggagagagaggcagcugcagccagccagauccaggcccugaacucccagcuggaggaagccuggguuguccggagagagguuggugauggagaggcagugggagaguucagaguauugggaaccccguaugguuagcacccuguggggcugguuacauuggacagggccugguggugagauagguaccuggggcuaccuguguuugcugcuggaugugaguuuacaucaggaugacacaaagaggauuagauggucaggguugacauuaccuugucccugugcccaaucacagcucgaaggccaggugaccacccugagucaggaggugacacggcuccagggacaauguaaacaagaaucuucacaggccaagguauggcagcuucuccccuuuggucgcagacacucuccuccuuagaguccucggagcagacccuugucccaggguuggguagaccauggcuucucaagccccugccuugcccccucuccacauggucaagaccguccaugcagccccugagacgaacggcauaggaucuccugagggucagucucaagaggcccagcugaggaaggaaguggcggcucugagggagcagcuggagcaugccugcagccaagggugagugcaugguaggggcagccaggaggggacagggcagggccagccugggagucagcuccgucuccuuggcucucucuuccccaggaucaguguugggaaagaggagguucugugccgauugcaggaggaaaaccagcggcugagccgggagcaggaacgggugagaaggguagacagacaagggacaggcugggugccagcagggucagggcagagcuccagggucucagcugcuguagcaugugggcuucuacaggguucagggugguaggugaucuguggggagacuagcagggggagggcaacuuguagacaucuggggcuacaagggccacugaggacugagccccccguccucuguggccucagcuggcaggagagcuggaacuggagcuacagagcaagcagcguuuggagggugaacggcgggagacugagagcaacugggaggcucagaucgcugacauccucagcugguagggacauggagccugguggggccugggauggcugaggacccagaccaugacacacagcacauuccuauucagggugaaugacgagaaggucucaagaggcuaccugcaggccuuggcuacuaagauggcugaggagcuggaguccuugaggaaugugggcacgcagacacucccuacccggccucuggugagccccaugcacaugagccguguguguguguguguguguguguguguguguguguguguguagcggucaaaaggcagcuuacagggagucacuucucuccuucuaccauguggguucccagagauugaccucaaguugccagguuuggcagcauaccucuaucuucugagccaucuugucaucccccaaggcuccagguuuaugcugaggggugaggagaguugggucuuugagucuggccaggcagcaugcgaggcauguuuuagugggaagcaaggaggaagggagggagucucugaagcugucagucgcagagagcaucuuacaggguacccucgguugcucccaggaucaccaguggaaggcucggaggcugcagaagauggaggccucagcccggcuagagcuucagucagcacuggaagcugagauccgugccaagcagagucugcaggagcagcugacgcaggugcaggaggcucagcggcaggcugaacggugaggccaugggcggauacugcuggaguggaguuccuuccgaggccuggggugagcucuugcccucuccccccagccgccugcaggaggcugagaagcaaagucaggcccugcagcaggagguggcugagcuccgggaggaacugcaagcucgaggaccggggggugagugccuacccuggagccaauccccagcucuacucucaugaagacuagggagaucccaugacagcugcaccuagaugagacaguucugucccucccacaccggaccugucugucacucagcucucacugaacacugcugggugccacacccguaucuuacugagguggaaacugagcccccacccacccuggucccucagucccagggcaacaaccucaguaacguuuacccucugucuacagaugccaggccuuccacuucccucaucccucuccuguccuucuggaacacagagguaagauccaggcagagggacuagcuagggaggagugcuggugagaaacaugguggcccugacuuucuuccaccuucauucauucccagaaggauucugccaaggacccuggcaauucaggagaggguccaaggucuggagccgaagcagagcugaggccagagggccgccgcagucugcgcaugggggugagacuccacaccaauccucaggcggggcggggcuucucccccacccccuccucacucgcucauucauuuucugcagaguguguuccccagggugcccgcagccaccaccaccccugccgaagguccuccugcuaaggucaguggccagaggggcaggacagcgggauagcgagccauucagcccguccccagaaccccucugggacacugggacccuaccaggccauguuuagcuggugcuggugcugguuuucugccgugaccucucagauacucagaguugacacugcggacuggcucagccucuuggccaccugacccuuugagauggugcacaggguacuggggggcgcuggggcauguugacaguguguacuccuucacagcccggcucacacacccugcguccccggaguuuuccauccccuaccaagugucuccgcugcaccucgcugaugcugggccugggccgccagggccugggcugugacaguaagaacauuuguccuucaggcucucccgucacaccguaacauacccaggcucuucucaacccgacagcacucacgucucuuaucaagcucuccaacuuaguuacuccuaucucacucgauggcaacgggugacaguucagguggcguuagccccaagggagcugucugggaaggcucacugccugacgggcuuuaucccucccaaauucuccaucucuccacagccuguggcuacuucugucacucagcuugugcgucacaagccccaccuugcccugugcccccugaacuccuccgcacagccuugggggugcaccccgaaacaggcacagggacugccuaugagggcuuccugucggugagcuguggcugagggcugaggaggauggcugugggagugaggaccugugcagcccuccaugccugucuucccacuaggugccgcggcccucagguguccgucggggcuggcagcggguguacgccgcucucagugacucccgccuguuguuguuugaugcuccugacccucgaggcagccuggccagugggguccuccugcaggccuuggaucuaagguaggucccagacagugacacgggacaagucauggguagugaggaguucauucaggggcgguaucucauguguccuuuguaccucccagggacccccaguucucagccaccccugucuuggccccagaugucauucaugcccaauccaaggaccugccacguaucuucagggugagcgcucagggcaggauggacccggccuccaucucucucccugugcugacccugucuugguuacugcuguaucuccacucugucccucugccagccaccucacugccacaugcucucuguccaaagccaccaugagcuugccacaaagcaaucuggcuauuuccugcuuuguuuccaaagccuugaugucuucccagugcccucaggaggcucucaagcaauacucugagccaccuggccauugagccugcaggugcccucggcccuccacccugaagccccuuucucuugggcuauacccuguuccuucuagcccugcguuuguguauaaagccuccuccucagucucaucucugcacagaacugccagcacccuccaggcccagucccuuguccccagguucgcuaacacugggugaugggcuuguccccuaggccugcuuuagggauucugcucugcauccuuaccgugcuuauccuucccguuacggugccaccgucacuaggcucaggaauugcuauugcucgucugacacccucccugccuggcaccacagccagcuagcuggcugucaaugcuuacaaacaucagcaggugaaggaaggaaggaggacagguggcuggcuggcucucagccguagcccuccagccugacucccuguccacaggugacagccucccagcugacagugccaccaaccacaugcacugugcugcugcuggcagagaaugagggggagcgggagcgcuggcuucaggugcugggggagcugcagcggcugcuacuggaugcacguccaaggccccgaccgguguacacacucaaggaggccuaugacaaugggcugccacugcugccucaugcgcucugugcugcugucauugguaagucgugugcugaagggcugccacucuugaguggccuaaggggaaggacaggccuguaaggaggcauuggccuagacuagucccaagcgcaacagccauucucucagccagcagcuguggguuccaccuugcacacagccucugagccaggcagccuggcuucucccaccucacuucugugggcucuggcucucucuuuuguuguuauuguuugguuuuuugagacaggaucugcucuauagcccuggcugucggggaacucaccauguagaccaggcuggccugggacucacagagauuugccuaccucugccuccaaaguaccaggggguuacaggugugcaccaccacucccagcugguuuuccuuuuucuaagagaaucucaaauaaguggaaggaacagagguuuuagggagaaacagcgauggccugggaggcugaggcagaaggcuucagaguauaaaggcugcagugagcuacauguggagaccuugccucacaaaucacaaccacaaggcguggccuagugcacacaugucugcucagcacgugcacaaacaagcagaagggucaggagcucagcucacccuuagcuaagaaguagcuucaaccaaccaaccaaccaaccaaacacucgguuggagugcuccuccagugguuagaagcacugcuccuccggagguccugggcucaguucccagcacucacuagaacauucuucgauccuccacuggaaccagguucacacgcaaugcacagacaugcaugcaggcaaagcacacauacacguaaaauaauucuuugaaaaaaauuuuacacacauacacaaacaaguuggacuugagcggugccacacacacaccuguaaauccagcacuggggaggggccacaggaggaugcagguucaaagccagccucauccacguagggagucaagugcagccugaacuauauaauauauacaaacuugcuucaggaaaacaccaccaacaaccaaacaggaagauuaccucagacucgugccaguuccagcuagcuacauaguaaguuauaggccagccuagaugauggaguaagacacugucuccacagaaagacuauuaaggcucugaugacuuucuuccuggcagcugggugggcaagggcuaggugcagagcugucuaggguucauggggcccugagccagcuccagcuugcagguaccccaguuaggggucacagcagagacucuggguccccugggucaguuaggauccagagaguggggcuuacccagaaugucacagcucaaggguaguaucccucagcccugaccccagucaccaaggcccuuucucauuacagccaguguaaacugugagcaagaaggggcuaaggauggggugugucagcaaugugugggucaccaauccuguugccucaagagaagcagaagaccaguaaggacaggugucacuggacaggugucucugaccucugaccucucuuccucugucagaccaagagcgucuugcccugggcacugaggagggguuguuugugauccaucuucacagcaaugguaccagagggcuggcccaggugugggugggcugggcagcacagguagccacugcugcuuacccacacgcuacucgcuccucucucccgccaacaccgcagacaucuuccaggugggagacugccgccgggugcagcgguuggcugugagcucugcggcuggccuccuggcugugcucuguggccguggccccagugugcgccucuucgcccuggacgaacuggagagugcugagguggcgggugccaagaucccggaaucccgaggcugucaggcuuuggucgcugggcgcaucuugcaggcccggacuccagugcucuguguggcagucaaacgccaaguucucuguuaccagcugggcccaggaccagggcccuggcagcgccgcauccgagagcugcaagcaccagcuccggugcagagccugggcuugcugggugaucggcucugugugggcgccgcaggcaccuucgcucucuacccgcugcucaaugaggcugcacccuuagcgcugggaacuggucugguggccgaggagcugccugcaucccgugggggccuaggugaggcacugggugccguggagcucagccucagcgagcuccugcugcucuucgccacugccggcgucuacguggauagugcuggccgcaagucacgaagccacgagcugcuguggccagcugcacccacuggcugggguaaggcugguagagggcuuggcaggguggggucaggcccuggggguccugugacuauuuuguguccugaguagcuugccuagggccuucuucacuccauucucuaccuggccaacuugaguggcagcuccagccggguaguuagcugcucuguaaccgacagucguaucccucccucugcaccacugcacucugacuccuucucaugccaccucuugguucagaccucuguucugggucucgucauccacgucgugacugcguuuaugcacugggaccuguagaacaggcuaggauuggguccuucagccagccagcaugggcaggcacacccugggggcuaggcuuguuggggaugaacaaaugaauggaggagaggcaugggcugguaugguuacuuguagccaaucugaugggcuggaggaaggacaggggacaguguccuuucugagcagaggcucgucugugguguggccugggguuacguguaacacagacugccacuggccacgucuccugucccuccccagcuguaugaccuugaccacugcuuugcuaagauuuccaugaccucaucuaauguccaagaucagggugauuauaguaccugcuccugccuggagcggccggagaguuaagagaggacaaacaugacaagcauuugcagcugugugggcauguagugagggcuggcuauuaucucaucuguuauggaguugggcggggccggcucccugugggacagaagaaacaggcucagagagggaccuggcuugcccggggcuacacacuacaggcuguuucccaccuacagguuacacagcacccuaccuaacaguguucagugaaaacgcccuugauguguuugacgugaggagagcagaauggguacagacugugccgcucaagaaggugaaggucagcccagaucgugggucgggugcagugggugacauggccugaccucuguguguucugucccaggugagaccccugaauccagaaggcuccuuguuccuuuauggcaccgagaagguccgccugaccuaccucaggaauccauuggcaggugagggcguauauaucugccuacaucuguguguguuuaccugugcacaagugugagcuugugccccggccggcugggacaugugagcaccuccccgcucccugacuuuccauagagaaggacgaguuugacauucccgaccucacggacaacagccggcgccagcuguuccgcaccaagagcaagcgccguuucuucuuccgggugucugaugagcugcgacagcagcagcgcaggugcucgaguguggcguggcucuggcugcugggugggacuuucuauucuugggggcggggugaggcuugcaugcuagcccugcaccuacacacccucugccuccagggagaugcugaaggacccuuuugugcgcuccaaguucaucucgccgcccaccaacuucaaccaccuggugcacgugggcccuacggagggaaggcccaacaccagggaugggacccgggugaguccucuguagccaaucacaaaacucccuguagucguugguccaaucacaggcuucuguugauugcuugccugcugaggcagaugacucaucccucugacgccuggaccucauugccaguagcugaguucccauggucugagcuuccugguccuagcccguguacacuguuccccauaggcucaggaacagaagagcagaggugcccgcagcuccgggccgcagcggccccacagcuucucagaggcauuucggcggccaguguccacgggcagugauggucucccuggagaaacagacccauguaaggacagcccuccaucuuccaguacucgcaugcuucccccaccuuaccacgccuuccgagcccuuagauugacccaggcauuuuguccuucugucucccuacuccugccaguagugaagaggaaaccuuggacaucucuguccagcgaaucaguguccugcccccaggggucccugagcccugcagcaucccugauacaggugagccaauggguagggcuuuccuucucccgcucaaaguuuaggcacuuucuggguuagcucugcccugggacaggaaguggucaccuccgagacgguggacacaucugcaacucuuggcuccccaagcccuagcuguaugcuccaaucagggaagaccacucccccugagcuugucccaccugcaaacugaaggugucccugugauaggugugugaggugaugguaccucacagugccagacgcaugggggacgugccccguaacggagcucuggggauuguguguguaacaagugugcaggugcagcaccugcaucguguggaggccaggggacacuaacaagagcuggaucuuuccuucuaccuugucucuaagacagcgucucucauuucuguuccaugugcuccaggcuggcacauaccuuccagcuaccgucccucucugaucccucuccccggaggaaugcugggauuauggacgugugccgcugcguccggcucuuucccuggguucuggggcucagugugaggcuuucagagcuguggcaaucguuuuuaucugcugaacuggcccugccugcugagccaucucccaaggccuagaauuaaaaauauauacuguguuguuuuugcagugcuggggccaaacauagagugcuguucaugcuaugcaaacacugucacugagcugucuucuguuuugggaguugagauggggucuuucuacuuaguccuggcuguucuggaacuugguguauagacuaggcuggccuugaauugaacgagauccuccugccucugccuacugagugcugggguuaaaggcaugcaccaccaugccuaaccuaagcuacagucuuaacagagacucggccuaaagauggggaggaacuuagauggaaaccuauuuugugcuggggaggcccucacucacccuccagccgcccucacaguccagucagaccaaagccacucggauccccacccugccguuuucuuuuacacacuccagcucuugccucugcuggucucucuccuuugaaugcuuuuucugccuucagugcucaggcugccugcccgccacuguuaccuuuuggccacauggccaagcaucacugcuacugacaccuccucuaccauuuuggcuccugugcuguggccuuccuucuuuccuuuuuuccuuuuuccucccuucucuuuccucccucccucucucccuuccuucucuuccuuuuuaaaaauggucucauguagcucaggcuagcuuugaacaugugguucuccugcugccucugccuccugagugcugggauugcaggcaugcgcaugcaccccacacccagguugccgaggccuguccuccaagcuugucuuucguucagcggggcaggggguguccauggugguuggggucaguuuucauuuuucugccugcacuaaaacaugguuuuggcugaauaucggauggagugaacaaacaagacccuggguuugcucacugcaguuuuggauucuaugaggacucucccccacaccuucaguguaguuuccuuuaggguccugcuacugcaagcgcuggguucuuugagaccucugucccuuuucccaucuaacuuccuguucuucccuccaggucucagaacggccccgaagucucccuccagauccugagucagagagcucccccugaugcccucuggcagugcccaccccauucccaagacagaaggaaugaggaagcaaagagcuuauaggaugccauacuccggcugguccgggaugugcugaaauucagacucagggagagccuggguggagggguaagagcacggcacgccuggguccccaggaauagaggucugacuccuugccccauuccugcuauucccuugggcuuccaacacgggccuacaugggccucuaggagugccguggcucuggugcccagggaagauugugccaaaguugugcuucacagggccagucccagggaagcuguuaggagucaggaugaggaauggaggggcagguccuugggaguaugcuggugucuugucugugcagccuggcccaggcugaggcagacguggagcaugcaaggucuccgcucagggucaggcugggauaugggcucugauugacagggaaggauagaaaagggggagcgaggcaagugagagaggggagaaggcggcgacggagcaaagggagggaagaggaggugauguaaucagaagauggaugcuaacccgaaaagaggagagaaggacaaaacaugugaugaggaggaugccugagaggggaggggaggagggagagugaggcaggggagaacccaaacccgagaacuuuucucugggguggggcuugggauugagagcaggacuguugcuagcuuauccguccagaaaaaaugguuccuaggcagggaggggaugggaggguauuuauaaaggcuucuuggugggagauagucacccuguggggaccacuaaagaucuccaggcacacuuuggcucuucccagcaagggggguccuuuucuggaagcuucgaucuaccaaguguauuaggggaacauagggggcauuuuauuauugaucacagucacuauuauuguuauuauauugcuauuuuuauuaaaccucacccugcuacaggguggggagugaaagaaguauuuaucucuuuaaacgccauauuccuggaagggauaggcucugaugcuccaagaugugacaagaaccaauaaagccaacuuuauaagcugcuggcu

SEQ ID NO: 9107 - RNA, 14485 nt, Mus musculus
ccuccgagucucggcgcugccccugccugcccgcucgcuucgccccgccccaccccgcgccgcuccgcgccggcuccgcagcuugcgcccgccggcggguccggcgccgggccauggcgcuguugcgggacgugucgcugcaggauccgcgggaccgcuucgagcugcuacagcgugugggggccgggaccuauggcgacguuuacaaggugcgcugagcggggcugcgggacgggcgggagcgcaggaggagggugcaucuucacgucccgccgcgggaaccccggccccgcccccuccucaccccgcuucucgccccuaggcccgugacaccgucacguccgaacuggccgcggugaagaucgucaagcuagacccaggugugggcccggguggggccucugugcuccugggaggcgggcgggugagcuggcgggggcagagaguuaacauuuucuagacccccccgugaagccgaccccaggagaaacuaagguuuggcaccugcucggcaaggagagaaauacucuaugcucauuuugcacauagggacagagucuaggcuauucguuccccccccccccccauaaugccuugugcuccccaggggacgacaucagcucucuucagcaggaaaucaccauccuucgugaaugccgccaccccaaugucguggccuacaucggcagcuaccucaggugagguuguuuauccucuuacccucuugugccuugcauugugccaccccagcucucugucuccccaggaaugaccgauuguggaucuguauggaguucuguggaggagggucacugcaggagauuuaccacggugagauccagacuccauggacauggccuuucccgaucccaacauagggguaggaaggcauccuucuggcugcacuuggacuccucuuagcuucugacuggcugugugaccuugagagaaauacuauccuccucugggcucaguuucccagccugagucuggaagaaauuuggcuaacaucacuuugcuguaguggugccugcugcuccccacucugcaggguggguagggagggucagcauaucccucaggcucuuucucuucagcccccauucuguauguuucagccacugggccccuggaagaacggcagauugccuauguuugccgggaggcacugaagguauggggcucauaggcagcacccauuuuggaauccucaggagugugggcccaacacaucuggccagugggagauugggaccuugggaugggcugacucaggggguggagguccuagcaggagggggccccccaguucuguugccggaagcagccuauuucccucuuggcucauucacuuccugcuuggggagagggguggaggaagcagcuuggguggggggcccaguccugaggaggggcucagaagagauaauuagugcaaagcagcuguccucagagacuucuguuugucuccaggggcuccaccaccugcauucucaggggaaaauucaccgagacauuaagguagggggucagccaagggcaugguucaaaugaggaggaagccgccaggcaccugacacaauccuuucuguguguucccccaacagggugccaaccuucugcucacucugcagggugaugucaagcugggucaguacccgggggacacucagggaccauagaacugagugcuggagaucccagucacuuuacuguuugagccucaguguccccauuuagaagauguagcauuauugccugccaguaguuggcuguaugagauuggcuggggagggaucugacauggcauuguuuuuagagauggaaggguggggaccccucucagaagaggggccuggccuggcuugguacaguuguggcuggacccaagcccuaccugguauagccugggcccuggggugggagguaagugaggcccugggucugguaagaguucuuuucugcagcggacuuuggggugucaggcgagcugacagcaucuguggccaaaagacguucuuucauuggcacuccauacuggugagauggugcccuggcaauagggguggugggcacaaggagggcaucuggccaucucguaugugacccugauucuaggauggcaccagagguugccgcuguggaacgcaaggguggcuacaaugagcugugugacgucugggcccugggcaucacugccauugaguugggcgagcugcaaccgccacuguuccaccugcaccccaugaggucagccuugcacuugccccuugccugcuccuugcccugcugaccuuugacccaugcguucacauccucccuagggccuugaugcucaugucgaaaagcagcuuccagccacccaagcuaagagauaagacgcguuggugaggccucgcccacagcugagauaccuuuuuuccagccuagucccgugggguagaggcuuuugcccaagauugaccuugguuuccacuguaggcagugggcagggagggaaggaagggcugguggcuugugauggagggucuucuauggcacaacgacagcacugcccaaguugcucuuccuuuggcagccggcgggggcagccgacaggaugcuucuuugcagagcuuaacuuggguuuggguggguggguggguggggcuuuuguacccaccaggacccagaauuuccaccacuuccucaagcuggcccuaaccaagaaccccaagaagaggccuacagcagagaggcuucugcaggugggaggcagggggugacuggggacuugagacucaaagacaaggccuggaggacagggagcgacuucaucaccccuugcuccuccagcacccauucacgacccagcaucucccuccggcccuccucacccagcuccucgacaaggccagugacccccaccugggaacccucuccccugaagacagugagcuggagguaaaggggggcugggagccaggucagccuggccuggugggaaggugguauagaugagaauuguuggcagagccgcucucuagucaagcccacugcacauccucgggcccaagccagccaugacugugacuaagcaguccuccuuucuguguggccuuuggcaagugucuugauguuucugugccaguuuucccaucuguggaaaggaaggcuguuguauuucauaguaaucuuagagggcugucaggaaaacaggacaccugaugggugaacuccuggcaagaggugagugaugggugcaggucugucguuuguguucuuucuuagacccaugacauguuuccagauaccauccauucccgcagccaucaugguccugcugagaggacccccuccgagauccaguguaggucuucugauaggguuaaaugcacccguggaucugguguuauuugggggguccauucugagacuuggacccccuuuuaaucuaauacaucgguucccuaguucaccaagugaaauucggugcuccucgccggaaggagacagauccucucaaugaaccggugaggcacuggcuauguguguguagaggggguucggggaagggaggcuugggugugcagaugcagguggaaugucccaaaucacagccagucugaagcagggguugccugugucaucuggggacucccccugggcuugcgucaccugggguccugggcuagaggauccccuccgccauuuuccuuuagacaguacuggaauguggaagacuggccacacccuuuugaaaccuagguuucacaggacuaagggcuccccacuuggccauauuccucagugugccugucacaggaccacaucaccccgucuccucuuacuguccgucacuacuuccuuucuccgcuccacagcacccaucccuuugcccuguuggcugcugucucccuccagcucccucucuugccuuuucucucuuauuuuuguuguuuugucuuucacagucuuugccuguugcagaauauuuccaucuggguugcucuguucucucccgcgcucucuuugcugaugugagcaggauauucuuacuugcucucacugggcuugaacuucuccuguaguauaggccugccuugaauuccagguccuuccuaacucucccuguccaucuccugaaaccccucucuuuugugucucaccucucuucgguaucucugccucggucuccuccagugggaggaggaguggacgcuccugggaaaagaggaacugagugggugagugagcgagguuggggaagcggaggggcaggcugggucuuauggaagacugaccacugaccccuuccucuggcccaggagccugcugcagucaguccaggaggcccuggaggaaaggugagggacccacacuuggggugaagaggggccuccaggccugggggacaguccccucucacaccccaucaugccaugugcugugucccuguaggagccugacuauccggccagccuuagaacuccagguguggauuggaagaggguagagcugggaagucacccgugagccuagagugcuguggggcagaagugcaucaugggacaccugcugaugaccaggcugcuccugauccucuugacaggagcuggacuccccggaugaugccaucggaaccaucaaacgggcuccauuuuuggggcugccccacacugagucaacaucuggugacaaugcccaguccugcuccccaggugaggcccagggcuggcaggccacagggaauucugggguagggcuagggcuuggagucacuauggucugugcauacagguacccugucagcaccuccagcuggcccuggcagccccgcauugcugccuaccgccugggcuacucugaagcaacaggaggaucgugaggugagaggacagcagaagggugggaguggggcugcagggugccaccuaggcccugacuccuucccucccuugcccacagcgaucauccugccaugggcuuccucccacccccaaggugcacguaaguggucacuggcugucccuagggccugcuguccuggcacugccacugggucccucgccagcuaaucacuuccuccccagaugggugccugcuucuccaaggucuucaauggcugcccccugcagauccaugcugcugucacuuggguucacccugugacucgagguagaucgggguagagcagaagcaauaacuuaggacacccuuagcuugggcuaggaacauguggcagccucugaccuuaugcccaugccugcagaccaguuccuggugguaggggcugaggagggcaucuauacccucaaccugcacgaacugcacgaggacacaauggagaaggugaggcuuguuggcuguuggggacagaggcacaggaugcuggcugcugaccaccuguccacugucucuggucccagcucaucucccagcgcugcuccuggcucuacugugugaacaauguguugcugucgcucucagguaggaggcggcgggugcagaggcagccagggcagcauucuccaaacuuccucugagcccuauguggucuuccuguuccgcuucagggaaauccacacauaucugggcgcaugaccucccgggccuguuugagcagcgaaggcugcagcaccaggcaccccucuccaucccuaccaaccgcaucacucagcgcaucauccccaggucagcagguaugggguacaaaggaggucagaauagugccugugggaugggacuccacccacuccugagacugccagggucuuagcuaaucacauaggcacuucccgucucugaagcuguuuccuccuggucgguaguugguggccuucccuccuguccaccuggcuuguugaaaagcacaaaaggaugugaacgugaauguguucuguggacagcauagauggugggcuucauccugcaguucagcgggccggggcugggccuggcaauguguccagagaaacccugcuuuagagaaacgaaggacguuuguggcagacugcuugguucaggguaggggcggggguacaccuggagagagugcucugaaagccaggaggcagagacagaauuagagggugcauuccaagguucuaggggaggggagagugaauaccggugagaccaaacagcaaggccuggagagccugugggcuuuagccugaggguggagagccagccgcacagguggcugaacccuuccucuguugccugggacuuggucugugucugguguacagcgguacucucagcguuucagaggaucuuacuguguacuggucagugugcucccuuccauugaugguucagcucacugucuaagagccaggcuggugugguggcucgugcuggacaucccagcacuagggaggaugaggcaggagaaucucaaguuugaggccagccugggcuacauagaagauacuucgucucaaaaacaaaauccagcuggguaugguguuucaugccuguaaucucaguacauggcagguaggggcaggagaauaaggaauucauggucauccuugccuauugaguuugaggccagccugggcuaugugaguuccugucucugaaaacagaauauacuggccauagcaagagcuacaguaggacugguauuuggggagccgaauggucaggucuggagagcaagcagagggcccagugcaggagcuaaguagcccagcacugacacgcggugcuaggcugcagcaauuuagcauguaauuaugcagcugguguguguguguguguguguaaaggagguagaugguagaccuagaaaaaugaggcucuuuggcagugauggcucagaacaaacaccauggagaagagcgggcugaggaagaagacuuuaaauggcuguuuugaaagccuucagugagaaagugcuauuugagccaagacggaggacagggcugaggcuguagcguacugaugaggugaggugaggugaggugaggugaggugaggugaggugaggugaggugaggugagguggcuugccuagcauguaugaggcucuggguuuaguccccagcacuguaggaauaacuaggacuuagaggaguguggggcuggccagauugcucaguggugaaaagagccagucaguugcugcaggcuauucgcuggcuuccacgugugcaccuugauauguauacacacuugugugcaaagaaaaaaauuguacggaaggcagaggcaggcggauuucuaaguucggggccugccuggucuacagagugaguuucagcacagccagggcuacacagagaaacccugucucgaaaaacaaaaaaaacaaaaaacaaaaaaaaaaccauguaaaaauuacuuuaugugcauuggugugagggucuaggucagauccucugggacuggagugacagacaguuuugagaugacaugugggcgcugggaauugaauccagguccucuggaagggcagccagugcucuuauccgcuaagccuuuuuccagccccaauaaauguaauuuuccaaagaagcuagaaaucuguagggaaggcucaggagaagagacgacaggcgaacacaaggguccuuaggacagacgcaagucugccuccucagagaggccgcuggugaggugugauuggcacugaggucuucaugggcucucuucugcggguggccagcagcgggggugcgggcugcagcgggcgugcgggcugcaguaagagugaaggaagugagagauggucugguucugcuguuuuacaaguggagccagcaggguuuccuggugaugauugagagggaaagggggugggggcugagggcgaagcuuuugaccuagguugaaggaaggauggagcugucaccagcugugagugacggaggagucugcucugaaauugguuuugccacauuaaguaaauuaaaugccugucaucucagcauucaagcaguugaggcuggaggauuacuggaaguuugaugcuauaguaugagacccaucugaaaagucacauuuccaaagaugccgauucucugagugggaccuuccuaguccagcugagagagcuggagcgcccagaagcgugggccaggaagcggcucuaacauuagugugaccugguucauggggccagcagcacuggggagaauggagaacagccuuaucuacagcgcucacaccaagccuguauuggugcccugugcccccugggcuuccugagccucuguucugacccuuucggcagagggcuugccagacuuugaacaugaagaagaggaaaucauggaguuuuucuuuuagaggaaacaccagaugcaaaaguaucagcaccagacugcccgaggccuagccagaugcuagcuggggauagagugggaggaagagggagggcagagggcagcaccggaggcggggcagacaccggcuuccucccgggggcucauucuggcaggggcacaaacagaaccugagucgcugaaaggaggagauugcaguguuaacagcccaguuccucagaugaagaaagaggcucgaguggucaguccccugagggcaugggggacuccccauaagacagccauucaccugccucacagggucagagccccaccuaggugcagaaggcaggccauuugcuauuugaagucuuuccagcugccagggccuguuuguccgucuuugaaagggacugaacauacucaagcugggaccugccucggcuucuggucuccacacugucugccagcgagcagacaggucgagaggucgggugacuuguuaaaacuacacagaaccuagagugguggcuuuuaccaggaacccuagcacaugggagacuauggcaggagacuauggacuaugcuacaaaccccaggcuaaccugggcuacggaggaagacuucugugucaaaacuacaugagggcagguacagcagcuuacaaucucagggacccacgugauggaagggggaccagcuccgacaagcugucuucugaaucuuuacaugugugacaugauguguaucuucgcagucaaccagucgguguaaagaaaugcuuuauuuacaauuguuuuaaauuuaguaucauuaggaggaagaggaguaguuuuguuuguuuguucaagacaaggucucucugucuagcccuggcuguccuagagcucacuauguagaccaggcugaccuuaaacucacagagauucuccugacuaugccacccaagugcuggauuaaaggcauuauugggggggggcggguaauaccccaucuacuacaguauacaaguggaggucagaagacaccgaccguacaggaguaauuuuccuggguauagcacacggagcccaggaauugaguucagguuguaagucugacgguaguagauagcuguaccuaaggagcgauccagucagcccaaggaaagguaaaaaagaauaaagaaaaaaggugugugguggugcuggaucugguggcucaggcuucgaaggucagcgccugggaggauucagcaugaucagaaguuugagagcagcuuggaugacaugaaccuugcuuuucuccaaaaacuuaaacacaaaaguggacuggaaggaugacucagugguuaggagccaucccuccucccuuccuacucuuccagaggcccuggauucaguuuccaucguccacaugauaacucacagacaccuuuaacagggaaucuggugcagucucaccuuugcaaacauaaaauuagugcacauuacauacaugcauacacauacaugcaugcaugcaugcaagcaaacauucacauacacaaaaauaaacuuuaaaaagugaaacccaaaacaaaagaacaaccuccccccagcccccauaagugcccaggcugaggagcccaagaugcccacagagccucaguuccuuacagcucuugcaggccggcacacugcugagccucccugagucuagggucucauccauaaagccaggaaaaugacagugacuacgucacaggguuuagugggugccuugcccauggauggcucccagaacauaugcugaucuugaccccuacaggcgcuuugcccuguccaccaagauuccugacaccaaaggcugcuugcagugccguguggguaagagcugacuguauggggcugggaggggugcugugaggcugagccccugcccaccaccuccuccucccugcaguucgaaaccccuauaccggcaguacguuccugcuggccgcccugccugccagccugcuucugcugcaaugguaugagccacugcagaaauuccugcugcugaagguaagagaccagaggacccucgggagggaggcgggaagccagcagaagaaacagccaagccucucugcuguccuccagaacuuuuccagucccuugcccagcccagcggggaugcuggagccgcuggugcuagaugggaaggagcugccacaggugugugugggcgccgagggacccgagggacccggcugucgaguccuguuccaugucuugccccuggaagcuggccugacuccagacauccucaucccuccuggugagcagcagagcugcaggaggggaugcuugagaaggucagaggggggggcuagaggcccuucaguccugccucuuucaucuggcuuccaugaaagauuucauggacuagccugggcacaguggcacaggccugugaucccucuuuugaggcugaagcaggaggauggcgugaacccacgaauagaugccagccucgguaacauaacaauccaaagcuuaaaaaaaaaaaaaaaaaaaaaaaaaaaaguggugguaugagcacuuggcagccagccuggucuacaaagugaguuccaggacagccagggcuacacagagaaacccugucucgaaaaaacuuaaaaaaaaaaaacuuuaaaauguaugcgugugacugcuuugccuccauguauguauccauaccaugcacaugccuuggaggucagaagagggugacuugggguuacaagugcuugugagcugcaugugcaugcugggaauugaacuuguccuuuggaagagccaccgaugaugcccuuacccaaugaacaucucuccagccccuucagucuuaauucuuacaauggcccuguaaaaauagguaguaacucauaucugaguuaccaaagagggaaaugaagugcagagagaggaagugacuugugucagccccucggcaacugaaucucaccaccugguuugucugacccuggaccuuuugcaggcucuuacaggacccugcaaccccuuccuggaucccaauaggccuaagggcaagucccuucuucuguguaugauccuuugaggcuggugugaggugaaauacacuguugguuuaagacuggcuguagaaugcccccucaguccuuggaaugcuagaguggacuggcucagcaagccgggccuugccuuccuucucuguccacagaggggaucccagguucugcacagcaggugauccaaguggacagggacacaguccuggucagcuuugaacgugagugccucaggaucgggaauggagggcaguggacaaaguggugguaaggcaggcuuuaugggugggccgucucagcagagagccagguguacccacucacaagaucucucuuugugcaggcugugugagaauuguuaaccugcagggggaacccacggcugcacuugccccugaacuaaccuuugacuucacuauugagacugugggugaguaagccagauguggacauaguaguauccaguccggaaguauguaacuggacuuagagcuuggggcugacaguugggaccacuguagauucccuauugccuuuggggacccagccuggauacccagcacuagugaggaccccuguggguuggucugugucaguuggggcugaaacagccaccaugcauuguggcaagggugaggauauuuguggagugcagggauaguguagggcuaacagcccauuauuccagugugucugcaggauagugugcuggcguucuggagccauggcaugcagggccgaagccucgauaccaacgaggugagugggccuaggguccuaacugccuccaugagccccuauuuagaaaggacuauugggauggucucagggucccuugucuuccaggugacgcaggagauaacagaugagaccaggaucuuccgaguacugggggcucacagguauuugcaaugugccuucaauuucagacgcugcccccaggcuaggcuugggauggucuucccgagcuuuccugcuuugcucacucuguaccucuucccccaccagggacaucauccuggaaagcaucccaacugauaaccccggggcacacagcaaccucuacauccucacgggucaccagagcagcuacugagcuaucuccccgaugacgccuaggccucaauugccaccuccagccucugcugggguuccagagggcagaccuaauucugagacguguuugggggcagagaggggagguagcccacccaccucagcaauaacuggaccagagggagcugugagcaccuacccucccuggagagcuguccccaguacaggaggcccugggcaggauagacugccugacugauccauuccacauuuucacuuuuccuuuccauucuuucugccaagaagagccugccccagguucuauccugggcaacauguauuuaagagagaauuauauugguauuaaagcugguugguuuuaucccacuagucucucugagguagaggaguugagcccucaccuucucugccuuccucucuccuuccucuuugucucccucuuuucugcaggacaucuuucuguaaguacuugguuggucuuagguguucaccauagaagggccagcccacuagugcucuguggagucuaggcucaggugacauaagccaguggucucugccccagcagcccucucuuggcugugucaauugaguccucugcuguaaucuggcauuuuauggacuugugcggggggaacucuaagcagagaccuguccagggcagccuugccccaaguaggaucuugcuuguggucugugggaugcuggcagccagccaaggagcuagcuaccauguccauuucugagaccggcacccugucccggcccugucuacuccaguguccagugagcagccuguaacaauacagcgaagcaucagcuuacacucgagagggggaugugaguuccuuuacuguucggucacuccacaccaagauacagcuuagcacccuggaagcucgcuggcaugcuucucccuguggcuugugcuuuguauuguccucccuuaguccccuucccugugguuccagacacugaaggccaccgaagaaugguggggcacacagauaaggcccggccuggggguggggguaagggggcguguggaguaaagguccagcucugucacccucugacauuuagaacaaauguuggcagaaggugccuggcaugcuggcugcaaguacuugccaguugagugaagcagugguugggugaggguggguaggugacagcucaugugagcagaauuguggaccuugugguuguuacuauccucuugacuacucucuuccaaagcucugacugguuuccagugaccaagagguuugcuugaccaaaauaggaagccagaggaaggaaagggacacaguauuuguccucagggagacagacccaagucaacugagggaccaggggagacagggcuacgggguaaacaccuagcuuccuagccccaauuucuuggggggcuggcaguaggggugagaggugggcugcagacagugagccugguggcaggagcccaucaggaaagguuuagggguauaguaugccaaagugaggagccugugaaaggcaagauccacugauguuugcucccagcaaaggugggugccacaagccaaagacagggcaauccaggacugugcacuaaaagacauaauuuuauuuauguauuuguuuauagccuuuuucagauacaaaauagacucuaggcuaggcuauggugaaugccugugaucccaguacucaggaggcggaggcaggacugccugugaauuacaguccagccuggucuacagagugaauuccaggccagccaagguuauauguaggcaagacucugccucaaaaauaaacccugccuucucauuuguccuccagucccuucuagaaguauuuaugauauuuaaagaauuugacauauuuuuauucacauggaaacauucuauauaucccucuggcuuuuugaaaauacauucuggagaucuuuaucaaccuggaugguuuuuuuuuuguuguuuuguuguuguuuuuuugguauagcuaguguaggguuuuauguguuuaggugacuaauguuaacugaaagaucuuuauugauggaauguauuucuacauuaauaucacaaaccacacugcaauaaauaacuccuaugucagagcuacu

SEQ ID NO: 9108 - RNA, 8229 nt, Mus musculus
cgacgaaauggcggcggggccgggggaacugggaggugucgcagcgcgcacuccuuguuacugcgcggacugaggccagaguggcaggggaauaggagggggcaaagucugugacgugagagaacggcuagcucauuggcugaaaccgauggagguaagcgccucggcgucguagugccacacgauuggcugaaacgauuccccucccccaggagccagccgcucgagaauggagaaagccgggaggagaagccggaaccaaggcggagagcaggggugcgcaugcguagggagggcacgcguguccccgcccccuuccccagaggggcggaacggaggccuuaagugacguuagucauugugcuagagguaacuagggaccgcggcgaaggggcgggcucgagcugacgaacaggauacgucgaagcugcagguagaguagagaaagacuuccuguuuucucugaaaaauaguguuacgaaauggcucaaaacuaggguaguugguggguguauuuaaagacuuuauuucauuccgguacaagguagccaaguagccugucacccgagaacuugaaaggcugagacaggagagcugacaugaguuuggggcuaaccugggguacaguauaucugucucaaaaaauccagguucaauggcacauacuaacucuuguaaaggaaaagucaggcgcuccaaguccuucuuggagaggggagagaaagucauuucaaaaguuagucuaaaagugugcacuuccagggaaaucucaaugcguuggaaauuuguuucggguaccuuaaaauuacccauaaaaaugguagggaacuuguaaaugagacugaggccaaacauuccuucccaugaaauaaacaugagaguaaugaaacagguuagcacaacauaauagaacuggggauagauaggguucucacagagagguuauuuagacccaguaggggaaacaguguuuaauauguaauuagaguggcuagagaaauagcagauaagaccaggcacuggcuacucuuccagagucccagguuggauuccuagaaccuaaauggugacucacaaccauccguaacuucagucccaggauaucagaacccucuucuggccucacaggcacugcauauauauggugcacagacuuauaugcagacaaaacacccauauacauaagacuaaguaaucuuuuaaaaugauguagaaaaguagacauguagacaacagaagguuuggaguaaucuaggaauaaagagacuacaaagauaagaaacucaaguaugguggaugguacaagucaacagacuaugacagguagggaggaaauggccauagaacagagaaagagcaaaugucugggcagaaaauacaauugagugguagaaccuagcacauguaacucccagauuacaucagcagacaugugaaaguagaaaagccaacuguaauacccaagaaaccuaucaaccuaagcagaggaggggccagcucggcaguuaagagugcuggacagcagggcggugguggcgcacgccuuuaaucccagcacucgggaggcagaggcaggaggauuucugaguuugaggccagccuggucuacagagugaguuccaggauagccagggcuacacagagaaacccugucuggaaaaacaaaacaaacaaaaaaaaagagugcuggauacucuuccacaccaacuaacaaccaucucacuucuguuccagaggaucgugacucccuguucugacaccucaggcacugcucuuacugcugauguacaaacauacauguagauaaaacacuuauacacauuaaaauaaucucuaaagacuuaacaacgacaacaaaagccccacaguaguagaauacuugcuuaguauggccaagggccucgguucagucccaaauacugaaaaccauuauguagcuggccagagcaggcuguggaaguuugaaugagaguggaccccuuagacuuauuugaaugcuuaaccccaguuaguagaucuauuugggaaggauuuggagacauggucuuguuggaggaggucuaucacuguggguaauuucaaaagcccacaccaggccuagucucuugucugucuccgucuuucugcugauucaguguaaauucucagcuacuacaacagaagcugccugcuuccugccgccaugcuccccaccaagguugccaugggcucacccucugaacuguaagcaauaagcucucucuccucuaacuuuccugggucacagcaauaaaaaaguaagugaugguggaggcauagcaugggaacucuuggaaccuugaucaaucauggcacuaggaaugucaaggagcacucaggccauggucuguccacagccuguauccaccauggcuuccugcccauccagagauaggacugcacaccagacccacugugcuucggggugaguguggugcucuggaaaaugugcaggcugccagugaacucuccucugucgggagagguaacugaaaucaaagaaacacuugcagaaaaccuagggcuucugcacaaauccgugaagggaguuggcugaucaacaugacacugugugauuguucagagcugggugaacuaaugagugaagaaggauaagaaauaaugaaauccacugaagagugaccauggcaccacauaccccaaaucagugggaggugaccugcucuaacauacuugucuuaaauaaguagaggauagaaggcuugagagaacuuuuagcaguacugauggaaaagaaaccauucuugacaauacuacuuaaggaaaaaaaacccaacuugcuaaugggugcagguaagcacuguguacauauuuucauaauacagcagauacauauuuagacuagggauuuagcuccagucuugagaauucaugagaucaucuaugggaaaaaguaauuauaaaguuggauuugaugacaagccacuguuuuaauuccagcacuccacagacagaauucaaggccagccugauguauguaacaaguuccaggccagcaagaguuacaugaugagacccuacccagugauuguaagaauuccaaaauucaggauaacaaugcuguaagucuuacauaauauucuaauccacccauaucuaucccuggguuuaggucaagagacuucauguaccuucucauuggaaacagugucagaugaaggacagugcugucuuccuuuuaccaugugcagcagugauggcugcuggguuuacaguggagcaccaacucugcagcacagcaggaaaugaaacaaucauccugccgagucaggacagaaugacgcccugguagggacagaaugacaccuugguagggacagaauggcauggcucuggcccugggacagggccagcagguaugggcuuaagacuuguuuguauaauaauguacauauuuuuacauuucucugaggaauguccucccugcuaacaacauuaauaacuccaugauaaccagagacagcaugagucugggaggucucagcauauugguaaaagcugggaccuuuaggacagcccuuaaggcuguggaaaagaacucuaaaaacaugaguuugaaaauauauaauuucucaacuaugcaaaaauacaaggauguaauaugaauugcauaaggggcuucacagaucuaaaggaacagaggcagcugaacugugagacagcuugugaggaagacacuaaggaaauaaagaguggugaucgaaagcugagaucacacucagcuaaguuuggguuuuguuuuguuuucuguuuaggcuuacaaauacacgcaguuuccugagcucagggucagccugggacagagauaguuuagguccagguguggucagaauggcacucucaggguaagauuacucucaggguaaagcuagaauuacaaaggcaggccgaucucugaauucuuuugcaauguuuaaaaaaaaaaaguacuuguuauucuuuuccuaagaaucaaagagccuggguuauaggaugcugguucauaggauaaucuagaauaaagaacugaauguguaaauaaaaaauuggauuuuuggucugcaugacccaagcuagcagaaaguggcagcaguccuucuuuagaauguuuucucucgcgagaacugagugucuggaaaucucgagagagugaaagcagcucuucugacaggguuucugauuguacuuggaaaaauccauggagcacgaacauagcucuuuuagaauuuuuuggucagaaaucccaagaauuacugacacagucuuuuagaauguuucccuagcagcuaucgauagaaggcugucugaagagugaucauagcucuuuuaccauuuuuucaggcuuucugauuuugaucagaaaacccaagaguuacuuuagaauuuuucuaacaggauuucugacuuagucagaaaauccaagaauuauuuuuauagcaguuuuucugacuucagaaagcccaugagcuauccagagaguuuuuagaauuuuuacuagcagagagagcugucucaaccacgguuuuuacauggggcgggggggacugucuaaagagcagaacacacacacacacagagagagagagagagagagagagagggagagggagagaacgaacagagucugggaagccaucucagcagaacuuggcggccagcuuggacccacaguuuaacuucgaguuguuucuuuucacuacuuccaaacacuccucucagaauccagaccuagcuggugcugguccuuggcaucauccucuucagaagacauaaaccaaggcaggauaauuaugaguuugaagcuauacacuauauaguuaggccucaucuaaaagaaaaaccuaauucaggaaauggcaaaaagaccaaggagcgcggcucgguucccuaaucccggcacuggagcucaggcugggggaccuaucucaggaaguggggugggaaacugaggagaaggcucaggagcucagaauaggaauugcucuugcagaggacugagcuugguucccagcuuccaugugaaguagcucacaacugccuguaacuucugccccaucaggcacuacacucacgugcacauaucuacauguggauauauacacaucauuaaaaauaguaaaaacuaagcccggcgugguggcgcacaccuuuaaucccagcacuugggaggcagaggcaggcagauuucugaguucgaggccagccuggucuacagcgugaguuccaggacaggcagggcuacacagagaaacccugucucgaaaaaccaaaaaaaaaaaguaaaaccugugcuuggcagugguggcacaagccuuuaaucccagcacuuggggggcagaggcaggcagaucugaguuggagaccaaccuggucuacagaguaaguuccaggacuacacagaaaaaaaaaaaaucuuauguuuacaagacaaauaugaauaaauaaaauaauaaaaagaaaaaccagggggaagguggcucagugguuaagagcacuggcuguucuuccagaggaccuugguucaacucccagcaaccacauggcagcucacagccgucaauagcuccaguuccagagcuucugauacccucacacuaacauacagacaaaacaccaauguacauuuaaaaaaaaauauaaaccaaauguguguguguauaugaaggaguacucccccuggguguguauguaugcauaucuuuguaccaugugcaugccugguaccagcagacagcuuuuuugaucagaacccccuagaacugaaauuauaagacaguugugagccaccauguaaguccugggaaccaaaccaggguccucagcaagaucagcaagugcucuugaccacugagcugucucucuacagcuccccccaccccgccuuuuuuuuuucuuuugagacaggguuucucuguguagcccuggcuguccuggaacucacucuguagaccaggcuggccccgaagucagaaauccgccuggcucugcugcccaagugcugggaauaaaggcaugcgccaccacugccugccccuacucuccugaucagaaaacccaagaguuacuuuagaauuuuucuaacaggauuucuaacuuagucagaaaauccaagaauuauguuuauagcaguuuuucugacuucagaaaacccaugagcuauccagagaguuuuuagaauuuuuacuagcagagagagcugucucaaccacaguuuuuacauggugggggggacugucuaaagagcagaacacacacacacacagagagagagagagagagagagagaggagagagagagagggagggagggagaaaaagaugacagcucugugauaaaagcauaggccccaggaccuaucuguaguacaacaaaaaaauaacaaaaggugagugggacuggugucacaccuguaaucgcagcacuuaggagguggaagcaaagagauagcugucaaagccaugcuggcuuugccauaaugauauggcauaauggcuuaugccauaauccugccauaaugaaaacaaguagugagagaagguucugcuugcaggucacaagcgacacuccugcuuauuggguagaauccucuuagggcuuuuuguuugagacagacacacuguguaguccugguuagccuagaacuugcugcauagaccaggcugaccaggaacucacagagauccagagaucuacuugccucugccucccuacugcuggaauucagggcuauguacuaugcccagcuugcccucccugcuccuuuuuuuuuuuccagacagggucuccuguccagcuuggcuucaagccacuauaaauuucagauggauccuccucucuuuccuuuuuuuuuuuuuuaagauuuauuuauuuauuauauauaaguacacugugccaucuucagacacaccagaaaagguugucagaucucauuacagaugguugugagccacugugugguugcugggauuugaacucaugaucugugccagaagagcagucagugcucuugacugcugagccaucucaccagcccuaaaaagaaaaagucuuuuccuuuuuuuuuuccuguuuguuuuguuuuguuuucugagacaggguuucucuguauagcccuggcuguccuggaacucacuuuguagaccaggcuggccucgaacucagaaaucugccugcuucugccuccugagugcugggauuaaaggcgugcgccaccaugcccagcuaucuuuuuuuguuuuuuugagacaggguuucucuguauagcccuggcuguccuaaaacucacuguguagaccagacuggccucgaacucagaaauccuccugccucugcugggauugaaggcaugugccaccaccgcccagcuguuuuguuuuuuugagacaguuucacuauguagcucuggcugaucuggaacucacucuguagaccaggcuggacuagaacucacagagaucuaccugagucugccuucugagugcugggacuaaaggugugcaccaccacagcccagcuagucuauccuuuaaaggaaacugagacaggaacuugaagaagccaguuauacuaauagucaaaaucagagaaagaauugccuucucuaccccaggaccuccugcuagggaacggugccacucacagugggcugaaucuuuaaggacaugcccacaggcuaaccugaucuggcaggacuucagcauuucuugacuguucaauagcccugcuuuagccaauggcgcauccugaguaagcuugaggaauguggugccugccgaguuccacauuacuuucucaauccauaggcuccuuugcaacuucagggcuuuccuuucuggcacaggccuguuuguugaacaugcuaaugaacccacucauguucucugcucugcuuuuucacacagggucucagcauguagcccugccuggaaauccugccucagagucucaagugcugggugacagguuugagucaccguaagugcugauguaucuauccccagaaacaaaaaggaggccccgucccauagcuaauauccgcagagaugucugcaccucacuuuggcaaacacagccacuccaacccagcaaugccacuuccaggaauugauccucacaaacagaguagcucugacauaggaguuauuuauugcagugugguuugugauauuaauguagaaauacauuccaucaauaaagaucuuucaguuaac

SEQ ID NO: 9109 - RNA, 14351 nt, Mus musculus
caguccgcgcaguaacaaggagugcgcgcugcgacaccucccaguucccccggccccgccgccauuucgucgccgggccuaacgguucggccaaucccgacccauauugaaaagagccagugcuccaccaaucggaggccgcugccuccgaccucaccucgggccggcccaauccaggccgcggccccuccgccccgagcccgcccccgcggcguccuuucuccucccucuuugugcgucuggcgccgccgccgcccgccgcgugagaggacgggcuccccgcgcucuucagccgcguagucggguccccucccccccaccuccagcucccggaagguucgugaaggagaagucgccgcggaggacgaggaaccgcugcugccgguccccuggggcgccauggcgaccggagcgaacgccacgccgcuggguaagcugggccuaccaggccuuuccccacuuccugggcccagaggcagcuucaagcccagccuauuggcgcucgggacgccgcugccgggggcccuaaccacggccuuguccuuagcggcggugccgucaccgccgccgcccccggccucguacccgccauagcagccgcccccgcgccgccgccgcucuuuucagcgagggucgccuccgcgccaggaccagcagccgggccagcccgguggcggcggaggugagucgggccgauagagcgcgagagucgucgggcgaaccgaaccggccgacggaggggcaacgccaccgcgguuggacgcggcgaggacgcgcgcgcgcgcacgggaggcccgggcggacgcgccacggggaacgcgcggccugguuugggaggcuucgauugcgcacgcgcaccgcgagaaccagaagggcgggaggaagcguucuucgcgcagacgcagugaggcguucaggcuuuguggcgcaauugugguaguuuuggaagaagccaccuguugcccccugagcuccugcuauggaggacaggagagucagguccacgggacgacguggugugaguggcucccuugaugguuuuuagcagccccguggcaggagugucuccuuucacagugaggcgaguucggaaggcuacuagggaugcuugaguucgaucauuuauuaaagguuuucuccuuuuguuuucuagaagguucucagagugaccagcuuuccccgugcuguuuuaaaaggcuuuuucucugggccuguaaucugagaaguagaaaaccuugugugguaaauguagggaagaauguaauaaaucagaguucugaugacaaguguccacuggucaggaaaacugaucuuuccacgaguaagaauggucauauugaaggauggcauguuucccacaguaauguguagcaagagauuuguuguguacucuuguagcuugaguuccaaugcuuugugggccucauuccaguuuccucuuuucugcccuuuaaggcauucagaauugauaauauguaucuguacacuucugauucuggguuucugugcauuaagucuuggaagcaagggcaugaugguucaugcuuuuaauccuagcacucuggaggcagaggaagguggggcuuugaguuugaugccagucuacauaguuuaagacugccaggguucucuaaagggacuucugucucaaaaaacaaacaaaagauccaaagaguuggagauaugcaucagugguagagcucuuacccaauauaugcaaaaacucugauguuaacacuacaaaagaaauguguuccuuguuacauucucuaguauuuucguuuuaaaagaacuaaaugugaacuguuccuuaacuuuccugacaggaggaucuuuaaaauggcugcuuguuuucucugaccucugagauuucuuucuuuuuaaaaauuuaggugauuucaguuuaguuuuaauuaucaugaacugcuugccuucugguucauauuucugccugaugggcucugucugucuuuagacuucccaaguaagaagaggaagaggagccgauggaaccaagacacaauggagcagaagacagugauuccaggcaugccuacaguuauacccccuggacugacucgggaacaggaaagagcuuacauagguaaauacacguucuacauccaggugcaucuucagauuguuacugcagauuguucugagugaugaaccuguugaaagucuuaagauuuuagucaugggaacaaggugugaugagcuaugcuuucauagcuguguaauccgugauuugcuuggccaguccugcauuugcagcuucuuguuugggccugcucuuagcucggcagcccccuucucagcugcuguucuugcucauuggugaggugaaugcuaucuuccucucuggacaggccccaguggagaacacugcagguauuguaaaccaguugcuuuuuuguagcauggccuuucaccauaaugucaugguucccuuucccuaaaauugugguuucguuuuuuuauagguacaaaauaguuuaagcaaaaaguggcucggaaagcauuuauaguuuacccauuuuguugaauuuaauccuucccuucaguauccuuucuuguuccaucuuuagagagcugucuuaaaacaggcucuuguaauuuaccacuaaaggacucugcugggaaggguuuacuguuugauuugaaaugaagugguggcagaauuuaaaaaauuagguuacuguccacaguagaauuaaaccucaaaauuacuuaaaauccaaggucauaauaaauggaaguuuuauaucuguccugcugucucaaaaagugcacuugauaaacauuuucaacuaaccaaguaaacauccucuuuggggcagaaaccucguuggguccauugagcuguguccuucucagacagcuucaaggcuaaggugcucugagucuggaggucuucauuuccugguucuuagauugcugaggauuuugaggcguggaauugucugcuucucacaguacuuacuacuaauccuacuuucuccugcuguuuacucucaccuaagccuugggugucauuagaccaguguuggaccuuguaagaugucuuagugcucccacagcccaagaccagucuaaaaaaacaguacuuuacaacucccucucuuccucuggaggcccaguuaaugcaucaagcccuuagagacuauuuacauauuuuguugaaguagauaaacucagaguuagaagcuagggugcauuuuuaguucaagggagguagcagucuuuccugguuuauucuucagugcuggauguuuauucacguuagaucccacaacuagaggcugcccuaugguacugagcugcuagguugcugagcuuagucuggcugcaagccuagagcuuguugucaugaaggagcuuggagaguagcaguguuuccauggcacauuugcuuuguccagggguccuugguauccucuucacugucgauuuuuuuuuuuuuuuaaucaguauuucagcauggagauguuguauaguccugugaaacaugucuuaaugcagauaauuagaauuuucuguauuuaagguauguauuaaaccuaauuguagguaaacugugccauuacugcuuucucagagaccuggggcguaauaaaaauacauaccagaagcagucacauaccaugucgaagaagcuacucuagguuugcuaucuauccuagugcuguguuaaauuuugucugaguuacugacagcuuuuagugaaucucucauguuucaaaccugggggccauauacagucucuugacccucacuuagcaucuacacaccuuccuaagauaucaguagcuggucugaaaauaaacuccuaggcgggugaagguagugcacaucuuuaacccagucacugaggcaaaggcagaugauuucuggguucuaggccagccuggucugcacagugcauuccaggacagcgagggcuguguuuuuugagacccuaucuggaaaaaagggggaaaaugauaguuuacagcaccuuacuuaggcccauuggauuaugaacaaagguaugugguuugcucaguauuugaguaaaggugcagguauuggggagcucuuuuaguacagaucugguuguacagaaaguacacacacaaaucuguaagauguuaaauugguuauugagugucuuacuuaaagaguuuuaaaucuugucuuaaugaaaaugaucuuugcucaacugcuauuuuuguugucccauguuauuugaguacuuuugggcuguguuuaauacuuauuaaagaaauagaaacuuaaguuuugcccugaguuuggugggaagcagguacugauaucuuaaaugccguugguuugggguaccaaucguaagcaaguguugguggagaagggagaggugaauaccuccugauaauuggaauuguaagcuuuagugaacagucuuaacugcuaaccccucuuccaacaaacuguuugcuuccuuaagugauaaccauuuugagguggacauuagcuguagauguagauggacuccugcgcuaggugguuggggguuuuugccucagugugucacugaucagucgucccuuucaaagucuccgaguucuucaugcuuguuauugagauuugagauguuuuuugguaacauugucuuuuuuccauccuuuuuuuucuuuccuaaccugguuucuuccagugcaacuacagauagaagaccugacucguaaacugcgcacaggagaccugggcauccccccuaacccugaggacagguugggaaacaguuuuaaccagcugacaguaacgcuuuuaccuuuuuucucaauauguuuuuacugguggcaacauauugugucaguucaauaacuccuaguuaagacgacugguauucugaccagaguagacuauaugcucagucaacaguuagaaaaguucucuuaaugggagaauaaguuaaagaaaaugguuaacugguuucuaauugguaagcauauagguuuuaaccugguaauuugcccaccccuagggacagugagagguggccauuaaccugccuuuucacuggcugcuuuggcugaaagcacaggggguaguuuuucucauuggguauguuaugcagggauuugagaguauuuuuaaccaucacugaauuuaagcaggccaaagcuuguugaagucuuaccugcuugugguuuugagauuguuuuaaaaucaggagauuucuaaccaacuuccuucauugccaguuaauuuucagccuuggccauugccugccugcggguuuugggaagggaaggcaagcaaccaacccccuaaauuauuacuuuuuccuuuuuaaaagggaguaugggccucaaacagcuguggucaugccauuucaguuugcaguuucucucaccucuggaaaguuaagaugucugugagagaggaauguuuuaaguggaauuuuauuggcugguacaggucuuugaacagcuaaagucuuguccuuuaauagacaauaagcuuccacugaaaucuuucuuagugcauguagcauaguugaaaagauugcuuugaagguguuucuggcuuuuguuauccuggucacaugcaguucuucugccccuuaccaugaaacaaaugaaccuaaugauuucuccauuauugacuuuguuuugcuuaucaaguuuguucuauuuuuacauauagauuuugguuggaaauuuuacauuucuuuuuugauuugaagauuuuuauuuuuuaguuuuuuuuaagauuaacauuauagguuauagaccacaacuguuuagugccuuuuuggccuuuuccccuuuaaugguaugucuacagguuaccaggcaauuccuccaaagguugaguuuuuaacaaaccuuguuugcuuccuggaaaacugggauuagagugcaguugaugucucugaugccucuucuaggugaagaaguccggccagucuaaccucuagauugcuagcuuuugcuuuucacuuccacaguuugggaagagguuaaaugguuauaaagccuuuaaaaggccaguuugguucuuguacaauuugguaauuagccagaaacacucgauccuagauagcaaugggguggauaugcuagaaaugaguacaaccaggacaggguuuuccucccugugugugcucaauuuugaaagaggcccuaaugccugauugcuuuugcuuuuuaagcccagguuggagggaaauacaugaguuucuuaccuuaauaagaugacuucuuaagguguauuucaaaauuaagccacuuuaugcuauuuugauguugcuuaacuuguacaguuaaaauguuuaaaaauguuauagauuuaaauguguaagaugacagucuaaugaguuggggacauuuguuugugauuaccaugacugaauugugcuaacaguucauacagauauuagaaacggaggugucauuuagccgucacuagccacgaacaaaccugaccuuuuauuccaucguguguguaaccugguaugacaugguucccuuuaggcugaagacagugggagcagccgaguucaguucuugcucuccaacuaggcacaguucucucaacuaaaccaaggguguaggagucuggacucuuuucaggauguuuuuuaaaauaaccugauccacauggucucuucccuucuugcagcugcuacuaaauuuucauacagaguaucaagccuauguccuuuuuguaaucuuaacucaguucuaggaguguaacuucucuuuuuuguuaccgcaaaagucuagcugugguaaacugaccauuuuaucauuuauauauauauauauacauuuuuuaaaaaauuuuuugcuuguaacagcauuuuacuccuuaaaaaugagagagaaauuccugcuuucugaacuuguaaacucugguggagaauuguaguuccuucccccuugcuguuggcagguucagacccuagacaaguguuugacuaaauuugcauuugcagccucuuggcagaggcuguguuagcacuuuaacgguuuucucuacucagacuccccaccucgaacagccagccaggccauugaaggaaaagcagagacgaagccuugcaccauuucucuccauuguggggccaaguagcuacaguagcuugagucccagcugcuugggugaacgagcuuguguucacuauguggcagggggguacagaugcucuuccugauaggcacaguucaccauaacuuggguuucugugguucaucaaguuugguuaucacauauuuuuucaaaugaaagagucauuuggcaagaagcuuccagaggaugguccuguucuugccacuugugguccagagguuucucuuuaauagauccuuccccggucacauagaaguaagagcauuuuucccuuucucacauacaccacaguuugcuuaacguuaagucagauuccaucuccucauuccacacgaucuugaauagcacacguuauggucgguuccuccgaagaguguuguuaggaucugagaggcagaggggcuggggagacuuguuauaguccaugugggagcaaggugagugggggucagagcaguaaugaggaucugucucccacagguccccuuccccugaaccaaucuacaacagcgaggggaagcggcuuaacacucgagaguuccguacccgcaaaaagcuugaagaggagcggcacacccuuauuacagagaugguugcucucaacccagacuuuaaaccaccugcagauuacaaguaagcagagaacacauuaaaagggcacacugaguucauaugugaccugcugggacaauucugguguaccuacucaccuuuuggcccaaauuauccucaauucuccauaguauauacucucuugauuaguuaaaaaaagagcauggauuaugugugccaccucccagaaauagauggugaugaucuuuucuuccuuaggccuccagcaacacgugugagcgauaaaguaaugaucccccaagacgaauauccagaaaucaauuuuguggggcuccuaauuggacccaggugaguaauuacuagucuauggcacccuagguuuuaauuguauuuggguuuguuguugaauuugguguggcauuuguuuuggcuggauuaugcuuaaacucgauuugugucaagguguccgucccaccacacacacuguuuucugugaauuaaaauccugagauguuagagcugaccuuaggguacagaguccuugacuaggugaucccacgugcugcauuuugcaguuucccacuaaugccuacucagcccagccuuuuuacugaaguagaggaguuugcacagguuguguaaacagucuuuucugccuuugauagagggaacacccugaagaacauugagaaggaaugcaacgccaagaucaugauucgggggaaaggaucagugaaagaagggaaaguugggcguaaagauggucagauguugccaggcgaagaugagccucuucaugcucuagucacugccaauacgauggagaaugucaaaaaggcaguagaacaggugugugcugagcccaggagggggcuucuugcuggaaaccuaggugauggcccuaaguacuuugacaacuaacugcugcugcaucuuaauagaucagaaacauccugaagcaggguauugagaccccagaggaccagaacgaucuacggaaaaugcagcuucgagaguuggcucgcuugaauggcacucuacgggaagaugauaauagguuagugauaauguugagaagaaugcauagaaauuugaaccuuuuugaagugggacaguggucucuacagguguuugaauugauuucucccaucucaacaggaucuuaaggcccuggcagagcucagagacgcgcagcauuaccaauacuacuguguguaccaaguguggaggggcuggucacauugcuucugauugcaaauuucagaggugaggccuggcuguugaaguggcucuccagcagccacugguauucaggaucuuuguuuuuauaaugacucacgcaugguucaucucaugcaccagagcagcauccuuuguggaucugggugaugugaguuaaggcucaagaagacuacaaauguguaaugccuccugguauugucuuuuguugucuuguccaaaaacuuaugcucugacuauaaauguuuccauuggguguguuauuaauuuaccuuaacugcuuaaguuuaagacuaagauuuuuuuuuuucccauaagguccuuuuaauaguuaaauuauuuucucucaaacagggaagauacuauaguuauauucauuugaguguuuugccuaugccuacauguacuucuguauuuugcaugccugguuccuauggagguuagaagagggcuuuagaucgccuagaccuggaguuacagaugauugugagcugccaugugggcacggggaacugaacccauauucuuuguaugaauaauaagugcucuuaacugcugagucaucucuucagccccauagagauaggauugauagaacgggagagaugaggauggggcuggagagacggcucagugguuaagagcacuugacugcuuuuccagagguucugaguucaauucccaucauccacauggcggcucacaaccaucugaaaugggaucugaugcccucugaagacagcuauaguauacauaaaaauaaaaaaaaagagagagaugagggucuuguacggugguugguugcuggaaucuguaauccagagccucuuuugugacuggcagugguuaaaaauagacacaaaauggacauuggauaacuguuuccaguaaaggauuagaaagggggucacauuugacugaaugcucuguugguauuuucuucuccuuacuuuguguuucugacccuacuuuaggccuggcgacccucagucagcucaggauaaagcacggauggauaaagaauauuugucccuuauggcugagcuaggggaagcuccugucccugcaucugugggcucuaccucugggccugccaccacgccccuggcuagugcaccaagaccugcugcuccugccagcaacccaccaccaccggugagcccugggacaguuuucuggucuagcuccccuguucucuucugcagagauaaggagcuauggccaaggauuugggguaaagcuuagagguggauauagcuggcaacauuguuuuucugggaugucuggccucuguagggucacuuugggaggacccuguccguguguccuugguccucugacauagucagaagaacaauguugccaccagggggcgcaggcgcggacauuggcaggaaaugcucucacguagucucucaugucuacaacucagagccgcccacccuggaugaauucugguccuucagagaaucggcccuaccauggcaugcauggaggugguccuggugguccuggagguggcccccacagcuucccacacccauuacccagccugacaggugggcauggugggcaucccaugcagcacaacccaaauggaccaccaccaccuuggaugcagccaccaccaccaccgaugaaccagggcccccacccaccugggcaccauggcccuccuccaauggguaaguaagugucagaccagaaaccuuggggcuugggaggggagauagggucaccccaaguagugagcugugagcugcaacagcaguuuggcuagcuaguacucugaaucuagcuaguacucugaaucuugcugaggucuaggcucauggaggaucugugcggggagacccaugaacuuuugggucaaaaagcugagaaagcuaugguguuuugccuggccaguucaaauguccugcuaagucccugcucuuuccuuccaucaagaucaguaccugggaaguacgccugugggcucuggggucuaucgccugcaucaaggaaaagguaaugcugcuuacucucuugggaucucugucuaggacugggagcaaauggggcuucuagcccaggacccugcucucuaaagcccaggacccuggucuuacugccugcagguaugaugccgccgccgccuaugggcaugaugccgccgccuccgccaccucccagugggcagcccccgccuccucccucugguccucuuccuccauggcagcagcagcagcagcagccuccgccacccccuccgcccagcagcaguauggcuuccagcacccccuugccauggcagcaaagugaguggaauauuuugggcuugugggggugggugggaugugggcuagggcugaggggaacaagaaccucauaauuucacacaggcuggagacaccuucauugaggacucuggucucucagcaagggcagugggguugaaagccaggcugccuggcccaagggaaugucuuggggaggagagcugauguuuggcgugguuguguuugggagagacuugggaggucuggaggggagcuugcuguuguagauagagcaccagaaguccaggcuaagcugcugaaugagcugcugguucggccaugccuugugagcggagucaagagugggauggugcaugcauguucuggaggggguugugauugggccugagagacugcagaaaaaagggaaggggccgauggggagagaguaguugugggcuugagguugaaugugccguucggugguggcggcggcugggcggagggacgucaaagccgguucuugugucuggaacuuuccccugagccccuccaggggcauuggugacaaagggcuuacuuuguuaagcccagagaccaugaggcugaccccaggguaguccugcccaccccuccacucccaucaccaggacagccccgcccgcccgccccccaccaccguacagcaugccaaagcaaggagcaggcgccccucguccccccugucccaaggcagcagccgcagagagccgcgguguacccccgcgcgugugaccuugggcuucuuuacuaccccagauacgacgacuaccaccacgagcgcuggcacaggguccaucccgccauggcaacagcagcaggcggcugccgcagcuucuccaggaaccccucagaugcaaggcaaccccacuauggugccccugccccccgggguccagccgccucugccgcccggggccccucccccuccgccgccuccgccaccugguuccgccggcaugauguaugccccacccccuccuccuccgccucccauggacccuucuaacuuugucaccaugaugggcauggggguggcgggcaugccgcccuucgggaugccuccagcucccccaccgccuccaccacagaacuagacuuguuuuuuuuuuuuuaagaaaauauauauuauauacauagagaguuggucucuuauaaacacacgccgaaccucaccauauggagccagacauugggaugcacgcaugugauugugugugcacgcaugugugugugugcacgcacugggcugggccaagugacuggacucgcuugggaaacgggcagugguaguggggcgccagcuugagcuuuccuggcaccuguagcaucgagugucuucuuugucuucucuccucacccaacucccucugccucuccccaaaccgggccgccaggaucccuccccgcggcagcgauggcccgagccaugagagugaggacuuuccgcgcccauuggugacccuuccaggcagacagccucagcagcgccccugguggacaggaugguucggcaaagcagccugaguuauuuuuguggacggaaucggaacacacuggcuccauauugugaaauuuuuauuaauuuuuaucuuuuuccuuuguuauuuccuuaucuuuuccuuucuucagacuccguccaaggagaugcucuccccggucuucugcugcagauaggauccuucccuugucuccauuccucuccucccaaagggagaggggcaaaugguuuagguacaggcuuuggcuauuaaugucaggcuugguggugggagugggggguccuaugguucuaauuguugaagggcuucagccacauucaaaauaaguaggugguuuaucuuugacaucuuuuaaagagucuggauaaaucugacucguugcucaauaggguuuauuuggcagugggauucacaucuuccugcacuccugccagcaguacagggcacagcccaagccaccauaggccagccuggagucuuuuucaugcucuggucacccaagcugccucagaacccauuugcuucucuccuuccuggaaagcuucccuuuauguuuuauuuugaccccagauguccagauguuuugcagugucuggggcuugugucccuuguucuucguucugcugcuuugccccuuccuucccucuucauggagugauuauguugauaauaauguguaaugcgcguucuuuucacugguuuaucuacagaaauuucucugggccuuuuuuucuguguuugauucaacacugcacuaagggggaaauguuccauugaauaaaagagcagugugguuuuccggguccguuucuuuucuuuuaaaaccuuuuuccugaccaucagcaccaaguuuuaccuaccuacccuggccccagcuccugcaugugaauggcuucagccccucacuuuuucuaguuucuaguugauagaacugaaaagcaggcucacuccacauuucaggagucuuugucauugugacagccuuuuccuggggcuccgacccccacccacauugaugagcucuagauaggauuugugucuccuagcugcugcccgacuuaaggaccuggaccuggggaggcaucagcacuaaaggucacgcuaacuaauccugcuugucgggcacagagcugcuaaaauuaaaacugccaaguggcuuuuuuucuuucucugcugguggcucucagccugccaggacugcaggucuaggggaguaguagggacaaaacguggugcccugugcugaguggccacgucuacagagucuucugcaguucuccuguuuaggguacuaggaaaaucaccccuugugucuuugugagagccacgucuuuggcagcucauacagcugcugcugcuuugucuagaggcuugagggcaguugcugucuacccuuaggcuuccuaaccaagcccucaacuagagguuuucccuauugucuuuaaccuuacagugugggggcagggccuggccacccucuucgaccuuggcuuuaccucauugcuucccucacaaucuugguuucccuggugggcucauugggcgguuaauuagcucuuugaagcucuggaagcggcaaaguggcgcuguguggguuuuagaaguaaaaucaauaaaugacuuaaccauggcucagcca

SEQ ID NO: 9110 - RNA, 15362 nt, Mus musculus
agaccgggugggagccgcagccgcagcgaggccggcgggcgggagcgcacggagguggcgcuggccgggcaggguucgggguccgcgcugcgggucccaagagugagugagcgagcacgcgcgcggguggggcgugggacacagagggugcggccccuagggaucuccuaggggcaggcuggcggggacugcggguggguggggaaucugcgguccugggugggacagagcuugcggaggggaugaggcacuuagagccacccgcaggaggggggcguucgaggcauuccggugcucgccugaaacguaucuaccaggcucuucccugcaaguccccauuugacagaugggaaaauugagguucagagagacuaaaugauucucaaggucacccagcaaggaaguaacagucaggagggaacgacucugagaaguccucgggaggauucccuaauguaggggagucuguguaagggcgaggucccuuuccuugggacaagguuuuggcgagauccaggaauguaaagaaccccaggcuuuggggcugcgagcccuggagccugguugaggggggaggggcggcagaaugggugugugcgcaaccaggggguauguggaugcgugugggaguguacaugcguggagaugcacugucuuugcgugugugcacacguguucagaugucagagcuacugugaucgagagaucagaggcugagcugguucaagugaacagaaggucugggaggugaacugcauucagguuugcauucugaaguaaaggacuuggguauguguggcugaggauuuucauugcaggugugcaugggaugugggugccauugugugugauuaggacgggaggugucuaugacccuggugugugugaaaagggucuucuugcacuuaauguaggucauuggccuucggcaaauaccuagucuagagaauagguguuuguuccugcaugggugcuuuuauaguccccacugaugaccaggauuauuaauggugucaugcaggccauggcgcuagcggccccuucugggcucccuacucggugcucucacgcacaauuuaacuaugcagcagggugggugggaaggcgggagcccagguugggaagauauauggcaauucuggaagggcuaggaccggacuccugggaccuuaguacuuguggguugggaguccgcgguucccaggcuuuggcuucccacugacaucucccaaccgcagugggcuaccccucccaccccccgccccaggaauguucuucucucuagcccuccuccccaagggcaggccccugggggaugcuacggccccgccucccacucggggagcccaggagggggagauguaggcaggacuccuggguucccuccucccuccuuccaucccagggagaaauuccuccgagguccccucaggcacuggguucccaaaauaacccugcgggggaagggaggcugugaagggaggggaagcgggaggagugcagagucaagcugugggguguugcaggugccuguggggagcaaaugcaaggagaggagggcccgccaggaggcuuggggcacuaacuaaccccugggguccuggcucgucccuuauucucguagaacccuucuaaccucccgcgacuccgcgggugggccggaagccucucagcuaguccauuucccaacuagcgaguugcaccaucccggggcaggaccguuuaacccuagaggggcaacggcaggcaacuccgcccaugcccagcagggggcgugcccacuccgccccguuccuacgcgccgagccgcuccccccaccucccgcgccucugcugacucccacuucucccaggacagggguccgaauugagcaccgugggaggcucugagaguguagcuugggucuagccuacuggcaccggcagccaugacgagcacucuggaccuggacaagggcugcaccguggaggagcugcuccgugguugcaucgaagcguuuggugaguugcaugcagcacgaggggucacacccagcuggacccugaaccagacucuaggccagaaccuacccaggcuccuauuuugaagucuucuuaagaaaagcuccuugauuuugcggagaaguaccccaauguaccccuuguacagacgucaaggaaggggccccagggucccaacacugaccugggaggggcauuaucugucucccugggggauccggaggaacucucuaucucuagccugggaacuguuuccggcagauggggguugguuuaucgggugaaaggggugccccuucccccaacacucaggaaaugaccucuggauucuugaccccggggaacccaggcuccuuccgcuccagcugguuccccuccugacgacgggcuugguccaagcucuccuccuccagccuuuggauccugugguaccccucauccacccagacuuauuucucaauuuucacuccuggcuuuggaguguugggaaaugcaguaggugggugagguccggagugcagacccagggaccugucaccagacugcagacuaggcaucugugccuccggaccaagggucagcuggcuucuuuuggacuuuuggagcagaugacuccggaaaggugcgagauccacagcuagugcgcauguuucucaugaugcaccccugguacauaccuuccucucagcuggcuucgaaacugcuccacuuauauccuugauggggcauggcucaggcucuguuguccacgaguccauucugcuuggcuugcucaagaccuuagaacauagagugcagacccuaccuauaucacacaauucagacacugaucagucuucuaggaccuaggcuuugcccugugccuaacugaggacuugggcucuccuguuaccuaggccuuggccucauucuccccuaacgucuuggaucagccccugcucugccccagggccuccucuccaucuauggugaaauccaacccuccgccuccaucaauacugccugcccccagaguugacuuaucaguucccccucuccccaugcauucuccuggguucaaagcaucccaugcgucagagcccaggucccuucccuugggugcgcuuccgcuccucuuccuaaccauagguucccgucuguugcccuuaacccuccuuuaccuaucagcaaucccggaaggacaacuccaauucucuacagaugaaaacgugucacuuggucaggugagucugggcccuggcuccuccucuugcuacccuuuugaagcuucgugugggcuguaggaguggacagacagcauugaggggaccuaccguguggguuuaccggggaacacuguccaugugugcugccggccucggugugucccgcuugcuguuguuucugccgggguuguggauggagaagaagcagaggucugggaugaaggguggggugggaauggcugcauuucaccacagcacacugcacccugggaugcuuucccucugcuagugagcaccguccuguauguaguuucuuccccuguccacuugagaggacuuucacugugccugccucuccaccagguacuggaucucagccuucccagcagaguucgacuugaacccagagcuggcugaacagaucaaggagcugaaggcucuguuagaccaagaagggaaccgcaggcacagcagccucaucgacaucgagagugugugcgugggggcggagcgcaaggggcacuacgcaugcuacaccauaugugcuuaauaaaugucuguucaauugaaugagugagggucaugucacucucuugcuuuaaaaccucccauggcccccuggcuccuucagagcacucguccagcugucagggcccuuugugacgccaggccagccugacauuccugcccugucucccgcacacuucauacugcagcuccuggggucugcucgccauugucuguccugcauccuuccucuccauggugcucccucuuguugccaugucuccuccauucucaccagacucagcacaagugugaagucccugcucagcgagggugcuccucucuugcagagcagaauuugccauucuugccuuacccccagaugcucugggcagacuccuguucggugacaguguguuucugugucugucucccccauuagauugugagcuccucgggggcaggcaccgugucuugcucaucucuguaccccagcgccuagcacagcgccuggcacagaguacguuguccaucaguguguguugagcucguggugaaggggacacgugagggaguugcugggaccgggggauguuacugcuuaggaugguggcuccugcuguuugggucucaagucaguuugaguggcaugucugagugagaguggggucacaggaagcaggggacaucuccagcacagggcucacuaccccugcccccccagcccuaccuacaaauggaagcggcaggugacccagcggaacccuguggaacagaaaaagcgcaagauguccuuguuguuugaucacuuggagccuauggagcuggcagaacaucuuaccuaccuggaguaucguuccuucugcaagauccugguguggccugaaggcuuguggucggggugcagugugggcugagaaggggaaggggauuccaggaagggcuaagacugggugggggggggguuggccccagggaugguugggcgguuucaucaaaugacagagggagggugagcaaggcagacagugaugggagaggccaacagggugcucaggccaaccccacuuguccccaguuccaagacuaccacagcuuugugacucauggcugcaccguagacaacccgguccuggagcgauucaucucccucuucaacagugucucucaguggguccaacucaugauccucagcaagcccacagccacgcagcgggcgcuggucaucacgcacuucgugcauguggcagaggugcccaccuuucccgugugcccagccuccgcgugucuaucaagccccgccccuucucuccuaagggcugcugggugacaugucgccuccccucucuauuugccuuccagaggcugcugcagcugcagaacuucaacacgcugauggccgucgugggaggccugagccacagcuccaucucacgccucaaggagacccacagccacgucagcccugacaccaucaaggugccugguuucgggaggggccugugcuucacagcugcggacuucgcagugcagugcugaggucuaggcucgcucgacuguucuugucucacagauaaggaaacugagacgugaaguggggagcaaggucuuuagcuguacaaugcaaguguccgugguggcucccaggccugcuuggucccaaagcuaauuucuucuucuuauuuuauuguauguguguuuguauagugcauguauguucacgggugcgugcaagagaccgaagcgugacauugacugucuuccucugaacuccaucuuauccuuuuaaaauccagaaguuuaaaaaacauugcugagucuuaaaggaugauccgcgaccucugcccaagcagcagggcucagggucaaaaccuccgggaugagaacucuccuuuucucccgagcuuuauuguguguguaccccagagcaaaacucugggggcuuuuuguuguccauuuccgccguccuccgaguagauacacgcaggauuuucugucuccgauggucucauucagcgugggugggaggagcaugaaugggaggagcuucccaguccacgugaugggaggagcuuuccauccuguccuguggugaucuuuuuuguuguuguugcguguuauugucuguccuaauuuaguauuugcuguauuguggaacauuggaggguuuucuuuuuuauaaauuaacuuauuuaguguguguauaugugcccauaauggguguguacaugugcccauaccacaguucuuguguggagcucagaggacaucgugcaagagucuguuuuuuuccuuuuaugaugaggacccuggagguugaaccaggucuucaagcuugaugccacucggucauuuugcuagcuuccucccuccauuccucccucccuucuuccucucucuuuuucuuuauuuuucucucucuuuuagauucagguaucacuguguagccccggcuguccugaaauucccuauguagaccaggcuggccucaacgucacagaguccaccugucucugccuccccaguccacaucagggucuuuuuucuuucuucuuuccuuucuucuuccuuucuuucuuucuguuuuuuguuuuuuugguuuuuuuggagacaggguuucucuguauagcccuggcuguccuggaacucacaucagggucuuguuuguuuauuuuugggauggggagucucauauauuccagacugucccugaacuuguuguuuaccucuagucagagaccuucaccgccaccaacugaaccgaguuacagcucaagccuuccuuuugaaccucuccccucaaucccaaccacugcuugguuuucugguuuuucgagacaggguuucacuguguagcccuggcucuccuggaacucacucuuuagaccaggcuggccucgaacucugaaauccaccugccucugccuucugagugcugggauuaaaggcgugcaccaccacgcccagcagcccaaccacuuuuugagacaagguuuugcuguguaaaaucuuggcugcuugguacucacuaugaagauggggcggguuuugaauuuauaguuauccuccugcaucugccuccccacugcugggauuuugggcuuaugugaccaggcucagcuuaagcuuuuuucccagugucugccaucaccaaacacccugccuaguaacauccuucuugaucaguaggcugguguuuaaauguugauaaccugugcucauuccuggugcguauauguaugcaugguagcugguccuaguuguuuucuuggacucaugaccugugagcuuugaucccuggaguuugagagagcaguguugggagcugauagggaggauuugaccuucuugccuaucuucggccuugcccccaucccuucccacaguuccagggcugaagugggaggaugguugaguggugugggugagugacacucugccuuuuccccccaccucuuaccccagcucugggaaggucugacagaacuagugacagcuacuggcaacuacagcaacuaccggcgcaggcuggcagccugcgugggcuuccgcuuuccuauccugggagugcaccucaaggaucuaguggcucugcagcuggcucugccugacuggcuggacccaggucggacccggcucaauggagccaagaugaggcagcuuuucugcauucuggaggaguuggccauggugaccagccuucgcccacccguacaagccaaccccgaccugcugagccugcucacggugaggggcugggcagcauggcugcauuugcaucugcuguggcugugugcuugcuggguucugagguuucccuugggcucuguuuggggcuugcucuggacucugaugugauuucaagguugggcugagaccugggccuagggucuggucucaggagcuguuaaugugguucauaggcuuagucugaggcugggccuggguccuugcuccugguaguggauuauauucgaaaggcaggacuaaccuuuggauuugugggugccauggugauuucuuucuuucuuguuuuuaaagauuuauuuauuucauuuauaugaguacacuguagcugucuucagauacaucagaaaaaggcaucagauccuaacagaugguugugagccaccguguguuugcugggaauugaacucaggaccucuggaagagcagucaaugcucuuaaccgcugagcccugacaugggugauuucuaacauggcccugggcuccugagugaggcucuuuuaguauuuacuuguuuugauuuugagacaggaucucacuugguagcccagcgacucagaccuacuaggaagccuaagcuaaccuugaacucguggaggucuuuaggccagguucugacgcugcguuuuggcugauauuuuggcaacgaguuguguuuaaaguuggcucugugggccggcuggcacggaagugguugcagguguuuucuagcuggccuuugaccugagucuagcucucacaucaggcucugggcagacugguaguccuguggcccugaguuugggacuccugugugagagaggaacagggaucagagggugugagcagaccugugugucgccgcaggugucccuggaucaguaucagacagaggaugagcuguaccagcucucacugcagcgagagccacgcuccaagucgucgguaagggagccccuuccccaucaccccaucacugcacuuuaguauccuaggaugcaaagacaaaaccccacccacuacacuugccugacaauggaaugcuggggguugggguggcuuugggcagacucucuuuccauuuacucgagccuuagauucauuccugcucuggcccuggcucagaccuaacccucuuccacagccaaccagccccaccagcugcaccccgccuccccggcccccuguguuggaagaguggaccucaguugccaagccuaagcuggaccaagccuugguggcagagcacauugagaagaugguggaggugagaggcguggaggccgagggaaucugcugggaauaggggugugugaugcugguuucccuagagccuugcccugggagccacuguuaaugccagugcuaaccauccccagcaggcaccacuccaggcaagcuaguugcauuaugggcuggggagacaggaccaaaaaggagcaugggagacaucucugauacucuuuauaauauagacugggcucggagguuccuuuuaauucuccccucuccuggucuccuguguuccucuguagucuguguuccggaacuuugacguggauggggacggucacaucucccaggaggaguuucagaucauccggggcaacuucccuuaucucagcgccuuuggggaccuggaccagaaccagugaggaggacaagggcccggggggugggguggagggaagacaucaaucuacuucccccuugggcuccagugucugugugugcagagagcgaggccuugcuugggaagcugcccauguggcugugaugggguggagggaagcugccaguccuagagggauagugucacuuugguaguuuggacagaugggggagccccaccugagccuggcaaagagaacacuuuuuuauuuguagagcccauagcugccaagagugugggcaagucgagcuccuggguuuaaugaacagauaaaggccgugauuagcagcauccaguugcuuauccacagcucacacacagacaggcuggaaaacaucuggaucucugaagcagguugaaugugcccucuguaaccaugucuaugccccauuuuuuugcugagaugacaaaaacccaggcaaaauuuaccguccaucccagguugauuuauuuuuaaaugugaccuguauuucaaaacuaugugguuuggggacuggggcugugucucaguuggcagaacaucugccaagcaugcuugaagcccuggguuuuauuccuaaccaugacuaaugcgcaggcggacacacuucugccaucccagcaccggggagguagaaaggaccggaagcuccaggucacuuucaauuccauagcagacuugaagguagccuggguuacaugggcuugaucuggaaaaaaaaguuuauuauuauuguccccacauuacaaaaauuuauguaagaacaagauccagguaauaaaauaaaugaacaaguguuuaaaguaagcaaagauuaaaaaaagaaaggaaaaaaaagcagggcaggggugcuguaaccuuugccaacacugguggggggcggggcagaggcagguagacuuugaggauagcuuauucuacauagauagccuguuucagcacccuccccugacccccaccgaaaaaguaagcaaaagucuguuccuuuccccauuauguagccuaggcuagggugaacucagaauauaccucaggcuggccucaaacucaaagcacucuuccuuuguuuuuccuagcacagggaucacaggcguaggccaccaugccuggcugccuccauccuuuuuggcauccauguaaaauggauguagauuuggucugaagugaguuuuguugauaaacaggauucacgcauggguggaucuguuucugcugguggcuuuguggcuucugcuagacuguagcagaaauucggguuuccuucuugggcuggugggugauuuuugauuuuuuuuuucuuguuuuuguuuguuuguuuuucgagacaggguuucucuguauagcccuggcuguccuggaacucacucgguagaccaggcuggccuugaacucagaaaucugccugccucugccucccaagugcugggauuaaaggcgugcaccaccaugccuggcuuuuuauuuauuuuuuccuuuuugggcuuauucagugggauaaaccuggaggcuguagcuucagggagccucugcccuaagauucaaccuuauauaaacucggaccacugauuggucaccagacgccaguauugggcuuauaaggagagaggaggccauuuaccugggcuggggaucaguggcagguaccaggcugagcguggagauagauuccuaucucuugcaaaaaaacaaaacaaaacaaaacaaaaacaaaaaaaccuguuggucaguucuauuauuauucuuuauuuacuucauuucuuuuagagacagggccucacucuagccuacacuggcugggagguuacuauguagcccaggcuggccuuccagccuuagccaccaagauggugggauuccagggaugagcaacacugcccacuuuuuaguuuaguucugcacaggguauugaacccagggccucugcauaccaggcaaacacuuuuaucccugaaccacaucccaggccuguuuuuauguuugcuuucuguuauaucacaagcauuuucuauguggauucauguagguguguaguauuuauuuguuuguuuguuuauuuauuuauuuauuuauuuaugguucuggguauggagacuagggcuuaacauguuucaggaaagcacucugccacugggccaagguauccauauuaugucauccuuuagaggacugcaucguguggcuagccgcccuucaccugugccuccuccaacugacguacauguagaccuguccagagcuucgcuguauuuaucugcccugcugcuggggaagucuuuguagccacuccuuugggccaauguuucuggaggagaaauuccuagaagugggaucacuggauccagagcaggucacauucuaaguuaggagggagagacugccaaccugacuucggaggaggugugccagguugcaccccaucagccgugcccaagugccugugucucagacuccucgccaagagcagugacuauaauaauaagccuugcaguuuugccaguugaguuggaaaaugguguccuugcuaauuugcauuucuucaguucgaucggggacuaucuauucauauguuuauuggccacuuauacuucuucuguuaauuguucauauucuuugucugucauccugcuggguuugugcgucuucuucucauugauuuuuagaaucugcacuaauggauguuaaccccuugcuguugaguguguuugcaaauauuuucuucccgucugucacugauguugucuuuuuuccauauaaaaaaaauuuuuuuuuaaagcuuuguguguuugauaugucaaccuuuccuuugguggcuguuuuuuggauuuguaugguguguagaaagggcccuguucaaggucauggaacgauucucaaaucuuccuuucaugguuuuaugugcucgccugggucucauucugggagaacgugguuuucaugcagguuguauaugccauauaaagucuauauuuuaguauuugucuuauaaaucacuagagccugcauugagaugcaggcucucuaguguuacaucguagacuauaaaguuucgaauaaggaccaguugugaaagggacagaccaaggagcggggugugguggcacaugccuguaauuccaaauucugggaggcuuaagcaggaggaucaggaguguucaaagccagacuuggcaauaacagcaaguuugagguuggccucagauacuggagacugugucucaaaacaguagcaaggcaagauggcucaggcucuuaaucucagcacaugggaggcagaggcaggcaggucucugugaguucuauccuggcuaggaacauaaggaguuucagaccagcuagccuacauaaggagagcuugucucaaaaaacaaacaagcaaacaaacagagagcaggggcagaguaucucaaaauguagaaaauagaaaaaagaguagugacugaggacccaccuagcugcuuggacauuuuauaugcauuuucuccuuugacccucagcaguccucgaagcacagcaaauaggauuaugcccauauggcuauaaggaaacucaggcuccgggugauuagucagccccaggucacagggcugagagguagagcucggauuuguucuugcugaggauggguguguucagacaguuucucuauguaguccaggcuagccuggaacccacuguauagaccuggcuggccuugaacucucaucaaaggcaugugcuaccauggccaguuagagcugggaucgaaacugagaucuaagcccagaacacacauucuggcaucuaaaauacguuacaagaagaaaaggggcccuugggaugccggggucuggaggaaacccccggucacaggcgcagcugcuccagagaaccccaauucucaggcguccugcagguguagcauagcacacugcucccagugucuuuagcugacacccccauuguccugaggaggaaacccuagggaaauuacuuggccaagcccacacuaguuaguagcagauguucccugcacggaagguccaaagucaugagcuggguggagaccucuuccucugccggugggauuagggaggccggcccuugccccagggaaggacccgaguugaggugaccccacgcccaccaccagggauggcugcaucagccgggaggagaugauuuccuacuuccugcgcuccagcuccgugcugggaggccgcaugggcuucguacacaacuuccaggagaguaacucgcuacgcccgguugccugucgccacugcaaagcucuggugagcgccccacugcccagaaucgcagcgcuuccaucugacccgccagaccuggccugcggacccacgccccgcccuucugcuggcccacccgguccacacgggaacacuagccaacccgcggaacauguagaacucaggccuucuccuucagaccuauaaaacccuaacccccaagcauggcccccuucuuuauugcagauccugggcaucuacaagcagggccuuaaauguagagguaagauacgaugggugauggaaagaauggcuucgcugguggaucaagcuuugggggugugguaggagugugguggggagaguuacugcuguagggauuuuuauuuugauggcagcgauuuccaggaagugaaguacauuguaaccagagaggcaucuugacugacaugaggggguuaucuuuuaagaggcuguggugagccaagcugccuaggaaaagaaacuuuugagaggguguaguccgguauuaaauuaacaugaagaaaacaauuugggaggaggcuuguaguuugaugggggaugguuucucaggaguacagauggagcacggacuugaaggaugggauggcgagcuuucugacccauggcccuugcugggcucccugucuucccuuccucagcuuguggugugaacugccacaagcaaugcaaagagcgccugucaguggaaugucgccgcagggcccagagugucagccuggagggcucugcacccucucccucacccacacauacccaccaucgggccuucagcuuuucccugccucgcccaggcaggcgcagcucucggccuccagguaagcgggccuccagaaaggccuauuaacuuauccagaaugccggcugggacuauaaagaagggucagauaggugacgaugccagaaagugcccaaagaacuuccaacuuucugaggauaggguggagggaggcucugcuuccuaaguacugggauuaaaggcgugcacccuaauuuugacgaagcuuccggaccccgagugugugucuguuuuguaaggggguuggcaucccaccagccauuugcauuucucuuuuugcuugccauuauaaaagucucuucccccauaaucucugggugauucucuuggggucucuguugguucugaucaguucgcugagugaugguuugcuaaaugacuauuuucucgaggucuguuaaacugaggucuaagguaauuugaccacaaucauuuggguuggcguaaguccucaaaaauagaaaagagaaaaccauuugcagugggucuucagaugugcugggcucuaaacuguguaauacgcacaaaaucgacauuuaagcaaacugcaccggcggagauguggcuguggggagagcuucggcagaaagaaacgaagaauaaaccucagaaaguggggucguuuggucguccugagaauugauuuuuggaggaugggccugcuuccuggacgaggaagagaugggagccuucugugacaggagguggcugcuggggucacagggacccaggguggggauaguggacaacucuccgucccucuccgcagagauccgugaagaggaggugcagucgguggaggacggaguguuugacauccacuuauaaaauggugaguccucccuuugcaggcugccaccagggucgccccacggagggcuggggcggcuuauaggaagcgccugggcggggggggggggggauuugacaagagguuccucaugacuucuguuuuuuuuucuucuucccagcugugacuaucaaggacucauuccugccucggaggaaagacuuagaguagagaagggagccagagauucuggggcaggagguuggggcuggggguggugggggucgaggguggcaugcauugagaagagggccagggcuggugucccuaagguuguacagacuccugugaauauuuguauuuuccagauggaauaaaaaggcccgaauaauuaaccuggaucaucagccua

SEQ ID NO: 9111 - RNA, 9210 nt, Mus musculus
auuuaccguccaucccagguugauuuauuuuuaaaugugaccuguauuucaaaacuaugugguuuggggacuggggcugugucucaguuggcagaacaucugccaagcaugcuugaagcccuggguuuuauuccuaaccaugacuaaugcgcaggcggacacacuucugccaucccagcaccggggagguagaaaggaccggaagcuccaggucacuuucaauuccauagcagacuugaagguagccuggguuacaugggcuugaucuggaaaaaaaaguuuauuauuauuguccccacauuacaaaaauuuauguaagaacaagauccagguaauaaaauaaaugaacaaguguuuaaaguaagcaaagauuaaaaaaagaaaggaaaaaaaagcagggcaggggugcuguaaccuuugccaacacugguggggggcggggcagaggcagguagacuuugaggauagcuuauucuacauagauagccuguuucagcacccuccccugacccccaccgaaaaaguaagcaaaagucuguuccuuuccccauuauguagccuaggcuagggugaacucagaauauaccucaggcuggccucaaacucaaagcacucuuccuuuguuuuuccuagcacagggaucacaggcguaggccaccaugccuggcugccuccauccuuuuuggcauccauguaaaauggauguagauuuggucugaagugaguuuuguugauaaacaggauucacgcauggguggaucuguuucugcugguggcuuuguggcuucugcuagacuguagcagaaauucggguuuccuucuugggcuggugggugauuuuugauuuuuuuuuucuuguuuuuguuuguuuguuuuucgagacaggguuucucuguauagcccuggcuguccuggaacucacucgguagaccaggcuggccuugaacucagaaaucugccugccucugccucccaagugcugggauuaaaggcgugcaccaccaugccuggcuuuuuauuuauuuuuuccuuuuugggcuuauucagugggauaaaccuggaggcuguagcuucagggagccucugcccuaagauucaaccuuauauaaacucggaccacugauuggucaccagacgccaguauugggcuuauaaggagagaggaggccauuuaccugggcuggggaucaguggcagguaccaggcugagcguggagauagauuccuaucucuugcaaaaaaacaaaacaaaacaaaacaaaaacaaaaaaaccuguuggucaguucuauuauuauucuuuauuuacuucauuucuuuuagagacagggccucacucuagccuacacuggcugggagguuacuauguagcccaggcuggccuuccagccuuagccaccaagauggugggauuccagggaugagcaacacugcccacuuuuuaguuuaguucugcacaggguauugaacccagggccucugcauaccaggcaaacacuuuuaucccugaaccacaucccaggccuguuuuuauguuugcuuucuguuauaucacaagcauuuucuauguggauucauguagguguguaguauuuauuuguuuguuuguuuauuuauuuauuuauuuauuuaugguucuggguauggagacuagggcuuaacauguuucaggaaagcacucugccacugggccaagguauccauauuaugucauccuuuagaggacugcaucguguggcuagccgcccuucaccugugccuccuccaacugacguacauguagaccuguccagagcuucgcuguauuuaucugcccugcugcuggggaagucuuuguagccacuccuuugggccaauguuucuggaggagaaauuccuagaagugggaucacuggauccagagcaggucacauucuaaguuaggagggagagacugccaaccugacuucggaggaggugugccagguugcaccccaucagccgugcccaagugccugugucucagacuccucgccaagagcagugacuauaauaauaagccuugcaguuuugccaguugaguuggaaaaugguguccuugcuaauuugcauuucuucaguucgaucggggacuaucuauucauauguuuauuggccacuuauacuucuucuguuaauuguucauauucuuugucugucauccugcuggguuugugcgucuucuucucauugauuuuuagaaucugcacuaauggauguuaaccccuugcuguugaguguguuugcaaauauuuucuucccgucugucacugauguugucuuuuuuccauauaaaaaaaauuuuuuuuuaaagcuuuguguguuugauaugucaaccuuuccuuugguggcuguuuuuuggauuuguaugguguguagaaagggcccuguucaaggucauggaacgauucucaaaucuuccuuucaugguuuuaugugcucgccugggucucauucugggagaacgugguuuucaugcagguuguauaugccauauaaagucuauauuuuaguauuugucuuauaaaucacuagagccugcauugagaugcaggcucucuaguguuacaucguagacuauaaaguuucgaauaaggaccaguugugaaagggacagaccaaggagcggggugugguggcacaugccuguaauuccaaauucugggaggcuuaagcaggaggaucaggaguguucaaagccagacuuggcaauaacagcaaguuugagguuggccucagauacuggagacugugucucaaaacaguagcaaggcaagauggcucaggcucuuaaucucagcacaugggaggcagaggcaggcaggucucugugaguucuauccuggcuaggaacauaaggaguuucagaccagcuagccuacauaaggagagcuugucucaaaaaacaaacaagcaaacaaacagagagcaggggcagaguaucucaaaauguagaaaauagaaaaaagaguagugacugaggacccaccuagcugcuuggacauuuuauaugcauuuucuccuuugacccucagcaguccucgaagcacagcaaauaggauuaugcccauauggcuauaaggaaacucaggcuccgggugauuagucagccccaggucacagggcugagagguagagcucggauuuguucuugcugaggauggguguguucagacaguuucucuauguaguccaggcuagccuggaacccacuguauagaccuggcuggccuugaacucucaucaaaggcaugugcuaccauggccaguuagagcugggaucgaaacugagaucuaagcccagaacacacauucuggcaucuaaaauacguuacaagaagaaaaggggcccuugggaugccggggucuggaggaaacccccggucacaggcgcagcugcuccagagaaccccaauucucaggcguccugcagguguagcauagcacacugcucccagugucuuuagcugacacccccauuguccugaggaggaaacccuagggaaauuacuuggccaagcccacacuaguuaguagcagauguucccugcacggaagguccaaagucaugagcuggguggagaccucuuccucugccggugggauuagggaggccggcccuugccccagggaaggacccgaguugaggugaccccacgcccaccaccagggauggcugcaucagccgggaggagaugauuuccuacuuccugcgcuccagcuccgugcugggaggccgcaugggcuucguacacaacuuccaggagaguaacucgcuacgcccgguugccugucgccacugcaaagcucuggugagcgccccacugcccagaaucgcagcgcuuccaucugacccgccagaccuggccugcggacccacgccccgcccuucugcuggcccacccgguccacacgggaacacuagccaacccgcggaacauguagaacucaggccuucuccuucagaccuauaaaacccuaacccccaagcauggcccccuucuuuauugcagauccugggcaucuacaagcagggccuuaaauguagagguaagauacgaugggugauggaaagaauggcuucgcugguggaucaagcuuugggggugugguaggagugugguggggagaguuacugcuguagggauuuuuauuuugauggcagcgauuuccaggaagugaaguacauuguaaccagagaggcaucuugacugacaugaggggguuaucuuuuaagaggcuguggugagccaagcugccuaggaaaagaaacuuuugagaggguguaguccgguauuaaauuaacaugaagaaaacaauuugggaggaggcuuguaguuugaugggggaugguuucucaggaguacagauggagcacggacuugaaggaugggauggcgagcuuucugacccauggcccuugcugggcucccugucuucccuuccucagcuuguggugugaacugccacaagcaaugcaaagagcgccugucaguggaaugucgccgcagggcccagagugucagccuggagggcucugcacccucucccucacccacacauacccaccaucgggccuucagcuuuucccugccucgcccaggcaggcgcagcucucggccuccagguaagcgggccuccagaaaggccuauuaacuuauccagaaugccggcugggacuauaaagaagggucagauaggugacgaugccagaaagugcccaaagaacuuccaacuuucugaggauaggguggagggaggcucugcuuccuaaguacugggauuaaaggcgugcacccuaauuuugacgaagcuuccggaccccgagugugugucuguuuuguaaggggguuggcaucccaccagccauuugcauuucucuuuuugcuugccauuauaaaagucucuucccccauaaucucugggugauucucuuggggucucuguugguucugaucaguucgcugagugaugguuugcuaaaugacuauuuucucgaggucuguuaaacugaggucuaagguaauuugaccacaaucauuuggguuggcguaaguccucaaaaauagaaaagagaaaaccauuugcagugggucuucagaugugcugggcucuaaacuguguaauacgcacaaaaucgacauuuaagcaaacugcaccggcggagauguggcuguggggagagcuucggcagaaagaaacgaagaauaaaccucagaaaguggggucguuuggucguccugagaauugauuuuuggaggaugggccugcuuccuggacgaggaagagaugggagccuucugugacaggagguggcugcuggggucacagggacccaggguggggauaguggacaacucuccgucccucuccgcagagauccgugaagaggaggugcagucgguggaggacggaguguuugacauccacuuauaaaauggugaguccucccuuugcaggcugccaccagggucgccccacggagggcuggggcggcuuauaggaagcgccugggcggggggggggggggauuugacaagagguuccucaugacuucuguuuuuuuuucuucuucccagcugugacuaucaaggacucauuccugccucggaggaaagacuuagaguagagaagggagccagagauucuggggcaggagguuggggcuggggguggugggggucgaggguggcaugcauugagaagagggccagggcuggugucccuaagguuguacagacuccugugaauauuuguauuuuccagauggaauaaaaaggcccgaauaauuaaccuggaucaucagccuaaaacccucugaugcuguacuucuagcuaugcuguugcggucuagaauuccauaggguggauagauugggaccugaucauggggauggggucucaggagcagaaaaccucagaacacaagacucuugggcagagugggaggaguccugaaucugggggacucgagccuugggacuagugagcuugugcacccuagaauugcugguacuggugcaacuagaguuuucaacccagaggcaagacgcuucugccguuccagauaagcucuuaggcccuggaucaauccuacacugacaggacuucauggcagggagagggcagcccaggguacuggcuguggagcagagcuaggagggguggggacagccagaggcuggggcuggugugccucagggugggggcugacauccuuggucaugcagccuccuggccuggugcugccgccagccggaaggacagcgacuuccagaggaaaugcauauugaucuugcucagcuccggaggccuccuaacccagcuugcucuucccuucuguauuggcagcacugagaacuugggggggggugcuugucaccacuaacuaaggccaaggcuauuucuaagacugcuuugggacaggaggguggucuaugggaguuuucuaaaggaucuagagccugacccagaugucccuaaggucaggagguaccagauagcaaugcugagaaugggagcuacauccccagauuuccacacuguagggugccuuacagcagcuguugggguugaaaaggagcacccuaaaucccuaccuguacaucacucuauucugcagaccuggcaguggccuccaaucucuuggaagagugcacuaucccagagccucuaauuccugccuguuucuaccuuuuugacuucaaucccucuggucuucuaguccuuauuuuggguccccucauucuccugcccugucacaaugaucagcuucagcccugucccuuauugaguccccuacacugccucuccuucuguccucagcccccuccuccccucccccucucgaggcuguaauauccguuucaugauuugggggcugaguugcuauaacaacagacggcgauuguguugugaagagcagcucgcuccugcucugccagccugccucccgcugccuccaucccugcagccuggucggcuccccagcccacccccagccccuccuuggccucuucccaguguguggugcugcccgguguucagcucugccucaucugggaugugaccuguaccugccuuuccacugucauucaaaugugucagaauugagugucuggcccucacaugguguuugccugagcauaugugugugggaccugcaccuacacuugccaggguuucccucccuguuggcuuguguaccugccuagaagggugucugcucuaugcugcuccccaaugccacauugggugugagccuguguauuugagggguguguuuugaagugguggggcccagcugccaugagggaucugaaucucggaccuuccuuguagaggagagggacagggagguguagcagggagguguagcagacuccagcgaccuuuccugcccuugaugggaaaagcugaagguagagacagaagagcgguguucacccuugccucccuucccacucagacuccugggguuugagccuugucacugggucacugcaccugcuugucugucccucugcauuuugguguuuguacgugugaguguggguccugcaggaggaggaacagcagaugauggguggggcagugggcuggggggggggucagagaggcccugacucagcaguucuuguucugcugccucuacuggccuuggcagccaguaggggacgugugggggguguggugguagugggggcagggcugccugagggucucuccaaggucagaguaggccccaagucugggaccuuguucaggaaucucccuuuccacugccugggaaauacccauugcagcuaggucuucuccuauccuccuuccaggcuaucaaaggagguccucucuaaggagcgguggggggaguguccacauucauuaacucaggaauugacugcucugcaaaguaccuaccgacgaccagggagacuccaugggcagguccccugugagucacuuggguguguguuugcccuugagugugcagguaccuguguaugcacaaguaugcagguuauggaucgaguguguccccccaccccccguggugacuuaccaugguggggcaucucugcagugucccuuuguguuucuuggaaacgcugggcacacaugaauaggugugcauggcugugugcccccauguguaucugcauacauuagugguuggacguguguucuugcauauugccucuggcuaaggaaaugccaacugcuaccagcugugcagaucacaggcccuguaacagaaaucaggggccuggagagaacuggcaaaauggucugccacacacccacggccacacccacgccggcacacugucucauugagaagccuuguguccaacuuagguaaugguauacacaccuaggcgcuggaucuaccuuuucucgguggaguaaaugaagagggguguuccuuccucacacucugacacaaacacggcgaugcagacauucuuacugcagaagacuugcacgccaggaccacacucugaaacucacagcuaaggguaggagcucgaagggaagauucuacuagauuuguauucaguaacagggaguggguagcuuccaccccaccacuagccuuuuccuaccccagaaaagccuuccacagggguggaaagcugguuccaaacucugggauucccaugagucugggcugggaaaccccacugucucuagcuuagaaucuugccaaccuccaagcuucguccuuaucucagaaaagccccuagcucuucaguuccggaggcuuccagcuagaggauacagagacagugauugguagggucucugcgagcgacuggaaaagccacuagcaguccuggggugggagaggcuuccuuggcuccggguagcccaggccagcccccccagacucagccagcagagggcgcuguggccaaggcccugcucggguccugcucucucggugccucaagucgggguucaguccucuccuuugguuugucccagcccugggcacuaucuucgggacccgccggcaggggcgggugggugugggauccaacaacccaaccaaagguagaaggggcuaggguaccuggauucccaagaccccgagccuggggagagcaccugcuggguuaagaggccuggacguccgggcaaagguccagagaggugggaaagggcucggaugcccuggggccgggacgccu

SEQ ID NO: 9112 - RNA, 482 nt, Mus musculus
ggugcacgggcucuaugccaucaggaggcuuagcuugcuugggucacccagaaacucaguuucagacucugcuaugggguagacauguucugacuggauagaaguuaggguucauagguagacuuuuuguuuuagacagggucagacacuguagcccaagcugacgucaaacucaugaauucauggugaugccccugccucagccuccugaggaauggauuggacagguaugaaccacugcacagagcuucguggauauguuucugaucaagguuccuugaagguugaaagggcccagcuugcuuugugugcacacccuagacagggaagaguugagaugaagagccgucugggaacggcugguggaauggaauucucuagcgaguggacccaauguauauugaaguguucuauuuccuuaggauuggaagagcagagggugagugggcucuugcucugaaaagcaugcaccuguaauuugc

SEQ ID NO: 9113 - RNA, 4583 nt, Mus musculus
uagaggguagaaggcagaccugaggacauggaggaaaagacugugaggcauagcucucuucagugccuguugcccaagaagguggggcaaggguguguaaacucagccuguaaaaggugcucugugcuuccccacggauccggccuaccucagagagagugcuaggggacuugccauucacuccccuugaagagccccaugccaggccugcugcuggcugcucguaagaucgacagaugggacucaugccuguggcccuucccuggcagugagucaaacuugagccuccaagaguaggaagacggcgucagaggcaccaggagcagagggcaucuucuggggucaguccggaagaugagguauuauuggcuggauccugagugugugugggcuagccacagggagccuguucggaauagagggcaaaggucaggagacaagagguaguguggaugggcagagaggaccuagaugagcucagcagucauagggaaggagcuccugcuaugauuaggcccacgcuguuacuauuggacgggccccaagcuuuccugugcgguuugcacugcgcagggaugaggacauuggaaaugggaggagcgugggaguagaaaaagcaccguguuaccacguagacuggagaggccacccggccaggcuuuggucagucugaggacaggcacuuuagggaggacaugucccuagcaugggucuccggugauggccagcugauugcagaucauaagccagguuagguuaggcuuugacgcuggaguucucaguaguggcucggucugugauggaaaagguggaaggcagagcuggcagagggugcgagccaggccgggccaguggaugggaaugaagcguugccaggcgcaacggggccugaggcucacuuccuuaguuuauuuauuuugguuauuugagacagagccucacauacccuaagcuggccagaacuugcuauguaguugaagaucuuugaaacgaucuuccugccuccaccuccugagugcuggaaucacaagcaugugccaccaugcauggcaacauucuagauuuauagaggugcacaugucuguagucacacagcaauucaguugauacaccuggagccuccagguuggcuucucaggugagugagcagccugccagccuccuagaggcaugagagugguggcccagacauuccugaccccuuuccuggcuucggggagccaccgaagggacuggccaguucauuuauucaccucucuuggaaguccugcccucucuaggccccaguauccucaucuccuagaagcuggggucgaggguugggauguauuagugggagagcuggagugcuuugcccggcauccaugaggucuugauuuccaucaguggaacugggcaauccgcucuugggucagcauuucacauggcuaagucuguggagggcuaggcacucuuaggcuguaaacuucacggcguaagggaaccugaggggaaguacgccugagacgcuugguaaggucccuccuccuucaguggcaagggucugcuguggccuccgugagauggauggagcugcuggaggaaaggcucaagaggugugugagaaguuaagcccccaagaaggcggggguaggcagagcagagaaggcucuggaugugagacuuggccuggcugcuggaucugcuaaaggaagcccugggaugauuaagagagagggguggaaagacugugggugcggacaaccaagagaagugcucagguagggauugggcguagacugagcuggagguagagccggagaggaaauuuucaacuccauagccaaaaggaccagaggcaaccuccaaagccagaguuugagcccuccuuccagccuagagcugcuuauucagcuucuaucuaccggaggucagaggcuugcagagcuuugcuuagugaagaggcccaggaggcugaugggaguuguaguuguugacccacagauagaugggagguguaguucaugcccccugaaggccuaaugggaccuguaguucccgcccacaggaagcugaugggaauugcaguuucugccccaggguacuugaguuauuagacuaaaagagaagacaauacccucucccuaucacacgccuucccaauuaguuauccugggcccuguuuuagcuagcgcgucccucccagauggcuguguauguguuuucuuuucuuuuuuugcuuucuccuucuuuccguuguuuuauuauuguuugaacaauaauaagagggccagaagcagucauaaccuggccagguucuggcgguccauggggguucuggggaggggguggggggaagucagugggggucagagguggagggugaagaaaguggagaguuagguuuagcucaguaaucauaugaccuccgcccucacucacucuccguccucccucccucauucccaauccucccuaccuccaugcaucuucugaacuuuucaccaccucccagaauccuaagggacaaacccagcuccagugugucugauccucccugcccacuguuccacacaagcauucccgguuaaaguuuccucccauggcccucugaaauuagccccagguccuuuccacggccagccuccccaaccccacccccacccccgaguucacacucacauagacacgccagccaucgucucuccuuuccauggccucuccacugacccuuccuguucccacgaugucacugaauggugccacuccccagaccuaacccgcacacgcacuguguaaauuucagucucguguucaaugagggggaagagagagggaggagagagaucuuucuggaggaagcaggcuguccagggagggagaugccaaacagauagacagaaaacguuguacggaaaaguuguuuuuucuuauuuuuuuucgggagaacccgcuuacacagcucuguuuguaauuuuuuucuucaugcuaaaaucacacggccuauuuguugauguaaguugccugaauuccgugguaugcuaucuucuuuuuuaaaaacaaaagcaaaaaaaaaaaaaagcaaaaagaaauauauauaaaaaaaacccuaaaagauauuguuguuagguuuguuuaaaugcugcuguuguauguuuuuaaagccuuaaaccaguagaaaaaaaaaaaauuccguuucuuuucaauuuccuuuccuuucuguuccguuugguuucuuaagacgaaacaaaaagaccaaaacccaaagucacagagcccgcgcguggggugcccagggcauccgagccgcagcccgcuuaaagcgcaggcgcuggccggcuggcgggcgggcccggcccgcguagucuccgccaaagccaauugaaccgauuugggugugaggcuguuguuucucucucugugccggccgcccgcgcccuggcccucgcugacgcccucucuucucucuucucuuucuuuuccuaggaggagaguuaauauugcccauuaucacggaggacuccuuagacccuccucccguggccacccgaucccccuucgugcccccaccccccaccuucuaccccuuucucacgggcgugggugccacccaagacacccugccuccgcccgccgcgcgccgcccguccucggggggcccgugucaggccgagcgcgacgacagcgacugcgaggagcccguggaagccucgggcuucgccuccggggaggucuuugacuccagccucccccccacggacgacgaggacuuuuacacuacuuuccccuuggucacggaccgcaccacccuccugucgccccgcaagccccgacccaaccucaggacagauggggccacgggcgcccccggggugcuauuugcgcccuccgccccagcccccaaccugcccgcgggcaaaaugaaccaccgagacccacugcagccgcugcuggagaacccaccccuggggccugggguccccacggccuucgagccgcggcggccgccuccccugcgccccggcgugaccucagcccccgguuucccccgucugcccacagccaaccccacggguccgggggagcgcggcccgccaggugcaguggaggugauccgcgaauccagcagcaccacgggcaugguggugggcaucguggcggcggcggcgcucugcauccucauucuccucuacgccauguacaaguaccgcaaccgcgacgagggcuccuaccagguggaccagagccggaauuacaucaguaacucggcccagagcaauggggcgguggugaaggagaaggccccugcugcccccaagacgccaagcaaggccaagaagaacaaagacaaagaguauuacgucugagcacccaguccaggcaccccacugccagcugcuccucccaggagggaggagggugcggcccucucccugcagggggaucuggggacccucuccccggcugccucaggcuucucccacgaagaggaaacgcaaaaaaagaaaaagaaaaggaauauaacuacuacgugcucauccccuucccucccgcugcccucggcgccgcacugucagcucuggggcuggcuguccuccgcucug

SEQ ID NO: 9114 - RNA, 1488 nt, Mus musculus
acgcacacccccgaggggauucaggagguggcuccguggguaagguucuugcuuugaaugcaugaacacuggaaaucggauccccaggcagaagucagggaaucccugaagcaagcuggcugcuagaauuggcaagcucagggugcagugagagaccccugcugacuccugagguugacuucuagucuuccauauuuaugcaugcacauauccuaaauauguguguggggauggggugggugagaugcugugugugugugugugugugugugugugugugugagugugugugugugagcccuccagagcaugcucaucucagcuugggcaaagcugggcugagacaguacuagcucaauucuuuucucugagcaaagcuuuccuucuaacaggugaccuucgaucucaggucucauucuucgauuuucucucuaaugagaaaagcaauaaaaaguagaccaaaguucacccccugggaccuguguuaugcacguucaagagcaaaagcaugggugcagauccccaagugcucgggggguugggggguucacugggggucaccgugcccuagugcagggcagagaggguucgccaccagggccuucaucccaccuucacugcuauugcagguggaggguggaugaacccagagcuuuguccccauggcucccagucccucccuccugggauucuucuuugccaguuccucaaagcaagaccagauacaaaauccacugcaaauggaggcacagaaccccgucuccagagugucuugucuuuggugagcccuaacuugagagaacccccaccgccacagauguuugcccauggggcccucagcccuucacauuagcuuucuuaugaagaacuguggagaaucuugguaacuagaaucuucucuguuacagccagauugaagccaaaacuaaacagcacaaaggacuccugaggccccuccccucccugaggaccuacugguggcuaaugguugggcagaguggucauuuucucuaguguuucagccacuaguggguuguacaugguccauuaaguaaccucccacccuugcuccugugaugaagcccagugggucacacaaaaaccaaguuaaauuuaaagcauuucaaaggagccggugagagaaguccacauguaaaguuauuuccacauaagccugacaagaauucaacccccagaacccacacaaggccgagagagcacagcuguucacaucuguaaucccagcuuuccaaggggaggugggagguagggacagguacuguccuagagugcacaguagccgaugaucacagcagcuuggcagaaacuucuuacucagcaaggaagaaagagaagaccuacuccuaaaaaugauccucugaucuccacaggcauggugugacccacgugcaugcaaacacacucgugugagcgcaugcgugcucgcacacacacaugcacuuggaauaaaaacauuuuaaacauaau

SEQ ID NO: 9115 - RNA, 1488 nt, Mus musculus
auuauguuuaaaauguuuuuauuccaagugcaugugugugugcgagcacgcaugcgcucacacgaguguguuugcaugcacgugggucacaccaugccuguggagaucagaggaucauuuuuaggaguaggucuucucuuucuuccuugcugaguaagaaguuucugccaagcugcugugaucaucggcuacugugcacucuaggacaguaccugucccuaccucccaccuccccuuggaaagcugggauuacagaugugaacagcugugcucucucggccuuguguggguucuggggguugaauucuugucaggcuuauguggaaauaacuuuacauguggacuucucucaccggcuccuuugaaaugcuuuaaauuuaacuugguuuuugugugacccacugggcuucaucacaggagcaagggugggagguuacuuaauggaccauguacaacccacuaguggcugaaacacuagagaaaaugaccacucugcccaaccauuagccaccaguagguccucagggaggggaggggccucaggaguccuuugugcuguuuaguuuuggcuucaaucuggcuguaacagagaagauucuaguuaccaagauucuccacaguucuucauaagaaagcuaaugugaagggcugagggccccaugggcaaacaucuguggcgguggggguucucucaaguuagggcucaccaaagacaagacacucuggagacgggguucugugccuccauuugcaguggauuuuguaucuggucuugcuuugaggaacuggcaaagaagaaucccaggagggagggacugggagccauggggacaaagcucuggguucauccacccuccaccugcaauagcagugaaggugggaugaaggcccugguggcgaacccucucugcccugcacuagggcacggugacccccagugaaccccccaaccccccgagcacuuggggaucugcacccaugcuuuugcucuugaacgugcauaacacaggucccagggggugaacuuuggucuacuuuuuauugcuuuucucauuagagagaaaaucgaagaaugagaccugagaucgaaggucaccuguuagaaggaaagcuuugcucagagaaaagaauugagcuaguacugucucagcccagcuuugcccaagcugagaugagcaugcucuggagggcucacacacacacacucacacacacacacacacacacacacacacacacagcaucucacccaccccauccccacacacauauuuaggauaugugcaugcauaaauauggaagacuagaagucaaccucaggagucagcaggggucucucacugcacccugagcuugccaauucuagcagccagcuugcuucagggauucccugacuucugccuggggauccgauuuccaguguucaugcauucaaagcaagaaccuuacccacggagccaccuccugaauccccucgggggugugcgu

SEQ ID NO: 9116 - RNA, 11620 nt, Mus musculus
  misc_feature (10852)..(10951): n is a, c, g, or u
ccgcacggggcgggcugggagccgggaggcggugccggcgcccgcucggccccagaggcggcaccaggaagcacccgccccggccggagccgccauguaaccggcgccgcccguagccccagccgcgcgggccccagcgacccgcccgccaugggagacgaggaugaggacgagggcugcgccguggagcugcagaucaccgaaggugggugccggaucccgaggcggcucucccggacggguggcaagagucagcgacccucugggcucacucgccccccuguguccgcagccaaccucaccgggcaugaggagaaggugagcguggagaacuucgcgcugcucaaggugcugggcacgggaggugagaaaccgcuuucacuggcauggugcuuugggccuucugcccgcccacucgccuggaccugggccugggccugguugcuggggagguccccccacccuuucccggcauagcuccccuugcccgccccgcccuaccguaccaggguuccgagccuacuugccgggcguccacguugacaggacucuucucugcaaaguccuaugcgugcgugcccccugccgcgauuuccuagccucuuugggguuuugacucccucccaagagcuuugcacagcuucucuccccaucuucccuugcgagccccacucuuguauuuugcaaauuccccaguccggguuugcacaucccuccgcugacugggagcgcgccucugccuccggugccagcguuuucaucuuuucucagcucucuugaucaucccagguuugcacgugccccgccccuuccccgccccgcaggccuucuggaguugcaagcuccccaggcuaguuugcacugcaaauugcuuuucaggcuuaaccgagcacccuccagggagggcucaccuucuccuuagaaggcucugucagccuuuugcaccccccuucccaccagucugcaccgcccucgcacuuacagcccaccuuccaaccgcuugcuugcugcucccacagccuaugggaagguguuccuggugcggaagacgggugggcacgacgcgggcaagcucuaugccaugaaggugcuacgcaaggcggcguuggugcagcgcgcgaagacacaggagcauacccgcaccgaacgcucggugcuggagcugguucgccaagcacccuuccuggucacacugcacuacgccuuccagacggaugccaagcugcaccucauccugggugagggccugucacaucucagcuuuggagagggacgggaguuagauuaggcuaccuuguagggaaacauuucaacgucuccucacucccagacuacgugagcgguggugagauguucacucaccucuaccagcgccaguacuucaaggaggcugagguucgaguguaugggggcgagauugugcuggcccuggaacaccugcacaagguaagagacggcccugccuuuuggcugcucuccugggacugcccugaaccuaaugaggggcuuccuguuucagggguggccugggcggggaccuugaaagaacugcuugagacagcacuaccuggaagggucuucugcuccagaaccuucuggaaggggcuuuccuccaacaggaaccuaggcuaaccuucaucggacuuccuuaaguggugaccucagaccucaguuaccaagaccucugaaauggggcuuuuuguucacacuccugggcgccuuggggccugugcacaggacuucucaaugcaggguaccuuugguggcccuucuugagucccuucuuacuugcuuuuauuuugugcaugugugguguguguaugugcauaugugccagagcacaugugugggucagauucugugacauuaacaauauccuuccaccuuugcauggguucugagauccaucucagauugccggcacucucucugcugagcccucucgaugguccccuguuuaacucuuccuguagccaucucauguagcccaagcuggccuucagaucccuguguagucaagaugaccuugaacuucgaauccugcagcccuugucucuuugagaguucaggcuuguugaucacuccugguuucauggggugcuggggacccagcccagggccccaugcuaggugcucuucuaaccagucccacccagccuugguccuuauuuuuuucucuuugaucucuuccuuuuccucuuuguucguuguuuuguuuugagggucuugcucaguaacccggcucuccugguaauugcuggcuaaccucggcuagccucagcuggcugccuuagccuccugggcacuaggaggauaggcaugaguuuacaugccuggauccaguggcuuuucuuaucuaauaacuagcucugcccagcuuuauccugcccuggaguucucccugcaggugaaagaucuucagggcaucucuuuauccuacguggggaccuacagggacccgcagggacccacagggcuguggcuguguagugugucucucaggguggcacucaacgucccaucugcuccugacagcuggguaucaucuaccgggaccugaagcuggagaacgucuuacuugacucagaaggucacaucguccuuacagacuuugggcugagcaaggaguuccugacggaggaggugagugaguggcgcucccagccaggccuuugaccugcucccuccgugucagcccccugggagggggcugcagaguggucggguaccaagguucccacuguuuucccagaaucuucuaauuugagcaaguucugcucuaagccuuuagggcccuugggguaggggugaagcuaagguauacaaauaagguauacaaauggguccucuuggcuucucagaaagagcggaccuucuccuucuguggcacaaucgaguacauggcucccgaaaucauccgaagcaaggcuggacauggcaagguggguugucagggugaagguggcagggguggggcuagugcacaaggccuucacucuggcccugcuccauaggcuguggacugguggagccuggguauccugcucuucgagcugcugacaggggccucacccuucacacuggagggagagaggaacacucaggcugaggugucccggugaguuguacaggucauggaggguagcugagggcuauacggccuuccugggcugggcugggagggggcuugcugccccugacaccccacccauccucccagacggaucuugaagugcuccccucccuucccucuccggauugggccuguggcacaggaccugcuacagcggcugcugugcaaggacccuaagaagagguugggcgcagguccccagggugcgcaggaagucaagagucaccccuucuuccaggugaggcuuuaauguaugaccucauagguccuucaccucugaaggccgggcugcagcauggggagcacaaauguauuccaucuuuuccgauguuacacacaauaagaggucaaagggcagaaugugcagaccccacuguccucagggcacucacugggcagcucccugggaaugcgugaacuagcacggagccuucacaugugaucucacugaguggccuuuccuagcuguugucuucuguuuauauacagucaucagauuuggcaucuaucugacaugcagcaagagcauccauccauuuguggguauccccuguggccaggcacaggucccuccugccuccaugcugggauccuagccuuggagggucuccaggggugcucucagagcagagucuuccucucccgggccagcauggccccagguagaggcaugggcaagacuagaacacagaauggagcugaccaggguccacuuccuucagugaauuucuggaacaccccccucccccaucucagacugcugggagagugcucaccugucuaucauccugcagaaguccccaaggucuuugaggcuuggcacuugacaugguguccucucccuucugcccuuucuuuggacaaagaucuuuggaggcuacugcacauacacacuuacccgacaucgcacacauacaaacacacaugcauauauaugugcacauacaaugggguaguggugaggagaagaaauccagaccagguugucuuugagaauccaagcucauucauucauucauucauucugucugucugucugucugucugucucucuguucuuccauauuuagauauggcauccauuuuuaggguugcuuugugacuccaaagggaugacuauguagccugcuuuccaggacggaagugggaggaggaagggcaggguuugcaagcuucucaccuucccuucaaggugcuuuccuaggcuccaccugacaguauuuccuugcaagcuauugggcacaaccagcuacaaagaagugucuguaagauggugcaucuugguuguauuggaauuaugaugcuaaaaagacaggaaagcggaugcuggcagaagcuuaguuaguucugccaccuuagcuuaaacauaucaaagagcaggugcucauucccaaaagggaggacaacuuguagggauggguuuucuccuuccacugugugacugugaggcuugggggugagugcccccuuccagggcgcugucucaccugcguguuuagucuccuugucguuaggagaauucauucuccagcccaagugccacaugguaauuauacauagguugcagaauggcgaaggaagcuuuagagaggcuucccugcugaggcuguccugaagucugagcaguucagggccaggcugaagugggcugaacgucccugaagaagaagcuaugggggcgcuugggugacaguccucugcuguggcaauuugccuggaugagguugucaccugugacccagugacuaguuagcagggcagccacaguuugaucauaggauccuucuuuucacagucccaggggaaggacuuccuuuagaugugauaugcucagugucugaucuuucugacacccaccagggucucaaacucccuauguguuucugacucuccugacuccacccuccccaguuuuaggaugauaggcaugcucaguucaugcauucugaggaucagaccaggauucugugugcaucuagggaggcacacucccgccugagcuucgcccucccucagggcuugcuacauuuccagguguccuuauuuauuagauacaaauguuuaucagcuugugccucuggcugugcuggcagguggcaguuguuugcuuguauaaaggagauguaacggucauucuuucucagcaguuagauucaaaauggaguagcacacgccaaggcugugucauuauauuauaaaguagucauucaagguuaggcacaggcugaaagguuccguuccauaccacagagaaagcagaguggaucaccuuguucucacccuuaaccucuguucccagggucuggacuggguggcucuggcugccagaaagaucccagccccauuccggccccagauccgcucagagcuggauguggggaauuuugcggaggaauucacccggcuggagcccgucuacuccccugcaggcagcccuccaccuggggacccucggaucuuucaggugagugggaacccacaugaccccagauggcauagaugcaggacacuguuacuugcuucaguccugcuggcaaggucacucacugcacagacccuggguuacucugaggacacaucuccccagacuguuccacuucccaggggugccugauguuaucaguuauagaagucaccauagcuguuuuuuauggcuuuguauuucauacuaacaucugcucacucuuuucaaacuuuuauucauuuauaauugacuuacucacuauguacauagggauuuugucugcuuguauguuuauguaccaugaguaugccugguauucaaggaggucagaagagggugucagaucccuagggacugcauugcagacaguugugagcuaccauguugguacugggaaccaaacccagguccucuggaagagcagagcucuuaacugcugagccaucuuuccagccccuguuucccuuuauauacuagggaugaaacaucgggccuugcucugccacugagccaugccacuaucuccuuuuucauuuugagauauggucuugaugaguugccuaggcuggccuugaacuugcuaccuuacugcuuagucuccuaaguagcugaaguccaggucagugccuccaggccuggauuuucauuuccuuuccauuccaccauuucugcguuaucuaaaaauauuacuuuagggucuagagagauugcuuaacaguuaagagcacuggcugugggcuggugagauggcucagcggguaagagcacugacuguucuuccaaagguccugaguucaaauccuagcaaccauaugguggcucacaaccaccaguaaugagaucugacacccucuucaggugugucugaagucagcuacaguguacuguguauaauaauaaauaaaucuaaaaaaaaaaaaaagcacuggcugcucuugcaggugacaggaguucaauucccagcacccacaaccaucugugagucuaguucuaggggaucuggcguccucuucuggccucagagggcacugcacaaauguggugaaugggcaugcaugcaggcaaaacacccacacauauagaauaaguaaacugaaaaaaaacauugcuuuaaauuauuaagggccgaugauguaggucaguuggcagagggcuugcucuucguaugugaagcuuggguuuagucccagcacugcauaagccaggcuguugcucaggaagcagaagcaagagggucaggaguucagggccauccuuagcuacauacggaguuuugaggccagccugggauauaugagacucagucucaaaaauuauuaauaauuuucaaaauugcuaaguggacaagaugcuaugguuguaccauagcccagcacacuugcauagaaacccagggcagaguggcaaggcuugccuuagcuuggcauccagggccuggggugaugugauccucugucagcugcuuaccauucuccuaccugauguuccacacaguaccauugcacguccuagaggcucccaagcacaccucuauuuugccugcuccagagcagucaaccggcaagcuccgcauagguuaagaccaccuggcucucugggauuuccuuuccugugcacugcccuugagccuacguaccuaccgcugagcaauuugacaugacuggucuggaagucccuaaggaacgggauuaaucccugugucuuucaggcuuagggcucagguccagccuguagaacauaguuuaaacauauuaaauaaaacuagaacaauauugaauaugauggauccagccaguuaugaugguauuacacuggucaccccgagggcugaggugcagacucugggugagacucuguugagcaccaauaacugggucugggcacugggaaugaaccagagaccuuaacaggacaaagcacuacccacauggagucugguuuaaagaaaccaguugugcagcaugguaauggacaccuguaaucccagcacugugagacugaggcaggaggacagauucagccugggcuacauagugaguaccaggccaacugagguuacauagcaugaccugucucaaaacaaagcgaggacugaguaguggugacacugaucuuuaaucccagcacucaggaggcacagccagugggaucacugugaauucagaccagccuggucuacacaguaagacccugccacaauacaaauuaacaaccccaaacaacaacaacuagaacaaaauaguaacaacaggacucugaaauugcuaggacaugggucuguaugaaaagcaaaggccaccuuuugauucucucugucuuuccuugguaccucuuccucucacugaggaggccagggucuggcuugaaaggauagagaauagagaguagccccccccccccccccagccgaugaauuaucuuaagcuaaguguguaugacaacaggcgcagcccuuguguacaguccugggccacuagucugugcuagguacguugugguuagaaaaagcuggucacugugauaagacaagugugugugugugucgaucgcacacuuggaggguaggcauggccccaaguaaucauaaacaggguaggauaagauguguccacacaggcugugugggcccagauguaagagugcccucacugcuccucuguggaugaacucagcugccuccgcccauaggcauccaaccccacacucaucuuugcagggauacuccuucguggcuccguccauccucuuugaccacaacaaugcagugauggcugauguacugcaggcaccgggugccggauacaggcccggcagggcagcaguugccaggagugccaugaugcaggugggcuggccuggggguggaggugguauuggcuuuguccucuggggugaggggacucuggcccaguuccaccgguugcuggugguaugauuuggauguaggcaggccgucggccaugacagggccacucauauccagcauaaggaucuaaugggcacccuuuaucuccaggacucgccuuucuuccagcaguacgaacuggaccuucgggagccagcgcuggggcagggcagcuucucugugugucggagauguaggcagcgccagagcggccaggaguuugcugucaagauccucagccgcaggugggagccagcugugggcagagcccuccagagagggcuagggauaagggcccaguaggccacuguaaccccuccggccuuguccccaggcuggaggagaacacucagcgagagguggcugcucuucgccugugccagucacaccccaacguggugaaucugcaugaggugcuucaugaccaggugaccaaugcuuguuagggacagccuguguggaguggggggugguagagaagagagagagagagacuccagaagugggaucugagggguauaaggccugaggacugagggacacugcugaggauggagccggaaaggaaugugaggaggaugcucaggaagggggcggagcuuaugggaugggugugguuaaacguggauaaagaaugguguccugaaaagcuguuuguuugagguggggguggggaauccaggaauauggggcucccgcgauacccgagcgggcagguggugguagugacgugccuugcaucccgcagcuacacacuuaccugguccuggaguugcugcgaggcggagagcuauuggaacacauccgcaagaagcggcucuucagcgagucggaggccagccagauccuucggagccugguuucggccgugagcuucaugcacgaggaggcaggcguggugcaccgcgaccugaaacccgaggugggugcgggacucgggcgguggagcaggacugccuggcaccuaugcugggcccugccccugacugucgcccgcuccccuccgguagaacaucuuguacgcggacgacacucccggggccccggugaagaucaucgacuucggguucgcgcgacugcggccccagagcccggcagagcccaugcagacuccuugcuucacacugcaguacgcugcacccgagcugcuggcacagcagggcuacgaugaguccugcgaucuauggagccugggugucauucugguaagguucucggaggagcugggguuaauuuuccugaugguuagcccgaggcaggggaccaggucuguuaguggggguagcaugucuuugaggccaggaugcaaugggucucugcgaaccugggauugaggguccaucacuuuugagucccuguaguggagagggugguggagcugugagcgggugaggaugcagccugcccccuugcagccugggcuggucucacuccuuuaucuccuccuaguacaugaugcugucuggccagguucccuuccaaggggccuccggccaggguggacagagucaggcagcugagaucaugugcaagauccgugaagggcgcuucucccuggacggggaagccuggcaaggugugucggaggaagccaaggagcugguccgaggugcggagcuggaggacuuggggcaugguuagggagggaaggucaugagauccccggaucagggacagagugagucuccuuuccagcaugccccugccuuaccaccagggcuacugacagucgaccccgccaagcggcugaagcuggaggggcugcguagcagcucguggcuucaggacggcagcgcgcgcuccucgcccccgcuccgcacgccggaugugcuggaguccucugggccagcugugcguuccgggcucaaugccacuuucaugguaagaggcgggccgcugguaggcggaacccgccuuugauggguuagggggucuugaccucugggggcuggaggcccggggcuugucgaucugggcacugcaggaugcgcgccaaggcgaggacuagcaaaccaaaaucaggcgggguggggacauucauucucuccuuucccaggcguucaaccgaggcaagcgcgagggcuucuuucucaagaguguagagaaugcgccucuggccaagaggcgcaagcagaagcuccggagcgcggccgccucccgccgaggcuccccagugccugccuccuccggucgccuaccagccucugccgcuaaggggacaacucgccgagccaacggccccuuguccccuuccuagcucccgccacugugacccccuuaccuuuaggagcuccgauccgggagccuggugcugccaccagacuuuugccagcggcucccacucugaucnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnuuugccagcggcucccacucugaucccuaggaauugcccuccccuccacacccacuuccagacagagcagaaguauuuuuauaagcagagauuuuuuaaaagugucuuacuagauaagaguuggggacacagagaagcaacuguugugagcaaaguggagcuuggggcucccucgcccgaucccaaugcugccccaucaggaagagagaagguccuuuccaggagcaacucugcuaagaaagggcauccuauccuguuccuaaguacccaguugccauggagaagaaaucaggagcccguauacugugcuucccugggacuuugccccuaggaggggacacccaucaaugucacuuuauggaccgugugcaaugauguccaccaaagaccuguguugggaaugagagagagagagacccugagggaccucuagagcauuucugagauacaucacuuuugucaacggcuccccuagugggguuaaggaagaaggcaggugcuccccagggggagccccuuucucacucacccauuccucaugggcacagcugcuucuggcugcagguggagccuuaggguucugggcuaggcauccacagucacugccucagccccucuaggcugugccuuugacuuuaaaauaaaacuccacccagugcugcaugugga

SEQ ID NO: 9117 - RNA, 13591 nt, Mus musculus
cggggacuuccucuuccucucagagcagguguagcugccacagcgugacagggacuacacccugacccccaacauggagggggccaaggggcccaggcucagaggcuuucugagugggagucuggccaccugggugagggucaggugggagaggaagagaguguggggcagacugagggcugggggaggaggggcuggguguauagcaucagcaggggggggggaggggaagcuggucugggaacuggggcaggaggcauucaggggcacuggugaagugugugugugugugugggggggugguagugggaaucauagaguguuuugggacagaucagggacucaggaugaguuuacuaguugggggugguggugguggggaguuucuaccuguuuagcugacuucuauuuguuuccacaggcacugggacuggcugggcuggugggggaggcagaagaaucagcggggggaacagaggaggaggaggaggaggaggaggaagagggggcucuuuguacagagaagagauuccugcggcugaucgauggagccuuacuccuucgggugcugggcaucauguaagugacauggggaaguugaguuggggggggggcugugaauaguaggaggagucugaggguggagggcaaggccugucuggguuguggggagguccucaagccaaccucucacccauguucccugggugaucauagugcucccaguucccgaggaggacuucgaauggucaggggccgugaugguccugcagccugucggauguggaaccucugucaucuaugggggcgacugagggauuuuuaccagguaaaacauugggaaggccagacaggaggcccagcagccccugugaaggugucuuucuuaguguuggccuauucuaggaggagcuacagcugcugauccuaucaccaccuccagaccuccagacaauggggugugaccccuucucaggugcugcuuccuacccacccucuguccucugucccugccccaugucccuauuuaacccuuuguggcuugugcccagcagaagaggcaguggacgagcuggaaagcauccuucggcuguugcugggggccucagugcaggugaagaggggacgggagaagagaauggaguucugacaggaggaggggccucugugugccagcuuugggccuucucuguccaccacagugugaacaccgggagcucuucauccgucacauccggggccucagccuugacguccagagcgagcuggcuggugcaauccaggagguacugacggcagcaauacaguccaggggcuugauuggguucauuuucucugccagcugaagaauuaaauggcagggaaaaaucugaagcgcagcagguggcagcagagagagcucuugcacagcagacagaaacagcaguuaggagaggcgguuauggagggcgagcaagcacacaugcugcagacacacagagaacaaggcucugcuuugcagaagcagggcucaggaagccaaaacaaacaaacaaacaaacaaacaaaaacaaaaacacccccaacaaacaaacaaacaaacccggucuccucuggaggccugcgguuuuaaagacucugagaagucuuccucacccuauuuucucuggucagagacuguugugugacauguccucaucaggccuugaacuuguugagccaguaugucagcaaggguccacuagugggcggcaaaagcugccaggcuuuugucuuaaguaagcagguugaggaggaagcuggccaucuuggaagagcuuugccaccucuuccaugucauggcugcucuuccugucugucugucuaccaggaauuaugucuaacuccugaucucuagguacugugguggguggcacaggggauuuguugcuaccccugaagccaccuucaccuccugauguauugcucucugugcccucaggugacccaaccuggugcuggugugguacuggcucuggcuggaccagaauccggagagcugguggcugaggagcuggagaugcaguuacggagccugacagggaugauguccaggcuggcgcgggagcgcgaucugggggcacagguaggggacaggcaaggggcgauggggcugucauaacccagaacgauuuuguugggaucggaggcccgaugugcagagguuuuggaagaugcuucuuugaccuuugacuuccugcuagcgguuggcugaacugcugcuagagcgggagccagcccacuugcugcugccagaggcuccugcuaaugcgucugcggagggugucucgcaccaucuggcucugcagcugaccaaugccaaggcccagcugagacgccugaggcaggaggugugagugucugaaggcucaggaaggggucagugggaucuggauggguccccagcccccggguguggcucugcagcuggcagacacccuccaucaucccauccuuccagggaggagaaggcugagcaacugcuggacucccaggccgaggugcagggcuuggaggcugaaauucgaaggcuccgccaggaggugcgguccaacgucuuccccccaacacaccgcccuccgccauuguccccucuucaucgugguccuauugcuucuugcgaucccucaccccucugucccguggcucgcuaauccuaguuccacaccauauggcccagacucaggcgcuguccgcacaagccaagcgcgcagagcucuaccgcgaggaggcagaggcacugcgggagcgggccggccgccugccacgccugcaggaagaacugcggcgcugucgcgagaagcuucaagcugcagaggucuucaagggucagcuggaggugaggugggggcggggcuggaggcggaguauuugguggguguggucuggaggcggggcguguaggaggggagucuggccaagagaagagugggucuagccuugcuugggaaaucgugauagcugggugaagcgggugaagauacagcaggugaagucugggacaagcucuuuaggaugggcggauguaagggagaagaggaggagacuugaagagacggauaggguaaaauagggaagucggcagugagaccccaccaaguagcuguaccgauaaguggggucuagagagauacggccuuggaaggcuucuccuugggguaccuggggagaccuugaagagaguugcaaugggagguagggaaagaggcagggugugaagcugucccaggagaaggaaucuggaacugccaggcucugagcauaaagauuucaucucaccaaggauccuccuggcuuucccaccaggaggagcggguccuuuccgaggcccuggaggccucgaagguccugcuagaggaacagcuggagguugcccgagagcgcucagccaggcugcaugagacccagagggagaaccuccugcugcgcacgcgguugggcgaggcccaugcggugagcuaggcugaccuguccaucguugucccugguucuccaugacucuaaugaugcccaagguuucucuacgugauuccuguaguauguugggauauucagacuugcacauuuggccgaugaacaagguacugaccuauuuuuccacacccaggaccuggacucucugcggcaucagcuggagcagcugguggaagagaauguggagcuggagcuggaacuucagaggagucuggagccacccccaggcuccccuggggagggugaguuaggccuaggguaagggcaaggaucugggggugaaggcaggcucucugaguggggaggacuuguuuucaaguccuuacuaagucucugagagguguuggggugggagucagagagggcggacagaguuugacuuggucaugucuccagccucccuacccggagcagcacccucacugcaagaugaggugagggaagcagaggcugggaggcuaagggcaguggaacgggagaaccgggagcuucgaggccaacuacagaugcuucaggcacagcuuggcagccagguuggucccuccgguauccuuauccucgcugcuucccacccacauccuucuaauaacccccauugucucucucauauguccucagcacccucugcuggaggagcagagggagaacuccaggcagccaccugugccuaacagggauccagcaacucccucggcccuccaucacagcccccaaagccccgcuugccagauaggaggugaaggcuccgaaucuuuggaccugccuucuccagcaucauacucugacaucacaaggucacccaaguguucucaggcacccgacucacacccagaguuggagaguccucuccagaugguaucucaggauccccagaccucagaccaagcucuccaagaaucagacccuacuguggagacacaucagugccuggagaagucuggucauagagucccucuccagagucccaucgucugggacccaccacaggguccagaggucagaauugaagugcaggaguugcuaggagagacuggaagcagggaggcuccccaaggggaguugguacacaaggcccagguccuaaaacaagagagccccaaaugcaggcccagaucugcugagcucacccuccgggagccucugaaggaccagaaggcccuggaucgggaacuagaacuauccaagcaacagaaagagacaggaaggcaugaacagaggcccaagggguuggagaguaaacugggcccucagaaaccacagcagacaucagaaggggugccugaugccugguccagggaggagccaaccccgggggagacccuggucagugcuaucccagaggagcaggcccucagagaugagguagcacaacuaaggagagagguugcaggccuugagguuaaacugcaagcccaagcccaaagacuggaggcccgaagugcagaggcucucugccucucugaggagcuggcccaagcucgcagaacagaggcggaggcccaucaggaggcagaggcccaggcccgggagcaggcccgucugcgugaagcaguggauacggcuagcuuggagcuggaggcugcaucucgugagagggaggcccuggcagaggcacuagcagcagcaggcagggagcgaaggcagugggaacgugacgggcccaggcugcgggcucaaguugaggcugccgagcagcaggugcaggcucuggagagccagguccgcugucaucuggaggaagcugagagggaacaugcggagaaacaagcccuucgggagguaugugggguacagcagugggucaggaaaugagggccugggacagcugcuggguuguaaugguguggguuucuucacugcacugagaugggacagaagguagaaaauccagcccgcuccugcuguugcaggacaccugauagccaguccuugauggggcuggcaacaggaaggacucacacugccaauucucuggucuauccugcacuccuguugugguagacucugucccuuugcccuggccccuucuuccuguauaaaacagauacugagccuugcagcacucagagucuauuagcagaccaggaugauuguggaaagugccugacucauaccuggccaaggccugcuguaagugaccaaacaauagcucuccaggagccggggcuggaguccauucugcagugagcuugccuggcacgcacagagcauacaccauacccagccccuauaaacuagacauaugcuuuucauuccggcacucaggaugcggaggcaggaggauuagaaguucaaggccauuguuuagauugcuuuucuauuggaacucagagcaggaaccuggagacaggaacucacugagugaugcagaggccaugaaagggcucugcuuacugacuccuugccauagcuuauucucuucuuuuuuauacaaugaaggacaaccugugcagggaugguaccauccacagcgggcuggguucuccugcauuaaucauuaaccaggaaaaugccccacagacuugccuaucggcagugugauggaggcacuuucccaguuuccuguucccagaugacugcuucugucaaguugacagcauagagaucuuuggcuguauaaugaauuggaggcuauccugggcuacaugaaacucugccuagagagaaaaugaaaacaaaacauucaguaaagaugaagugugccagguagugguggcgcacaccuuuaauuccagcccuugggaggcagaggcaggcugaucucugugaguucaagguuagccuggucuacaaagugaguucuaggacauccagggcugcacauagaaacccuggauguggcauugaaggagcugccuagccgagcagagaagggauccugaggcuuuuaagugggcacagaggguucccaggcuucguggaugggcacuugguagggcuauggcuagaacagggagcaggcagggccgaaggucuccacuuggaacugcacuaugguucucauagcucuaaaagcccuaauggccagcugggcagcacagccuuaugggaauuguaguucuuuucuuccucuuccuccuuuucuuucccuucuuccuccuccucuucuugauuuuuugagacaauguuucacaguguagcccugccuaucugaacuugcucuguagaccaggcuggccuugacccuggcucugucucccaaguuuugggauuaaaaguaugugccaccacugcuagcugaauuuuaggguuuuuuuuguuuuguuguuuuuucuuuguuuguuuguuuuuuguuuguuuuucguuguuguuguuugagagaauuuuaguuuuuuaacuagagacugugcccacaucuguugggaacugcagugcacagggcaagcuguggaggaccguugcuuaggaugauggcucaacagccuuaggggcaggauguggcuggugauugggcagugucaucuuuauguagcuuuaucuuccaggguccccaggagucagaaugguuuggccuuccuccccuuugcagcucacaggucagaauuggccuuccaccccuucccuggaauggugugacccaacugccaaaugccauagaccaaccucugcagcccugcaccgugguuaggccugagaacucuugguagccaucccucuguggugcucuguagaccugccuccacugagcccccgcacauggcuggaaaagcggcuggcagggcucaucacccucauggguacauucgaaaccauaggcucaaagaggugaagcuguuugcuuagugugcaucucugacacagguuuaggcccccacccccacuccuuucauauccauccuacaaagcugcuggcaccccgccuccaugucuuuuagacaaggccucauauugagcuuaggccuccuuaugaagcccaggcuggccuuaacuuugcagccaucuuccaagcuucuugagugcugguguuacagaugugaaccacguaugcauuacagaugggaacacggagacauuugccaggguaacaggacgaggcagagagcaggauaaucccuucuuggcccugucucuagccuuccucugugucuggggaagaggagugcucccuucuucaacccaccugcucagccuguucugccuacccacaggagcuagagaaggcugugcuacggggccaggaacugggggaccggcuggagcaucugcaggaggagcuagaacaggcagccuuagagcgccagaaguuccuucaagaacaggagaaccagcaccagaggugggcacgguggcuggggggcagggacugacagagaaggaaggacuggguguuaagguuucuccugguagguaccggcaucuggagcagcgucuggaagcugagcugcaggcagcgucuaccaguaaggaggaggcacugauggagcucaaggcucgagcccugcagcuggaggaggagcugauucagguaaagcugccugagacugaggugcuggccccuugccccagccuggggguaggcaaccagggcugucagggccuaggucuuuccucugggcugauggaugacugcucaucuccuacccugguggggcugcuuccucuauuccuuaagugaaugggaccucuucuuggggugacugcucugccuuuugguuugggcuccaacacuucccugugugugugaggcaccuacgauuugugucccggaaccuugccccugcagcugcgccaguacccgguggaccuggcaacuggggcgcgagcugggccucggacuguggagacccagaauggacggcucaucgaaguggagcgaaaugugagugacaggccgcggguugcccaggggauggcagggcuagcggcuuaaacacugaugaccuccauuucugacagaaugccacacugguggcugagaaggcggcucugcaggggcagcugcagcaccuggaggggcagcuggggagccugcagggccgugcacaggagcuccugcuacagagucagcgggcucaggagcacagcagucgccugcagguggguggcagccaccuuguccccugccuguuagugucguuucaugcccuuuccccggacuccagccaacggucucaucugcuuccacagugcuuucuuccugaccucggccaucgcaggcuguaccuucccccuuuccuugccuucagaauccaugucugcacccacucccguuccucaucacucuagcaucucagccuccuccccuacacuagccguuaguccucaccccuucccugcccuuuacccaugugucccaucccugguuugggucucuugcauggccccaccaccaugaugcccuucuacugcuuuuaaccuuugccuguucuucagcugugcucggcuucuuccauagcuguccucugcccccuacggucucgggccaugccccgcauuccuugugggcugggugccccucugcagugguccucccuaccuucucaccuuaggcugaaaagucaaugauggagaugcaaggucaggagcugcauaggaagcugggggugcuagaagaggaggugcgggcagcaagacgggcccaggaggagacccgagggcagcagcaggcucugcuucgggaccaugaggccuuggugcagcugcagcgacggcaggagacggagcuggagggacuguuggugcggcaccgagaucucaaggccaauaugcgagcauuggagcuggcccaccgugagcuucagggccggugagucuccccaaaugcgccacuucucuccccggcaugcuuacuugcccgucuuccucagcaggucugacccaaggggauauuccauacuccgaguaucuauccuauugcuccucucuugggggucugggcuccucaacuuugaggcuguaaaugguguucugcuuuggggcuuugcugggauguggugcucaugcuuaggaggugucagacuuucaguuccccacagugcagugccuacuugucaaggcugcagcccuugcaguccuuugggccccuuguucauacaggcaugagcaguugcaggcccaacgggccaauguggaagcacaagagguagcccuacuggcagagcgugagcgccugaugcaggauggacaucggcagcgcggccuggaggaggagcugcggagacuucagaaugagcacgagagguacuagcucuggugcagcccugaccccccacccccacccccaggucagcauucccacaggugaagcggguuagaguggguuagucacugccccugcauguccugcgucuccuccucucuguggguguggccuuccuggcuccugggcgagcaguugucuuugccuccaaagagcucagaugcuacuggccgaggugucccgggagcgaggggagcuccaaggugaacgcggggagcugcggagccgccuggcgaggcuggagcuggagcgcgcacaacuugagauccagagccagcagcugcgugaguccaaccagcaguuggaccugagugccugucgucugaccacacagugugaggugugguacaguguugugggcagccuggggcagccaagggaggcaagccaagauggacagucucgagccggguauucauccggcccuugcuguugcccgcagcuucugacccagcuucgcagcgcgcaggaggaggagaacaggcagcuguuagccgagguccaggcccugagccgggagaacagggagcugcuggagcgcagccuggagagccgcgaccaucugcaucgagagcagcgagaguaccugugagcaugcucagggacagguuccucggggagccccaguucuccccaccucccaccccacccccacuacgcccccagguccaagaaaaaaguuccauagaguagucuuaccugcaaugggguggcccccgaguuacaccugcuucuuccagggcuuugccaggauuucugugaauucauucucucuucuuccuaccagggaccagcuuaaugccuugcgccgggagaaacagaagcugguggagaaaaucauggaccaguaccgugugcuagaaccugggccccuaccccguaccaagugaggccccaccuuccggaacugggauccugcuaaccuuugcccuguccuacccucugaccccccagcuccccaaaagccaggcuggggugcaggucuuaguaaggguuugccugacccuuuucauuuccugaaaugauucuccucuccuucucuucuuccuuaucccuucuuaugcccucuugcccccaggaagggcagcuggcuggcagacaaggugaagaggcucauucggccccggcgggagggggcccuccauggggggccacgccugggggccgauggggcuggcagcacggaaagcuuggggggcccccuggagacggagcucccugagggcagggaggcagaugggacaggugggucugagggucuggugaccaggaugucccuauuccaugucucccaccuuggcaucugcuguacugucuggugugcacuugugcuucccugccaccugccuccaccugccuugaugcugauggcugcucucugcuccaggacugcagagucccuugccugggcucccccuuucugccuguauugccaucuccccauuucuacacaacccacaguaacaccuaagaccucagagcagcagggcaccuuagagaaagauuauuuaugcuugauggugguacagaaggaaacugagggccagggagcaugggggugccuugcccaaggcuccauaguaaauuugugugagccagcagcacauuggccaggcccaugggccagaucucuucccgcuuacgcucugcucuucuuucuacccuguguaaccucacccacuggcucuuugcuugccuggccccuuccuguacuugggugacccuucucccccaugcaugugccucucacaggguccucgucaccagcacccaugcgccgcguccagagcucucucugcuugggagaugagacccuggcaggugggcagcggcggagacucaguucccgguucccuggggggcgaagcucugcgucauuuaguccaggggacaccccaaggcaacgguucagacagcgaagacccggcccccugggggcacccaguacccacagcaaaggugagauauagagucccugaaucuaaguucccauuauuggguggacucagcauuuuggagagucauuccucuuagucuccguguuccuauaugccuugaccgucacugccuggcacuguggcccaguggcugccuuucgaucccuaggaucugguguggaaugggauggcuccauuaagacccucucggagcaugaagcagaugacacucgagaggguaaguggggguugugugccccaucugggguccccagcaagucucacuuaccaguucucucuucugacgaggaaggguucuuuaccaaacaccagcugguaugcuccuggggagauggcagggaacauucugguguagggaggcagacagcaaauacugccugaaaauaaucacugucugcaacagccaggacugacagcaguacaauuugaacagggcaugggugguacaugcuggucaucccagcagcugggaggcugagauagaaggaugacaaauucaagaccagccuagacuugguggcaagacccugucuuaaggggaaaaaaaggaaacgcaaugugagcuauguguguauucuuuuuccuuuuuaguaauccugucagaaacauaaagagagauagguacaacgauuuuaaugacaugacucauuuagcucugucugcuuaaaugauuacugcuuucaauguguagucagugcaaaaaacuacaaaugagguuuucuuuuuaaauuuauuuuuugaggcagagagucucacugugcagucugguuggcuuagaacugacuauguagacuaggccagcuucaaauucaugucucugccucacgaaugcugggauuaaaggcacgauucacauucccaguucugggauugaagcuacgccucacuuuuuccuuuccuuuccuuuccuuuccuuuccuuuccuuuccuuuccuuuccuuuccuuuccuuuccuuuccucuuucuuuuuuuuuugagacagggucuuguuauauaggcuauaauagccuagcucaccauauaguccaggcuggacgauuuguggcaauccuccuaccucaaccuucuuaguccugggauaauaguuugugugcuaucacacucguuauuuuuucauacuaaguuuuuaaagucuagcaagcucuucacacacaagcauauagcaguuugggcuagcagaggcucagccccagccugauaggaggcuauaaugcugggaaagaaguaagagugugcgugugugugugugcgugucaaaggccacacuggaauuugagugggggcacuguuuaaggacaggcuucagagaggagccgaaauauagggacagcuuggaggcaggcuagaacagggagguggggacaggagguuuggggucccaugggcugccuugacugcuggccaucuuucugggaggaaacuugaucccaaucuuucucuccagccuuccaggagcagaaaccggagaaacaguuccuuaccccuucccucagccagugauucuguggggacagacggcuuaggcgugcagccuucuccccauuguagggucaguggggcucccaggcagcccaagagccgggggaccaggggaccccaagaagaccccuuggacaaagaggccugggcucucaggucccccacagccuauacuggggcucugagaaggagcugggacgaggcuguggacaggggagaugauugguccaaaccgggagcuccuggccagggcucuugcucugaaguacagcccucaccaaggagacgaucccugggagacuccccagcugaagacggcuggcaagagugggcaagaaaacccucugccagcucuagauggggagcuaaggcccauucccuggggacaggccugggcugauaucugagcauugucugggacacgagggaaagaagaauaaagcugaaaccccuugaaucuggg

SEQ ID NO: 9118 - RNA, 3723 nt, Mus musculus
cgcgccacgaacuccggguugaacuccacgggguugaugcggaccucaguggccugcgggggggggggggcgguaaaaagguuuagcgagguagguccgggucccggaggcuccacccugaacuauaugggcgaugaacccuugugcaguuaccugcaggcgcagcgggaagccacgcgugcccacgccccgcacaugggagcuuaggagauugugggugagcaguuucauguugucacagcggagcgcgugaggccggaaccggaaggaguccacacuucuccuuucuaccacuuccgcuuugaagccguugaacucuucgccggaccggaaguggccgacuuaggggaccuuuuggggggcuuggcggcagccgagaucggaaggacuguguugggucacguccugguaccggaagcguuucucggggagacugcaaaggcuuacgccgaaucccgcucgcugaagagaguacacacuaugcaagucacguguaaaccggcugcguuacggcgcagguaaaacgaacacauuugaggcucagccagaucauccccgaccucuguuugcggcuaugggucacgaacugucacgucgguaaaccaggcaccucuuucugcgauugaagaaggugugcgagcccugagagccccgccgcgucguagugcgucacggcccugccccucuaagccggcgcuguggcugcgacgugggacgugcggcgugggcggagcugucccugcauccaccuccugugggcagagccaucugcgggugggcugcggcagcggggcggguaugcuacagcuggggcuucgaguccugggcugcaaagccaguucugugcuccgugcaucgacgugcuuggcaggcagagcaggccggaaagaagcagguugggaguguggcggagcccgcagcuucagcagcuccgcggugaccauggccccgaucaaggugaccgguuuuaccuuuccuggguccagccuaucgcgucucuuuggguuccacgcggggucucgggcuguccuccuugacguuucuucuugucauguuuuuuguaagacccugucucugcuucuccguccugggacauuucuugagcugcccucucacaucuaugccacguccagggacaaguccccaccauuuucaagcgaccgaaugcuaugucauuucccacauucuuaaaaugccucuuuugccgcuuggcagcuuuuccaacccuuuccccaaagccccagcacuuuugugauuguacuaaacuccauuucaucucaucuuuugaaagagccauggucccuuggggaccuggguugaucuuuuccacuucuguuuccacucuauguaugcucaccccgaucccgcccuucuguuugaucuuucugggaauucuugaaccuauccccucuccuguuuuuggacuuaauuuuuagagaaagagagagggagggagagaggaagggagggauggagggagggaaggaagggggggggcacacagagacagagguugacuuacuauauagucuuggcuggccaggaacuugguguguagaccagacuggccucaaacuccuagagaucugucugacucugcgucccgaauguuaggauuaaaggcccuuuauaaaaagaagaaaaaagaaaaacuuuuaaacauguacuuaguguguguguuugguaacaggcaugugagugugguggucagaggacaauuuucucaggagucaguucuaucuaccaugucgcuuguggggcuagagcucaguugaccaggcuugguggugggcaccuuuaccuacccaccucagccuuccuuuccucuuguggcucugaaagcccccaggugggcugacacuucccaccgaccccaagagccuacauccugaacauuuuggcuuacauagcuaaccugguuuuccaaaguguuucuccugguguguggauaggauuuuucuuccugccuguuaccaggcgguuucucaaccccaaacauagcccucuguaccccuccucugugcauugacccaucuuggguggcuuguuuauacaguauugcaacacuugagaaggccucucccuuucucuguugccaccaacuggccuuaagcagaaucagucauguaggauguggggcaggcaggacauacaggagagcgaggacagaaauggaccccugaaccgccaggcacuuuuucugcugggugugagcacuggcuccaucaaggucuaucuguguggcugugguucacuagucucucuucacucuguuuuacccuggagucuuuuucuccaggugggagaugccauucccucaguggagguauuugaaggggaaccgggaaagaaggugaacuuggcagagcuguucaagggcaagaaagguguuuuguuuggagucccuggggcauuuacaccuggcuguucuaaggugagacuucuccuuucgagaaucagaaacuggggaccaggagugugggagaaaagaacccacauuaaaucugauagcucugauugacgcuggugguggaagcccuugggacucgggcuaaugagacaaaagauuugccuauggucuugaccauacacccuuagguccaagcuuccuaguagccaaggcaaaaaggaaguggccaguuucacacugguuuccuuacccuggucagggauguuaggaaauagggggagcaggcugagcaacugcaguugcucuccuuugaccuuuuguuuuccucucagacccaccugccuggguuuguggagcaagcuggagcucugaaggccaagggagcgcaggugguggccugucugagcguuaaugacgucuuugugauugaagaguggggucgagcccaccaggcagaaggcaaggugagguguggggcccgugagggggacggggccagguaggaaguuuccuuguuuuugugacauguuauuuacucauuuuguguguggggugggcacuugugccaucaugcacgaguggaagucgaggcuaaccugugagaccugagucucucuuaccagguggggucguggggacugagcucagguugccagacuuggcagcaagcaccuucacucaccgagcccucucacuccuugugacauuuauucucuuuucugcagguucggcuccuggcugaccccacuggagccuuugggaaggugagugugccauccuucccucagccugcgguugguccuggagggacauguuauaugggagcagccccgggccuguguggggguuucugacccccaucucugccuguucccuaggcgacagacuuauuauuggaugauucuuuggugucucucuuugggaaucgucggcugaaaagguaaaguagacccccuccccccagccucucccuguuggcacccagccccucccuguuggcacuaggggcccuggcugcugccugggcuucugcagcuggaccucuuuccggcagguucuccauggugauagacaacggcauagugaaggcacugaacguggagccagauggcacaggccucaccugcagccuggcccccaacauccucucucaacucugaggcccuggccagauguccucugacucucccaucucucccacccggcucuaggccaaaaggcucgguaccuccuuacugggagccacguaaauggaaccuugaccauauuucugcaauaaacaguuuaauuugugucuuuaccacugguacagg

SEQ ID NO: 9119 - RNA, 1354 nt, Mus musculus
cacgucccacgucgcagccacagcgccggcuuagaggggcagggccgugacgcacuacgacgcggcggggcucucagggcucgcacaccuucuucaaucgcagaaagaggugccugguuuaccgacgugacaguucgugacccauagccgcaaacagaggucggggaugaucuggcugagccucaaauguguucguuuuaccugcgccguaacgcagccgguuuacacgugacuugcauaguguguacucucuucagcgagcgggauucggcguaagccuuugcagucuccccgagaaacgcuuccgguaccaggacgugacccaacacaguccuuccgaucucggcugccgccaagccccccaaaagguccccuaagucggccacuuccgguccggcgaagaguucaacggcuucaaagcggaagugguagaaaggagaaguguggacuccuuccgguuccggccucacgcgcuccgcugugacaacaugaaacugcucacccacaaucuccuaagcucccaugugcggggcgugggcacgcguggcuucccgcugcgccugcagguaacugcacaaggguucaucgcccauauaguucaggguggagccuccgggacccggaccuaccucgcuaaaccuuuuuaccgcccccccccccccgcaggccacugagguccgcaucaaccccguggaguucaacccggaguucguggcgcggaugauccccaaaguggagugggcggcgcuugugcaggcagcggacaccguaaggaccccgccccuucugucgccccuugggggcgggcucaggcucugagccucuucccugcccggacggccucgguguucgugugcccacugaccacguacgcuuccuuuccacaguuaaacuuggccgagguacccaaagagccgacugaaggcuaugagcacgacgagacauuuuugaggaagaugcaccacguguugcuugaggugagaauccuugggcaucgccugcccagaccucccacugaggcuaccggugcuuagcuuuguccugcuccccugcagguugauguacuggagggcacccugcaaugcccagaaucuggucgucuuuuccccaucagccgcgggauccccaauaugcuguugaaugaugaggagacugagacguaaccuugcuagccgccacuuugguauuuuguugacuguguguuucuguuguacggucuguuaaauagacgugucaugugugacccccaaacuccccccagugacucaccgaccaccguguacuugagcuccauaguauauuuuuuuucucauuaaagguucaaaaccaaaagcgguuucucuuugcagcaaau

SEQ ID NO: 9120 - RNA, 806 nt, Mus musculus
caccccaccccauuauguugaugggacacuugacagauuugguagaucagcaccccugaggacccucaaguggagaagcagaccuaaaacaugcaaguagcccugguuugcgaguuccucaaaggcagaggugagacacgagcggacaaaacucaaggucacugcggugaccgaaugaaggucacggggaaaggcggggccacgugcguccgccucacgcaagcagccacgcacugacucugggaccaugcauagacucuuuaauuucucuaggauucaaauuccaugcagaugagguugagcuuggguucgagggaccggaaaggacacggagcggacgucucgucggccacuugagcuggagguucacugauccaaaaaguacagccucuuguuccugcgcuuccugaucccuucgauguaucccugcagcucuuuagucaugaagugguuccugccaaucguggaccuauaugcuagggagagggaagagcugagcucagggccaugaacagcagcaaagggcuucccccauuugaggaaccacaggugauuugagguggcauuuagugcuggauuuggaucuguguuaguuuggggaauuuugggucuccuaggugcgaugugaagaauggaggggaagaaggcugaagaaguugcugcaagccugaacagaggcagugagacccaaccuccuccugagccgcucacucuaacuaguuaucuggcccuuucuucccucuaugugcucauauaccaugagcagaagguuacgcagauaauccaauauccaguacauuuaccca

SEQ ID NO: 9121 - RNA, 4396 nt, Mus musculus
ccugcgccgaccugcuggucuccaccgccuuccucccgcgucgcuccccaggcuccggauuccgggaucggacuuccucaagccuagggcgugugcaggagccagcgagggcugcuuugggguucccauuuggauccuggaggccugcuucggcugauaaguccuccagcccuucugggcccgaauucccuccuguaaaaugggguuaaugacaccucccuggggagcuggugaaaacucuguaaacagcuuagugauuacuuauagagccguucacugaagcucggccgucggaugcaauggucguugcgaugguuauugcucccccuggaccgagugaccgggaugggaagaccagcuccuucuucccgaucguggaggccuugcacugcccgucuuggggacaaccccccgcgccauuucgggagcuccuuuacggcaggauggccgcccgggugcggaagaagggacggggcgcccaggaaggcgagccguggggcuccaggggccucugcugccaggauaggugugcguacgcugccccgggccggagcgcggggccugcagacagaagcuagggggcgggguccggguaccaucuugguugugggcggaaguuuccuucagugacccugugcggggaagucguugccgccccccauaugggcacgccgaacgcgauguggauuugggaaucuaagcgugggaaaugguaguccccaaacauuaagagcuggcgguccauggcacugguagcccaggugcuugcugcgugcggccugcucuacucucggccgcccgccgccauccguaacccgggacacccgccggcagcgcaccuugcggcgauucucgaagagaugcacgccgggcgcggcgcauggcuucggagucccugccggucgcuacgcaguuuacguagcgaacggacguccgcgcaggcgcaggaguggggcggagcagagggagccggggagcuggagcccggugucccggcgaccggaucccgcuuaccccgcagcggccugagaccugacaucgacuuccucuuauucaccggggcugaggguggacgcggugggggaacacgucuggaaucuugaggacagaggaagaagccucccaauccggauuauuggaggggaaagaggaaccaagcuuggggagggggagagcggggcguugggcgcccccgcagcggccgcuguccuaagcugacgggcaucggccggcucucccccuccugccagccggacacgagcaaccaaggccagggacucugugccacugcauccucgcaucuuggcucuggggcuggcccagggagggacacccccaacccccauuucauuugcccuggguaggaaagaccacuuuauacacuccagagugacgggucuagggcccagggcccagguuacccgugcccacccccacccccacccccacgcccgacucugcugagaaggaaaggccugacaaccucaacuucuuuuuuccagaguuuccaggucucaccaccuauugcaggucccaccccuccguauuuauuucccuggcuucuggccagcccucuaucucugucuccggguuucaggccucccuccuugacauggagaguaaccugucuggucuggugccugcagcugggcugguaccugcacugccgccuacagugacccuggggcugaccgcugccuacacugcccuauaugcucugcucuucuucucugucuaugcccagcucuggcuggugcuucuguaugggcacaagcgccucagcuaucagacaguauuccuggcgcucugucugcucugggcagccuugcguaccacacuuuucuccuucuacuuccgagauacucccagggccaaccgccuggggcccuugccuuuuuggcuucucuauugcugcccugucugccugcaguucuucacacugacgcuuaugaaccucuacuuugugcagguaaccacgggaaccgguguggugggaguaggagggcaaucucaaugguccaaaggagugaugggguaucucugcucccaggugguguucaaggccaaggcgaagcgucggccagagaugagccgaggcuuguaaguacuggagaugucaaugggucaguggcagggaggaagcccacccagcaggguugagacaggaggaaccucagaaguauuugugauagagcuugagaaaccugaagcgucugauacagacaucuaugauagugucaggggagagagaccaucaauaucaccugugguggagaaagauggaggcuccaacccauggaaugcaugaaguccugcugcacuuuuagugaccuuggcugcaacaccccuguccuuacacagugccuucuaguuuauaaagauauuucacaucucaccugaggugcuauuccuaucgucauuugagaggauaacugaggcccaguuagacaaagcaccauguucaaggucacacagcuggaaugaggcccacucaggaacagauguuugacccggugcuccuaugaugcuguagcucucaaucacccccucaguuuccucaucugcagaaagagaugagcagaguuuagguguggccaucugaguucuaacugacccuggggucuccugaggagucaggguugcuggugagggccgaggggauccguggucuggggcugacuuugcugugggcugcaggcuggcuguccgaggggccuucgugggugcuucacugcucuuuuugcuggugaauguacugugugcagugcugucucgccagcgccaggcacagcccuggguccuucugcugguacguguccuggugagcgacucucucuucgucaucugugcccucucgcuugcugccugccucugccuuguggcccgucgagccccuuccaccagcaucuacuuagaggccaagguagagccaccaaccuugauguagcacccuuggggguccuuggacagaguucuuuaggauguaaaggaauauaggagcccuccucuccaugaagauccucuauugucaucucugccaggggaccagcgugugucaggcagcugcuauagggggugccaugguccuucucuaugccagccgggccuguuacaaccuggcagcucuggccuuggccccucggagccggcuagaugccuucgauuacgacugguacaacguaucugaccagguaggcauugguccuguuugucccuucuuugguaacuauaauaacuagccuccagcuggccagggcccugccagcagccucugugguggcagaauguccucagccccugcuuuuccccaggcagaucuggugaaugaccuagggaacaaaggcuaccugguguuuggucucauccucuucguuugggaacugcugcccaccacauugcuggugggcuucuuccggguacaccggcccccacaggaucugguagggacccccccccaaccaccucuugguccaguauagagggcuggacccugggaauucuggucugggguccugggacaguuacggcagcagaagaaaauauccauaguaccgacuucuuuccccauaccuuacagagcaccagucgaauccucaaugggcagguuuuuggcucccgauccuacuucuuugaccgggcuggccacugugaggaugagggcugcuccugggagcauagccggagugagagcaccagguaggcgccucuacccugccugaagugccucgagauccagccugccuccacgaggcaaugggaaccagucuguucugagugaaaccccucugaauucccagugcccaccccugcccacaaaagcaguuugcccuuugaccuagggcucucuguuucucagccucucccaucucaagaauguggcccugggcacugccugggacucaccuuguuucucugcccgcagcauguccggcagccugggcucuggcaguugguauggugccaucggacgugagccaggcuggggaggggccagccagacgaggaccacuccucugcucuucucccaggugccaggaccugguagucaccaccacagccucuauucuacaccacagacgugaucugcuuuuacuccccuuagaauacccaggccccagcuccccugaucccuggccccugugccaaguacgucugcugcuucuugcccagguugccaggagacuguggcugcuucucuccucuggccggcuccuugccgcuccuauuguagugagcuugugccaucccccuaaaauggaaacaaggccccaggauaccagaugcccacagugcccuggcaugaccugccaccucugcuuccacacuggagccggcuaccucuccugugccuaccacucaauaaacagaggcugugcccuguccucccuccugucac

SEQ ID NO: 9122 - RNA, 1463 nt, Mus musculus
uauguccguauuuuaugaaagacacuguaaacuuuuuguacacuaaagacuucauuacaugcacuguacuaggauuuguggaaguuaaccgauuucucacaaaagcccuccgaguucucugcauucacaaaggagggacuaaggcuguggaacagauaacaggccagagagucacaccucuuccacucccugaccucugcaggcgcaggggcuauggagacucggagucgccacaguucguacccagcggggaccgaggaggaugaagggauggaggaggagcuuagcccuuuucgaggacgcucgcguucggcuccccccaaucucugggcagcgcagcgcuacggccgugagcuccgaaggaugagcgaugaguuugaggguuccuucaaggugagcgccagcguuaggugcgaugggaccugaacccucagcugcuaccccuccuuugaucuagggcaugucgggauuucuaguuucagagccaccaauuuucccuuuuguguuguagagcaugcugggacuugcaguucuaauccguccucucucaguguccagugauuugcugggauuuccucccucuuccuccuuuguccaagaccccguccccagucccgguuuaugccuucaccuguaaucgagagcucuuacagccggaccgcuaugagaaccgaaaucuguaguacagaccaacuucacaccaaaguuucugaaccgccagguucauagaguacgaggcuugcuggcaucugagccucuccccaacuucuuaagcuacuuuaaauuguugaguucuuccccauccucuaaacacuagaucucuggcugugcaguuucauuuaggaucccggcacacgcaucaucccgugucucugaccgcccagugcagagcaagcuggugguggggaccugauucgggaugccagaaugaggcucacucuuuccuccuccuucccugaagggacuuccucgcccaaagagcgcaggcacugcaacacagaugcgacaaagcgccggcuggacgcgcauuauccaguccuggugggaucgaaacuugggcaaaggaggcuccacccccucccagugaucuucugcuccacaucccggaacucuacccgcucccgucgcccgccauauugggugugggcggaagucuuucgaggccuuaggaaaaaaaaagaggaucgcugugucccuuuaacagggagaagagcugacguacagcuugagucccuuccggugcgugcaauagccacggagggguggcuccuguuuggaguuucaaaguuuuccacgcaccccacccccuaagccuccggaaguggcuguuuucccucuccuguucuggacugcccucgggugccugugcuaaguugggggucugggugcuguccugucauaacuggggacccgaggucgcgagaaacgugcuuuauaauaaagccugcgcaugugccgccgcg

SEQ ID NO: 9123 - RNA, 22029 nt, Mus musculus
uagaagcuucucacagggaccuggagcagggcccagagcuccguucagagauuuauuggcgccccauagcccaggcuagugcuuugcgcuggauaugcagauaaguugcgccacaacucuuugcuucccggaacaugggaggggguggccccacaacagggccucaaggaguaggucagacuugaaggugaggcuaugucuggaacugacacucucugcagauggacacaccaggaucuugggacuuaguuuguuuuuugagggcccaacccacauggaguguuugggaaaauggaggucagccagucagcgauauaggacaugggauccggaaaaguggcagaucuggaaacuugacacggacugacugacagcugaggaaggugacuugggcaauggcaggaaucucagggagagcugaggccuuagcccugggaagcccaacccaggccacccaguuucucuggcuuuccuacccgaucuguuugccuggggcugcaacaaaaacaaagcaaagcaaacacuucauuggcaggagauaagcccagauaagaggcugccuuccuccgaggggggagcagccagucccccaccggccaggaagcuaggagaggccuugaaggagugccagccugccccagcugcagagcuuggcccauucucuugccacagggucucugguguuccuggcuggucccaggcucagagcauguccuccggcuggugaaggccauauagcacagagcuaacacgcaggccauccugccuuccagcaggucuccacuuagcuauggcccaguaaaugcaucuuccauucggggccuguuuccauaucuguaaaacaggcaaaacaucucccucauagggaugagagggccacagggcaucagcagaguauccuagcccugccagcaauagcccuuaagacuaucaaguuccuuucucucuuaagagcuauggacccuucccacuaaucugaaaauucagcuucaauccuuaguggggcccucagcagcccugguagaagaugcugggugcuugggucauaucaggcaacaggaagggguggggaguagggaaggcuuccuaaagcagggucugagccugaacaaagagagauggggaaaggcugagggaaaagagauuaauggguuugggaaacuuaggggcucgggacagauguuggaaggccagaagcuaccucugacagggacuaaggucaccacagaccuuaggcaaggcagccaaguucaaaccuugaaauagauagaaaucugaccacaauggcauaaccccauuuuacagaggaggagacugaggccccagaaaaauggcaguaccagaacuagagcccagaguguuuucauccaaacuacacuguacacagggucccugaaguccacuuuuauucauguaaaaaacaaacaaacaaacaaacaaaacuccccaaauauaaaggguugcuuucuacuacccagaacuccaggguuccacuagcugcuccuugggaaucggggaguaccuaucuuaggugaauguuaugggguacaagcccuagcccuuucccuaggccugaaguuagaaggggaggcugaggaccaagaggucccaggaagaugcagggaguuagaguuagugugaggcauuugccucagauuuuaaaaaaauaaaauuucuaaagauaaaagguuaaaaaaaacccaaaguauuagugucuucuacccauagcccagugcccacccagacuuguggccaccucuugcucagccaguucaaagcuggguguucuccuccuggcucuccgagucagcgcuggacaggugcccaccacucccaggugcaugaccauugcuggcacaggccaccagggggccgucccccagucccucugcugucucgcccagcaggcaccgacggaucuccuggggcaaccucucucgcuguuccugacacuccugggucagcugggccagcagcuacaagaggaugagugucccagaggggccaggcugcccagcuccccugcuaccugccugugcgccuccuccaggccucaccuuggguuccucuuccucuagcugcuggaggacuugcuguugcccugccaccaggcguucauggcgcugcuucugggccucuuccagcuguaaaggcgggcaagaguucagcugagggaagggcaaggccuggggcgggggucacuggggcagagggauaucagggcucccaagguguuggauaugacgcagggaccaggggcaguugguacaguccccggaggaaaggcauuaggagccuuuuggagaaaaaauguggcaccaaggugggcacugaaaagcugaguuccugcuggugaaggaggggagguggggcucacucacccgucugauggaguuuaccgacucagugaugugccgccgauuaaucucugucaguucccugcagaaguaaaagggacagcucagggccaggcucugucccggccuccccucacucaguggcucccaucacacuuacaccuccuucuuguguuucucccuugucuuggccucugagaugcuguuguugcgcuuccuguccaggaucuucuggaguuccuucuucucccuggagcagcacagauuagcagggggagucagaggcuggacucuggucaccagagucccccacccucacccaggaccuucuaucugucaguaccuuucauucagcuccuucagccucuugaacuguguuguguguguauccaggacaaccuccuugagccgcugaugagccuggggaggcaggcagcagccagcagguaacauggggcugacggcagagcuacccaggaagcuggcucucgucgccuguaccacgugccccucaccugucccucaccugucguagaugcuccagcuuccgcuuggucuccacaucugccugggcuucccucagcuccaacaggcucuguacuugucgguucuggaacucucgauacuguuuggccuccucuuccuccuucacguccuccgaguugguggccuugccccuauagggaaccuucucagugccaggucuccgguagaggaggacaguuagggcagagcucaugccagcagagcagcaggcaccagcuaggugagccaugcuaugcaaaucaggaggccuagcaagggccagcagcugucccguuagcuucacacuucacacagcugauggauuccuggccagagaccucagaagaggugucacucccagggaagagugagggcccggcaugggaaccugccuccaccuuccugccaucugagcaugaccacccagccuggagacucacaggcacgccucccucugauauuccugucagcacacaacacagguggcaacaggcugcagggcacucacagggcacugggggagggccggcacuuccccucagcccuggccugggccaggccauccagaaggcggcgggugagggccacagccuugcgcuggugcuucuuaugcaacucccgcaggucucgauccugccggcuccguagcuucaccauagccuuguggcuucugagcuccucuagagguguaggggucaccucuauaaggcggagcaaaggaggcagguuagcuguuggggugggccaggcauggcugagcuggguggggcagaugccuaccagguggcccuaccccagaucaggcugugccccuuaccagagaggaugcuggcaaucaaaucaucucgcugcccuggagagcagagacuguggugagaagcugugggauccagcugcggguggcuccccguggcccaccccuagcacaggcugccccuuaccugggcuacugagggaggagcuaguggaggaagugguaggaccggggggccagcgaggugaggcauccaguggguuaggugugggguuggaggggagcugugacccuggcuguugacacggggucuccugauaugucucugugcuggccugagccuguaagagaaaacucuuucaaaaaauguucucuucauccuuccaccuccucuaugcccuaugccccuuccagcucucucugccuacacaaugagaacaacaggcacccuagacccuugcccaagccaucaggaaggcucugaguuccuagagcagaugcuucuuggagaagccuggccccgcuccgugggccuuccucugcgccccucccucccucccgcccgcccgccuggugguuuguccuccucuuggaugcuuagcuucugauuuaaucagcaaaggaagccagugcagagcgggcaccagucucuucgacuaacagcuccucacagcccuaauugcagucagcucuuuccuggcggccacaggccccauggggacugggucaggacauguggcugaaccucugcuccuggcgccuucccacugaagccacuaucucuucauggcuucccuggcuuccaguaccccagugugugcauacccaaugcuuugacccugucuagacacaacccaaaucaucacaaaugggaauguccucuuucaagaguccauaagugagccgaggguauagcucagugguagagcauuugccuggcuugcuuaagaccauggacuccauccuuauccagcaugggagaagaaguaagggguuggaacugauugguaaaguaccuaccauaaauguuugagggccuuugcuuggaucaccucaugccuauaaccccacugcuugggugggcaaagauagggggcucucugaggucacuggccagccagucugguucaaugagagacccuaucucagaaaaucagguagagugugucucuggaaaaccacacacacacauaugugcacacaaaccaacauguuuacacacaaaagcaaaaaucuacagcccuucugcccacuguaagcuaucuaaaauccccugacaguaccacauggcagaaagggcaagcuuuaggggcugaaaacaggccaaaggcccagccaggcuguguggugcugagccacuucccauagccucagugucccaucucugugagggacaggacaguaagccaaggaugugacugaccucacacuagggcuggcagcaauagccacuucacuucauuucuagguuggagugagacaaaagaacccagaaaaggagcaggcuucccaggcauggggcaggcugagagacgugaaacuaggcucugcaauaagacacuuaacaacagagucuggagaaaggcaucagauggcaggguugguagcuagggguagcuguggaagagcuguucaaugucaaggugggccuaguccugcccacucaccucacucuccccaaugagagcggcuaguugcuuggcccgcugguccauuaggcuuacgugcuugaugggguuaaucaaggccuccgcauagucuagaggaaguagaagggccagucuucagaccaaagcccaggccacacuuucugccagcucagggcuccaagggugggaagucugaucccacuugaacuggggcaccuaaaucagucaugcccaagcccaguccccacccgccugagcuccgccgaacccaucgcccugucccccucacccugguggucaucugggauguagucagaagcuucaguguagauaagcagggcaggcaggcacaaagguugguuggccucguuucgcaggcagacauagugguauccugggugggcagcggggaaaguugaucucugccuggccaaacucccaagcugccccaguacugcccagagcccgaggacucaccugagcggauagcagagacaggcaggauacggugcccaacaaauuugccacccuccucaaaggcugcgaugcgaagugaggccagcgugggcagcacaaccuguggagcccacacugcugagccauggggcagagccaggaccaccauaccauagccgccaaggccucacccucagagcacagaagcccagcucaagggaugaccaccagaguccugagccaagaacagagguagccagaagcccucagggcuauccauaggauaggacaggacagaucacauuguggccugcuuagcaacuguacugagccauguguauaaauucaggacacacuucaaccaggucaagaguagaggcaacauucccaugggaccacaguggggguugggggaggucaagcuuguaguugugguaucuggcaaguacuuccugccguggggacaaggcagugcccguuccuaauguggggaaagaacaggaacgacaccagauagggcaugcugucaucaucccuaugucucuucuuaucccaucugucacucagaaaaggucagagaaccaagccugacccugcaauaugcaggcucuaaggggggucaccugcuuuuccuacucucugaccaccggucacuaucacggugccuggccccugcucucagacuaagcccagcacagucauggcgggccggccaccacaggggggcuuaccuuggggaagucaaaggguuccucgucccacacaggguugaaugaguuccccugggauguccggguacgauauuugcgucuugugucaacugggaggccaaacauguccaccucgacguagaugcccaccuucuugucagacaggaacugccccgaaaucaccuggggugggugggacaggccaggaaguuaaguaaggcagcuacugugcgucuuccucaaaacacccuaggcccaaccccuccugggccccaccuugacccgcaaggcguuggccacuaugccaucuacgaugaccucagugaagggaucaaaagacuuguccggccgccgcauaaacucgggcuugagcaaguacccgcugcgcccauuguacucaaacacgccugcguugagcugcauuggcaaaucuguaggcaacacaggcagaucaguaaagggucuuagcaagggucagccggaguucaagguccaggaccagggaugggaucaauggaucaagggcccagguucaaaaaaagacagaugaggguccacggaaucagucuaggugagggcucagacaaagucuggguuaaauuuggggaucgaggauuagguaaaucagaagccaguaagauggacaagggucaaggagggugugcuggccaguucuaugucaacuugacaccagcuagagucacuuuggaagugggaaccucaauugagaaaaugccucccaucacacuggccuguggcgcacuucuuuugauuaaggauugacaugggagggcuggaguccuggaugcuguaagaaagcaggcugagcaagccaugaggagcaagccaggaagcagcagcccuccauggcuucugcuccaguggcuuuccugacuucccucaacgagggacuuguaaacuguaagauggaacaaaucccuuccuucccaaguugcgucuggucauguuguuuuauccaccaauaaaaucccuaagacagggcgagagcucacccaaggucuggaaguugagggcaacaagcuggcaacccacguuccagaagagcugaggcauguaguuggaggaguccacucgugugcccuuaggguagaugcggcugagcugcuguuuguuguaucugggguugucggucagggccauaagagaagaagcaagcacccucuuccagucucugccuggcaccaucucauucuccuggaaucccacucccagcaaggugcccguguugucccugagccucugccucagcccacugagagccccaugcagauccuuccguggcaucugccaguccccacugccggccccacgcuagccacagugucuggggaggauacuccacaaacuccauaggacucuuggucaguugcuccauugccuuggucuccacgaaggaugacaucucgaagcacuuguuccuuucugggggaggaggagggauguaagagcagccaaggccuggcagggccagcucccagucacccauccccacucacuucgagcagccucgaaggacuugaacuugacgggcucaacguaguugacgagcguugacaucuccuccguggcauugaccucacugcuggcugugcccuguggucccaaacucaagaucagugguaccagaugucccuuacuccccuccccagggggacuagcccuuucccacaccugcaggcauacugcuccacagccuccugcaagacguugacacaucaccuggauagagguguccagcccacacacugucccuaacucagggacccucgcaaaucuucccucccacaacagccacagugacccuucugucaccuccacuccccagaauucccuuugagucucucuccugccacagggccuuggcacauggcuauugccaccucuuuaggucugucugccccaacuuccaugccagggcacagucccuuucccagacugcaauucuguauccucuucucuuuaaacuuuuuacuguauuuauucuucuuaugugugugugagugugugugagugggggcacuugcugccauggugcacacaugcugaucaggggacaacuucugagagucaguucuguccuucuaccuuggguucugggugucaaagucuggucacuaggcuuauacagucaucacuauuacgugcuaugccaccuugccaguccuguauccuaauacucuuuuuugagccaggguuucucuccauugcucuugauagccuagaacucacuauguagauagaccaggcuggccuuaaacucacagagaucuacuugccucugcugagauuaaaggcaugcaccaucauuuuuuuguuuuguuuuguuuuguuuuguuuuuugagacagaguuucucuguguagccuuggcuguccuggaacucacuuuguagacuaggcuggcuuuuuuuuuuuuuuuuuuuuuuuugagacaggguuucucuguguagacuagaaguguccuaaaacuguagaucaggcuggccucaaacugagagauucaccugccucugucucccuagcugggauaaaggugugagccaccaugcccuagcucuuuuuuuuuuuuguuuguguuuucaagacagaguuucucuguauagcccuggccauccuggaacucauucuguacaccagccuggccuugaacucagaaauucgccugccucugcuucccaagugcugggauuaaaggugugcaccaccacugcccagccccuacccuaguucuuuucuucuucccuuccuuuucuuucuuccuuccuuccuuccuuccuuccuuccuuccuuccuuccuuccccucucucucucucucucucucucucucucucucucucucaucuaucuaucuaucaucuaucuaucuaugcccuucucuguuaucugugaggaggacaagcaugaggaugcagaugcuuuuacuaguggggcaucucuuuggccuugcacccuaacucuugcagacucauuugcauaucugcauaaacuggagccugcaucaauuaagcucuaugagagcaaaugagaagcacaaaggccgccacccagcaaacgccccucuccccgccugugguccugaccucaucaguggugggcuuuuuuggauccguuguuuccucuucuucuucaucuuccuccucauccucucggucacggucaggcaugggcacauuagguucccggcugaggcucuccucaccuagagacuucugaggcuccaggcuggucuucucgagucccaccuccuccccauugcuuaggccagggcagcugucggagcugggggacccugcacaggggccaaggguccaguguuaggaccacaggcugguacugaggaagccugcagguugugcucaguguguggguggggaggucagggugcccucuucaagaagcacagcuuggggagaggauagggacccgagucuggguggcauuaaggguaguggcugcccagagguaucacaggucagaguuacacagagcagggaacuagaacaacagccugcacagccaaacaguaacacggcagaacuacaaguugggcucaggcagagccacacccagcagggguuaguggggugagcaguuaugugucacgugaugaggggcuucaauagggggacuaggcaaagguuagcugaaaguuuaagcaggugggugaagagucaguugauacaagucaaguaucaggggcuugaaggaagaggucaaaggucagaauccagagcccuacccucaccaggcggcagugacauacugaaagucagggcagagagaucaacacccagcugagaggugggaaggaaggaggucaggcuggagugauggagacacuggggcgaaaaguuacguccgcauuaggaucagggcuggaagucaggccaggccauaccaagcugaggugaggagggcucuguggcggccgagcucucacucaaggccgaguugcucuguuccagaggccgcuugcgcacugagcugucagggacaccugugcugggccgaugucgcuucuuauucuucaccaggauacggcccaucagguccuguggacuaggcagggggaugcccgcagauagcugggcaauguggacaggucaggaccuagucaaucacccuucaccuucauacacccuggcuuaacuccaaguguccccauaccggguauuugucgagagggucaaugagcagcgcauccccaaagauagagcggcaguacucagccaucuuggccugcugcuuugcccuguggggacaaggucagaggucaaagguccgcaggggucagaggccuauaaagugggugaguaucuuggauuagagcugaugacaguaugagaggacuguguugggguccaucagacugccucuaucagaggucucucuagagauucccagggcagggccacucacgagucgacaugguucucaaaggagaggaugacaggguagggcgaggucuugaaggcugccucagcgauggccucuagcacaucacgcaauggcaccucaguggucauggugaaaccaugagugaugaaaggcucuuccuccgguggccgucccuuccauacauccagcuccacacagcggcagccccacagcagugccuggcgguacaucuccaccgaugaugguccagccagcuggcccgcugaagguaaggcugugucacuaccuacuggccaccccauccuaccuggagccaacccacccuaaggacgaagagaccccugacacacccaaucaauuccagggcaauacuagucucucacuccuccagucaguguggaugcaguaccaucucccccagaagcccucaggaaaggacagacauccugagccccagucccugguggcaucagguggcacagaguagcauucagcagcaucugcagacacagcuggucccuccuccaaggcucccagcacugccccacucccuugaacuauggaauccccagauaccgucuagagcucccuaggaccuaacuaguauccaccacagcuauuccugcuacucaucuuuccugcaccagccucaccaccuccugccuaggggaucacagccccucccugccuccaacccaaucuccacagaacuccuaccaggucacacugcuuucccuacuucaagccauacacgcuuugccacucacauugaauccagaagccuuccagaccggggucgguccugccuucccuucccagccuucucuccccagcccucuccuccuguauaccugccauuaggcccauacacacacacacacacacacacacacacacacacacacacacacgguggacuaacacucuaucccuucguugcaccuccagcccuuuuuguauuucuaaaaccaucugucuccagcccaugcaacucuacaggcuacucccguacauugaaacaaauaugccaucagccuguccccagggacacuucaagauacccagaagaccuaucccucaaagauacugccccuuccccagcacuggccaaugagugaucgcggaggagcagugugagggugaggaugugcgugcccacgcucccugcugucucacucaccagugagauagguguugugugaggaguugauaaaauaugcgcucaguggcugggucauguccaugcucagauccagggccuccagaggcaggauaccauucuccuccccucccagguagcggcugaagcccuccauagacaucuggucugcggguggggugccaacaggucagcugggcuuggccagccccacccacacugccccgcugccaauagcuacucaccgcgcuccaggaacuguuuguucgucucguacuucucaaugagcagccgagccugugaggaccgaaguggcggguacagcacuucguugagucucgggucucucugcuucugguugauaaaguccaugagcugcuccagagugagguacggcuugcccuuggcaccucugaaggggccagaagcugggucaggcuguagccucagcucucaccuaaugcuccccuagugcucaccccgggacacggaagcgagaacgccugcgccuaacuucagcggucacagacugguauccugggccucaguuucccuguccccucuccugaccacucaacauugucaggcagaagacagacuggcaucagcauuuguaagagcuuuaaaagcugcuaaaagcuugacccaccacuugaaccucuagaccccaggaccagucuugccucuggccucccacacuguguuggccugggcaggucccacacaaccauugguucccauaccaaaugggcugaucaagccaccuguggcaaagggaugacagagaguuccagaaaccacaugaguacccugggugaguuccccuuucucgcucagauguccuaaaaccugcccccuggcacccguucucacuggaucagaagagcacugagcagacacuggagaccgagcccagccuauggacgccauucccaagcugcuuacaucuccagcaggaucuugucaauauccgggcgcagacacaguuuauucaagaaccgcucaaaaauuuccaagggaaacucaucagggcgaauggacucacucugagggcgaggaauguggggugagaaccuaggacagccaguuccagaaaguggguacccacugagacaccccacccugccccacccucacccuggcccugccccacacacucgguugaaguugaggccacaggacuccagcgccgucuccacccgcuucuuguccgccgagaacaucuucagaaugcugaugcaggcaggaggggucagggucaauggggggguggggggcagagaucaccaaggucagggcaggagagaagaugcugagggggaaggggggcucacuucuugaccggaauccguccauccugguucaccugcagcuucagcuucguguaucugggaaagcaagugcaaaggucagaucuugggucuggucagcggaacccccagugcuccccaggguaaccgcaggcucacgcuuuccgcaggaagguguuccgggaggcguucugagccaauauguucauggccaguuuaaacaacuccucugaccagaccugggaauugagaacacacaaggagaauaggugaagggggcagaggggcuagcccagccacagccuacauccaaaacagggucuggugcauaaaacaucaugagaacauggcuaugcuuguaaucccaccaccugagaagcuuugacagaaggauugcccugaauuugaggccagccugggcuacauaaugucuuccaacaaaaccucuccuuuccuggguugucgcuugaccccaacccaccuugacugugucaucuugcacggccaugaaguucaagaaugugguauuuacuggaucuggcccggccaccacugucaucaguuucuccuccagccgggugucaggaccuccaaagcccaguacuucucgaaucuuaggguccuguggggugaaagccaagggugaggaggaggaggaggaggaggaggagugucuuguccuuugacaaucuuggcccugucaguaugagaucuuaacccucaccuugggcaggcgggcauaacgaccuguccuugugucccugauggagcugauguccaguguguccaccuccuggaaaaaccagagccaagguuugugucugagaaguacaagggguccuuaauugccccacccaggcuguggaaugaccagcccccuggcuaggccuuaaccccaggacaagggggcuggguaggggucaccuguagaggccuaggcccuaaccagcagcaucggcaccgcucucaccauguuggguccuguccaguacaagaagaagccauuaggguccacacgcagggucaccagguuccgacuggaggccuccugagggcaguacaagacaagagucgggaaugagagcuggagaaggcuugguccuggaccuacaguaaccgguuucugccacugagcaaagcggaagcuccuccagccugcagaugcuccuggagaugaagucgucacagggcauugcagguucaguucccagcaugucucccagccucaccccgagauuuuaucccacaggauucuauucuagcuagcuacccugcccguagcacccagauuuugccacacccgacccuguacuuucauuucuucucuaaccaugaaacugcuauggaggccuccaggagcccauccuggccucgguuuccccagaaggccugagaggucagggaugcuagaauccuccgccucacacccuuuacuuuagcauccuagucccguaugugaugguuuguauauucuuggaccaaggaguggcaccaucuggagguauggccugguuggaauaggugugucacuguggguguggccuuaagacucucaucccaguugccuggaagucagucuuccacuagcaaucuuuggaugaagacauagaacucuuagcucuaccugugccaugccugccuggauacugccaagcucccaccuuggugauaauggacugaaccucugaaccuguaagccagacccaaguaaauguuguuuuuuauaagacuugccuuggucauggugucuguucacagcaguaaagcccuaacuaagacaucauaugaaagcagagggcuuaggagccuggagauaaagcuucucucugucccuugagcccuuccaguaucuggccacccuaagaucuuucucauugcucauuacccaucacauuguaccucaugggauccucauagccucuaggcucacccaucuuauagaaaagggccccucaggaagacuaggcagggaguuucuucucccuaacaacccuauggugacugacagaaaggcaggauaguagggauaugcucauuuucuaaaaaaggacuuagucacugaugcccaaggcuaugccauaugcucaggaccagcaaggacuuacacuccagucaguccuacacucccuuuagccaaaagagaauuagcauccccaaacugcugcucucucuccccugacaguccugccaccaacggugcacacucccguccccuugcccugucugugaagcacauccagcucuacgcccugaaacuaaaacucccucuccaugcuccccaacccccucuccgugcuccccaacaccuugugcgugagguguguccuuacaucacccucauuuuauacaggaggaaacugaggagucaggauuugcagggguacacuugcaaaguccuggcauguggcaaacagaaagccaagaccccugcaggaccaccccuggcuccugaccucagccucaaccucacagcagagagcucaguuucucucuugggagaauagggguucacagccccacccaugcagucucgguuuacaaaagaacagcagcugaucuggggacacaggucccuaaacccaugggacucauaauccuucaacucuuaaucagaggacaccaggucccaaccccuccaggagauuccaaaccuugcccuaggccugaccagcuagccaccaauagugcuagaaagggggaaacuuguggguacugucccuguagccccuguggcaccaucuucaggggccuaaccuccaaaggccacccagggcucuggcucuucaguuccaaacuuuguucagcacccccaccccaacccaggcccucuccuuguuuccacuuccuuauuuggguuuaucacacugcaaggaaaaggagaaacuuuucccuuuagucuggccugggggaagggguauccuggggccccggggguacccacccuugcccagcacaccugcagcuaaggccacgcccccagccccuccccuuaguucucacuccugccccacccugccggaaagaaacccagcgucuuccaggccuauggcccgacugggaaggaacaguaaggaaacucaggccgccugaguugaggcccuagggagcaaggagcccaggggguaggagagggaacaguacagaaacgugggugagacgugauaucuagauaagaagccgcaggugaguaucagggaaguaccugagagaaagcaauaaaaaguggggaccaggauuuauugagguucaaagucacuaaguuaaggaguggggagcaaaguucccagaguuggaggaaccuggaaaggaacaaagucuccgguaagggguggcucggugcucccaucugaacagaaagcucgcuggaauccagaagcaggacgaaaggguaucaaccagggcaggcuggaaagggaugacuauaauggcucaggcaagcgaggcacugagaagaguaggaucccaguggcaccccacccaaggcaaggauguccuaugcccccauggggguccugugccaggaacaggggucuggggaccagaccaaaaacuaagaaccagcauggagacuuugauauucaucguuggcaaggguggaaaagagugagaagaaggacaggauuuacagggguucaaagucuccaugccaagaagagcccaauugaccacagcuacugucuugcgggggagaagagcggggacaacgacaaagucuucaauuaccaggacaacaggggacucaaguuuccggagugcaacaaggcuggaauagggggugagguggucaggcaacacugaagugggggucccuggcauucaucuagucgaaugugacugaaggaauccuucgaucuaggcagagcagaggacagcccacucacuuaccucgucccauuugaugaacuuacucccgcgccgcagggucuccaccacggugggcggcuccagcugcagcgcguggacgccgggccucgcgcccgccauggcuaagccaggggcggcucggggaccuacggagccccgacgggaaccgacggugccacugcucucuccacacgcucccgcgcggcccgcucuggccccgcggcgucagcgcccgcccgccagccagucugucccggacggaccggagacucggcgcccggccccgcccccgcagagccccgccccgucgggcggugccgcccccucccaccgcuauggugccgcccgacccacggcggcgcccccucgcgguuggggcggcgacugcagccaaagggaugauggauggaauggggggggucuuuguuggccggcugacucaguaggacucucuuuuuuuugucuuagauaaagugcuauugagggugcaccuggaaagacggguguuggagccgcucaagacaugccaaggucagccgguugaggacucagguggaaaaggcgaagauaauaagguuaggggacacagacccuuguccucaacccgacuccuaccgcacuuaaugagcucaggaaacgucgucaccccaucucucuccaucccacuccacccgcgugcccucacuuugccucucccccuccugcugcagcacaguccccccucccagggagcacuuagcuggcuaaugggccucccgccggcaggcgccccucccccgucccuagcucuggaggccuggagcugccaccuccuuugaggacccaggcauccugguuuuccagagaaaaccuugccgcaguucuugugcugcugacccugugacgggagccagucucagugaaccucuuaguugaacauagugaaagaugguuguuugcccagagguggcagaagccucguggguguccccaaaggagggguugugcagcuccuggcccacagcaggugcccugaaaucuguguuccagugaucugaggaaccgaaggggcagacccaugggcaccggccggggugggggcuguagccccccccgcagggcuuggcugggggggcuccugccugggggccccugugggagcccccccaauacagaggaggcagcagcagcagguuuaaaguagaacucauccagaggggccagccaagucaccuagaaacccagaaagaguuggagcuagcucugggggaggagggucggcuaaggaggagcuucccuaccggcgccuuugccccaggcgcucaggccuccagaggagcccugccuggcacuggcuguccuccaaaucgccaucauggcggcaaacuuaaugaaucuaguugucuuuggcuguggccuugugcaguggugugauuguuaucuccacuugaggcccagagaggggaagggacuugcccaaggucacacagcuuccugagaggauuuaaccccucuuucugcuuccugccucugcucccuggucuguaggagaaaaggggggggggugcaggccugucaucucccuccucuucuucuuccuucuccuccuccuccuccuucuccuccuccacaaggacuauaagaaaauaccccuucagagcuccaacuaccacccaccuccuccagagaucagaaccauuaagaguggagauuggccucuacccacaggcuugcuuucaaauccaggacucccuuauccaggagcuaguuaucacagugcaauaaacacacaccccucuguagacgggugacagguagaaaagaaacugggaaugucaaaggggaaagaguaaaaaaagggcacaggggauccugcacaccaacgcuaagggcaggaugacugagcccucccagaagcuucuggaagcagggccuugaaaaacaggauggaagcuguuuguugagccaggcccucuucuucccccaccacuaaucucuugaggccaggcagccccccauuagaaggcucccucuuccucuuuggaugcuuucuuccagcccuggaaugguaauagaguuucuaggcaugcaguaauggggggaauaaaggcagcuuuuccggccucuacccuugauuaagggauuggucugggcccacaggucccuccccagggccucugauucagggaggugcugcaagcauccuuagcugcucucuggugggagggggccacauuaccaugggaagccacagccugaggcugcaggagaagcuaggcacucuccagucauaggagggcugguggaugagcauagcaggaugaaggcuccagagcccgagcuccaggucacagggaggucaggaucccggccuccuggaagacacgccuuucacaugagugauuugcccacuuccugggcagagucaggacuugaauccgaccccuugugcuucaaggcuagggcucccguuugagcggcccagguuccaagaaagcuguaggcuagcagacccaucuuuccucucacagugaauagucauuagaagaaacaagacagagcagcagccagccccaggaaaacaaggaugcucuggggaugacaugggagggagccagagggagaagcaggaugggcaugccucugaaaggaccuggcaugugacaucaaauauauggucaagggccaggaaaggcaguguuccauaucaucaucuuggggguacaggcaggguugacggucuucagagucauggacucaacucucacaguaucugucgcaaccauuccuucaagguacaaacccaugcugggauucaaaaagagcugcucugcccuuaguggggugagcugggcaugcagggaauuuguuccugggaaaagagacucucccauuagugcaggcauggaggaggaagucaggcucaacaugcaagggucacgccuaaacugcaacagcagcaggagccaaccucccgggcuguccaggcuagcugaagagaagcuaaugucagacagugggcugugggcugcuaagggaagaaacaucagcuuacugcagugcuuccccccacugagaaccagagggcuucccccccagccgcucuccucaguaagcagcucacuccccaccugccuucucggcuuacuuauuuauuguuucauguaucacaagcuggcuucaagcccacccagcagccaaggaugagcccgaacuucucagccuccugccugcacaacugcgaugauaacaacuguauguggugcuguggaucgaacccacggcacggugcgugcuagguaagcacuguuccaaggcggcuacuuccccagacucaucucccuuuacuuuaucuuuacgguacugggaaucaaacccauacccuugcacaugcugggcaagugcucuaccccugaccuacaucccuaaacgcuguggcuucucuccaaaaaaauagcaucgagggggcuaaagagaugcuucagaaauuaaaaacacuugcucuugcagaggacccagguucaauucccaacacccacauaguggcucacaaacaccuguaauuccaguucuaggaaagucaaaaccuuguucuguccuccauagucuuggggugguacacguacugcauacacauauacaaaguggucauaacauaaauuuguaacacauaaaauaacaaaaaguagcauaaaagagaagccuaguggugcaggccuuuaaucccagcacuugggaggcagaggcaggcagauuuuugaguucgaggccagccuggucuacagagugaguuccaggacagccagaacgauacagagaaacccugucucgaaaaaaaaaaaaaaaaaaaaaaaaagccuaaagucccggguuugaguuuggagguagcagcaucugugggacccuaagccaaacucugaaaucugccugcucagaagauguccauacagggcuaggacuugcugucccuguaaucuugagacuauuugaaacugagagccauagagacauccagaaagugcuacacaaccuccuuggguaguaugagauggaguggguggcaggagacugguagagacucugccuuaguguguguguguguguguguguguguguguguguguguguguguguggugguggugguggugguggugguugucauacagcccgggcucaaaaucccagcucccccuuuauauagcccugugacuuaacuaugugcucucacaacugaaguguccacgaguuuucccguuuaauguuccccacagccuucagaggaaguccaucgguccccccccccccacccaccaccucuuuucggucguuuguucaaccaauaggauggagaguccuuugccugagucugagaguuuuucgagcuagaauucgguauggaccuaauaguguccuaaugccuguagguuugacaaggagcacgcugacccaagcuaagguaucagcagaguccucagagcucuggcccaccaaauuuucgcuuucuagcagaaagacaaaggaaugaaugaaacaauuuaaagaugcagacagaauaaaggaagacuggaagguggccuccuaaagugugaaggaucgagaaguuacugggugaacuagcuugcugucccuacagcagaacaggcaggggucccaauaaacgcucauuuggggucaacugcuauuauuaccuuuaucauugugaguuuuggcuuccccacaugcuagcucuuugcacccgaguuuccuccuuugcacacgcucaagcugcggggcgcccagggccucgcccagcacaauccugccagcucagaggggcgcgccccaaacaaguuugcgcuucaaugcg

SEQ ID NO: 9124 - RNA, 1270 nt, Mus musculus
gggguggccaguagguagugacacagccuuaccuucagcgggccagcuggcuggaccaucaucgguggagauguaccgccaggcacugcuguggggcugccgcuguguggagcuggauguauggaagggacggccaccggaggaagagccuuucaucacucaugguuucaccaugaccacugaggugccauugcgugaugugcuagaggccaucgcugaggcagccuucaagaccucgcccuacccugucauccucuccuuugagaaccaugucgacucgugaguggcccugcccugggaaucucuagagagaccucugauagaggcagucugauggaccccaacacaguccucucauacugucaucagcucuaauccaagauacucacccacuuuauaggccucugaccccugcggaccuuugaccucugaccuuguccccacagggcaaagcagcaggccaagauggcugaguacugccgcucuaucuuuggggaugcgcugcucauugacccucucgacaaauacccgguauggggacacuuggaguuaagccaggguguaugaaggugaagggugauugacuagguccugaccuguccacauugcccagcuaucugcgggcaucccccugccuaguccacaggaccugaugggccguauccuggugaagaauaagaagcgacaucggcccagcacaggugucccugacagcucagugcgcaagcggccucuggaacagagcaacucggccuugagugagagcucggccgccacagagcccuccucaccucagcuugguauggccuggccugacuuccagcccugauccuaaugcggacguaacuuuucgccccagugucuccaucacuccagccugaccuccuuccuucccaccucucagcuggguguugaucucucugcccugacuuucaguaugucacugccgccuggugaggguagggcucuggauucugaccuuugaccucuuccuucaagccccugauacuugacuuguaucaacugacucuucacccaccugcuuaaacuuucagcuaaccuuugccuagucccccuauugaagccccucaucacgugacacauaacugcucaccccacuaaccccugcuggguguggcucugccugagcccaacuuguaguucugccguguuacuguuuggcugugcaggcuguuguucuaguucccugcucuguguaacucugaccugugauaccucugggcagccacuacccuuaaugccacccaga

SEQ ID NO: 9125 - RNA, 2879 nt, Mus musculus
augagauugaagcugguuuuauuuucccuucccccaugcuggggguucaacuuggggaccaacccauucacguuacaccagugcccugcccuaacacugaugcuaagguacuaaucuaaguuccuuaggauccacaaagaaauacagacucacucuuggggguuuuaaagguuuuuuuguuuguuuuuguuuuuaaacagucuggucccugaugggggccuccuagcccucugcagccugcuacaguucuggucccugacgggggggccuccuagcccucugcagccugcuacaguucugagcgucucucaaucuugagcagcuccaccucaaacaccaggguugcuccaccuggagagagaagugccaucagacugggaccugggacgcugggagagugacgggcugagggugguaaggguauuaccugggaucuuugggggggcuccccgcucuccauacccugucaaaagcacaaagacaaagaguuaaguuguggccaggcucccuucuagcccacauaaaggauggggggggggggguuugcaggggugacaggagagggugagaacaccaaaagucuggcacugagcgaucuacaauugucacucucuacugcucugcaguugucaccagcucagcuagcgcgagcuuuccucaauccuggcugcugaacacaagccagacuugaaaguggcguauaugcugccaugacuaaauggaguggggaccagugaaacuuuaauucauccuuaggcacaucuaagcccucuccccauuaccucccaaccccaagggccucuuacccagcucggaugggaucaccaacuuccgcuuuuccccuucacacauccugcaggaugacacaugcuuagcacaugaagcgcccagaccccugucccacagcugggccuuccucccacagcucgcuugcuggaucacucacuacaacauguaccccagaccagacuuaccccagcagccccuggucccagcccuugauaaccuggccagugccaagggagaaaacaaagggcugguucugugguaggcugcugucaaacuccgucccaucuucuagcuuucccugugagaccaugggaaaacuaguaaggagaggugacaaguccacaacccuuccacccagcuagucuccccaccacagccccagggccaaugccuuggguagcucauguguguuaauuuggaugcugauaucuagcugaguaaacugaaaagcaagauagaaucgugggaaggagcuuagaggucaaagggggauagauguguuugagguuaucuaccuagcugagaaaaaacagaugccaaaguccuuucagguccugaaaccugccaaagccccagaggcugcuccacucugacacuuaccguguagugcauguguaagacaucucccuuucuagacuugauaggacagugguccacacguuucuucacuccaaucugcagcuuccguuugccuucggcccccguggcugcugccagggcacucaggcaaauggacaguauugucaggauccagcucagccucaugucucuguaggcaaaggccaccccacccccaaccaaaaaacugggggguggagucaugggacgucuucagucuguaucaggaggacgccaacuccccauuauaucuugccuguuucuggggaaucccacaguccugggucaccacccccuccccugggcucuguagccacacuuaccaguccagugagaagggggcuugaccgaggaccccagcagcgaggggagggggucaggggaggccacagcagccagugcccccucccuuugcucacuaccugaccuucucucccucccaguccccaucuccguucuucaguucccgcuagccccuuuacgcaaaguccaaacccuaucugauugcaccggauuugucccgacuggacgaccccacucccgccacacccagcugcccccuguccagcacacccacacaucugcggcugcugcagguguucggccccgaggcacccacacaucuccacuagguggcucugaggagccccgguccuccgggggcaccccccaguccggccccgugccuccuccaccaggggcaccuccccaacucugagcucuugggggccuccggggaacccaaacuggcucagagucagcagggcgccgagcucgcuccacccacaccaccucuccagggggaguucucggucuaccgcgaccccaggcgcggccaccacggagaccgcccccgcguggacgcccccggccauagcucaagcuuagcucugcgcaaggcuccuuggccccacccuuuacggcgugaagcuccgcccccugaccugcagcuccacccuccgcaauguuagaccuagucuccagcagaggggccacgccacucacugacugaagucccaccuccaacgacugggaucucacgcccucugucuccgagccaaaggcuccacuuuccaccugcuccagcuccuccucuaaaccccaagccccgccccccacgccuccuacuccagcuaugggccacuggguuccgcccucaacucgcacuggcuccguugucccucccaccgcuguuccgcgccccgccccgagccccagggcuccgccccguacggcgugagagcccgcccccugcggcauugccagaggccggaccccagccccaauuccuucguuugcugccccuggcuggcacgcggacuccggcccgcuucaggccggccugccccagguugcccuccugcacccggaucccccagccugggcuguggccccccgcucaccuccucgccgcgcccccggagccaaucccgcucgugcugucacuucugcgcaggcgcgucuucgucgcu

SEQ ID NO: 9126 - RNA, 5193 nt, Mus musculus
auagugucuuccaucucuuuuaucagagugugagugugugugugugucacaguuaucauaacagaacccaaaucccguuauugguagaaguuugggguuuucauagugaggggagacagccagccagaagaugcucacuugaccagggugguuaagugagagaguacccuggccccugaggugagacaugagguuccuugacaauuguuagauggcagcucugggagauaaaagauggcgagagagcucucuaaaagguccagguccuggggcagugaccucccagacugaggagguucgccugugcuccacucuucucccugugaagcagggccauaaaagcagccgggcccguggagucuggaaagcagcuugucacuuucgcggcuuccggcaccuggggaguggaaaaggggugucagugcuggcuggagcuucaccccaagcucuucuuuuagauuacuaauuuuuauuuuuaaauuuuuguuacaugggcuggagagauggcucagugguuaagagcacuggcugcucucccagaugacucagauucaguucccagcacccacauggcagcucacaacugccuauaaccuaguuccaagggaucuggcccccucacacagauguacauacagguaaaaugccagugguuuuuaccugcauaugaaauaaguaacuucuuuuaaaaauuguggcgaagggggcuggagagauggcuuagcgguuaagagcacugacugcucuuccgaagguccagaguucaaaucccagcaaccacaugauggcucacaaccauccauaaugagaucugaugcccucuucuggggugucugaagacagcuacaguguacuuacauauaauaaauaaaucuuuaaaaaaaaaaaguuguggugaagggauuggccugugcucaugugaaugugugugcauuuuagguacugguggcuuaaucauucuccaucuuuauccuuuuuaugccaggcauaaggaggcaaaggcaagcagaucucugugaguucaaggccaggcuggucuacauagugaguuccaggacagccagggccauguagagggacacugucucaaaaacaaaaccaaccaaacaaaaacguauuuugcuauuuuuauuuagguguguguaugucuggcuguauaagcacauuguauauaggccugaagaggcuggaggagggcgucuggucaccacaacuggcacugcagccuucaaccaaguguguucuccaggaccagcaaccucugugagccagcucucuccaucccgcgccaccuuuuaucuuuugagacugagucacucacuauaugugaagcuaauugauucugcuucaauggcuggccaacaaacucugggguuccuuuugucccugccugcucuugcaauaauagguuacaaugcaucgcgcuccuacccagucuucaugcuugaauaguagauacuuucccagccaggccauuucuccagcccccacuuauuuaucuaauuaccagugacaucuuuuaaauuaaguauauacaugaugcauguaugugcacugcauguaugccuggucucugcagaagccagaaggcauuagcuauucuggaacuagaguuaugagugguuaugcgccacugugugggugccggaaaauaaaccuggauccucugcgagagcagaaaauacucuucaccaccaagccauaccuccagccucuauguacucgugugagccaaacucaccaugucaccaaggagugcccuugaacuucuaagugcuaucuuaccugucccauuuggugaagaucaaacagaaaguuuuuuggaugcuagguaagcgcucuacccacugagcuacauccccagcuccucuuuauucuuaucguuuguugagaccacuuugcuccacagccccaaucguucucaaaaucauauccuccugccucugccuccuaagugcuggaauuacaagugugcaccaccauuccaaaagcagcaguuguuuuucguuuuguuuuguuuuucuuuugucuucuguggauuuuugcuuuuuuuuuuuuuuuuuuuuuuuuuuuuugguuuuugguuuuuugagacaggguuucucuguguagcccuggcuguccuggaacucacuuuguagaccaggcuggccucgaacucagaaauccgccugccucugccucccaagugcugggauuaaaggcaugcgccaccaugcccggcggauuuuugcuuuuuuaaacaagcuuccauauagcccaagguggcuucagauucucucuguagcuucaaaugaccuugaacuccugaucuuccugccuccaacugagugccaagacucccugaauguaccaccauguccagucccagcccucuugagcauuugaaccccauuuuauucugauacucucuagaagccuccagggccuggcccauaagucauccccuggccucacuauagagcacagaaggguuacuuaaguaagcacuccaggcagaggcagaugggggcucucauauuaucuuugcucucucagagccugcagaauggagaaauaucaaucacauaaagcucugcagauuggaaaaagccuucuuuaguuccacuccgggagaugguugauugcuuagcuagauuggugccccuaucacagguucagcauccuuuccuaagaguggcaucagcucucucacccucugacuugcacaucuagucuucagcugagguuuugaugaucugguuaccagcagaugcacaguaaaugacuuaacacauucagcuggcuucuccaucccuggucuuuucaccacuagcaggcucaucuggaccugcuccaggacauaaccuugcggccuucucacacaagcaccaccccacagacuccuuaccuacaggugucuggguugagcucuaagccccgcccuuggcaauggaggaagcggcggcgucugcagcggcagcggcagguccgggggucagggcguugacggcgcugggugcaaggcgggcagaggauccuggggcuggagugggauggaugaugucagcuggggaggaugcucccgggguagagucccagcccggaacagagcggggcuggggacgguggugggguauggcaacccuaggaggagaagcgacacgucuggggugggaagagucuucccaggagcuaggguuagagcagaguguguggauuuggggaguauaaaagggaagagagucgggugagagaagaaggcagaggggcugcagccuccuggcucacuugugcacccccuaacccaugagcucucucuccuggaccagcaccaagaaucccaaaaacucaccugucuggcuucacagcacucuccuuuuuuuuuggucugaaaagagagagagagaaagauuaaagaaacccaagccuccugcacucuugccccaggauccaugccuacuacuucuggcucuacucucagucaccuggucccuacuaaguaagguacaagcccaugccugguacccccaccccaugcuacacuuugugaccuggaccuggcuggcaccugcauucacauuggcuguguucuuccagggacaucucccccagcugacugcucggguacuggaucaugaggaucugugcucaggagaacgaggaagagacagugagugguggggggcagggccagaaaaagacagaggaaggggauacuagauaggcuagagaaagaaugaccagaaauucccaccuccagcacgccccucccuggguuggcccagcccauaggacaucacugucccaucaacacaccugacccauaggcccugguaccugcauucggacuugguguugcccagugggcacacauuccaggccaucgucagggcagcagccaccacagcgcugcacagucacacagcugggcacuaguuguuugaccacauugcccaugaguuccaugcucagaggcaccaccaccucccugggcuggcauguggcacgugcauaaacgucuauccauggcaccacugugggcagacccagauggauuaaguucuuaucaggucuccugaagcuccucugagcauguagccucucugauacccuaucaccaccaccccaaccaucuuuuaaaccugucuuucucugccuuguuucucaagaaaugauuaagcccucugccucaguuucuuccucuauggaaugguaucgcccaaaggaguugggaucacgcaagauaagggauaugaaaucagagcaagugcuaaccccucuuaguacuggcugguggcaaguuauuguuaacuauuauuaccuuucuucugguggcuggggccaucaaacugggacacaggggccugugggaaagaagauaccugggcccaagaugcacucuaaaagggcuggcccuguggcuauguaagggcuccguccuugagucaggcuucugcgccuuucugacaccuuuccagauuuauucuguucccaagaccuugguucuaauuuuucuuguauacucagacaucugguacuuucccuggcccaagacccaccaggcauacucugggaaugguacuaaagcccaagccuuagcgcugggcuuguuuuaggucaggagccaggauagugggagacaaacgagguucggagggcacggaggcagcuccgcccuacaaccgcccaggggauggggugaggugggggaguggccccaggggcaugggcuaggacuagcgggccuucgccaaggggcaccucuuaagggauauucccgguuugaacugaggauccccucgacagagguagcaggcgccuccccacuuccgccaaccuugagagggcaccgcgggcgggcgggcgagcuagcgagcgggaugucgcggacgcacguaccugggugcgagccagcugcagcagugcaacaagcagcaggcgacggagcagggggcucauggugcccgcggggggcgagcgccgggagcgcccgcauggcccuagcccggcggcguggggggcggcggcagccagagccccauggcgcgggcccggggacccggggcggggcgcagggggcggcuccuccgcggcccccucccgagcccugggcgcaggcagcgcaacgcagcgccgcagcgacggccugaggaacaagacaggcaggcggccuguaguggcggcggugguggccgggacggcgggcaacgg

SEQ ID NO: 9127 - RNA, 5193 nt, Mus musculus
ccguugcccgccgucccggccaccaccgccgccacuacaggccgccugccugucuuguuccucaggccgucgcugcggcgcugcguugcgcugccugcgcccagggcucgggagggggccgcggaggagccgcccccugcgccccgccccggguccccgggcccgcgccauggggcucuggcugccgccgccccccacgccgccgggcuagggccaugcgggcgcucccggcgcucgccccccgcgggcaccaugagcccccugcuccgucgccugcugcuuguugcacugcugcagcuggcucgcacccagguacgugcguccgcgacaucccgcucgcuagcucgcccgcccgcccgcggugcccucucaagguuggcggaaguggggaggcgccugcuaccucugucgaggggauccucaguucaaaccgggaauaucccuuaagaggugccccuuggcgaaggcccgcuaguccuagcccaugccccuggggccacucccccaccucaccccauccccugggcgguuguagggcggagcugccuccgugcccuccgaaccucguuugucucccacuauccuggcuccugaccuaaaacaagcccagcgcuaaggcuugggcuuuaguaccauucccagaguaugccuggugggucuugggccagggaaaguaccagaugucugaguauacaagaaaaauuagaaccaaggucuugggaacagaauaaaucuggaaaggugucagaaaggcgcagaagccugacucaaggacggagcccuuacauagccacagggccagcccuuuuagagugcaucuugggcccagguaucuucuuucccacaggccccugugucccaguuugauggccccagccaccagaagaaagguaauaauaguuaacaauaacuugccaccagccaguacuaagagggguuagcacuugcucugauuucauaucccuuaucuugcgugaucccaacuccuuugggcgauaccauuccauagaggaagaaacugaggcagagggcuuaaucauuucuugagaaacaaggcagagaaagacagguuuaaaagaugguuggggugguggugauaggguaucagagaggcuacaugcucagaggagcuucaggagaccugauaagaacuuaauccaucugggucugcccacaguggugccauggauagacguuuaugcacgugccacaugccagcccagggaggugguggugccucugagcauggaacucaugggcaauguggucaaacaacuagugcccagcugugugacugugcagcgcugugguggcugcugcccugacgauggccuggaaugugugcccacugggcaacaccaaguccgaaugcagguaccagggccuaugggucagguguguugaugggacagugauguccuaugggcugggccaacccagggaggggcgugcuggaggugggaauuucuggucauucuuucucuagccuaucuaguauccccuuccucugucuuuuucuggcccugccccccaccacucacugucucuuccucguucuccugagcacagauccucaugauccaguacccgagcagucagcugggggagaugucccuggaagaacacagccaaugugaaugcaggugccagccagguccaggucacaaaguguagcaugggguggggguaccaggcaugggcuuguaccuuacuuaguagggaccaggugacugagaguagagccagaaguaguaggcauggauccuggggcaagagugcaggaggcuuggguuucuuuaaucuuucucucucucucuuuucagaccaaaaaaaaaggagagugcugugaagccagacaggugaguuuuugggauucuuggugcugguccaggagagagagcucauggguuagggggugcacaagugagccaggaggcugcagccccucugccuucuucucucacccgacucucuucccuuuuauacuccccaaauccacacacucugcucuaacccuagcuccugggaagacucuucccaccccagacgugucgcuucuccuccuaggguugccauaccccaccaccguccccagccccgcucuguuccgggcugggacucuaccccgggagcauccuccccagcugacaucauccaucccacuccagccccaggauccucugcccgccuugcacccagcgccgucaacgcccugacccccggaccugccgcugccgcugcagacgccgccgcuuccuccauugccaagggcggggcuuagagcucaacccagacaccuguagguaaggagucugugggguggugcuugugugagaaggccgcaagguuauguccuggagcagguccagaugagccugcuaguggugaaaagaccagggauggagaagccagcugaauguguuaagucauuuacugugcaucugcugguaaccagaucaucaaaaccucagcugaagacuagaugugcaagucagagggugagagagcugaugccacucuuaggaaaggaugcugaaccugugauaggggcaccaaucuagcuaagcaaucaaccaucucccggaguggaacuaaagaaggcuuuuuccaaucugcagagcuuuaugugauugauauuucuccauucugcaggcucugagagagcaaagauaauaugagagcccccaucugccucugccuggagugcuuacuuaaguaacccuucugugcucuauagugaggccaggggaugacuuaugggccaggcccuggaggcuucuagagaguaucagaauaaaaugggguucaaaugcucaagagggcugggacuggacauggugguacauucagggagucuuggcacucaguuggaggcaggaagaucaggaguucaaggucauuugaagcuacagagagaaucugaagccaccuugggcuauauggaagcuuguuuaaaaaagcaaaaauccgccgggcaugguggcgcaugccuuuaaucccagcacuugggaggcagaggcaggcggauuucugaguucgaggccagccuggucuacaaagugaguuccaggacagccagggcuacacagagaaacccugucucaaaaaaccaaaaaccaaaaaaaaaaaaaaaaaaaaaaaaaaaaagcaaaaauccacagaagacaaaagaaaaacaaaacaaaacgaaaaacaacugcugcuuuuggaaugguggugcacacuuguaauuccagcacuuaggaggcagaggcaggaggauaugauuuugagaacgauuggggcuguggagcaaaguggucucaacaaacgauaagaauaaagaggagcuggggauguagcucaguggguagagcgcuuaccuagcauccaaaaaacuuucuguuugaucuucaccaaaugggacagguaagauagcacuuagaaguucaagggcacuccuuggugacauggugaguuuggcucacacgaguacauagaggcuggagguauggcuugguggugaagaguauuuucugcucucgcagaggauccagguuuauuuuccggcacccacacaguggcgcauaaccacucauaacucuaguuccagaauagcuaaugccuucuggcuucugcagagaccaggcauacaugcagugcacauacaugcaucauguauauacuuaauuuaaaagaugucacugguaauuagauaaauaagugggggcuggagaaauggccuggcugggaaaguaucuacuauucaagcaugaagacuggguaggagcgcgaugcauuguaaccuauuauugcaagagcaggcagggacaaaaggaaccccagaguuuguuggccagccauugaagcagaaucaauuagcuucacauauagugagugacucagucucaaaagauaaaagguggcgcgggauggagagagcuggcucacagagguugcugguccuggagaacacacuugguugaaggcugcagugccaguuguggugaccagacgcccuccuccagccucuucaggccuauauacaaugugcuuauacagccagacauacacacaccuaaauaaaaauagcaaaauacguuuuuguuugguugguuuuguuuuugagacagugucccucuacauggcccuggcuguccuggaacucacuauguagaccagccuggccuugaacucacagagaucugcuugccuuugccuccuuaugccuggcauaaaaaggauaaagauggagaaugauuaagccaccaguaccuaaaaugcacacacauucacaugagcacaggccaaucccuucaccacaacuuuuuuuuuuuaaagauuuauuuauuauauguaaguacacuguagcugucuucagacaccccagaagagggcaucagaucucauuauggaugguugugagccaucaugugguugcugggauuugaacucuggaccuucggaagagcagucagugcucuuaaccgcuaagccaucucuccagcccccuucgccacaauuuuuaaaagaaguuacuuauuucauaugcagguaaaaaccacuggcauuuuaccuguauguacaucugugugagggggccagaucccuuggaacuagguuauaggcaguugugagcugccaugugggugcugggaacugaaucugagucaucugggagagcagccagugcucuuaaccacugagccaucucuccagcccauguaacaaaaauuuaaaaauaaaaauuaguaaucuaaaagaagagcuuggggugaagcuccagccagcacugacaccccuuuuccacuccccaggugccggaagccgcgaaagugacaagcugcuuuccagacuccacgggcccggcugcuuuuauggcccugcuucacagggagaagaguggagcacaggcgaaccuccucagucugggaggucacugccccaggaccuggaccuuuuagagagcucucucgccaucuuuuaucucccagagcugccaucuaacaauugucaaggaaccucaugucucaccucaggggccaggguacucucucacuuaaccacccuggucaagugagcaucuucuggcuggcugucuccccucacuaugaaaaccccaaacuucuaccaauaacgggauuuggguucuguuaugauaacugugacacacacacacacucacacucugauaaaagagauggaagacacuau

SEQ ID NO: 9128 - RNA, 4674 nt, Mus musculus
cauaggcgcaggaaauggcggcgaccaaggagccugugaguggggcaggggcggggcuuggcugugucuccuccuucgcacgcccccuaaugcuuugggugagaaggggugucccaagugccuagcgggugguccagacuuggagggugaugcuggaaggccuagagcaccccuugucugguucuuaguaaagaggccuuccucgaauuugccuuugugggaaacugaggcagguuccuucuuucugccacgauccccgaaguccggcccgauugagacccaauggacuuuugggggccucccuuuccuagcugccugcccgucgucgucaugccgucccuguugcuccagcugccccugcgccuaugccggcuguggccgcauagccuuuccauccgacuucucacagccgccacagggcagcggugaguugagccccagaauuuguccauguucagugguuuuucuccugagagcccaccuugcgucuugagauaguugucucugcauuaugugucaagucccagacaacauucuccuucaaugcuaggcacuuaguauaccaauagcuaagaacugagcuccgagauuaaguuaaacgacaguucgggaaucugagcucuggucugcucuuuccauagcucuggcguguugucaggcuucgcugugcauacgcugggaaagaggagguugaguacaaagauguagauuucugggcuugaaucuggaugcugguccuccagcauucaaugaaguggggacaugggaaucugccuuuuccuuugagauggaguuuuccuaugugacccagguaagccuccauagucaaucuccggcaugucuauagaguucaggcacagccuccauguacuugccacucucacagaggauccaguuuuuuuuuuuuuuucuucugagacaggguuucucuguauagcccaggcuguccugaaacucacucuguagaccaggcuggccuccucgaacucagaaauccaccugccucugccuccugagugcugggacuaaaggcgugcgccaccaugccuggcuuuuauuuauuuauuuauuuauugguuuuucuugguuuuucgagacaggguuucucuauguaguccuggcuguccuggaacucacucuguagaccaggcuggccuugaacucagaaauuagccugccucugccucucaagugcugggauuaaaggcaugugucaccacgcccggcuaggauccaguuuugauucccagcauucacaugguaaauuauggagacccucuucugacccguuggagacaccagacaggcaugugguggacauacauacagaaaacacucauaaacacaaaauaauauaauuuuaaacaauauuugaagaaacuuuuuagccaggaugguaguacacaugccucuggucccagaauuuggaaggcaauggcaagcacugugaguuuaaggcuagucuggucuaccuagggagcuccaggucugacagguaauaagacccuauuuuguaaagaaagagagagagagaaagaagaggaagaagcaacaaaggucuccuggguuugucguuuaggagaggacuacacuuugaaaaagagaaauccugacuauucuugaaauacccaaagggcaaucuggggccagaugugucuugggacucaguuccugguagcugaacugaaggugugguugagcagggguggcagacugggcgauggugcccucuggccuccugagucucugcagguuugggcuuuucuccacaggucugucccuacuaauuacuaugaauuguugggcgugcauccgggugccagcgcugaagagauuaaacgugcuuuuuucaccaagucaaaagagguauuggugcccccaaggugagggagggagaggaaaccugagcuugacacagggcacucuaacuuccugggguaggucugugucuccagcugguagcaccuuccucccaccugcauggaugggagguguucauuauucucuaugaucuaaagggucaggggucuuucugauuuauuuauuuuaugcaugugauauuacuaucacugucuucagacacaccagaagagggcaccggaucccauuauagauggcugugauccaccaugugguugcuaggaauugaacucaaaaccuauggaagaacagucagugcucuuaaccgcugagccaucucuccagcccuggggugggagugggggugucuuucugguuauguuggauuuuuuuuuuguuguuguuuuuguuuuuuuggauuuuuuuuugggggggguguuucgagacaggguuucucuguauagcccuggcuauccuggaacucacuuuguagaccaggcuggccucgaacucagaaauccgccugccucugcauccugauuaaaggcaugugccaccacgcccgguuguuuuugagacaagaucucacauuguagcccagacuggucucaaacuuucagugguccuccugucuccaccucucuagaaugggaguuacaacugugguugguuuucuugacugagagggguuaggaggcuguacuuucugacucuggccuuugggagggaggggucagcaaucccaugagcggucaguauccagguaagguccgugggagugaugucagucuucauggguggacaucaucaggagagguccuaggaaaaugagcuaagggguccccugccucaccccagcuacacccugaucgagacccugggaacccagcccugcauagccgcuuuguggagcugaaugaggcauaucgagugcucagucgugaggaaagucgucguaacuaugaccaccagcugcauucagccaguccuccaaagucuucagggagcacagccgagccuaaguauacgcaacagacacacagguauaguacagcaguccugacacugcugcucuuacccucaagucuuuccgggagagagccccggcuuuccauuguccuucuuuugcucuucagcagcuccugggaaccccccaacgcucaauacugggcccaguuccacagugugaggccgcaggggccggagucaaggaagcagcagcguaaacacaaccagcggguccugggguacugccuccugcucaugguggcaggcaugggccugcacuauguugccuucaggugccuccccaugcuuccugggauacuggguagagggugggucaagcgugcugaggccagccagccacugcagccuaugaccugcauacuuugucucucucaagcuaagaacuuugugaaaucaagaauuggagcccugccuuucugaguaaaggcagaucugcacacagggcuagagucguuuucuguuucucauagcuugaauguuaaucuuugaugcugcuuguuggugagcuggagccaccugaaaccauacucaaaaaaccacacacggucaaaacccagggguucucuccuagcacugcguaaaugagggcgguuuuuccuuuuuguuuuguuuugauuuguuuuguuuuguuucucugagacaggguuucuuuguguagaacuggcugaccuggaacucccuguguagaccaggcuggccucgaagucagugcaccaucaccaccaagcaauuuuuuuuuuuuuuuuuuuugcaaauuuuuuaaguucagggucaucuuugguuacauauggaguuugaggcuagccuaggcuacauuaaacugugucucaauauagaaagaaagagggccaggcagugguggugcacgccuuuaaucccagcacuuggggggcaaaggcagguggauuucugaguucgaggccagccuggucuacaaagugaguuccaggacagccaaggcuauacagagaaaaccugucucaaaaaaccauaaaaaaaaauaaaagaaaagaaagaaagagcgaggaaggacaagugccguauaacagugacaguccaugguagcugccaggaccucaccauacacucgaaugcaugcugucauaccaguuuucuguggcauagaaacccaaaggauggagcccauuguccguaguaucuagcaauggagauuaccuaaauaugcccccuuucuagucuucugggagaggcaaccugauuucagagcuguuucaccaaccuucuucacaggacagccagugacuuagggugccaccuaguucugggacuugggccacuuggugucuguuauagagagagauguaaaguugugugagagaugcuagaaccuggucaaggaccaggguuugagggacaccagaguucggagacucggaguuaacugcaauuccuucacaggaagcuggagcaggugcaucgcagcuucauggaugaaaaggaccggaucauuacagccaucuacaaugacacucgggccagggccaggucugucacugcucugacuuugcuuccugcuucagcaccacccuccaggaugucuguccugauccuguuuuucuuuccagggccaacagagccaggauucagcaggagcgccagcagaggcagcagccucgggcagaacccucccugccuccagaaagcuccaggaucaugccccaggacacaagccccugagaggcuuaacuaaaugggaccuucauugguccucucccugcugccuguccagaacuacacgugcaauaaacucauuuucagacgccu

SEQ ID NO: 9129 - RNA, 19565 nt, Mus musculus
accguagcaacauauaaccacgccugacuggcuucuuuauugaggagggacguggguaagaacaggugaagacagcugggacccuagguugggaagaacacccuccccuccccguaugcacccacugccccaaauaaaaaauaaccaacuaugggggagcagccgagacagugacggggaggcuaggacugggcagggaaggacacucggauugagggcagcagugaagagaccaugcgugugcugggagggcccgagguggcgcuggaugagucugucuuccuuguaggcauguauaaauauaaagauaagccuuucuucucccccccucugcccagugcugcucgccaccuucccagcucgccuuccucauuggcgaagggaagagggggaaaagcaaguuaucaccgaauugcgaugagacccacauccaucagcuucuggaucuucugcgcuauuacaggauucuuuaagugucuaggagaagaagauacaguuaacugaacaagucuccuuccacccaaguuccucggcugcagagcauucucaaagacccugcacaugcaaaaguccuuuucaccagacaggacagaaagaaccugccuaugcuacuguuugucugcacagcugaaagccuagcauaguuggccuucccaacagaagcuuaggcuauuagacuaacagaaaaagcaagcucacaggcucucuguaccaccaguauuuucuguuaagauugauaggauucagggcuagagauggcccagugguuauugauggagagagaacucggagcacuuacugcauccacaguggcucucaacccucuguauauccaguucuagagggucugacacccucuucauacauacauguagguaaaaugcucaggcacauaaccucaaaucauacauugaaagaaugauagaauucccucucacuuccccacucaacuuacucgcucagagccuggggguccuuuugcaucugcuccaggaugagucucauggcugggucacucauuaucugcugcaccucagggucagccauggcccgccgcuucacauccucagggcuaucaugucuguuguacugugccaucauacagcguugguaaccaucugcugcuuccugcauuccagaaaagaucaagggaggcaggucaacacuauuuggcucacugcuucagcagguccaagaugacagaucauugacaaaggggaaaaaaagagagacaagagaaacugaagcauuugggaaggacaugaaggaccagagaaaacacccaaaggagaaaccaacggggauguauguuauaggccaacagcagcuuaccuuacagcuggaguccaggucuaacgcuuuuugguacacauccauggcuuuuguauaguccuucauggcuuccagagcagcugcuuuccguguauaacccuugacuacaaacagaacaggucagacagcaacucaguagcuccugacugcgauccuccccuucugccuacaugcuucaaagccuuuaaccuuaaucaucucugggggcaaaagcagggcccaggagaaaaaugaaaagcacuuacugaagguuggcucuagcuggaugcacuccucacaguccuagggaggaagaaagggaaguaauuagguuccuuucccccaaggugcacaguggccagcuacuauacccugacucugcugguccuaucaaauccaggccccuggguuucuggagagcaacuuaaaaggagaaagaguuggccaggcaugguggcacacgccuuuaaucacagcacuugggaggcagagggaggugaauuucugaguucaagaccagccuggccuacagagugaguuccaggacagccagagcuacacagagaaaccuugucucgaaaaaccaaaaaaggagaaaaagaguaccagaaaggacagcuccagauaaccaaccccuccaaagcuggucaacaugaauagguagggcacuucuaucugagaacuagcauacaaauaacacuaacugcgccuuaagccuuacacacuuuggacaagcagcagaaaaauugaaacaaaucaucugaguuccagaucagccaggauuccaugagacuuucuuuuuuuuuuuuaaauuuuauguaaguacacuguagcuuucuucagacacaccagaagagggcaccagaucucauuacagaugguugugagacaccaugugguugcugagauuugaacucaggaccucuggcagaagagcagucagugcuuucaaccgcugagccaucucuccagccccuuacaugagacucaaaaaaagacaagugcuauauucaugaaucgauaggugccuagugcagguaucagaggcugccucuggcccagauggagugaaugcagaaacuugcaucccaacuugggagagcccaaguuggaaaacucuacuugcucccuccucuuggagcuugagaggaagcccauggaagcggaaggggaggaacuguggaagccagaggggucaaagauaccaggagaccacagccagaggaauuagcaaaaaagggcugaugaggguucaaaugaacugaaguggcgaucacagagcuugcacgggucugcaguagauccucugcauacguuauggaggugguuugguguuuuagggagucugguucucuugccugcucuugggacuauuuuuccuccuacuggguugccuugcccagccuugccguagggcuugugccugcucuuacucaucuuguuguggcauguuugguugguaucuuuuggaggccuauucuauucuguggggugucaaucuaggggguaggaggggaagaagcuacaguuaggauauauuauaugagagaacaauaaauaaaaaagaaaagcuuuuagucccagagcucuagagauagaagcagguagaucugugugaguuccaggacagccaguacuucacagagaaguccuaucuuaaaacaaaacaaaccaacaaagaaaacagccaagggggaaaaagguuaagaaaggaaaguuuugagcugggcgugguggcccacaccuuuagucccagcacucugaaggcagaggcagguagauuucugaguucgaggccagccuggucuacaaagugaguuaguuccaggacagccagggcuacacagagaaacccugucucaaaaaaaaaaaaaaaaaaaaaaaaaaaaaaaaaacaaacaaaaagaaaggaaaguuuugcugcuaccuaagccaacccuugccccccaaggcucccacugccuuauaagcuaaucagguuuugcugugcccuugcagcucuaacuacagugaugucauguagugacaacucugaaauuuugguuuccuuacaaaccucagaaauauucuaagaaugugcuuuuguuuuaaucccaggugugggaugauguggggcugcuuuggacuguccacagcagcugacuaugauuugccucauguucuaacaaaggcgggguuuuaucagcugcaaaugguucuggaacugugugauguuuggaauuaugggaacuuuucagagguauacguaauacaaaagcuagggcccugacaggugggguugguaguuguucagggauacaguuuguuaguaguaugcccaaggaucucucuucucccucuauccuuucuaccccaucuagugaugggguggguagaaugguggggaugacaaugaugauaaagagugggaaaaagaacccauauagcaagccgagcgugguggcacacgcauuuaaucccauaaucccagcacuugggaggcagaggcaggcggauuucugaggccagccugaucuacaaagugaguuccaggacagccagggcuauacagaaaaacccugucucgaaaaaccaaaaaaagaaaaagaaaaaagaaaaaaaagccgggcauggcaguacacauugauaaucucagugcaggggcucaauggcagcaagcaaaaucucagaaccgcgccuacagcaguuguggaacaaucaccagguguuuauaauguuguagcugcuggcuaaaaacuugucacucaagaggcugagggacaaaaauuaugaguuugaagccaguguggacuacauaaaugaaguauuaugaaaacagaaaaggggacuagacaugauucaacaguuaaaaauacuugcucuugcaaggaucugaguucaauuccuagcaacuacuuguuaacuugcagccauucauaacuuauucuagggaagccaaugcccucuucuggccucugagaauucgagguuucauaucuggcacauguguacaaagcaggcaaaauacucauacacauuugaaaaauaauacagaaguggagaaaaauauugaggaagacugggagaaaaagcuacacaggagcuacauaggcuuacauaagcucaaccacugacuuuuaagggcucaggggucagacagacacagaccuccaacuucccucacacauuacuacuacugucaacuuagaaucuuaauuagaacauuaaccugcagaggagcggacaagaaagaggcuuggcucccugcaaaggcuuguagcaacuccaggucucaccucaaguaacccuaucagaacucccaggccucaccuugagugccagcugaaacuccaggagcuugguguagcaggcagcucgguugcuguacaguuuggcaucucucggguuccuuuuaauggcuucuguauagugcuucauggcuuggggguaguccccuagauaguuauauacaaaugacuuccauuagcucagcuggcuuccacugcagcugcucaggcugcaguccuaccucaaucuccuggguaccaugucuagcuagcuacgaaugauuugcuucugcuauuuaucuggcuuuugagaaaggguuucuguauagauagaucaggcuagcuucaaacucaagaaauccuccugcuuggcaugggcuacccaccacccagcuguuucuguuauuuuaaaacaggguuucauucuguaacuagggguucuggaacccccaaugaucugccugucucagucucccaauuauuggaauuacaccuauaaacccucacaccaggguaagcuugguuaugaacagcuuaccuaauguagucaauauauuagacucaaacccaauuaccacacacacacacacacacacacacacacacacacagaggauuuuuguuguuuuugagacagggucucacuaaauaccaucaauuggccugaauucuuuuuuguagacaaaccuggaaaacccugccucuggaguuccugccucaguccaaguacuaggauuaaaaacguaagcaccucccucccaaaauuggcagggugguaguaguacaugucuuuaaucccaacacucaggaggcagaggcagauggaucugaguucuaggacagucagugcuacacagagaaacccuaccaaaaaucaauacccucccaacaagccacaacauucagcaaaaagaaaauuugugauagccaaaaaccccccuucccucuccugcaaaguguuccuugcacgcaggcacaggaagcccacgucagaacggagguuccuggacagcgcuguaccuuucuggaagcauucguugcccuuguucuucuccuccaaagccaagucaggguugauauaagccaagcgcuccuguuccuucagaauuuucucugccuaaaacaaacaaaaaaauaaaaaaaaauuauuagcacaguaauuuaaacaucuaaacaccaacuuuuuuuauuuuuuuucccucgagacaggguuucucuguguagcccuggcuguccuagaacucacucuguagaccaagcuggccucgaacucagaaauccaccugccucugucucucaagugcugggauuaaaggcaugcaccuggcaaaccaaaacuuuuucuauauuuauuuauguguguaugugcacuuguacacucagugccuauggggaaaucagagacaacuugaggugcuucucuuuaaguucccuagaacacgaguucugugaauugaacucagguugucaggcuugguggcaagcaccuaaccuaauuaggguggcuccuaauuaggauuaggaguuucagagcuagaacaagauuuucaucucauucuugggcugaagauauugcuuaguagauauagguaccacaaaauaucuauuuaaaaaacauucuuaagccgggcgugguggcgcacgccucuaaucccagcacucgggaggcagaggcagguggaucucugaguucgaggccaaccuggucuacaaagugaguuccaggacaaccaggacuauacagagaaacccugucuugaaaaaccaaaaccaaaacccaaaccaaccaaaacaaaacaaaaaaaaaaacauucuuuccuuauccagguacacuguaaaagcagaauagaacuugcgcacauaugccucaaaaccacgcccuuagguuggggauguagcuuaggugguaggguugcuuguuuaacauacacaaggaccuacaugcaaucaccaguacugaacaacucuacuguggcagacuacuccugugaucuaagcuguuacaagguagagggauguuggcagaaguauaagaaguuuaaggucauggaaggccaacuuaggcuuugcaacuuugaccuccauaccuacacuguggcacauacccaauccaaacaaauaaauguauaaaauauaaaaaaacaagagaaacaaguaaaacauagcacaauauuuuuggaguuagugaggaacugcuugggacuccucacuaugcuacccagguuguuuuuaaacuacaccacagagcucuauauuacagagacgcucagaauaguccuguccuacaauacugagccagacaaaucacuccguaaaauuacucccugugauggcuugaauaacaaugaccccauaggcgggcaugguggcucacaccuuuaaucccaacacuugggagucaaggcuagccugucugaguuccaggacagccagggcuauagaaaaacaaaaaaacccugucuugaaaaacaaaagacaaaagaaugaccccauagucucaaauauuugaaugcuuaguuguaggggugggggaauauaugggcuauggaauuauuaaagcaaguguguaacuguguucggacuuugagguuucaaaaacccaugccaggauuaguuucucuguaucuacaaaucuggauguaucucucugcuacuacagugccuaugugccuacaccaugcuccccauaaugauaaaaaacuaaaccucugaaacuucucgcaagccccucaaugaaauguuuucucuugcugggcaugggagguagggacagguggaucucugcgaguucaagguuaagacuggccuacauauaacuccaggauagccagggcaguuauacagauaaacccugcucaaaaacaaaacaaaaagaacaaaaaagccgggcggugguggugcacgccuuuaaucccagcacucgggaggcagaggcaggcagauuucugaguucgagcccagccuggucuacagagugaguuccaggacagccagggcuacacagagaaacccugucucgaaaaaccaaaaaaaccaaaaacaaaaaaacaaaaaauucucuuguaagagaagaucugccuuggucagcaaagaaagaaagaaaagaagaaaaagaaaaaguugccuuggauaugcugucucuucauagcaacagaggauugaguacaagacacuccacuccauuauuuauuacaaaugguauaccaaccacucuggcuaucaaaauaaugagaccgggcauugugguccaagccuauaauuccagcauucagacagauggauuacucugaguuccaggccagccuugucuauacaguuucaggauacccagggcuacauaaucuuuucagacccaccugcuggcacuucuugagcacaucugggguucggugcucugcuagagacuuguuguagaaauguauagcauccuuguacuuuucuucuuugaaauaggaauugccaauucgggcauaagcucugaagaagacaagagggaaaaggcagagucagaaacaaggucaaccauugaagaaaauacaaacugauucuaaacaaagcuggcucagcagccuggagacccggcucucaacaaggguuucaggccccagcgugguggguucaguggcauacuuggcgaucugccgguaguccucucgguucucucugcccacuucaauggccuucucacagagcucccggcauuuguuauagucgcccuucucaaagugcacagcugccacgaagaagggugagaaacagacaagucaacaggccugguuucuuucuuuucucaagagugccuaacagcucucucaccccugguuucuaagccucaccugcuugauuaguuauguaggucauguugguaggguccaguuccuuggcucugucauaaugcuucagggccuugucaaaaucuuucuucuuguaggcaucauuucccagcuccuucucuuucagugccuagauggagauggaaaggugagugcuucacucccauacggcagcagccacagcagcacaguacaugcugucugucacagguauccauuagcaugugccaccagcauuacaaggaagguaggcaggccucuuccuacacuagacagagucaagugagccagggcucaaggguacuuuuuuuuuuuucauuuccagacugacuccuuuucccaucuacucucuuggaucuuuaccaggcagcagagggcuucucugagggagagaaaauccucucaacucaaagcaacuacagaugauauaauuugguggcagguuuuuaugagaggcagucacaagcgggcuguuguggcugucuugagaucuuagcuguuagggaacagcaggcacaguacgaggaucagaaagggccaaaggaacaggaggagucuucagaaccgcucucuccacccacacggagggccuuuuuccagcugagacacccugagcaaccaacacucacccauuuaaggguacuaaauuuggcaacaaucugcuguuccugacuaugaggggaaacacaauucuuuaggcacaugucucuugcucuggaagagcguugccaaguggacacccaccugaaaccacauccaaucaggaggccaaagccucaggacuaaugcagacagcacacccugaucauggcagggccuacuaccccucacaguuuuaucgguucuacucaguguucaugcuggcagcacaugcggagggucgacugagggucuacuacuacugcagcagcacucccaacauuccaacaucacuaggaaacagcuuguaaagaacauccuucucaaacacacacucacaaacaaaaagaccaagggucucccugggcaacacaaaccuccuauaaccacaguaauucuuucugauguaucauauauauaauauauauauauauauauauauauauauauauauauauauauauauauauauagugguucacaacuguucauucuuuugguuuuucaagacaggguuucucuauguagcccaggcuauccuggaacucacuuuguagaccaggcuggccuggaacucagagauccaccugccucugccucccgagugcugggauuaauuaaaggcgugcgccacaacuguucauucuuaauuccagucccagaggaucugacaccucccuuaccuccauggguacuggcauccaugugguacagauacauacaugcaggaaaaacacucuaaauacacauuaauuuuuuaggggauguggggugguauucaagacaggguaucucuguguaguccagacuggccucaaccucaagagaucuuccugucucugcuuaucaagugcugggauuaaaggcaugcaccacuacuaucugaccaaaaaccaaaaaaaauuguugcuacaauuuuuuuuuuugguuuuucgagacaggguuucucuguauagcccugaaaauuuuuuucuuuguugcuguuuauuuugguucuaggggacaccauuucucuguguagcccuggaacuuacucuguggaacagaauggccuugaauucagagaucugccugccugccucugccucccaaguguugggauuaaagaugugugccaccacugcccagcuauggaggcaagagcaggugaucuuugaggccaacaugaucuauagagcaaguucucagauaccccacacccauacagagaaacuauuggaaaaaaaacuuacuuuaaauuuuuauuuuuauaacuuuuuuauuuuauuuauuuuaggugacugagaagauggcucagcagucaggaccacucucugcucuuccagagaaccaauucccagcaccacaugacaguucacagcugucuauacuucaagaucugacacccucacucaagacaugcacgcaggcaaaacagcaaugcagacauuaaaacauuuuuguguaugaguguuuugcaugcacaugucugcauacuauugcauaugcuugcaugcaugucugaugcccagagaggacagaagagggcaucucauucccuguaucuggaguuaccaauggucgugcugggaaucagaacuggauccuuuggaagaacaacugcuggcauccuucuaagcucucuccuucuaccaugucgaucucaaugauguuaagcuuagcagcaaaugcuuuuuccucacugacccucugauguauuuauuuuaacuuauuuuuuuuuccuuucaggcacuauugcccaggugggacucaaagcuucugugguauugaauagguaugaccccuacagauucauguguuuaaaugccuggccacagggauuggcacuacuaggagguguggccuuguuagaggaagugugucacuguggagguggcgcuuugaggucuuaauaugcccaaguucugcccagugugaaacacgcagucuccuucuuuuuuuuuuuuuuuuuuuaaagauuuauuuuuauucauuauaugugaguacaccguagcugucuucagacacuccagaagagggcgucagaucucauuauggauggugugagccaccaugugguugcugggauuugaacucuggaccuuuggaagagcagucgggugcucuuacccacugagccaucucaccagccccccagucucguucuaacugccuucagaucaagaugucaaaguguuggcuccuccuguaucaugucugccugcaugcugcugugucuaucauaauggaugaaaccucucaaacggcaagccagccccaauuaaaugccugucuuuuauaagagcugccaaagucaaagucaugaugucucuucacagcaauggaaacacaaacuaagacaaauguggugcacaaaaauaaggggcaaaacacucgcacacauaaaguaaaaauaaagcacgcaccuuuaaucccaguaucugggaggcagaagcagauagaucucugaguuuaagguccuaucucaacacuaagaagcaaccaaauaaaacauaaaaaugacugaucccagcagucgagggcucauccuaaguuuaaguuuaaggccgaucugaggcgcaggaugaagcugucccuuuaagugucagacccagggcucccugcauucuaggcaggcauuccacagguuaagguaccccuagcuccaaaucauuccucagcuacagucugcagacacgccuauuuaacacuggcaaucuguaaaugugugacgguuuagaggagaaaaaacaaagaccuguuucuuauucucuggaagaucuucuuccauugguucuggcuugggcuccuuuuugggaggagguggggguggggguguugcugccucuuccucuucauccaugcugcccagaucaaccccaaggaggacacucagaguagucaucacccggggauccuguaguuuccuagauugaucauaagaaaaugggcugaagaaauggcucuacaguuaaggcauacuguucuuuuuuuguuuguuuguuuuuucucuguguagcccugguugucuuggaacucacucuguagaccaggcugagaaacccuccugccucugccucccaagugcugggauuaaaggugugggcuaccaccacccagcaggcauacuguucuuacauagacucagguucgguucccagcccucaggcuuggaaacucccaaccuccugaaacucaagcucaaggagauccaacagcgcuggucuccucaggcaccugaacucacaagcacaucauauaacuuaaaauauaaaaacuaaaauuucaagccaugaguaguaguguacaccuuuauuccuagcacuuuggaggcaggcagaccucuuaaauucaaggccagccuggucuauagagggacuucaaggccaacacagaaaaacuguuuccgaauaaguaaaaguuaaaauaaguaagugagggcugggcgugguggagcacgccuuuaaucccagcacuugggaggcagaggcaggcggauuucugaguuccaggccagccagggagugauagugaguuucaggacagccagggcuacauagagaaacugucucugucucugucucucucucucacacacacacacacacacacacacacacacacacacacacaaaguaaguaaauaaauauuuucaaagagaaaugaaggcuuggagagaugccucaaaaaaauuaaaagccaagcaauaguggcgcacgccuguaaucccaguacuugggaggcaaaggcaggcagauuucugaguuugaggccagccuggucuacagagugaguuccaggacagucagggcuacacagagaaacccugucucaaacaaacaaacaaacaaacaaacaaacaaacaaaaagaaagaaaaaagaauccuguggcucucucauaagggccagaguucagaucuuagcacccauaucagguaguucaaacacuaacuccggauguaagauaggggaaaacaaaaacaaaaacuuuaaaaaagguaaucaagccagcuaugauggugcaucccuuuauuucaggcggagguugauggggcugugaggcuggacugauauacauagugaguuccagaauagccaggguaauucagaaaaacucucaaaaaacauaagaacaaaaagcaagaaaaucaucgaaguagcuggacuuagagauguguacuacuaaugcuggcugcuacaacugcuccuuaccuuggcacucauuaacagauuccuauaccuggaugauccuuaccuacuaacaggaguacaagcucagagauggcauuugccuagcaugggcaagauuggaaguaacacuccugaaugucuugcuauuacaagcugaccaacuuuucuuuuuuacaaaugcaauuacaaaaccuauccuccucaguggcccacaucagagagcuucuguccugcggccuguacucacgugcccaggucugacggcuuguucugcagcuguucuaugagcucccuguagguggggucacugagcagcgaccuuguccuggggucguuuuccaacuuuugguauagauuaggcaaguugaauggauucaugaauuuccucucuguccaaaugaaagacaguacaguaguaugaaauauuaacuugagucuucaugacaaacauagcccaccuaccacauaccuucacuuuggggaggacagcacuguuuuaaaaauuaauccagccgggcgugguggcgcacgccuuuaaucccagcacucgggaggcagaggcaggcgaauuucugaguucgaggccagccuggucuacaaagugagcuccaggacagccagggcuauacagagaaacccugucucgaaaaaccaaaaaacccaaaaaaaaaaaaaaaaaaaaaaaaauuaauccuacuaaauaaaaaagggaaugcugaaugaauacccaccugccaaccuggccuccauguucugcaagcccuccuuaagcuggagauuauuggcuucauguuuuaaaccuucuucauagguucguuuggcuuccucaaaccgguuuaggaauucaagggcugcugcuuuucuugaauaacccugaacagccccaaaauuacagucaauagaggucacacagaaguaaauucagaucaauucaaagagccuauuaggguuuuguuuuuauucauuuaaugcacaaggguguucuccuguauguguaccauauguaugcauggugucuacaaagccagaagauggcacuggggugccugagacuggaguuaaagacaccacguggaugcugaaaaaauuauacccagauccucuggaagagcuaccaguguuguucccaaaggauuugucucaccagcccuccuuuuuauccuaagacagggucucauguagcuaagguggcuucaaauuccaccuaucucuacuuuccaaguguugggauugaagguauaagcuaaacugggcagugguggcacacgccuuuaaucccagcacucgggaggcagaggcaggcggauuucugaguuugaggccagccuggucuacagagugaguuccaggacagccagggcuacacagagaaacccugucucggaaaaacaaaaacaaaacaaaaaaccuguuuuacaaucgauggcaacaaacuugaaguaaguguucccuucaaggggugccaggguaggcuggccggccaaaaggagcaaccuauagucaggacaggaggaccuacuaauuaggaacuacagacaagauccuuaggaaacuguacagagcagaacucuucagcuuaccuugccccagucaggcuucaggucaacagucuugcagccguccucauaggccuucugguagucuccuuucuuggcguaggcugcagagcgauugcuguagagcacaugguucuggggaucuaguuuaauugccucagaguagcacuguaaggcaucaucaauguucccagcacucagggccuuauugcccuucuccuuuagcucauucaccugaggaggaaaggcaggcaucaauacagcuucacccuacagaacugauuucucuccccuaggguguuagauuuuacuuauucuuccaaaguaucagcuaguuggcugcuacugaucaauaagagaaaaaugcuaaucuauccauguucuucuacaccucuagaaacuagcagagagaaaaacaaaaacaaagcagaggcaugcucagauacaugacugaccggacacaugguggcacacaccuacacucccaguacucagaaggcucaggcugaaggaaucugaguuccaaguuauauagaaacagggcccuaauuaaaugucucagugugauuuaaaaaaaaaaaaaaaaaaaaaggggcuggagagauggcucagcggguaagagcacugacugcucuuccaaagauccugaguuuaaaucccagcaaccacaugguggcuuaaaaccauccuuaaugacaucugacgcccucuccuagugugccugaagacagcuacaguguacuuacauauaaaaauaaauaguaaauaaauauuaaaacaaaacaaagaagaaaaacaaacaaacaaaaaacccucaggccugacaaucuaaguuagauacuggacagcaaaggaugaaaaagaaccaaccccaccaaguuaaccucuaacagccauaugugcacaccugcauucgcccaucaugcccuuaaguccuagaagcuucagaauaagaggauccuguucuuccaugcucauuguggcucuacugccauuucccauuaucagcaagagccaaaaaguacuuacugugcugacccuuaaggguagaguuaguccccaccaauguuaguccccauccacucaugauguuaucaggaaguggguaagaggaugaagacaaauaucaucuaaucccauucucuccauuuccaagaagcuucauaaaguaaaggaggcuugggcuggagagauggcuuagugguuaaaagaacugacugcucgucugaagguugaguucaaaucccagcaaccacaugguggcucacaaccauccguaaugagaucugaugcccacuucuggugugucugaagacagcuacaguguacuuacauauaguaaauaaauaaaucuuuuaaaaaagugaaagagacuuugucuaagaguacugacuuuccuuucccauagucaaagccacaccccuagucuuuugcccccuccccuuuuuaacacuuugugauagggucucaguugaauuuagaaggcuagccuugaacaugagaugagaucuuccuguucugaucucccacuagcugagauuagaggucuaguugcuuuucuuuucauuaucuguguguguguguguguaaaggguuuuucuuagcucuguugaccuacagaaggucaagaacgucacacugcagagcaguaguagccuaugccuugggaggcagaggcacacaaucugaguuccaggauaccuagggcuacauaaaaacucaaaucuccaaaggaaaaaacaacaaacaacucaaacaaccggacauaagguaccuauggaaaaacagcuucacagcaccaccaccaccaccgcagauuuuccaagacggguuucugcauagcccuggcuguccuugaacucagggaucugccugcuucugccacccaagugcucggauuaaaacuaccacagacucaccgcucccuuuuaaagccaagaauagagugaacaugaguaggauguuacuuauguuauugggaugggcauguagcucacuugauagcccaagcaccagguuggaccccagcaccaagcacaguggcauauaccuauuauuucaggauuuaugagguggaagaaggagauugcuguagugaaauuauuacagcaccuauuauggaaugaucaucuacucaugauucagaagacugacauagaauguacuucuugcaaaugcguuuagaaucccaagguacaccaauuagaaacuuucacagaacagaggucccaaugcacauguaagcuggcuuuucucugcaaucucaacacuuaggaagaggcagcggacccuauucucagcaaaggaggaugacaugcaggagagauaaaggaacagacaggaaacugccaauaugacauuccuuuacaggaaggucaagggagaaaaagaguacacaguacacaaauauucaucuuugagcugggcagugguggcagaggcagguagaguucugaguucaaggccaguguggccuacagaguuauuuccaggauagccagggcuacacagagaaacccugucuugaaaacaaacaaacaaacaaaaaaaaaccccucgucuuuguuugcaguuaggaucucuuuauguagcuauagcugaccuguaacuccacuauauagacaaagcugucuaucugucugccucugccuuccaaguguugggauugaagaucugugccaccacaccgggcauuagaaauaauguuuugggauuuuuuaagacagggucucacuauacaacucuggugguccacuuacuuacucagagaucagccugccucugccucauugagugcaccaucaugccuagcaaaauuaaaucuuaaaauauaaacuaugugucacuguaggaguuaccuggaauucuacucuucaaauguacaauuuuccagacaggguuucucuguauaacccuagcuguccuggaacucucuguagaccaggcucuccucaaacucagaaauccaccugccucugccucccaagugcugggauuaaaggcuuacuuaugccaccaccaccuggcucaaauguacaauuuccaauauucaaacgcauuuguguauaugcuagugcauggggcagacauuggaagucagggucuuccuccaacacucuccaccuuacucugagacagaaucucaaugaaucuggagcucacagacaggccugagaugcucgggucuccccuccccucaccgauuuaguggguaaaggcaaucggaacccaggccuucauccuuagacaucaaacgcugaaccaacugagccaucucuaagcccaacgcucaaauuugucaucuuacuguaaguuugcaguccacaggaacacuugcacacuuguauaauggcuggcaggauuuuuccccacugaggaggguggggaggauggacgggguagaccauagcucuaaauucaggcccuguguuugaucccuagugccacacaaugaaugaaugaaugauaaugaaaaacaaccucuuuuuguuguaacagagcaagguguuacucauaccaaaaaagcgucucucuuguccguacugcaguuacaguuuaauuacuccaaggguacagaaaguugauuaaccucuccauuuagucuuauuaacaaggugagaggccccacggucccucacagugacuauuccagaacaaaagguuuuacuuuauacaucacaguaaaaguaguaguaagcugugcucuuuuuguauguguguguuuggaugaaucacaacgguucaaugacagcuuccaagguaacaaaaccucuccaggccucagaugcaggccacuguagccugagcuaaaucaccaagguaaggacggcagguuucccucugugccccagaucagaugcugagcgguagagacagggacuucuagcuccucacuaucggcucacaacugucuaaaaccacuaaauccuguguaaucgggaacggaauuuccaagggucggauacucagucaccccacagucacuacgaaaaguggggggaggggcgacauauguaugccucagggagcccuggugacacuguccgcgcccgccuucucugcagucgcgcggguccuuuucccgggcgcacacagaugccguguaccccgaaggcugcuggggugaucggucaccggaucccuccaaguucgcagcggccgacaggggccucuccgcgcugaggaggcccggcccccagaagcuucggggcccggccgcggccaggccuguucccgcuccacucggcgggucgcgggggcgacgggcgcucgccauucuccccucacacgcccgaccgcggcucucacgcccgcgccucggccgcccgacccggccccccaaccacucgcuucuccccgccaacaggccugcgcugccccggggccccggccgccccucccccuucaccugcuccauagccuggcccggaaccccguugaaucgaauucguccgcuccgcguucccaaccgcacgcgccgccuucuggaaccuacuagaagcugccgggacccccagguuaccgccccuuccucgccugcucacugguugaacacguccaggaggcucugcucgccccuuuuauaggcuuaaaguucagucaaucaucgugacuucucuuucauugguuuuuuacgggucuucucuucagcccugccuccucugcaccuccggauuggacacuccgcggcaagucccgccuauuucagggcuaggcuaacugagggaggagcgggucuugacgacacggauugguugguuaguccgucaauuguagcuggccuggccg

SEQ ID NO: 9130 - RNA, 8115 nt, Mus musculus
aggcagcggcagcagcacuucacauuuauugagggccugcccccaaggagcucacagccugggcugagaccccacaugugcuggggguggggaggagaaggcagguaaugcagauauggcccaagcaaagggggugcagagcaggcacaggcaggggcucuggggaacaggggacaggcaagcucuacuagagugucucucucacaccaggucagcuccuccagggcccagaggaugccuagcugcuccacccacucuaggccagccuccucccaugaaucucucaccccaguacuccucaaucaugcaggcccuugaagguuggcagagaguuguaucuggggcccuggccagaacagcaagucuguaagugcuuuguauggguggcuugagaccucuggucaaguucccacagaaacccuugggaggcuaaggaagaaagggcaggccuaugggagcagaacuccaaggaaccagaaggggcccacagaggccuggucccuuccaacuucucuuggcaggaaugcuugggguagaugguuggaaagcuggggacccauccucgggaaagggacagccagacacaaggcagccagcgggcagguagggaagggcggcagagcagggaagcgcacacucgggcucaccaccagcauccccuuuaauaaaacauggaagguucuaugacaggagaagggaggagugaaauaugaccauuuacaaccacacacaaaaaaaaaaaaaaaaaaaaaagaaaaagaagagaaagaaagaaaacccucuguacaugucuagcgccuggcaggggaggcaggcggggcacaacaggccagccgguccuauuuguagaggauaucguaguguccaggucgguagagaagguagaccuugggcucggagcccucggggaagacguguggguugguggugccgcccucgccgcgguccauguacuccacuuggauggacacacugagggccugggccagggcuaugauguggauguggucgcucuccuugcacauggguuccaccuccuguggcacaggggcaggucaggccugucccaggaucccucccccaggucccacagcucacccuggcaugccccacccugacacaaaagagaaaaggagggccccaaagcagagugagagaggagguggcaccugcuggcagaacuccuuaacaguccggccacccucgaugaagugcucgaagaacuugcucucccgcuguagguagccugaggugagcagucgcagguagaccacaagguagucugaggugcucuggucauugaaggaggccagcaggucagcuacugaggucugcuucuccaccugcucgauaagguccaugaacugccccacccagggacaaaagguaagaugaggaagauggcaacaggccacccuuaccauacauuaacccagccugaaacuggugggcucacucaccguguuguggaagucuucaauugugaauucagugaagcccugggauaccagguccucuuuacucuuggcagacacggcuuugaaccugcaggugggaaggaaugggaagccaauaugggcuccucggcuagcagagcaaggcccuagccagcccaguccugccuagacaaggacacccaccaagcucaaaaagaaguccccaagcaacccaaaugauggguagccuaaggcccugacuuccucaugagagguccagagccccagugccugucguccucaccgcugcaguuccuugcugucaucuagcagugccuccaggugggagaagccaaacgcucgguagaagcaguugccaucaggccgggucuuccguauguaugaguacuuuuuguggagguccugcagagaugcagcucagcuuaacauucaccagcccaagaaauggcuagaacagcagguggcaacugagcucccaccuccuggcuucugaauggggacaccaaguaacccacuggcacucuuggaagcuaugcacuuaugugucaaugguuguacggucgccagccgcuaagccauguggguaccacuggcuagagcuuuguuuaaaaacaggugacuaaaucuguccuugacuaauacagcuuuuuaaggucuuuaaugcaagcaagacaaacgggaacaggacaggccauacuaccagcugcccugcccaguagggcucuagccacagagaagcucucccuacagucuggggcuaaacuggcucuccaauacacuuucaccuucuaaccaugcugcccacaacagggaccaccuccuucagcccuuccugcuuccucgagaugaagcagucccaugacacagacuccuaguacugcuuaagcaggucuuacccaucuggacaacccuggcccuggucaccccuugugccugcuccuuccucagaugacuauccucagacaacugucaguaaagagaguccuuuuacacugaaaauauggcccugacauuucaucugccacuaugcugccccaauauucacuaccagcuccugucccucagauucaaggacaccuuccuaucaguuuugacuccagagucauauaagauccagguaggccucccaguacagacagaaacuugugugggcagcuucugucuggccaauguuaagaacccuccccagccuagcccuggacaguggcagcacuacccuucuucucauuuucaccuguccucucccacgcuaccccucaugcuucuccacucugaaaggucaggcuccaccaaaggacacaguauccuuuaagccaguuacaacccaaacccagggcuuccugccugcccuauaaaccccagaggccugaccguaucuuuaccucuuagucacagauacaauauucccuuucauuuugguuuugagacaaggucucauuuugcaguacaggcuggccuugaacuugcuguaaucuugccugggcugaaauucaagaccaccaaaccuagauagaguuccgccuuagaugcucugccuccgaccccucuuccauggcugagacaucuccacgggcacagcugguuugcaccaacuugaucuucaccucggcuuucaaugaccucagagauggcucacuucugcccccacccaucuaccaaacaguagaucccuuaggcucuuccuucaacacaccuagcacccaaauguaucacuacacagcccacuccuggucuaucacgccugcuuaauguuuuacugucaaagccccucacuacccccucuuccuccacugugcccugaaaccuauuuucacccugaagcacuaguaaccucacagcuaagccuucuuccucucugcagccuuuaaagcauccagacauucccaggccaaacuggcuuucauggaggcuccagccugcccagaugcccacuuauuaaaccaaccucagaccccacgccccuugaacacccugucacuuggcaucuugcuucugucuguucaucaaauacaucuuucauagaggcucuugcccucuacccccauuuagaaugcaaauucucagcuaggcauggaugaacaugccuuuaaccgcagacagaagcaggaggaucucuggaguucagggccagucuggucuacguaagcaaguccaggacagccaggacucuguuacacagagaaacccugucucaaauagccaaggaaggaaggaaggggggagggagggaggaagggcaaguucucccacuccuucauuucucuccacaguacuaacgaccucuaacaaccaaaguguguguguguguguguguguguguguguguguguaguguuguguuauagaguugggacaggguguagugcuguguuauagaguugggacaggguguagugcuguguuauagaguugggacaggguguagugcuguguuauagaguugggacaggguguagugcuguguuauagaguugggacaggguguagugcuguguuauagaguugggacaggguguagugcuguguuauagaguugggacaggguguagugcuguguuauagaguugggacaggguguagugcuguguuauagaguugggacaggguguagugcuguguuauagaguugggacaggguguagugcuguguuauagaguugggacaggguuugcuauauuuagcccacauugaccuugacccuccugccucauuucuccugggauuaaaggcaugcugaccaccacauauaccuuuugguuuguaucuggucuugcacugcccgccguaagcaccacagaagcaggacuguguugcaguccccaguauguguaguaccuccagugccaggcaaauguaacaugaccacuacacuaaggcugcucagucuagccacucugcuauuguaggcucacugggcacauacugucaggcacccuguagagggcucacgcccacuuccucacaaaguccacuccuccaugcaggagccaaguauauagccauccugguuuugccaucaccacccaggaagaacgggguacgcagagaggaagguuagggugcugcgguaccuugcuguaaacauucaaacaguuugcuaaaugacucacugcuaagaaccugaggagcuccuguugguuuuacagggcagcuuaguagaacaggugccccuggaugagccacacgggagagaagagccugcugccuucaaagcgcuugcugggcacagcagcacucaauucaacacguucccuaaacuugccccauggcuggaaauaacucuagccagaaacccagcauugucugaggucacacaacuggagagcaaaggucuaccuggcucaaaaaaucaaggccuuuaccuccucauauauauuuugguaaaaucccaaaccccugagcaguggguaaagcgaucacagacuguggacagcugaucuaggcugaacaggggcuauuuaguccacacauuucccuucagaugcuaaggacagaacuuaagagcuuugcaaauacugggcucagguugcuacuacugagcuagcuguaccucagcccuacauaacaguuaaaguuuucauuaucugccaacugcgcagagucaggaaagcucaugacuucuggcuucucuggcaacaggggaauaacuacggacacucacucccaugccuggcuauuugugagcuacgcugcucacaguucaccucucaggcagcuucacucuugggcugcugcuguaagggguuaccugugugaccaccugaaggccccacuugcgagcagaggacaugaacaccuaugaucuuuggaggaagacugaaguacaccauuucuuaacucuucaggcugccuacuaaauacuguuucaucccagggucacaguucaagcuccgcugcucccagcuuuugggcuuacugggaaagaagcuugccucaguuugagugaugcagcagagacacacagaagaagccuguucuccgcaaagaucaaaguagacagacuacaggacaggucucugugaccaaucuacccaucccaacaccagcaaguuuggccccuggcaggcuacugaguugucagugcccgcccagccugcaccuggucccaccugagcaucaccuaccucaaccuuacagccacccuacaggcagaugcuuucacugucccuauuuuacagaugaggacacccagggcucagagacacugaaggaccugucaagaagacagcugcugagugguaaucugauaugaaugaggucucaguccagaggccacacuucaagaacuagcaauaggagguguguccccgcccaacacccgacccucucagacauuaggccugacaagaagcagggcugaaacaggcucccuccugccccucuggccaggaucccaccuugaucuucuguugguagauguugucauccucagcauacuccuuguacaggacugagaguuccagccgcucugacaccagaggauucugcacagcaaucugcagggaggcaggagacugaggaagccacgccuaacaccuacaaacggggugguggccauccagcagcacagcaaccccacaaaagcauagagugccuaaaguagacucagagacuugagagacucgagaggggagggcuucaaaacagacacuaggucucaggcccugacuaugcauccccaccacaaagcccucagcuacucccuccccaacuuucuucggcaccucaccucuugcugaauucgguccugcugagccauaauggcuucaucauaggccaaacaguuaacaccuagaaaaaggagaaaaaagaagugccaaccaaggguuccuauggggucuggcuaucucuauggcaggcagcuuuggcagaacaggucuggaaucuggaacccuaugccuuacaccccacuguguauucuuagcaaaguucuuccuucuuugaguucucauuuccucaucuuuuggagaaaguagcuaaguguggugucauuugggaggcugaggcaggaagaccacaagucuauauagcuaaucucuaaaaaaauaaaaguaaacaagggagcaauuacagaccagagcaggauuaagaagccuaggaguuagagaucagcucuggaaauauagcaagccuuuaucuuggaagaaaaaaaaaauagggcugggcuugagacccagugguaaagauauauuuguccugcaggugugaagcccuagcaaccucaagaaauaaguaaauauaaauauaaauaaauaaguaaaaugacaaguaaagaucacccccaaagcucucuugcagccccgauauuccuuccucccugccuucuaaaagcacuguguagcaucuagggaaugcucuggggaagggagcucugggagaaagcaggaugaagggguggagcccuaggaagaaugagugcauccuguaagcaugcacuuuacugagacacgcccuuuguccuucugugguccccuguauuguucauuuuccaaauuaaaaaacaaaaaacaaaaaccagagguaacuccaucuuguccaaggucaaguccacauuuguaaaauuccagucugagcucuuggacaugucacuugccaaaguccucuccccucaccucuagaauggauuaaugccaucaccuugcucccaucaucaaaauaugcugggauccugccagcagcaacuacuaccuaagcacucucuagagucauccacggauucgggacguucguucugaggacucuaagcagcuauuguaggaguuucuagucuuggauccuucuuagaugugauggagaacaauuucuuucugcguaucuggguuuccuaguccucaaccucuagaauauaguguggaguuagaguagggugugcgaguaugacuggcuuuuuaaagccaauccuuuggggccugguuauccuagguucucagcugagcuucccaccauguccuacaacaggacugucccucccacucaacagacuuacucaaccccuagagcucaaguucucgggagacagggagaaggugugacugguuucugucuuuuuuuaaagaccaagaaucuaggaaaacaaugccuggauccgcucaaaggugcuguaaggccagcacaagcucuaaggcaaagagccgccaauggcaucccgaacggcccagcagggacuucguccuuggaagcccggcguuccucaacgccuuucagcagcucggccccggccuaggccucggcuugacugcuaggucuccggcgggcugacugugggagccggccgaggccacgggaccggcggaggcggggcggcccaggccccgccccaggcgugcgcgagaggccgagccccggccccggccgccccgcccggccgggggucgccgcggcccugcuuccauugugagggggaggggaggagacgcggggaagggcucggucgcacgcugcgccuacuccccagggcccugacuccccgaguuccucgggaacggcgggccguggauugcccccgcuagcccgggaaggacauccuucccuccguucguaccuucggagucgcuacccaguggcuccugcuucugcugcugagguuccuccgccgccaucuuuaaacagcgccgcacuggcgaucgcuuccggguuauuaauugcccuccucccgga

SEQ ID NO: 9131 - RNA, 2477 nt, Mus musculus
cuuccggcucgggcguccggcaacuucagcgccggaacuuccggcugguucggccaucuugacucccugaccuuggacugguccucguccguggucguuccgcgccgucaugucuguccugacgccacugcugcugaggagccugaccggcucggcccggcggcucauggugccgcgggcucagguccacucgaagccggcgcgggagcagcucgggguccuggugagcgggacggaccgggagcggggaggugggcgaacugugguagccugcgacauuggcuuaggccuguccucaaggcauggaugagacagucgcucggcugcuccuaagcccuagguauuuuucccaaguuccuggaugucaggucagcccgcuaguuuguuuacucuguucggccucucuaaacccgucucuccuuccauuccccccccccccccaccgcaggggagggcaugccugguaacuggcagcgacgucaugguuguuacugcuacauuuuauuauuaaggagggcugcagaguucaccaggucuacauucccagagauguaggagcauuuagauacuaggacaauuuuuacuuuuaaaacauuaguuuaaaaacaugaggcagggucucuuguagcccaggcugaccacauuugacuuugaagcgauaaucucuuuagugcugggauaacaggccugugccaucacuugugguuuauguggugcuggggaucaagcccgggacuuuguguuaggcaagcacuuucuuaauacuacaccgcagccuaggcccccccaucccucccuuuuuuggagcucuucuguuuuaagugacaaugggucaugaauccagauaucugggcauugaauuagggguagaaccaaagcacugccacugaagaaacagugacaaccaagccaugcccucucuuacgcccauuuagugggagguugaggcaugaaaacagagcucgggaauucaggccagcuugggcaacauacugagacucugucucaaaaacaagagucugggggcuggaaagauggcguuuggugcauagccucaugaagacugguucagguuccagcacccauauaacaagcuuguaacuccagcuccaacgcaucugacaucccguccugaccuuggguaagcaugcaaacacauaccugugcucacacacaugcaucauacaaauauagauaaaacacaucuuuaaaagauacaaaaccccagcagggcaguguggcacacgccuauaauccagcacuuaugcuauagaagcuguggaucucugaguucaaggccagccuggucuacugagugaguuccaggacagccagggcuacacagagaaacccugucucuguguagacaacaaacaacaaaaacaaaaaaagagaagaaacuguauagaaagcaaggacacgugagaaugguuuauuuaagaaguauucgcuucaccagcaugaagauuugacauugacuacccaguaaccggcuagucuuuagcccuagugcugguagggggagaggggcagggagcucccuggauuccacuguucagcuugucuagccaaaacagugaacuucagguuuaguaaaaaaaaaccugucuccaaaaaaaaaagaaagaaagaaagaaagaaagaaaagauggagagcuguuagaugagaugccagacaucaagcucuggccuucacccacauggaaaacagcacacauacacaccagugagcauaguggcacuugaguguauuuccaggaccagggcaucaggaacaggagaaucucaaguuuaagcccaggucuggguggggugcauaguaagacuccugccugcacccuuuccccccacagauaaauacaucuuuuuaaaaaccaaagaccuuuauuucaaggcuggaaauggacuugacccaguguccccuccauccuuagagucucucugugucuguaucucccccucuccugugcuggggauugaaccucaggcccaaguugcuuucuuuagugugggucugcuggauuuucugccuuggucuuugccacugagggacuucccaugccuaaggacuaccugaacugggagugccuacagaauucuugcccugagggauccuucuuucuuguacucuguguaggauaucaccauugggcucacuuccugcuucguguguugucuucugccugcgggcuggguccugucacaccuggagagcuacaagaagcgggagugaagggagcagucuucccucauccuuugacuagaccacuuuugccagcccaccuugaucauguugccugcauuccuggcuggccuuccccgggaucauguuauucaauuccagucaccucuucugcaaucaugaccucucgaugucuccauggugacaacugggaccacauguauuggcucugcuugguggggucccccuuuguaacaauaaagucuauuuaaaccuugcuccagaaaugcaucau

SEQ ID NO: 9132 - RNA, 25614 nt, Mus musculus
auacauucaagguugcauuuauuuuuuaaaaauguugaaaaauaaacccaugucuguguaaguccccaacccuucuuucuccaaacuuuuggggguggacaaagugggucuccucacagcuacccaacauucuucccaccagauuucugccauccccaccccaauccccuuccacugcaccugacuuauugcuaaaaagaaggaaaggugaaugaggccagcuaacauccuguccucucccccaucccccaggcuaaagucauuacccccacacaaaggguaggcccagaggccaagcccucugcaggcaggcaggcaaggaggcagccauuccagucacagccaggaagcaagagucccugcaggcccugagaucuagccccuggcuggggguuuacaagcucagcugccaggaacacaugcagaacccacagguccaagcugugccaacuggcagcuuuggguauuugaaagaccuggcaagagcccuagucccuucuguccuuagugcugccagagagauccagccaaagggguucaggagccucugggcaauggaggauucaggcucaaagugagggugcagggggcuccaaaggagcuccaaccaggguagguggaggcugaggaccagggcgggcacuguggcgagaggcagccagggcagggcggaugagcggugguggaggcugguugggggccagccgaggcugcaggaagcggcccugcugcaggggaggcggcuggcggagcaaugugggagcugugggcagagguggccucagcagcggggguggcugggaaagcgaggugggcgguggaggugggggcggugcaggggguacugaucgggguacugauguugagacagauguaaucuggaccugaggggagagaaaaaggugaggagacugcuccugcacacacucauccuuagagacucaccuccucccuggagacucaucccugcuucucaccucaucaucuucuucuagggcuguggcugguacaggagccccucgccuggccucuuccguggggaccggagcugcgggggccccauccugcucagccucccauuccugcagcaccucuuccagguugaagcggcgacgauagcucacaaagaaggucuucacuugggucagagucuuguucccaaucaccucugcaauagccccaaagucuuugccguaucuacgaauagcuguaaaggucaaaaaaaaggcaucagacuguaaauauaccucagaacuguuugcuuccccuccaccuucagcuccuggaaagguuaaaggucucuaggguucuugggacucgccauggccugacccaccuugaacagcuagaaguugcucaucagugguccagcgggaguugaacuugguauuagccuggaaagcaaggaauauaaauaaccauuaaacuaaacuaaaaauaugaaaagggagggaggggauggagagaugguccagcagguaggagcacugacagcuccagcagacuaacaaccaucuaaaaccuaggguaucuggugcccucuucuggccuccaugagcagcgaguauguauguggggcacuuacaaagauauagagaaacacuaauacacgagacaaaagaaaaauagucucagcagauaaaggcuucugccacuaagccuguuuguggauccccaagauccacaacacaggcugggcaguauuggugaacgccuuuaaucccagcacuugggaggcagaggcaggcagauuucugaguuugaggccagccuggucuacaaagugaguuccaggacagccagggcuacacagagaaacccugucacaaaaaacagaacuccuccaaguuauucucugacccccacauaagcacuaaggcuccugucugucaccaccucaucccauccgaccccacugcacccaaguuaauaaaugugaaaagguguuuugggaaaaacguaugcuuccuaggccaacuccccuccccguuccggucuugccucugaggaaaccccccuuuuguacccaaguaaacagaagagccuuaccucaggggggcggagagggucaaugccgcccuccagugcuuggcggaggcugcuauuggucugcuucaugcucuggaccuacaaaggccaaaaaggcaagcagagcaugcaucccaugaaggccaguaccacccaacucacccaaguccuucccugaguagagcuuccaccaccccaccaccacccuguccacccaaccuugggacacugucaacucagccccggugguggcaggguuugguuugguuuuggucuuuuggguuuuuuuugaaggacccacagccucaaauuugcuauagagcagagacuggccuugaacuccuaauucuccuaccucugccucccaaguacuggauuacagugacuguacagcaccuggcuuuauauuugagaccaggucucgcuuggggcuugcagaagacagagggacaugacaggcagguaaaagugcuugccacaaaguccagagacuugaguuugauccucagaacaacuuauauaaaggcagaaaggaagaacuggauggggaccauggcacacaugcugauagacacaucauauauacaugcaugcauacacacaucaugcaugcaugcaccuggcauacccuuucuugccaccaauucugaccugaguuugauccccagcaccugccuacuagaaagagccaacucccacagauaccugacuucuacaccauggcaugugugagccccugccucccuccccccauaaacacauacaaaauaacaaaaaaaugagagaguguauucuuagauagcaauguauccccagauagccucaaauucacuauguagacaaggauggucuccuggguuuuuuguuuguuuguuuguuuguuuguuugagacaggguuucuccauguggcccuggcugucuguccuggaacucacucuguaguccagguuagccuggaacucugaaauccaccugccucugccuccggagugcugggauuaaaggcaugcaccaccacugcccgggcaaggauagucuucuauguuuaaugccuagaagagcuagagaguagcucaguggguaguguuugucuaguaugcacaguacccagcacuucaucaacaggacaugaugguaaugccuguaauaccagcccuuggaggguagaagaaagucaggaacucaagguuauccucuguuacagcacaaauuugagucuggccugggauauaugaaucccugaucccacuccaaaaaaaaaaaaaaaugccagggagcuggccagacaggcagguaaaagugcuugccaaaaagccugaagacuuguauuugauucccagaacucauguaaagguagagaaccacaggagcuguggcacgugugcaugcgcacgugcacacacacacacacacgcgcacgcgcacucgcacacgcacacgcacacacacgcacgcacacacgcacgcacacgcacgcgcacacgcacacacgcacacgcaaagcagaaaauaaugucaagucccugacaacggaacagagccaggcuugacacugcaccauuccccuuauaccuaagcugccccacacaggucucaggaaccgaugacccccucugcaugguucccuuuccuuggguccccaccuggcgcuuaagagagaugagcugugagucaagaccucggagugugagguuagcgaggucugggcuucccgauacugcagugaggccuucaggacucagguacaugcccuugggcggacgucuccgaguucgaagugggugguggcgauacugagauaucugaaccuccuucuucccaggaccaggccgugcauucagaggucuggauggcagaggcugaagggagagaauaucaugugcaguccaaggacaagcugaggggcgggcagggcagagcagcuagggaccucaccucucgcuuggggucuccaguauccgguucccccucacucacagcuccucgucccucuucuaguucaucacuguugacacagagccaaacagaaaaugagggaaggcccaacccagaauacugucagcccccuacccccuucccggugccagcaacccccacccccaccugucuucuuuguccuugcggccacccagccgccuggccugccuguccaucacacuaguucgacuucgggucuucuuccaagaguaguaauacuucaccaggcugggaaucaccuugucagggagcuggggaggcaaggccagagacaggaggccaccugagacucuggccccagguaagcuguuugggacuaaagggcugaggagcauucaaggggccaugagcauaggcguaccaucugcuggauccgcuggaagcacuugccauggaacccaaaggccuguucaaacagcaccuuguccuccaccguccacucaucagggaagggagugaaguuggcuaggucagccagugauuucuccacaucguguuuaugccacagaagcaugccgagugccugguccaggacagaagccacucagguucugccacggcagcacugcacugcccggugggccccacucccaucccucggggcccccacccaccugcucaauguuauagccaugcuucuccuuggccauugcaauguacuugucaacugcaggggggaagaggagggucacacggaagccccacaguaaagaccacucgugggccuacagcccccuaccagacuuccauguuagugggacuaacagcucacuucuuuuuuguuuuuuguuuuguuuuguuuuuucaagacaggguuucucuguauaguccuggcuguccuggaacucacuuuguagaccaggcuggccucgaucgaacucagaaauccgccugccucugccucccaagugcugggauuaaaggcgugcgccaccacugcccggcaacagcucacuucuaaggaagagcuagccuuaggaggacaggaacuaaaacccuguuccugagacugaacgugaccugggcccagcgcacucacguuuggcaucugauacacagugguugggggaccacaccagcauucccuucagcuccuuguugcuauagcgugcagggcucucugaaaggaugagcagaauuaggcacucacagaaacaggagaccacugagcaacacagucaagcgaggaggugaggcccagaagggaaggaggagcugagacccagacaggaaggcagagcaggaaaaguaacagugccacggggccacccaccccgcccaccgccugucccucaagcaggagccagccaagaguucccagguggggcuguaggccaagccaucagccuccaccccucccugccgcccucccucccuccaugucuguccugccacucaccaggcuugcacuccggaauuacugcuugguaauugguuccaacucggaucaugcugucuguggagccaggggaggcagucaagacuccagggaaguagggggaggauauagugaggggagguagcugaucuggaguucuccuuccugaccacucagggacccccaccauacaggagacucacuuuuccuugauagugccccccagcuacccuccgauagaagguacuaggagagucauacccugccuagucauggccauggggggaaggggagguuaagaggacacuuuuaaagcccaggcuagagcaaagugcuuuguucuaacugggggugggagcuuggagggcugccccuagaucuggaccacagccuugcagagagcucggggcuccuccccaccacaugagcuucacagcuccgcauagagguaucuucccaguaccugguccaaucagaccucaguccccugcaaggcugcaagguaugaggacccaauccauccaagagaggcauccuaagcucccucaacgacugagggcaaaggggagguggguggucaagggcccagccuguagauuuccugugccggcaacaccaggcacgagaaggcugagguugcaauccaggagcggcagaaaccaucugugguucgcaacucuccccccccccuccuccaccuuccaugaucccuccccggaccagcgcgccuuuaacccuaggccaccaggcucaccaugagagugcuccuccucgcugcugucauccuccgaguguggcuguccgccguugggugccgucuuggcccgacuucgggacaagaucccggagcccgcacugggcuucuccauuacugagggcauuacccuacccggcagccccgaggggcacgggauccuuuggagagcgcaggagcuugccgcgcuugccucgagugcugcgccuggcccggccuggaggggucgccacugaggcuacgagaggcaggaggucagcguggcuaggguccgggaggucggggccccggagggcagcccuaacgcucacugcgacccccacgggcgaggacggcagaaaaguuugugaaguggggguacgggggagacggcgcggccgggggcacgcucgcuccgugcgccccucggggcugguucucccccggggagagucggggcgcguugcccucggggagccccggagccgcgccgcgcgccugcccacgcuguuuggccagcaagggcuaccgcgcaguggccgccgcagcugacuccgcgccccucggcugcgcugaggaugccccgauccccaacggagguaacccugcccgacccgaccccacggcaaccacgccagccggcuggagccccggcggcaggacggcgcgcacggcgugcggcgcuggagcagaguugccgggaggcgggcggagcgcagccgcgggcgccgccucgcacccuccccggcgcgcucgcucgccccgccgcgcucgcgcuaccgccgcucgcucgcccgcucuccgccgccgcucgcuccucgcgcacacaaugaagcugcuggcagggaaguagugccggcugcggccucagcaccccucccccagccgaugccuccgccagcugaacaucuggcccuggggugggagggagggcccggggggcggggccuggggccggggcuagaccuccaggggguggggucaggaccggaauggggcgcacguaccccccccagggagcacccuuggugucucugaguucucagacuuggcccuuuuggguagaccccagugccccccaggagaagcccggggucagccccacccacaagcacaccgguuccacacacuacugggcucugguuacuguggccugccccgggggcccugaggccgccuguccgaccgcccggguggagcccagcuuuuccuuccauuucccuuccugccaaggaacucccugcccccccuuccgcagggggaucccccccuucaugcgcccuugggggccaaagcggaugggaggccggacaggcgcaagaugaauuucuauaagagccacugggcuagaaccugacuucugcuaggucuguggguccccaggggucacccuagugucuuucaacugcugcagucugcacccaaaacaguaguaucaaagauugaggaaugaguaugaaagguaauagggcaaguucugggcugaaaggggcgagcuccucacuggguucacugucaccccagcuggaagcagcauccccccuccccccggacaggcacaggcagagugacagacagggaagcggguugggaggcacagacggaguugggggagggggugggcagagacuuucaaagccagacccagccacccugccaggcacacaaagagccagcgcacucaccggcagcagcucgaagccugugagcugcgccugugcccguccccgccgccuggggcacgugcugcagcucacacaggccgaagcccccgcccgcugucccucccacggggagcccggacuccuggacacgccucuacccgggcacacccgcuaugcccagaucgagccgagccugcacgcgcacccuccucucccuucccuuccuuggccacucuguaaucagauuccuaaauuuagaagcagcccuggccccaaccggggaucccugccccuacccacuggcuguggccgaccggccuggguccuguggucaggccacgaccuggcuggggcauccuguuccugggggcucuuugccugcggcuggcagagucagacacgaccccgcccgacuucagcacuguccggccacauagggccacccagucagcggccacguugcccgccacaccuugggccaagguuauggggccuuuuuuccuccccuuaaaucaugagcugggcaccaagccucaggguggggagaucugggacaaagaaagaaagaaagaaagaaaaaaugaaccagaggcaaucugagcugaaggggucuguaccaagaggcaaagcgacuuccaguggccccuagaaaugaguggcagggagccagaccuguccccaauaccuguaccuuguagugaggugcuccuguuucuaucccuuugccuagcuagcaaccauugugcacaccacacucuccuaugauggcgucuuucuugcuucuggcacccauuaggcaaggcuucuauuggguccccccuccuccacuugccuccuuccauaggagaaccuaggaucccgggccaagaccccaagaccucaagcaucaagcuuaguucuuguuuccguccuccagggcugccccaggugugccagcacaaggccuaaagaggaucccaagccacaggcuucccuucugucuggaggccacuucucccacacacugggacccaauacugcucucacuuagcccuggagccaggcccccacccccgcccacacacaccaaaggaagagccugcucuagggugggggcaggguggggagauuuauuuauuuauuuauuuauuuuugagguaagagggcugucugagagcccugauauagugauccuucugccaaggagagacacaacacgggaggggcaucagaguuuaaggacaacugugggggccacagggugcagaaguggcugguuucgagugauguauuucacccucaagcugcaagggcgcaggagagaggcaaggucccaccccucccaccugcugcagccgcccccuccccagcuggcccccucuuuugugagaaggcacacaaaggacaaggggccccggccggucuggccaucugcuccuagcagccuggaggcucuuaaagagacagcucccccucccuugcggcccugggacugugggguguggcuaugccacagaacccaguccaggcuguaccccaggucccacccacucuaguuccccaaguccuaaggucaggaaucuucuucccucaggcgugggguucagaggugccauguggccagggaucugggguaugauaagggagagagccagccagagaccagccccuccucucaugcagccugaggaagcucagaagcaagcagcaagaagcucaccucccugaggccaccugcaagccuggcuagagcucaggucucccgggaaugcucucccgccauuuugacggaugagcuucuacucuuggcccacggggagggaaggcgaacacgacagcgcccuugccuucucuuagggaugggagccagggcccagacugccucacagcaaacccaagcccacagccaggcacauuuauccccugugcucuuccugaugagggauauggggccuugcuuggccuuauacaggucucugccugaagcuugccucucuugccuaggcuccugggcccucagauccccaggaaagucugcucucauccaggcaggucagagcaucucaucgauuuaccacuugguucacagacacaaaacaaacgugcuugauagcucgucauugucuucacggcuauguucuaagagucuagcauacagcaggcacucagcauuugcugaaagaaacagcagacuucaggagcucacugucuuuuccccuuagcugagcuccuaugugcuagaccugcugagcaucaugccuccucucucuucaaggugaggcagagggacaaggguugagcagggaugcugggaaagaaaaggaagggugaccuugggugagccaccgggccuccccuccucucaaaggcgggggcagcuccagccaaucccuaaucugccagcccugccagacagacugggacuguccggagcagaggcuggaggcuggcugcugugguguggugccugggacccucgccaggcccucaguggacacagccaaggggcuaaacuuggggagggcggcaggcugguaggccuaggguggaggaaggagagugggggacccaggcaaaaaaccugguagagcagugggggagaaagagaugcuccucuuucagaggagguggaugugggcggggccccagaguggaaggagccuugggaguucuuccuggccccuucaguguuccucagacaggaaugcuuccuucagagccuugugugcccccugggggcuuccugacaggcugggaacccaggguguuuccucccucucucugggcccuguuggugagcaacacucccuccagcaacacccacuccacccccacuugugcaaaaauauaauaaugagaggugacaauccaguguuuggcacaacuucaacucagaggccaagggggcucugggccaagccgaaguaguuaugaacucggagauuuggaccccagguuuccugauccccagggcagggccgggagauuugauaccuggagccaagcgucuggucuggagcacuaagggagaugggucugaaggucuugguugacagaaaagcgacagaggucucccagacuacauaagaggcagcuuccagcuccaguaaagcugcuugaguuccagaagguuuuuagaaguaaacggccccucacccucaccuggauaacagcugcgcccucuagcgguggcaguccagcccagacuuccccagggcaugugcccucccaaggaggcugaguauugcacccugaggauccaaguuccuggaccggggaccuggccauuggugcccagccaccuacccuggaccauaggagucacugaaccuuagauucauucccaguaagcccuucuccagagcuaccugugaaaggagaacaugcuaggccaaagcagggccaggagcucugaucuagggcgacucccagcugugcuccuugcuugcccgcucugacccucugcuccuccacuccuaaaagggaguaaguuuucaccccaucauuuauuaaagaggauccacuagcaucucagguggaauacagcaagcaaauccuucaauagugcuugucuuguagagccaagaucccacacagcaccccagcaggcagacgagaggcucacugcagcaugaaguagcccacacacugugaaccagcugaaggccauugccucuggucuaauggacccacagagggacuccuuguuccuccuuggugacaucagaccaucugcagcuuccuuguagacuuaccaacaauuccagauuccuaccucagugacccugcuagcccaucaugaacacauagcccuauacaauggcuuuaaugcuuccuccacuguggccugcuuccuuccauucaguaaccuuccaccgcucccuauugucucccugcaaagcuugcccagccugguacuagaaggcuuucuagccugugccuaaggggucuguccagccaaaggagucuguuaaccacccccagagcaucacccugcaaacaccagcccuagaggcagucccucaucaccagaagugccuuauggaugaugcucaguucucaucuacuucuucaggauucauccccugcaacccugacaucugccucauccuugccucuggaccccgggcaaacccuuguccccuuccucucuccagccucuuuugccauggccucccuaaagcuacugcugccccccucccgcaagcuaggcuucuugaaaugguuguucacaccuugcccucaccucccacucacuccccaacccaagcagugccaccacagaaacugccugccaaggucaccagcagugugguuaucucuaaugccaaagguguuaggcaggggucauuuugcccuggguacccuggacacgucuccgaagccucagugguuacccuuggggcuccaaguuucccaacucuccaggcuccgaugcuaccacucaggcuucaggcagccccagcacuguccucagcccagcccuagccccaggcucccucuagacugugaagcugacuaccaggaagucuucaccaucaacugccuucugugccucccuuauuuuugcucucagguucuaacucugcaaagcugcugcugacuccucccccacuguccagccucauccccaccuccuggccuccucucuagcucucuucuaaucugccccacaucugauuucuuucuuauguuuaugaguauuuugccugcauguuugucuguuacuaugugcaugcagugcccucagaugccagaagaaggcaucaguuccccuggaacuggaguuacagucgauugugaaccuccauaugugggugcugggaaucaaacccagguccucuggaagagcagccaguccacuaaaccacugagccauuuuuuagacucuguaaccuauuauugacagcccgagugauccuccuaaaacaugaccagauuaacucaguccccugcuucucauuauccuguccccaaaacaaaauagcaagcuggcucaguggguaaagguacuugccaccaagucugacgaccugaguucaguccccaagggagacccacaagguagaaaacaaaaagaaauccggauucuggcaaguuguccuccaauuuccacacucucaacauggcacacacgcaaagaguguuguguggggguuuuguuccuuuguuuuccaacuugacccaagcuguuguccucuaggaagagagaaccguggccuggagagauggcucagaggucgagagaacugucugcucucccagagguccugaguucaauucccagcaaccacaugguugcucacaaccaucuauaaugagaucuggugcccucucuggccugcagguguacaugcaggaagaauacuguagacauaguaaauaaaucuuaaaaaaagagggaaccaaaauggagaaaaugccaccaguauaucugugggggcauugucuuuuauuuuuauuuuuauuuuuuuaugucuuuuucaagacaggguuucucccuggcuguccuggaacucacucuguagaccaggcuggccucaaauucagaaaucugccugccucugccucccaagugcuaggauuaaaggcgugggccaccaccauccagcuaggggcauugucuugauuaaagguugacauggaagagcucagccacuguggguggccuaagaaagcaugcugagcaagccauagagaagcaauacaauaaucaacauuccugcuugguuucugcauaaguuccagccuugacuucuggcuugacuuucuucauuaaugggcugaauccugucagaugaaaugaacccuuuccucaccaaauuacccccagcaugcugucuuuauugcaacaaagaaaagugaauuuggacuuugcauaccccaggcugaucucuuguccugccucucuucaccccaaagugcuuuggauuacaaucagguaccacaaagccuguuucuuuuauguugguuagagcuuugugcaugcuaucuauguaagaacacucgcagcuacauaagaagucucccucaggcuugcuggcugacuuugauccucaggaagagcugaccagaagggacaggauggcucaguggauauauucacuuguuccuaagccugacaaccugagucugauccccagagcauacaugacggagaagagaaucaacucuuagaaacugucauuuggggcuggagauggcucagcaguuaagagcacugacugcucuuccgaagauccugaguucaaaucccagcaaccacaugauggcucacagcuacguuauacucauauauacauaaaauaaauaaaucuuuuuuaaaaaaagaaauugucauuugacugccacaugcauccugugacauucaugccuccaacacacacacacacacgcacgcacgcacgcacgcacgcacgcacgcgcacacacacacacacacacacacacacaaacaaaauagauguaaagaacauuuuuuaaaauggaaagaaaaccaacuggaaaaaugcaggcuguccucucagcuccucaggaagcugaggcaaaaagcacaaagcucaaggccaggcugggcuacagggcaaguucaaggggccagacugggcuacagggcaaguucaaggggccaggcugggauaggauccaggacuuagguccagcuugggcuacggagcaaaaaaacugucuuuaaaggugggaagggagugaugggucuggagagauggcucauuugguaaagugcucccuauauaagcauucagucucuagcaccuaagcaaccucaucaaaauuaauaaaaauuaaauuuaaaaaaguaaacaguuuuaaaagcuggauggugauggcacucaccuuuaauaucagcacuuggaagguagaggcagccgggcagugguggcgcaugucuuuaaucccagcacuugggaggcagaggcagacagauuucugaguuggaggccagccuggucuacagagugaguuucaggacagccaggggaaaaaaaagagcccuugggccaacuccagugaaucuacugcaccuaugagccuuucucucauuggccaauacauuuguuaauuuccauucucugccauucucugcuaucuaaaacuacagaaucagauguaacuguccacauugguccacuggcguuggccacagcaacccugccacucccagcauggagcccuuugugcucucuccaggcuccgugugugugugugugugugugugugugugugugugauguuggucccuguaaugcagccgacuaacaggucuuucaaauguagcucagguaucaccuugucuaguauaucugcccccucuccauuucaauaccacugaccuguucaccaugagcucagacagagagaagcugcuaucucucccaccugagcacccccaguuccucauagguuuccagggcaaguggcagaggguagauucucccauccaaguacucaccaggcccaacccugcuuagcuuccuagaugagacaagagugguauagauauagacaaaguacguucucaacacaggccugcugaggucucugcuuccccaggaaaucccucagcuucuaacugccugggacccuuuucaucccucagaccacacugcuagguuccuggucaccucaggcccaagguugccuuuguuccaccaacauaucaggagcugcuugaagccaaagacuugcaauaaucauagaaauaagaaugaacuugaagggccuauuaguuuuucacacuccauucccaggcccuaauuagcagaaguacacagcgggcacucaauaacuauuauugaauaaauuaguggaugaauaagcaagugaauugaauacuuauaaauaccaaccauugugugcagugggcauaccuggguuaucuugucugcuacucucccagaaacucuauuggaacaggugagaagcuggcugaggucuuaggucaccuacaggccacagacauuggcagaggcaaggaguugggagcugauaccaaggccagccagagcccuaggucauuuauucucucugucucugucugucucugucucucugucucugucucucucuuucugucucucucucucugucuuuguguguguguuuuucugucuuucucugauucuuugucuccuucuccgucuuucucucucagugucuuucuuucucuuuucuuguuuuguuuugaaacaaaguuucaaguagcucaagccagcuugaacucccuguauagcaaagacugggacuaucuuccccucccucucucucucccuccuccucccucccccccccccuucuugaaacaggauuucucuguguagcccuguagaucagucuggccucagacucagagcauguuaaucccaaacugggauuaaagaugugugacacccacgaaggaggcugagacucuuuuagaaacaaaaacacaacuggacuauaacaagaaaucugcuugccuccgccucccaggugcugggauuaaaggcaugcgccaccaucgccuggcucaggcagugcuuuuaaagcacccagacaagcucugccugaugguauaagccuuuacuuccagcacuugggaggcagagacagggugguaucuuugcauuuuagaccaucuuugucaacauaguuaaauucuaggacauccugggcuacauagaaaaacccugucucaaagaaaaccaagccuugcuggggagucgugacuucugccuuuaauccuagcacucaggaggcagaguuggguggaucucugcaaguuugagaccagccuggucuacagagcaagcuccaagauaguacggggauacagagaaacccugucuggaaaaaccaaaaguaaccaaacaaacaaacaaaaaccacagacaaaacagccugucucuaaagacgccaucuucugcggugcugggaauuaggacuucagugcagggauuuuuuuuuuuuuaaagaauuauuuauuuauuuuauguguaugaguagauuucuucagacacaacagaagagggcaucagaucccauuacagauagcuuugaaccaccaugugguugcugggaauugaacucaagagcagucaguguucuuaaccucugagccaucucuccagccucucagugcagggaucuugaagaagacagagcucagcuccugaagucccugauguccccuuuaaaguaacugucuuucugugccucauuuguacugugucuggccucuuuccuuccaucugccucccugccaucccaucucaugccgguggcagacacuccuaaacccuccuggcagccuuucuugcugaagcaagcugcagagcacaauccccaucagcagucuccgggccgugugccaggcaauggccucuggcuaagacugugcagugcaggagaggaggugagacuggggagaagaagggcagggcgggaagcauuuguuaacugaaugacuaggccacaccuauaaacaucccuugucccuuaguuugccuaucugugcuggguuaccugccucggcaggcucacuguagaucaagacaaucuuucaccucuaggccauggcugugggucuuaaggaaccuucuccugaucauacuacaaccaacagacaggcaguacugcacagaagaugcugugugucagggugugggcaugggcauuguuguggacccccaauuacaacacuuccuccugccugugguuuaaauggguuccuuccaaaauccugguguuggagcuaguaauuuuagcucaguugaaagagagagauucguaaagucccaagcuugauguccaccacugcacaaaacuagacaugguagguggcuagagcgauggcuccaugguuaagagcauugacugcucuuccagagguccugaauuuaauucccagcgacuauaugguggcucacaaccaucuguaauggggucugaugcccucuucugguaugucugaagauagugacaguguauucacaugcauaaaauaaauaaaucuuaaaaaaaaaaaaaaagaguuugaaccagucauggugacucaugcuuuuauuagucccaggacucgggaggcaaaggcaggugggucucuaugaguuugaagccagccuggucuacauaguaaguuccacgacagccagggauauguagagaauaaaucaaucaaucagucaaucaaucaaucaaucaaucagauguggucuuauguagaccaggcuggucccaaaucuaucaauucaauauguagccaaggaugaccuuuaacuccuuauuguccccgucccugccucccagauaggauuacaggcaugagaugcugccauucugaguaggguguguguucauuuguuuacuuaguuuuuacuggagguggggccuaccaugccaagccuuuuggcagucuaccauugagcaccuccauguuagagauagggucuucuuguuguuuaaaaaaguauugcuucagugggccgugguggcgcacucgggaggcagaagcaggaagauuucugaguuugaggccagccuggucuacaaagugaguuccaggacagccagggugacacagagaaacccugucucgaaaaaccaaccaaccaaacaaacaaaguauugcuucagccagggugauggauaaugucuguuauuccagcaguuaggaggcagaggcaggcagaucucugagucuaagcgcagccugaucuauacagaauaagauccaagacagccaggguacacggagaaaccccauccuggguagauggggacuauuguucuaugucaaugagggcaguuagccuugaauucucaauccucuggucuuaaccucacaaggguugggauuuuaggcauaugccacuguccuuguuagguuccuguugugauaaaaacacgaccaaaagcaaauuggagaggaaagggcucauuucuucucacagcucccagguugacuccaucacugaggagagucagagcaggaacucaaaguaggauccuagacgcagaaacugcagcagaggccauaaaggaacauuucuuauugguuuguuguucaugacuugcucaaucugcuuucuuauacaacccaggaccaccacgguggguggugcuacccacaguggccugggcucccccaggccaaucaagaaaauugccccauagacaugucuaugggucagacugauggaaguaauuccccaauugauaguccuucuuccuagaugauguuagcuuaugucaaguuggcaaaaaaacaaaccaacaaaccuaaccagcagaacuaucacaccuagcuuguagaucuggucuauuuagaagcaaaacuaacuaaauggggguccuugguaaagauauagagccagugugaugacucagcaggcaaagguacuugccacaaagccugacaguccaaguucaauccuagggcccaaguccgggaaagagagaaccaacuucuacaaguuauccucuggucuuuaaccuauacuauggcacaugcccuccuaaucugaacagauagauagauagauagauagauagauagauagauagauagauagauagauaguaagauagauagauagauagauuucagagagaggugguggcagcgugggugccaggcuguuuggaaacauggaaccacuggcuucagggugggaaaucagucugagauucgggaaagccggagcugguuucagggguccccaggccuaugacgagaggggucucagacucuugcacaucuaggugcugcugggaguugcaaaagagccaagaacgaagucaggggcccuccggcuggggacauugucuagcccaggacagggggaaagaggagcucuggcuugucccaguuaugagugucuuagcuuggcagaggcagacuugguggcaguuguggcugggagcacagagaggccuucuaugagagaauuaagcagcggcucuguaguccaaugcuuucuccauggcuccccacagcaaauauugaugaaagagacaguccuggguucuaaacaguuuauugguuguucauggcagaaaauggaugcaugcucagugguuaagagcacugacugcucuuccaaagguccugaguucaaaugccagcaaccaccugguggcucacaaccauccguaaugagaucugacacccucuccuggugugucugaagacagcuacaauguauuuacauauaaaaauaaauaguaaauaaaucuuuuuaaaaaaagaagaaaaaggaaauggaugcauaacguaccauacccacuuuucaggguggaccugagauuaaauaccuuuuacaggaaggaaugucugggaagggaagcuuauuggcuaagcccuaggggccucuagguaccucauuagcauguagaacucugcuuugggccuaugugaccauaggacucauuucuuuuaugugaggaacaugguacauguuccaggccaggagucugccacgggguggggagucagcuaagccucagaugugugcccacagagucucagggucucaaccugcucuaccuuaccaaacuuccuggagugguuuuaccaucccacagagcaggacagugccucuuuucacacuccugacgccacaaucccagaacuggaagacaaugaguuucugugguuuaaguccacuggugugugcuguuuggcucuugccagcugaccuaacaacccaaugcaaagggugauggucucuccagaguuagcuggacagagaacuaaacgggccauucuaggacuuagaaggcagaugcaggaacacccagaaggucaaguucauccucuguuacauagacaguuugaguccagccuaggauacaggaggcccugucuccuaaacaugugcuucugcgauugcucauuccauaaagauucuuuguauauaugccuuacaaucuggacugaacucuugggaucccaaauuuauuugcuaacccccacauguguacagugcacuggugccugcacacacacaaaugauaacaacaacaauaauaaaaaacaaaagcaaaagguacaggaacaugguuuugguggugaacagcuuuaauuccagcacuuggcagaggcauguggauuccugugaguuccagcccagucugggcuacacagugagaucuugucucacuauacaucaaauaaauaaauaaauaaaugauuacuuaauuuuaaaaaguuaaaagggucucagacugggacuucucccucuuggcucacguugggaagaggcugccccugccucuagccuugguuuccauccaugaaaagggaguauaaagcugggugguacacgccuuuaauccaagcaugugggccacagaggcagagggauuucagaguucaaagccugccuggucuacagagugaguuccaggacagccagggcuaagaagagaaacccugucucaaaacaccgaaaggaaggaaggaaggaaggaaggaaggaaggaaggagagauuaaacacugcaugguugcuacagucaccauauaaaguaucccgccagaagaaucaugugcugaaggcuuuguccccagugcuagcacugagagguuucugggucacugaugcgugacuccacugaugagcuccaggcugaguggguauuacaggaggggcuaggguggaggaagggaucuuuuccgaggccuuugaaggguauauuuugucccuggcuuucauucguucuccaccuccucuucucuucuccucuccccucuuuucuucuuccuagccaccaugagaugaacauguuccuuccccagccaccccugcugccaccaugauguucugccucacaaaagccuaaaagucagccaggcgugguggcgcacgccuuuaaucccagcacucgggaggcagaggcagguggauuucugaguuugaggccagccuggucuacagagugaguuccaggacagccagggcuacacagagaaacccugucucgaaaaaacaacaacaaaaaaaaagccuaaaagccauggagccagccaaccgugaggagacccaugacacuauaagccaaaacaaauucuuccuagcuucacucguuucccucaguauuuugucacagugacaaaggcagcgacuaacaguguaacaccuuccagacgcuggagacugcuguccuguaauucaguugcuacuuaugccuccugagcacccuagugccaggagcagagccugaggaacucacaguuaagaaccagcagggaguucaucccuggggacagaagccaggcggggcguaugguagguuacucaucuacuucauucccagcucucuuucacuuguuuguuuguuagcuuuguguguuugaguguuuugucugcauaugugucuguguguguacuuagcacgugcagugaccacaaaggccagaagaggacaugggauucucuggggcuuagaguuacagauggucaugaggugcugggaauccagccccaguccuuugggagagcagucagcauucuuagucacuuuuucuccuuuucuuuuucuuuuuuuuuuuuuuuuuuuuuuuuuuuuuuuuaagauuuauuuauuuauuauauguaaguacacuguagcugucuucagacacuccagaagagggcaucagaucuuguuacagaugguugugagccaccaugugguugcugggauuugaacuccagaccuucagaagagcagucgggugcucuuacccacugagccaucucaccagccccccuuuucuuuuucuaagauuuauuuauuuaauguauaugagugcucuaucugcacuuacaccugcgugccagaagagggcauaagaucccauaauagaugguugugaaccaccaugugggugcugagaauugaacucaggggcuauuggagagcagccagugcucuuaaucacugagccaucucuccagucccuuaaucacuucuuauauugacacagucucacuauggucuuaaauuuauuuucuuuuuuguuuucuuuuauuuucuccccaccuuuuuucuuuucuuuuuuuacuuuuauuuauuuuauguaugugaguacacugucacuuucucagacacacaagaagaggacauugaaucccauuacagaugguugugagccaccaugugguuucugagaauugaacucaggacaucuggaagaacagucagugcucuuaggcacugagccaucucuccagccuccuuuuuucuuuucuuuuccuucucuuuuaaagauuuauuuauuuuuauuugaugugcauugguguuuugcccccguguauguuggaaggggccggauucccuagaauugaagagacagacaguugugagcugcaaugugggugcugagaacugaacccagguccucuggaagagcagccagagcucuuaaccacugagccaucucuccagcuucccucuuuuucuuuucuuuaaauuuuauuuauuuaauacuuuuuguuguuguuuuuaagaugagauuucucuguguaggcuuggaacucacucgguagaccaggcuggucucaaacucagaaauuucccugccucugccucccaggcaagaggauuaaagacaugcagcaccaugccuggcuuuguuuuguuuuuaaacagguuugauucauuguguuuuucucuuauaaagcuacuuauguagccacugccuaagccuggauccuuugcacggagacucugguucauaguacuacaaggugagcaccgaauucucgauaaggagccuuggggaacacagccacuuuccugaggucagcaggcagauagcuguaguuuuggaguuggcaucaaagguggccuuggugaaguuguccaugguggcaguguagcuagcaccuggcugaucuguagccaucaucaaugucagccaggaccagcagccucuuaggcaccagagcugagacaaugccugugccuacgagggcagagaugagacacagcaccagagccacaacagucugucugucacuuugcaugaggaaguuggagccuugcauggguaauuaaucucucuacacagagaccauggaaaguuggguaagauggucuccaggugacacuggcugccuucuuacaguuaaaaaucugaccaacuagcuagccagugguggcgaacaccuuugauccuagcacuugggaggcaggggcagguggauuucugaguucgagaccagccuggucuacagagugaguuccaagacgcagaaaaaaccugucucaaaaaacaaaccaaaacaaaaaaaaucugacccacaagccugguagagucugcaaugcaaacaaaaagcuuuaaccuggagcugcagugauaguucaguaguuaagaucucauauugcucuuccggaggacccaaguucaagucccaccuguaacuccacuccaggggaucugacaucuauagccuccaagaacuccagugcucacaugcacagagagacagcacagacagacacacacacacacgauuaaaaauaaaaucuaaugccagggggcuggugagauggcucaguggguaagagcacccgacugcucuucugaagguccugagaucaaaucccagcaaccacaugguggcucacaaccaucugugagaucugacgcccucuucuggagugucugaagacagcuacaguguacuuacauauaauaaauaaauaaauauuuuuuuaaaaaaaucuaaugccaggcggugguggcacaugccuuuaaucccagcacuugggaggcagaggcaggcagauuucugaguucgaggacagccuggucuacagagugaguuccaggacagccaggacuacacagagaaaccaugucucgaaaaaccaaaaauaaauaaauaaauaaauaaauaaauaaauaaauaaauaaauaaaaucuaaaaaccaagccugacuuuggcccgcuggcccaucugaucacaccuuauccuugagcuggagagaaggcucggcaguuagaaccaugugcugccugccggggcuggguucccagcauccgcaucaggcaccucccguuccaggggauccaacacucucugaccaccacagggcuccugcacacaaacacgagcaaacauaauaaauuaauaaauccuuuauuuuacuuuuuuguaaagauuuuaacuuuuaaacuauguguauguguguuuguagaugcacaugaguguggguacucaaagaagacagacucaucugaucaucuggaacuggaguugcugggcuggagagauggcucagcaguuaagagcacugacuguucuuccagaagucuugaguucaauuccuagcaaccacaugguggcucacaaccacuggugaugagaucugacgcccucuucuagugugucugaaggacgccuccaguguacuuauauaaguaaaucuuuaaaaaaaccaaaagccagccacaacaucuaauauggguguugggaacuaaacucagguccucuggaagagcaucaccagcucuuagucacagagucuccaacuguaaacaaaacucaaucuuaagggauacucccaggccucucuuccuuagugaggaaggggaaagguagauuuccuccacaccuugucuuuacuugcucugcccuagccaggcuugguccuggguugcuguaauuuauuugugugugugugugagagagagagagaugcauaugggcuaaaagugugcauguggaggucagcgggcaacuuucagaaauugguucuccucccacccaccauggguucuuggauugaccuugagccacaagcacucuugcccuccuacucaccucucugguccuugguuuugacuuuugagauagggucucaug

SEQ ID NO: 9133 - RNA, 6873 nt, Mus musculus
uauaccaagagcauucuggguaguagagaacagaaaaacugcucuguaguuccuuguaggaagcucccccucagacuccuugagauauguuaacuuggagaacaccuccauucccuaucauucuguuguaacaagucuucaaagagcugcuugcuuucuucagccacaguagaugccuccuugacugugaguaccagcagaccacgcaacugaagcuaucagugugguuuacucauccaguuucugugcuacaucccauagcagagacgagcaggagaucuagcagugagaggugccugcaggccacaaagccucacagcagcggucagagccugccugccugggaagaguaggcagcaugaagugagucagagccucuucaucccuuucaugccugauagcuauaacgaccaauaauccucagccucuagucuucagggucacuagagauaauagauuccucucagugcacuaggaauucuacuguguacccagagcacacacaaguuucuagucccaucucaucucugaaucuguucauuugucucgugggcuacugguacucagaaagccauuauaaaacgucaacccaucugcauaaguccacugagcuugggcaccugucuucuugaaucaaagugagaagguaccuagacucugccuaacuguauauaagaaguggcacgagaacaggcaggucucaggagcaagccaaaucucugcuacugacuaggcugaccaugccaaagcaggguuauggugagucuucuaaauuggaaccuaaagaaggaugcccuuuucacaggcucaagagaauauccacacuuaucacaguacuggguuuucaguaaugccuugguaauguuuucuuuucuuucuuuuuuuuucaagacaggguuucucuguguagcccuggcuguccuggaacucacucuguagaccaggcuggccucgaacucagaaauccgccugccucugccacccgagugcugggauuaaaggcgugcgccaccacugcucagcucuuggcaauguuuuugguuaucucuuuuuacuuguuucccacucauaggaaguagauggguauuaccagugcagcuggacugcaggggcuuccucucacgcucacccccuuuucuuuguuucugauauauucucuggacucugggcuuccaugacuaguucuacugcuguguagagaccuaucaucuucaagaacuugacugcaaauaucacuguagcugagcugauucacacuacccuugaauuccuucuagaacaaggaaaagucaaaucccugcuauagcaacacuauuaggcagaagacucuuucaagaagccacuuuccaacaggcauuuaagagagagggcagccacacugcugcccacuguauagugcaaaggaaaauuaagguggucucuccaggguacuucccuuccuguuagugacuuaacuccuuccuuccagaaacagucaagcagccaacauaccaguaccacauggugccaagggcuggggaaagcucacauugccagccuugcacuucauuuggcuccuccuauaccaguggguuacuguaaccauggagaccagugaguucuuccauaucacaggagagccaggcugccagcagccuaggcuuuggaggauaggggugggagugaagcaggaggcagccagcuacagaaaggcuugacucacuugacagggaacccuggaaguagauggguauuaccagugcagcuggagugcaggggcuuccucuuaggcucacccccuuuucuuugaauagagguuuguuucugauauauugucuggacacuaggcuuccaugaccaguucuacugcuggguagugggagacugccacugaaguuugacuugcagugggacuacuuuggcugucucauagguaacacagauguacacauacuacauggaaggaagggcuccaucuaguaucccguacucuccuuuaggcaauccaggaaggagguucugcuccccuguuagucucaaaguuugauaccuuuauagcuaggagcuauucccuucucuggacuucaacagcacaugacuuauaucaucucuuuuuguguccccaauaucuuaauucccuucaaacucugauggugucuugcucaccuucaugugagcaauagagcccacaccuaacuaguucauguacuugugaaaagaagaugcaauuucacugggcguugugucgaaugucuuuaaucccagcacucaggaggcagaggcaggcagauuucugaguuccaggacagccagggcuauacagagaaaccccgucucgaaaaacaaaaacaaaaacaaaaaaaaaaaaaaaaacgccauuuccuccuuuucaaaacauuugguuaauuuagugucuaucaaaaggagggauuuugguuugucuuauuuguagcccagaaugcuuagcacaguuuucaguaaaauacuaaauaaaugugcagggugaagaagaaaaugugaauguguugggggcuggagaaauggccuggcaguuaagaguacuaguccgguggugauggcuaacaccuuuaaucacucaggaagcaaggcaggcagaucucuggucugaauuccaagacagccagaacuacauggagaaaccuuguuucaguggcugguggaaagagaaacacuugcugcucuugcagaggacacagguuugguucucagcacccacaucagguugcccacaacugccugccacuccaguuugggggaaucucauguccucuucugaccuuuuugggcaccugcauacauauggugcacauauagauauguagagacacacagcuauaacuaaauaauauaaaaaaaaaauuuaagaugggcgugguggcgcacgccuuuaaucccagcacucaggaggcagaggcagguggauuucugaguucaaggccagccuggucuacaaagugagcuccaggacagccagggcuacacagagaaacccugucucgaaaaaccaaaaaaagaaaaaaaaauuuuuuuuaaaggcagacaagugugguggcauaugucuuuaauacccuaagcuacauuuggcauucagguucaccaagcagggcuaccugucucaaaaaggaggaggaagagaggaaggggguuggggggcaaagaaagaaaggagacauguugggagugaacaggaacguaacucuuguuagaaagcuugcucagcuauucaaagcccuggaugacacucaaagcacaguauaaaacuggacacagugucauauuccuuagcacuaggguggaagcaucagaauuucaagguuuuccuccacuacauagaaaguucaagaccagccuggacuagaugagaucuuaucucagagacaaagaaagaaaagauguuggggaguuguguguaguaauauucacuuguaaucacaucauccagaggcaggagaacugccaugaguuccaggcuaccuugauuacugugaauucuagguagccaaguuuuaccuaucaagagcuuguccuaagaacaacaaaacagcaaaaaccaagugaggugguguaguggcucagagggucaaaguguuugcuaucccagcccugccuaucuaaacaccaucuuccagaacccauguggaagccaggcaugauggugugcaucuauauucccaauaucccuauagagagaugugagacagagacaggaaaacggccagggaggcuuaugggcuagcuagccugcugucugccauaggagaaacaauaaagugcuugucuagcauacaaaaaggccauggguucaauaccagcacuguaaaaacgagauuguagacaacuauaaaacuuuccucagaaaguggaaguaggacucugaguucaagguaauuuccuguagacagggcaaguucauggucaaccuacaauacuugacucaaaaaaagggaagaguugaaaugucuucagaucauguucccagcuuacaaccaagugggcucuugcccaucagucacuaauagaaacuggagaucauagacagcuagggaucagcaagguggcauaucucaucugcuuacuucuuggcucccuguuuccucaaagggggaaucuccugccucucguggcaaucaggccucccacuuuagacagcucuucucucugccuuccuacauucagucccuccugguuugcuaggaaaacagcauguguugcagagaaugaaauucaaugugaacuauuucaaaaagcuccugaucagagaagugacaauuacugcauaaagacugcaggagacauucguaucugcuacauuuacugcuugaacuggggcucugguugguuacaggcccugucaaccuuaggauacucccaaauugcucugucccacuacacagagcugcguucccacccugccccucccagaaugccuccugcuacagugaggcagcaugaacuaaacacagcagcgauggcggcggggagcucagugacucacccagcacaccaucuccucccaggaucucccggcuccuccuggggcuuugccaaagcaaagcaacaaagaagcaugagauuuuuaagaaauaaaaauaaaaaauaaaaaccaaaaaacuaccucagcauuuaugcaacugauauggacuuaacccuuugcucugacuugccuaauguggcauccuuauggagguugccuaggaguucagccagccccaggccaggaagcaggcuuccaggucuuacccaauuccagaagcugcuggaaagugcugaacaaaagucaugucucuuuuccacuucaccuuuuccuacaagaauaaaaacuacugccuccuauccuucaaguucacagagggagcugaagaagcaagacagaggaaaaccaccaggcccguucacugcccuacaaguuacuguggccagaggucagccagaggaggagguuucagaaaccacccagggcuguuacuaaucuggccucacaacugccuccaucagaccagacuuuccacagugugacuacucccuugaagugacuguuaaacauuuaaccaguugcucuguccagaaaccaggcucacuugcccuaauaggcagaggugcuacaugcccaucuucuguagacagccaacuagaaugggagaaaaccugagccauggaagggggggggggucugucagaccacagaguaaauccacugcauuggcuauccugggcacaccugcuacucaggaccaucacaguccaguacagcuuucagcaagcacccugugaaaaagaggggguguccuuucauuuuuauuguuuggcaucugggacuuuauauguaugcuagcuucugggacuaacuaaagaaaacacucaggcaggcauaaugggcuacagugcguuccuccaaaaauuccccacucauccuaaguucccuucuaggagcuggggugggguuugggaugagcucagugguguacugguucuaccaugagccuaaugaugggccccuguccagcagugcuaaaguucccucugagaaacccuuaccaacaguagcuauucucuuaggaccccacugaugggccacugcucucuggguaccauacacacaguaccuuaaucuucuaaaucuuggugacagugugacacagaggacuugaauaaggauccuucaaaaccuccuggcauggcuggggcuugcagugaaauaggagagacugacugaagagacaggaacccaaauagaaaccagcauuuuuaaugucugcugccucacagaagagaagagcuauugcaagaggaacagggaagaaaauguccaacuagagggagggaagugagccucugacagugucuugauacauuuggggccaauauaagaauagcuggcuucccuauagcauaaucaaagcaagggggaugugucuaucugccauccuggacugaagguaaacauugcuguacccuaaguagccacaguuaaaacagguaucuuaggcaggcugguugucagcaguuaggugaagacuggaaaguugaagccucccaguaagacucaggcccucagcuucucacucuagaccuagagucagaggggugggcaacuauucaauuacugacaguaauggccauuuuguuucuagagaggcccuagcugcaaguacuuucagccagggguuacaguguacaauacagaucacagucaucuuuuacuacgugugucuuuucagagucccaggaagacaauaugacuauuucagcuuccaagagaagugaaugaugcagggaagagccaauucagccagguggcagcaaucuggcucugggcuuccuggccucugacagggacgugcaggacgacccuuggagagaaaugggucacuucugcgucuuguuagauggaccguuacacagacugagaggacgcugauugcugaaggaggcagccagccaagucuguagcuacccaccucugaauuuauugaagacagggaagaaaagaaccccaagagaggaaugugaaugccauauucuaaaaggaaguucuaauuggcaaugagcauggaaaacuuaccuggaauuacaaucaagcugggcacaagaguacuacugucccguccuauuccucuaccuaguccaugcuacucaucaaagacaaagagucuggcaggaauaaagaagcugcuaaacacaagucuuaauaaacgguaaaaucagcagugguggcgcacaccuuuaauccuaguacuugggaggcagaggcaggcggauuucugaguuugaggcaagccuggucuacacagugagcuccaggacagccagggcuacacagagacccuuaucucaaaaaaccaaagaagaaaagaagaagaaaagaaagaaaga

SEQ ID NO: 9134 - RNA, 1027 nt, Mus musculus
cggaccggacagggaagggcccucuggggcugcagaugccggcccagggaagcgccuggggaccgggaaccggggaccgggaccuggagaucuagucccggaccaccaagcggaagugagguguccccccccucaccucggagcaucggcucgggccgcgggaucacggccaccaccacggccucgucgucaucauccccuuccucacacuugagcgucaccucgaagcaauccagagccgcggcgcccuuggcuuucagggccauggcgaggcgaagaagggcgaccggauagccgaggacguucgcacagaccucggcgcaccgccuguggcggccgccuccugccccggaccaccccgggcccgcggcucgccuagcucacccgccgcucgcccggccgccccgccagccacgggcuucaacgcgucacgaccccgggcggggaggguucgauccggggcccccaaccccgccgcucccuuuuauggaggcucauugucagcguccguccggcagucccgccuccagaccaggcuggccaaucacgugaggacacgcccccuagccccgccccagccacaggucugggccagaacccugugcagcgcguuugucucuggccgguuugcucggcggcgaagccuggaguuuuccugggagcggcgccggcagccuuggagacccgguagggcauccccaccaauggcuggaggaaagggcugcucggcaucuuacuucuuggcuuuccccugacuagcugccugccugggaggcaacacagacgagaaaagaccgguggggaugugugaaggauacauaggcucagaaguguggagacaucucuucuaauuucuuugggccucguuccuuucuacuagcacauacgcuuuagggaaagaaaaaucacuuuggauccuccuaaacaaagauucuagaagaugaagaggacaagaguggcgugugggcguguguaaaccgcuuccgauggauauaauuuacguuaaaaacaaaacaaaacaaaaaac

SEQ ID NO: 9135 - RNA, 1713 nt, Mus musculus
aguaaauuuuacaaaguguauaaagaaucuguucucuacaauaacaaaaaccaaaggcuacaagagcaguuguauauacaaaacacgaagauauugcuucacuugcagacagguuccugaccagacacggagacgagacagagaaguggggaugggcagaggagagcgcugcgugcagaggaggagggagagggggcaagggugucuucucccagcauaaaucuacaggcacgagcaggagugcgcaggccugggaaugcuggaggccgugcuggcacuggcuauggugguguaggcaggaggcagagcccagaauguccaccugcucagccucugaugccuggcucuucggguaucagcucagagagaguuugggaugaggauacagggccagcuggucaacuggccagagaggaaaggcgguuucgaucccuggagucuggaaaacaggagaagcaggcuccuuccacucaucuuccucaccucuggcuggcccuguccauccuaccaaccucccuauccugucaagaugcccacaauauccaagagcagguacauaagcaaggggcuuuuagcuucucuugagcaggcaggacaggagaggccacuggacuccugcucuuccugggccauugggcuggcaggcggagcucacuuggagggugggagcagccuguccuagagggacaagggaggggccgggaggacacuggugaagggcuggccaaggaucgaggacgugcacgcacgcugggucaaagugcagggcaagccgggcagugguggcgcacgccuuuaaucccagcacuugggaggcagaggcagguggauuucugaguucgaggccagccugguugacagagugagucccaggacugccagggcuacacagagaaacccugucucgaaaaaccaaaaaaaaaccaagaaaaacaaaacaaaccaaaccaaaaacaaaagaaaaagaaagugcagggcagucacaggcucuggcagcacugcagcuuguugggucucuguccaucggugguggguggcacacugauguccaccacguuguugccaggggacucaucgugggcugcacggucagcgauuugcuucugugacacaauacgguagauuucugugaggauguucuugaaugcuuccucuacauugguggaauccaaggcugaggucucaaugaaggacaaguuguucuuuucugcaaaggcacgggccucaucagugggcacagcccgaagguggcgcaggucacucuuguugcccaccagcaugaugacaauguugcuaucugcaugaucccgcagcuccuucagccagcgcuccacguucucauaugucaagugcuuggcaaugucauauaccagcagugcacccacugcaccacgguaguacgcagagguaauggcacgguagcgcuccuggccagcagugucccagaucugagccuugauggucuugccguccaccugaaugcugugaguggcgaacuccacuccgaugguacucuugcucucuagguugaauucguuucuggugaagcgugacagcagguugcucuuaccuacaccugaguccccaauaagcaccacuuugaauagguaaucguacucgucgucccggguccccauuguccuggcgcuuccggcgggaucggcgacuccgcagccccaccacaaacaccugucgggggcggaaccggcgccg

SEQ ID NO: 9136 - RNA, 1713 nt, Mus musculus
cggcgccgguuccgcccccgacagguguuugugguggggcugcggagucgccgaucccgccggaagcgccaggacaauggggacccgggacgacgaguacgauuaccuauucaaaguggugcuuauuggggacucagguguagguaagagcaaccugcugucacgcuucaccagaaacgaauucaaccuagagagcaagaguaccaucggaguggaguucgccacucacagcauucagguggacggcaagaccaucaaggcucagaucugggacacugcuggccaggagcgcuaccgugccauuaccucugcguacuaccguggugcagugggugcacugcugguauaugacauugccaagcacuugacauaugagaacguggagcgcuggcugaaggagcugcgggaucaugcagauagcaacauugucaucaugcuggugggcaacaagagugaccugcgccaccuucgggcugugcccacugaugaggcccgugccuuugcagaaaagaacaacuuguccuucauugagaccucagccuuggauuccaccaauguagaggaagcauucaagaacauccucacagaaaucuaccguauugugucacagaagcaaaucgcugaccgugcagcccacgaugaguccccuggcaacaacgugguggacaucagugugccacccaccaccgauggacagagacccaacaagcugcagugcugccagagccugugacugcccugcacuuucuuuuucuuuuguuuuugguuugguuuguuuuguuuuucuugguuuuuuuuugguuuuucgagacaggguuucucuguguagcccuggcaguccugggacucacucugucaaccaggcuggccucgaacucagaaauccaccugccucugccucccaagugcugggauuaaaggcgugcgccaccacugcccggcuugcccugcacuuugacccagcgugcgugcacguccucgauccuuggccagcccuucaccaguguccucccggccccucccuugucccucuaggacaggcugcucccacccuccaagugagcuccgccugccagcccaauggcccaggaagagcaggaguccaguggccucuccuguccugccugcucaagagaagcuaaaagccccuugcuuauguaccugcucuuggauauugugggcaucuugacaggauagggagguugguaggauggacagggccagccagaggugaggaagaugaguggaaggagccugcuucuccuguuuuccagacuccagggaucgaaaccgccuuuccucucuggccaguugaccagcuggcccuguauccucaucccaaacucucucugagcugauacccgaagagccaggcaucagaggcugagcagguggacauucugggcucugccuccugccuacaccaccauagccagugccagcacggccuccagcauucccaggccugcgcacuccugcucgugccuguagauuuaugcugggagaagacacccuugcccccucucccuccuccucugcacgcagcgcucuccucugcccauccccacuucucugucucgucuccgugucuggucaggaaccugucugcaagugaagcaauaucuucguguuuuguauauacaacugcucuuguagccuuugguuuuuguuauuguagagaacagauucuuuauacacuuuguaaaauuuacu

SEQ ID NO: 9137 - RNA, 1344 nt, Mus musculus
uucggguaucagcucagagagaguuugggaugaggauacagggccagcuggucaacuggccagagaggaaaggcgguuucgaucccuggagucuggaaaacaggagaagcaggcuccuuccacucaucuuccucaccucuggcuggcccuguccauccuaccaaccucccuauccugucaagaugcccacaauauccaagagcagguacauaagcaaggggcuuuuagcuucucuugagcaggcaggacaggagaggccacuggacuccugcucuuccugggccauugggcuggcaggcggagcucacuuggagggugggagcagccuguccuagagggacaagggaggggccgggaggacacuggugaagggcuggccaaggaucgaggacgugcacgcacgcugggucaaagugcagggcaagccgggcagugguggcgcacgccuuuaaucccagcacuugggaggcagaggcagguggauuucugaguucgaggccagccugguugacagagugagucccaggacugccagggcuacacagagaaacccugucucgaaaaaccaaaaaaaaaccaagaaaaacaaaacaaaccaaaccaaaaacaaaagaaaaagaaagugcagggcagucacaggcucuggcagcacugcagcuuguugggucucuguccaucggugguggguggcacacugauguccaccacguuguugccaggggacucaucgugggcugcacggucagcgauuugcuucugugacacaauacgguagauuucugugaggauguucuugaaugcuuccucuacauugguggaauccaaggcugaggucucaaugaaggacaaguuguucuuuucugcaaaggcacgggccucaucagugggcacagcccgaagguggcgcaggucacucuuguugcccaccagcaugaugacaauguugcuaucugcaugaucccgcagcuccuucagccagcgcuccacguucucauaugucaagugcuuggcaaugucauauaccagcagugcacccacugcaccacgguaguacgcagagguaauggcacgguagcgcuccuggccagcagugucccagaucugagccuugauggucuugccguccaccugaaugcugugaguggcgaacuccacuccgaugguacucuugcucucuagguugaauucguuucuggugaagcgugacagcagguugcucuuaccuacaccugaguccccaauaagcaccacuuugaauagguaaucguacucgucgucccggguccccauuguccuggcgcuuccggcgggaucggcgacuccgcagccccaccacaaacaccu

SEQ ID NO: 9138 - RNA, 1344 nt, Mus musculus
agguguuugugguggggcugcggagucgccgaucccgccggaagcgccaggacaauggggacccgggacgacgaguacgauuaccuauucaaaguggugcuuauuggggacucagguguagguaagagcaaccugcugucacgcuucaccagaaacgaauucaaccuagagagcaagaguaccaucggaguggaguucgccacucacagcauucagguggacggcaagaccaucaaggcucagaucugggacacugcuggccaggagcgcuaccgugccauuaccucugcguacuaccguggugcagugggugcacugcugguauaugacauugccaagcacuugacauaugagaacguggagcgcuggcugaaggagcugcgggaucaugcagauagcaacauugucaucaugcuggugggcaacaagagugaccugcgccaccuucgggcugugcccacugaugaggcccgugccuuugcagaaaagaacaacuuguccuucauugagaccucagccuuggauuccaccaauguagaggaagcauucaagaacauccucacagaaaucuaccguauugugucacagaagcaaaucgcugaccgugcagcccacgaugaguccccuggcaacaacgugguggacaucagugugccacccaccaccgauggacagagacccaacaagcugcagugcugccagagccugugacugcccugcacuuucuuuuucuuuuguuuuugguuugguuuguuuuguuuuucuugguuuuuuuuugguuuuucgagacaggguuucucuguguagcccuggcaguccugggacucacucugucaaccaggcuggccucgaacucagaaauccaccugccucugccucccaagugcugggauuaaaggcgugcgccaccacugcccggcuugcccugcacuuugacccagcgugcgugcacguccucgauccuuggccagcccuucaccaguguccucccggccccucccuugucccucuaggacaggcugcucccacccuccaagugagcuccgccugccagcccaauggcccaggaagagcaggaguccaguggccucuccuguccugccugcucaagagaagcuaaaagccccuugcuuauguaccugcucuuggauauugugggcaucuugacaggauagggagguugguaggauggacagggccagccagaggugaggaagaugaguggaaggagccugcuucuccuguuuuccagacuccagggaucgaaaccgccuuuccucucuggccaguugaccagcuggcccuguauccucaucccaaacucucucugagcugauacccgaa

SEQ ID NO: 9139 - RNA, 8950 nt, Mus musculus
acaguggcaucaguggagggguccaggaucuuaauuucucagaccuugcaucucuccuucagcauggaaauccagucagcuugaaaacuggcauccaagaguccuucauuucucaaacccugccugcccuauugugaggaaguaggagcuggggauuucaagguauuugauggucacaaaguucugugacuguaaaaguaggaauuagucgucuuuccaguccuuuugggaaacgacucacagacugcgauagguagaaugccuuacuccaucuucucaaguuccuuugccccuguacauuuugaaucuuucauuuccacuguagacaacacucccaucaccaugcucugcccucccaggaagugaacgcacccauggucuauggggucuccuaacaagggaccucguucugcacuggaagccuccacaguuugcucuuuucuuuguugcugcugcuguguuaaaauaauuggaaagguuucuguguuacaugagaggguuuuuucgguuuuguuuuuuuaaacaaagacucguagagaugaaaaaauuacuaaugaaauuguguacgugucugugcgugcaacauaaaaacaguaguaccaagaagcucuuuuggucccuguaaaacugcaaauugauguauuaauuauaaauaaaaaacacagugacugucucaucagucugcaacuuuauucuuuguacaguuugggugaaguaagagcaaaggcuuucacucacucccacccucauuccaggaauuuugagaaagaacucccaagauugcaaggauucccauggcacugagcacaagcugcacuacguuuguuuuccaaaaugaaguuagagacccgguaaaggaugaccuuagaagugacuggggugaaaggcaccugccuggggaugggaaggaagguuccccacuugccacaggaagcagccgaaagcugaaacugaacugguuucaugcaugucuggucugacaucagaacuccucugacuugcucugcccccaaacuaaguuggcugugacucauaaggcuggauucuagauuuauucaacauaccucuggguugggggggguggggugguacuuuaugacugaugcaaacaacuucacaaauacacauacaaauguuugaauagugucacuaaguaacauggcauauaaauauguauccagaguaacauuuacauaugggucauaauagcaagcauaucauuaacaaaacaaugaaggaacuucaccuguucaugucagaauagagggaggagacccagcagccccuugaggccauaggucauuauggcagaaucacugcagagguacuugacaaccaccuugggaguugcaacuguaugggaaaggccuaucaggagggcccaagaaugugucucuagcaagcgucuaaaaugaugcuacccugaagacugcugaaaucugccccagcuaaccugaacuucugcagugagcucuggcaaucacgacaaucuguggcuccaauuuauguagaggugggcgagaauaaucacccucagcguaaaacaugcagguggaaagcaaaaggguaagugcacagccuggcacuauccauagucucuguucuuaagauuuaauacugucuccaaaacccuggccggucaaaacuggaauuucacugagccagcagcuguuccagaauaccugauggccucaaaacaagcacagauaagcagccuaauucugcuggggaaaccucagcggcagggaaagugggccccaccuggaguucugacuggcaagccugcacugcugaaagccgccugcauccucauucccguaagugcaguacacaagugcugugggccugcagugcccaauacccacuuuaacaggccuaauagguaaagaaaucuuaguaacuugccagauuggaagcagggcaauauagugcaaagcucacugaacugggaguugggaguugagauuugaaaggaaucaguuugugagcuccagggucccuucccacugacaaucuugaauuauaaaaaauguuauaaaauccgugguauaaaauccaucucgaucuagggaacugggccugaggcacuugaaccuugagcuccggcucuggagggugagaagggauuucuuuucuuguuuucucaccacaagggcugcacuggccccagaacccaggccccacgcccugaccaccgcacccugacuuuaaagggagggcacagugccugcagcgacuucucuuugugaagagcagacacuggaccuggaggcaaaaaggccaggggaacauggagauaccuaguauaucccaauccccucaccacacucccaucucaguucuuccuccaccaccucacagcuuaucucugauacacgcauaauaaauaagacauuugcacguaagggugauugggccaguuccccucuccccuucauauaaaaagcauuaaauacaguuucaaaauaaaauacaaacagcaaaaaagggccugaucuucggaccaccuguucuccacgggagaaugaaaucuacauaccccucucggaccugccugggagacugaggggcccuuuuggcaccauggggccuggcgcuguuuccggcaagagaaaaggaggcagagacccggccccaagcccagggagcugagaaccaguagcguguccaccgagggcaauucacguucagagggggcaguaguagagcccuaccaccccagugcccugagguggaacgguacuggcacuggaccaagaguauucccgcagccuucaccguguggguaacagaagcccucugaacaggagggccuaaagaaaaagugcuaaucccuuuaugcccccggucccgaaggcguggcacuggcccaggaugggugcgcucgcuguccuaggccagccggggaaauugguccagcagacugggccccaccguuccggccccgccccgcccccugcucagucccaauucaccgccugggccuccgagaggccaagaauuggaccccacagccugggagccgagagccgcgcccgcuggcgugaagccacacagaacugggccacuggccagggcgcgcggccagcgcguccuuccuggcuuccuugcgcccugccuucaacccuaauacugacuggcugcgccccuuccccggccuggcagcacugcgcccucagggacagccaagagugcucacugcgaacacuggggaggcgcuuuggcuuuucgggaagcggggagcaccgcacaaagagugccuggacccccgggcuagugcgcgccugaggcgcaaguacuagcuggcacagcaaagugucacgggacgacugcagcggcgccaucccauccccaucccaggcccgggccccggccccagccuagcccgaccagcggggagguggggaauccccgggccugacaucaaggucucucagcccaagggccaggacagcgcagggugacugcuacgcgcgacacaccgcgccaggcuugagauccgcgccgcugucucguggugccggggcggguggcccaaagcccucguggccguagcaacgcagcgcugccuccucauaggccucuaaaauggucuggcgcuccuccggggugaaguccauggagaagggaugcaccugcagaaugugucgcuugauggugcucaccuugagcguggccagcgcgcccccgcacaccaugcacaccagcccgcgccggcugccgucguaguccaucaaguauucgccccgccagcgcggcugguaguugcgccgcugcucccggcugcgcggcggagguggagguggcgguggagguggcggcaguggcagcggugggaaggccagccccccgggcuccuggcugucaucuucgucguccucuuccuccgcgggucucuccgacggagcuccaggggacagcggcgcgucgccuggagaagaacaaagggcugccuuggagcgagugccaucaaucaggcccagucccuguucuccacugcucuucaggucccauccucccgucucucuacagccuuccauccucaccacccuucccuccgagcccugcccucucucccuugccaguugcuccgacccauccacaggcucaccccaccacuccuccucuggcuccgccuccucugccccuccccccuccucagaggcugaagcugugcugggggcgacagggacgcugggcgacuccggccugggcagccccagggccagcaggugugcggccuuuucgcuccacuccugggcgaugagagcuuugacuggcccgcugaggcuguuggagccgggguggcgcuggcggaugugucgcuugauggugcucaucuugagcgaggccagcgcgcccccgcacaccaugcacaccaggccgcgucggcagccguccagcuccaugagguacuccagccgccagcgcuccugguaguggcggcgauggucucggccccuccgaggccgguucgggaugcccucccucucgcccucgcccucgcccuccuccuccuccgccggcccgggccucucaggcacccagccagccucuuccuuuacgucuggggggcugagauccugagaggagggggcuccagcagcgggggcggagucccggcucuuucuggucagguccugggggacgaggucaucgucuguuggggaaggggugaaggagaagggcucagccuucuggcuguguuguccuuacccacacaagaggguuccauccuugcuccucaccccagccccaagcuagccggccccagccagagagagauggguggaaaguugaaugucugugugugaagggaaaauaggccugcagcccucaaccaaauaucccugccucccaauuuuguuuucaguucccaugcugccgcccuaauauugaagggaucucagcccugggacagccucgcaccuggugagggcugggugagcucggacagagccucaggcuggucaccccaggccugcagcagggcacugcgcugggggccacugagcccuagggagcuggggugcacuuccagcacgugagcacggaugucguccaagugcaggcugggcagugcccggccgcaggccaugcacaccagccgauucccccgugggucguaguccaugagacacucagcccggaaccaguucugcagugacuccuucagccuccgcuccaggcgccgggcccccagcccccugcugcccccagcccuucgggaggcugcgaggcgccggcgccgaggugccacugagcccccucggaccccucgccgcuggcgccggcagcccccaccagcuggggcuuugccugaaaggguuggagggaagcaacugagucucugacccucuggggaguccccaccacagccaggugcuccacacagucucuuucucacucaacugacucaggucccguggcugaucucugccuagcuuuuccucuccucuuacaucuuuuucuguucuguuuuuauaagacagaaacucauacaaccuaggcuggguucaaaagcccuaccuaccuauguagcaacguuuaucuaauuaaugguccuccugccuccacuuuccuggugcuaggaugacaggcauaugccaccacacccacuuccuuuaucuuaaccccucucccuaauccuccuguucacucacucaagucccacccagccucccuagacccugauuucagccccgucccugggcuucuuugugccaacaccacacccacuccccucaccaacucacaaccacuuccucaacuugacccucccacccauacaacucuugcuccuucuacuacagugucuaggccucagggaugcuggaaacuaccccacaccacuaucucuccccacucucaaaaggaagggcaguaaacagacuccacccaaaaagaaacagagauucccuaaaaaaaaaaaaaagaaaagaaaguagaaaagcugcccccucccugagccccauaucacacaaacccuugccucuccauauucuguauuaccugagcccuugggugggcaagcuugcagguuggcccccuccuccuccucuucaucuucuuccuccuccuccucugcccccugggcccccaggcucucagccucaccaccggcccccagccccagaugggcgucccagcuguugcugaucacuuccuucucccugggacuccagugcagggaguagggguguuucuggcgaaugugccucuugauggugcugagcuugaggguggccagggagcugccacacaccauacacaccaugccaugccgggaggggaugaaguccaucagguacuccagccgccaguggucgugguaauagcgccgguggucccugccggggaugcgacucuuuccaggccucgaggcccgagccucacaaugaucugaguauuuccugccugaagaugcugguccccuggcccuggaggaggguagggggguacucccccaggacccuaaggcacccccuuccagcugaagagcuuguccugaagaagggaaaagggagacaggcucucaauuuccuauuuccagagaaaggaccuagggcuuugauuuggaagcaugaaaagggggcaggggagguuagggcaagagagggguggcaagagcaaugaaagggaagugggugaugaggggguuggaacacccacacagagagcagggacccagcuggagaacaaagagaugugggcacugggcuagcuugcugaagacuuuaaaaccaaggugaaggccacggaguuuaaggagggauaaagccagaagcucagcaggcugggcaguuacagccagaauacagcaagcaguagggagaggggaacaauaggggguauuugucugcacccagaucugugcacaacacccacccaccugaggccccuccaggagggcacccaccaaagguuaucucccuuucccaauaugccauccuguaaauagcaguuuaaggaugagguaggaacugucaggucuuccacuggagggacaccuaagauacagcugucaacaccuccagggaaaggaguuucucggaccuggacuuccccagagucugggaggcacaaugacccgaaaagaggaggucggagggccagcagagugacuaccgacugcucuucagacuggggagcagccaccacccaucacacccauuaagucguucuaguuuaucucauuugugcuagcagggaugugguugcugccagcccucccaacagugugcacuucuggggccucuccaaccauuaguguucuuucacuuugucaaagacacccagagcccuccuugcagugcuggcugaccauuuuuuauuuagaaaacugucuccuggccacaaagacgaaacaagcagacucuggcauucucucaguacagaaucccagagucagacaaacaaaugacaggaucagagagggcucuuguccucguguggaguuguuugguuuuuugguuuuuuggguguuuuuuguuugguugguugguugguuugggggugguuuuuuugucuguuuugguuugaagguuuuguuuguuugucuuccauuacuuuuuuuuaagguagagguauagaaaaaacauuagauucaagaucuggcuucacuggugccuugcccagugaccuuugguaggucagucacauccgcucucugggccuauacgccuuugucugcaaaugcacugacugaauagcuagcauccuacuaagcaucuuuccagugcaggaccacuguuaaaucuaaggcagacuggcccuuuaagagcagaaagaagaaaaaaauaaaagaaagaaagaaagaaaaaggaggagcugagauuuuuuucaaaaaaauaaaaaggggggguggggggcgggggcuuauagggagaggagcucaaagaguagagagcacucucccuaguacggauggaaccuccgcugaucuaaaggcaaugaaccuuacagaagggagacaaaaaaaagcaguugguuuuaagggccaacuagggccggcaggucuugguacagcugacaaacuggggccaaaaucgauucugaaacgcgacaacgcacggguggggcauccaccuucgugugcgaacccaucccucacuaagaccuucccgacgugggguaugacagacgggggcccccaggacgcaggcugcgcuuuguuucucguagcguaaccgugaagggaagaguucacgucuccagcaaggccacgcagaaagggauggcauaaccgagaacagcggaaucccgagcuaugcuacucuggggaaagccucagaaagggacagagggacugggaagccuuuaaaagacagaccaccugggagugugaaagagaaagggcgggagccgcaaguuccagcaccucgacucccacgucgcugcccccccccccaaaaaacgagcaacgcggggcccuuuaaggagcagggauccgccccagcccggcgggcagaccccgccacgggcagggagcgccccgcgggccuuguagcugcucucugcgcccaccagguggcgccccgagccgcccugcgcucgucccccgcuuuguucggcggccgagaggggcccggagccgcagcccuccccucccccacgccggggccccccacccccggucgucggccccagaucuuaccgccgucguccuccucgggcuccgugccgccgcucgcugcggugggcggcagccgucggccccgugccgaggucacugcgggcccggggccgccccugccgccgccgcuccggcuccggugguccccgccgggcuccaugcgcugcgcugcggagcgggggccccggggcggcggggcgcggggccgcggagccagcggcggcgcacgcggggcgcucggugcgcggggcccccgggcgcggggcgcauucacgggcggccggccgcacggacggcugacugcucgcucggcag

SEQ ID NO: 9140 - RNA, 61570 nt, Mus musculus
cgcgcguccaggcucuuugugcgcaugcgcgcucgcacuccuucucucccugcggagcucggcugagucagucagucugucggagucagucuuccgaacaggcgucgccgggaacuucggagagccagcugcuggauuauucuguguccccucccacucucccgcccuacgucucucuucacccuucucccgcccuugcucguacagccauggcggagucgucagcggccacucaguccccgucagucuccucgucguccuccggggccgagccgucagcucucggcggcggcggcgggagcccuggagccugccccgcccugggggcgaagagcugcggcuccucgugugcgggugaggcgcgcguggggcuuggucccuggggagcgcgagcuacugggucuccgggaaggggcgagcgaccugucugggccgugggcggcuuuagucucuuggcgggcauuugaggaacaggcuaagggggaggggagcgaaggaccgaggugaggaaauaacggggugugaagaaaacagguugggggcgggguggugaacuagagugggcguugacgcugacccccugcaagggagggcaccgcaguggggugaaaacggagaaaggcuaugugcacccaauggaucgagugcuggaggcccgagagcccuagggugggucggggggugggggugacuuagagcaggauuagcgagccucaggggauugugacaggugggacguaggagaaaugaagucgcuaggauuuugagagggguagugguggaaaagguggcguugcagguuugcagaccgguugacacaaucuuaaauggaugauauagccuuccaaaaaaaaauuuuuuuuuuuuuuuguucgccagaaggaucaggaaguucuguuacuguuuuuggcuaaacugaaugccagauuuuuuuuuuuuuuuuuuuuuuuuucugagacucugagguagaugaggcgugaugagaauagcaugggaagauuugggagggagcugcugauaguccaagauggauccuuggcugcaucugcaacacagccggcucuucaccgguggugcaucguggggguggggacacgcagucaguugcuauauucuagaagauaauaaauacagucuugccaagccaucaccauguuuugauuucuuguuuucgauggccuauucucaauagcagcauaacaaaagggaacgauugcugcaggggaaagaauucagacaaagccugggcugcuugaacccccuucucucuugugugugaaaagacuaggagggacgcuggcggccuccuuuaguuucuuuuguauacaagucugccugcuggugggagcugacuggcaagcucgacucagaucagagagaucugcagugcagaugccuucuugaggaaaaauaugcaccacuggcagguggugguucuuaagagaacugagucuuuggcgaaaaauucgguuugucaaaggaaggauuuuaagagguuuagaaaaugcuuuguugacuccagcgcagucuugaauuaugacacaauauuccugaucuuagcauuaaauauauucucucauguuuccuaauacuggccuuccaccugucugagagcuuuggugcccugcagaauucuccaugggaauggccauuuggauaaaugguaugggaggaaguuuucuggagauaaagggaaugaggcagcauauuuugaacccugguucuguuuaaaccaccagcauuucucuuucaaauuuuugcauuuugggcuauuuuccagauaaacgguggcuuuucuauaacuuagugacuugccuuuaaucacugcuuacuguuugguuggccuaguccuaauuuccaaauuucugauaaaagucuagguuucagaaguuggccuuuugugcugaagaucaaauguuaaguauugaggaaucagucuagcuagcacucagagaauuaaauuuuuagcuaugguugucaucaaauagugaaaaaaaauuuuaauacaaaguagcccaggcuagcccugaaugcaagaugauucugccucaaccuccaugggaacuacaggugcaugccaccacacccaucacgaaucaacauuuuuuuuuuuuuuuaaagauuuauuuauuauuuuauguaaguacacuguagcugucuucagacacaccagaagagggagucagaucuuguuauggaugguugugagccaccaugugguugcugggauuugaacucuggaccuuugggagagcagucaggugcucuuacccacugagccaucucaccagcccucgaaucaacauuuuuauucuuuuaaugcacugucagagggauuggcucccuuagugugccagaggaaugcaaguauguacugccacccugugaauuuuauauuagcaguacugauauauuaacaugcaguauuuuuguuuagcuuguguuucugcuaucauucccucaugucacaugccacauugucacaguuuuauuauugccauuucccuguguuuuuuaauaaagagucuucuucuggaauucauuacauauccuagcaggcuuugaaaucucuccuaucucaucaucucaaauccugagauaauaggugugagccacuaugccaagcuaccuugcuuggggugguggugaugguguuguuguuguuguuaacauaacucuuuguuucauuuguuucgauuuuuugagagagagagagacaaagccaaaacaaaaagagguagcccuguguagcccuggcugaccugaaacuggcucuguagaccuggcuagucuggaacucagagauccaccugucugugccuucugaguccugggguuaaaggugugugccaacacugccaccaccacugccuuuuaaaauaccccuuuugguagugggaaagauucuaaaaugaggcauuuugccaacagagaaauuuauaucuugaaauaguauucugcguagauguguuugccuuguacuuuccuaacaguauaaauugccuaguaugaccauuuuucuuaauuuuuguauaaaauugcuucugugacaucaacuguagacauuuugucacuauugacucagugaggguuuuguuuuguuuucuuugucuuacaguguuauagagggaaccuagggccauuuugcugcuagguaaacuucuaagacacaucccuagccccacuauuggcauuugaaacagugucuaucuguaacuacagaaguacucaauggguuucuguugaauaacucaucaaguuuacaagcugaaaaggaauaccugaaaagcacacuaaauguccuaucauaaacuacugcucauuguuaauuaacugauuaucagaaaguagaaauggggugcuggcgagauggcucagcguguaagagcgcugacugcucuuccaaagguccugaguucaaaucccagcaaccacaugguggcucacaaccaucuguaaugagaucugacagguacucuucagagucagcuacaguguacuuauguaaauaaaucuuuaaaaaaaaaaaaagaaaaagaaaguaguaauaguuaaguagccccaguggguucuuguuggucaagugacuacuugaauauaaaagucugucguaugggacuagcaagauggcccaguggguaggacacuugcaguuaagccuaacaaccugaguuagaacucuuggacccacaugaugaaagaagaaaauugccucccaccauugcucugaccuccauaauaagcacaacucucugucucccacuuaaguuaaaaaaaaaguccuaugucuuggugaauuacauuuacauucuaaacuaaaaauauuauuuuaaaagcugggcaguguugggaaggcagaggcagguagaucucugagugggaggccagccugguuacagagccauggcuacacagugaaacccugucucaaacaaacaaaucauuuuuuuuuuuuagccaaaagacagcuuuuuuuuuuuuuuaauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagccaacaaaucauuuuuaaaacagcuggguuugguagcauacaggaugcagaggcagauggaucucuaaguuaagaggccagccuguuuuauauagaaagcuucagaccagucaagacuucauaauaagguacugucuccaaaaagcaacaacagaaaacaaagagucuucauaaagguauuccaauaaagcugaauguguaccuaucgccucuguauuucugacacugaggcaggagguucaccagucuggguagacuauacugagaaacccugucucaaaaacaaaaauacugcagugaagucaccauuccccuucuuccaugcuucccucucucagagaagaugcuucaagguuuggcaagaggaaaauaagauguaguuuauuauucuaaaauuuaacacaucuuaaaugauuccuaaaaauucugcugugguugucagguccugauuacauggaaauccuaaucagcagaucauaugagcugugguuguaggaaaaacaugcaaacauugcugucagucuuacuccguguucuuuacuaaguucaauuuugacugaccuguccaguaaguuuagaaauagugauuucuuuagaaacaacagcacucuguagcccaguguggcagguguuaaagcaauaguaaacugugguguaaacucugagagaaggcgagggccaggaugcuuuccuggaguucuuccuuugaaggagaugagaguuucagagacagacauuugagggugaagguuaaaaaaaaaaaaaaaaggcagaaauauguaauauucuuuacagagugagaauugcccuauaccuguuuugucugaauuuuauuuuauguuuaugguuguuuugcuugaguguguguguguguguguguaccacaugugugucuaguguccuuacaggccacgcaucagguugcugauggucagggacuggacucacaauuaugaaccaccauguaggugccaggacuagaacccaguccucugggaagacuuccagugcucuuaauugauggccuaucucuucagcacuauguuugaauuuuaaauaugguuuuaauacuuauaacauugaaauuuuauaauuugccaaagacuaacuacuuuuaugaaaaucauaaugucaaaauaaagcuacauuuuacuucaugauacuugcucaaacaauagcaugggcaauugaaaaauauuuugcuguaacuauuucuuuucucucucucuaaacuuaguucuguguucuauucauggccucauuucaugcuuuguucuaacagucagucaaacauuaacucuguaauuuggauuuaccguauuaacccuuaaauuauaaggauccuaccacuuguuuuuauuaaugucaguauuacauucauuccugacuauauccaugguagcaucauacauuuaccaacaaacaugugagcaccaaaaauuaccugauuucaauucuggcuuaucccuuuuuaauuaaugauuaaauuuuauuuguuuaagacagggggcuuggaacuggagagauggcucagguugagagcaauggcugcuuuuccagagguccugaguucaauucccagcaaccacauaguggcucacaaccaucugaaaugagaucuggugccgucuucuggccugcaggcauacauaaaggcaggccacugcauauauaauacauaaaucuaaaaaaagaaaaaaaaagacagggggcuucacuguuuagccuuggcuggccuagaacucacuauguagaccaugcuugaacuugcagagauccuccuaccucugccucuggagugcugggauuaaaggcaugugccuuuuggguuucucucuuucucucucuucaauuuuaagugcauugggguuuugccugcauguaugucuguagaguguguuugaucccuugaaacuggaauuacagauaguugugagcuguuauguugguucugggaauugaaccuaagcccucuucugccaguguuuuuaaccacugaaagauaccuccagcccuuggguuuaucucuuuaauaauugcuguuguacaaauucugugccuuaguuuccccuucauaaaaaugauaguaauuguuguuaugaaaauuaaggggcuggugagauggcucgguggguaagagcacccgacugcucuuccgaagguccagaguucaaacccagcaaccacacgguggcucacaaccauccguaacgagaucugacucccucuucuggagugucugaagacagcuacaauguacuuacauauaauaaauaaauaaaucuuuuuaaaaaaaagaaaauuaagcacacauacuuugccuauagugaauguuagcaaguaauaguagugauuaaugugaagggcuaaaguacacaucaucuguaugaacuagaugcuuuuguguccuugaaagcaaacuacuuaaaacuaguucaaaauauuuauuaacaauacuugaugcaucggacaguuacaaauuaucugcacguagaauaguaauugaauuacaggugaaaaauccuacucuuccuuaacaauaaaagaaaaaucagugauguuuuuuccacuaguacugagguguguguacagggccuggccuauaugguugacaugaaguucaccaaugagcuauguauucccagccacucuuuuaaauacauauuuaaaaauuuuuaauuauguguauguguguagguauguguauauacaagugcagguuccuagagaagccagaggugucagauuuccccuggaacuagaauuacaaguaguugugagccauccaguaugaguucugggaacugaaccccagucuucugcaaaagcuguacccuccuaacugcugagccaucucuccagacaucuauccauuaaaaaaaauaaaguuuuaauaauucuuggcuuggugaugcucauuguuaaucccagcacuuauagucaggcaauuuucugugaauucaagguuaaccugaucuauauaucagguucuagccugccaaagcuauauugagaaacccuaucucaaaaacaaaaaaaaguaaggaggggggcaacuuguuuccuagguggcuuggcauaacauuaguauguuuuaaguauuuuuuguacccuucuggccauaguaaauauaauuaugauacauuauaaaaugcuugccacagcagauguguuuaagagaaacaccuacuuauucaauuuguuuuguuuuuguuuuucaagacaggguuuccuuguagcccuggcuggccuagagcuugcccuuuagacuagucugucccuagaacucagauucaccuaccucugcugcccaagugcuggaauuaaaggcgugagccaacacuguccagugacuugauuuuauuuguggaugcaccuuaacccuaacuugaggucaccaggugauuauuuacauaguuuaagguaagaauucuaguguuuuuauuuuguugcuauucauuuauucuuugcacugcuuuuguguugaacacuuuuugccuuuuaguauuuuaaagauggucugaaaauaguagcaggaauaaugcugcuuuauuaaauucuucugugaggaaacuguuccucauaaugucagucaucuauucuacucaggugacuguugcaagcacuuguaaggugaaauuugguaaugaaugaauuaguggccuguuguuagaggaaagaggaaauuaaguuuaucaauucuguuugagccaagcauuauuucucuugaaagacacuucucuuuaaaguagugauaguccuagaacgagcauuuccuaguucuuggcagaauuaaauugucuccaaauaaguguuauguuuuuguuuuguuuuguuuuguuuuaaaaaacaaaaacaaaaaccuuucugccgggcaugguggcgaaagguuaaucauuagcagguggaccauuuuaaugguaguuuuuuguuggugauuuuuguuuuuguuuuuaauuucaaagaauauucuuaccucuuuucugaaaucaaacuauuccuguaaaaacaucuuugaaacauaaccaggagggauacauguggguucuuggcguucaucauuagcagcucuuccuucaggauucauggaaagguauucuggaaaaccucuuaagcaaaauuaauacauaaccuuuuuguucuguuauggcaaaaguuuucaacaaugggcauugauuuuguacaucuuauuuuuagucaaggucucaccaaguugcccaggcuguucuugaacucacuuguggcagaggcuguucucaaaccuucacuccacaagcagcugggauuacagguguguggcaaucugggcugguaauaauuuugauacauuaauauuugccuauugguuuaagucaugcccacauauaauaauuaaacggcugagcauauuaaggcucuuucuaagggauuuugggagauaggaagacagauaaaacauuggcuauuccuuuggaggcuauauucaauagaaggaagacuuguauuguuuaucugugaguuaagaacacacccuagguggagacacaggcucagagaaauuaagccaugccacaaaguuagcaauaguuaaguuaguagacuagcuagaaucaaggaguuuaaggcucagaucucuuucacauaaacauauauacugccucuaugguuagaauuugaagcagcuuuuacuaaaaauacuccagucacccaaccaagcaaacaaacaaaauauacaauagucaguguuagcuauagauaaauaaauaaaaagcucaaccugcugguuuagggcuggcaaaauggaucaguaaaagugcuugccacaaagcuugaugauuugaguuccauaccugggacucacauaguagaaagaaggaagugacuuaagugccuggcacacacaaaccccuacacccacauugggcaccaauauguuguggaaauuaacuaaucccgacuugggguuucauuuaguucccagauaaaaauaacacacaaccuuuauauuuacaauaagccuuaagcagcacaacaaaugagcagauaccuacccucuauauuauuagaaccuacuuuccuauugauaauucuaaauuauuacuuacuacuuacuauuaauucaucuggacugcucuuaauuccaauuggucagcccucaaggcuauguucucuugacgccuaacccauggcaacuucuuucuccuguaccuuccuuuccuugccuuuuuucuuuuccucuuucuuucuuucuuucucucucucucucucucucucuuucuuucuuucuuucuuucuuucuuucuuucuuucuuucuuucuuucuuucuuccuuuuuccuccuccaaacccaagccugagaaaccuaaacuguaccuaugucucuuuugcccagcuauuggcaucuuuauuuaccaauuagaaauaacuuggggccauggucuacauguagacucucaucucugggacaaccaaauccugggagccuacacuuagcauuacaauagauaauaaaagaccaaacucaacaaauaaguaaaaauuuauauauauauauauauacacacacacacacguaugacauguguauacacacacauguuguguguguauuauauacauacauauugagggaguuguauuuuguuuuuguuuuccuaaaacucuuugaagacuaggcuggccucagauuuacagaguuucaccuuucucugccuccugaauguugagauuaaaagaaugcccaccacaccugacaaguaauacauuguuuaagaaaaaccuggacuggugagauggcuuaacacagcaguccucaaucuuccuaaugcuguaacucuuuaaaacaguucuucaaguugugaugaccucagacuauaaaauuauuuucauugcaacuucauaacuauaauucugcuacuguuaugaauugugauguaaauaccuguuuuuggaugguuuuagaugacccuugugaaagagucauuguaacuccagaguguucuccaccuacagguugagaaccacuggcuuagcagguaaagguacuuaauaacaaacccauugucauaguuggguccccagaacccaugugguagaaacaaccaacuccugcaaguuguccaaccuccacacuuacauguuugugauuuggauggaaagcagaacuguccuggagaaacuuagcaaacagccuaaguuaggcuuucaucaccacugcaaaucuuacugguacuaauccuucaaagguuaagauaacccuucaucucugugauauucuugcucuaaaccuaucauuucaguccaaccagaaagaaaaaaagucagacccuaauuggaagauauucuguaaaaauguauugauugguauuccucaaaacugucaagaucaccuugacuccuaauccacggcagcuuuuccuuccuccugcacuuuuuuugguuuuguuuguuuguuuguuuguuuuuugugguucuccuccaaacccaagccugggaaauuuacaauaaucaauguuaacaauauagauaaauaaauuaaaaggccaaccugcuggggagaugacucaguuggguacaagcacaggaacuagaguccagaucccuaucauucaaguaaaagauggguuugacgcacauuucugaaaccccagcaucugagagaaagcagcuuuguagacaagcagauccugggguuccuuggaggaaaaauaguggagaacagaggaagauaccugaugucugcuucuggccccacaaccuugccuaugggcagguauaccuagaauuugcauauuuacacauaccaacaccacacacacacacauucaagaucauaaagccagaaaagucugagaagcugucgucuucugcaaguuaaaggagugauagcaauaugugaugaugcccugcaugucuuugaggcuggugaaacgggcacugggucugggaauguagcucaguugguaaaacgcuuggcuaggaugcacaaaacccugucuguguucaguccccagcaccauauaaaccaguaguugugacacauuccuagaaucccagcacuugagaggcugagucaggaggauuacuaguuugaaucuagucuuaacauacugauuuccgaacuaaaccaagucccaggcuaaccugagauacacagugagauccuguucuaaaccuugaaagagacagaauauaagcuaucccuuguguucauuaguggcauugaguccuucagguuuuuucuuuuccuucuuugcuuccuuuccuuuuuguuuuuccuccuucucuuucuaaacaaggucacauugugucauccugguuggccucaaacuucacagugauuuuccuauuucugcuuuccaagugccagaauuacagguguguaccauuaucauuuccuccauuaucuuuauuauuucucuaguuucuagcauccaaucaggagauuccaaguugucuucauucugccuugcuaaaguagugauuguuuuggauuuuuuguuuuuguuuuuguuuugguacuggaauuacagguauguacuaucuugugucugacuuaugcaggagauuuccaauuuagaucugaguucuucuuaaaacaugugugaaaauuggguauagugcacaugguugggauuccaacacucucagaagaugcauagugagacucugucuccaaacacauacaugcuccccccaaaaaacccauaugugacaguguccucuuuguacaauguaucauuuagauauuuaaaggcauuuggaaucuguucaguuccuuccuuccagaagaaugcuugucuccacuuccuccccuggcccugguucaccuaauacuguaaagucucuucuggagugauuuuuauuuacccuacuggcugucccugcugcauuccaacaacucacacuaugccuguucgaugucucuaacugcauuagacuagcuacugguauuuuuuuuuuuagcuuugacuggcuauuacagaaaguuuauuccauuaguauuugaggauuaagguugcguucuuaaguucacuuaccuguaggguagauuugaauaggaauauaaugugauuuuguaaguuagaaaccucuugcaauauuguugcaaacugcugguuaucucuguucucuaucagaacagauguuaugcauacaaauuggcaggguggaauuuuccacuggguggggguuauaauagaaacaaaccagcauaugacugccagguucauaggcuuuuuauuuuuugcauugggcuuacuuaaagcuuaaagaccguacuuagcccccagcccccagccaggucuaucacauuuauuuuugguuugggauauucuucaagaaauccaggcuguccuuaaagcccacaaucuccuaccucagccuucugaauucugggauuauagguguguuccaacacaacuggcuguuuguuuagauuuaaacugaucaguuaaaauuuaauguuaacaguaauugcauauagaaauggacccauuuggaaacauugaacaagagauaguaaacauuuuccucuaaaaaagaggagagagccuugaagaaguacauuuugcccuugcagaguugauucccagcaccccacacuagguggcucacaacugcuagggaaucuaauggccucuucaagaguccgcaggguccugaauucauguguacaugcccauauauaaauagacauaauuucuuuuuuuuuuaagauuuauuuauuuuauguaaguauacuguagcugucuucagacagcuaccagaauaaggcauaagaucucauucugugugguugugagccaccaugugguugcugggauuugaacuucaggccuucagaagagcagucgggugcucuuacccacugagccaucucaccagcccgauauacauaauuuaaaguaacaguaaguuauuuaaaaagagaauguaugugauaauuuaucuuaaagcaauuggaagugaauuucaaacuucuggucuugaauuaaugaguaacuaucugguccccaccaaauucuggcuugauuuuaauacacucuauauuuguuacaaaauaauuuuccuugauuaaaacuuacagguacuucuauggcuuaguuauuuaaaacagucuucuaaguauaacuuuaauauuugugaaaacuuuuuuauaauugaaagaaaaaagaauucaugcauaauauuuuguauauuuaguacauuugcagggaguguuuuguguguaugucuguauuuauaugggugcauguaugucccagagcauauggagaucagaggacaacaguuaucuaguaucaugugagcucuaauguuaaauuuggauugucaagcaccuuuacugcugagcaguuuugguaucucucugucucacucuuuuuuuuuuuuuuuuuuuuuuuuuuugagacaagguuucucuguguacccuuggcuguccugaaccuugcuuuguagaccaggcuagccucaaacucagagagauggacugccucugccuccagugugcugagauuagugugugccaccaccauccagugagaauuuuuuuuaauauauuuuacuuuuugcugaaaagaucauguuuucuuaaguaccaaaagcaaaaucuuccuucuaucccaaacaacaacuucuccucuuucacuuuuuuuuuuuuuaaauggggucucauguaacuccaguggccuggaacucuauauagaucagacuaaccugaacuuacaaagaucugccugccuuugccucugccucuugagcacugggauucaaaaguauguuccaucauucaugguuugugugagagagacgcagagacaaaggugccagaaucucauguaucccagucaagugcugggguuacagaucuucauacagguuucaccucagacuuuuuuuuuuuuuaagauguauuuauuuauuuaaugucuaugaguacacacuguagcuguacauauaguugugagccuucaucuaguuguugggaauugaauuuaagaccucugcuuacucuggucaacucugcucacucuggcccaaagauugauuuauaaguacacugaagcugucuucagacagcacugaagaugguugugagccaccaugugguugcugggauuugaacucaggaccuucggaagagccgucagugcucuuaccgcggagccaucuuaccagccccucaccucagacuuuuaaucccuuauguuaauagucccuuuuguugcacugaacacaugggagcacagugaauguauuuuuauauuuuauaugcuggcuauaucaguagacacagcuucaccuguuuuuuuguugcuuguccuggucccugugaacuuggaugaucuccaucuuaggauccugugcuccugcgaaggcaucaccauaaagcuuguacuucacucuuuuccagaucaccacguuaauuauguagauguuguuuuuaacuagucacuuauugguagucauuuacauuauuucuguuuaaaaccagugcccuuacugaaugucccuguacacauauguacuuuguaggauggauuccuggaagcauucacuacuuaguuaacgaguauguuuauggagcagauaaaaaagauguuauguauauguuacuuuuuuuauauguugacagaugagaggagugugauucucaaagcugaaagauuucucagcccuauuuaaccagugaauugugauuuuuuuuuuuaaaguauugagguucagguuuugccaauuaaauauuuuaaguacuaaucuuaaugacuuauugcuucuggauguaguuggaaauuauuuaaagcaaguggcaacuaguucuuagaaaacacuuugccagaggacagcagaggagagucuguucuugagguuguggcuguugugaaaugguagggcuuccucuuuccuccugaaggugauaaugcuugucuaaagagauugacuuggugaacuuguagaagugcauccugggagugaaaugagguggcacuggcaggugagugaaaacagucacuagaauaaaguuugagucuucuuuggccaguaagcccaguuaaaaugauaauguuugacccuccagaaaaagaagguuacaaugaagauuccugugugggcuugucaaauucucauucuguauauuuucuuucagauuccuuuguuucuuccucuuccucucagccuguaucuauauuuucgaccucacaaggcaaguccauaacuuuuuuugcacauuaauaaaaagaaaaauguuaagaaagaggcuguagcugaggaugaggugggaaucuuuuauugccccacauuucuuaaaauggaaacuaacuacuaguccguccuuucucuacugaagaguugccaguaguucccuguaaagacuaauauacuugaaugaagcugagugaaccauuuauaccgaaguuuuaaauguagcauugacuauuacuuaaaaauuaaaaacuuggccagugagaugccuucucagguuaaggugccugucaccuacccuaauaagcuuaguucaguccuuagaaccacgugguaggaggagagaaucaacucccauagguuauccucugaucuccauccaugaauuaucucacgcauacaguuuaaaguguauugggaaugguagugcagcaauuaagagcucuuguugcuuuucuagaggccuuaguuuaauuaccagcacuuauguuagauaacuuacuguauuucuaacuucauggaucagugcccccuuuaggccucuacaggcacugaauucuacacauacauacccccccacacacacacacacacaccacacaugcaauuaaaaauaaaauaaauccuugaaauauuaaaaguuugcauguagcgcuugggacuuuucaaucccagcaugcacuuauuaacuugaacuuauuuggaagaagaaugaaaguaugcuuccaaugaccuacaaaauaucagccuagcuacaaggguuaaaugcaaaucugaaugaaauuuaucccaacagcuaggcuguuuucagauguuugaaaauauugaacaagucaguugacuuauaucaauuaaggcuccuuauccuagagauuaagcagugacuuaaaaaaaaauccacucugcaagcagaagcaggaggaucuucugugaauuccaagccagccagaagugcacagcaagaagcgcucucucucucucucucucucucucucucucucucucacacacacacacacacaaaaugucaaccaauaggaaagauaucuuaaguuaauauagcagcucuugccaaaaauuuggaaagcaugauguaugcuuuguugauuauaauguaaaaugcauucuauuuguacugugguacuaaacccgaauacaggucaaugggaaacuuacuuuuuaaagauaagaugauuagacuguaauagcucaauaauagaacacuugccuuccaugcacaaauccuuggauuuagucccagcaucaccuaagauugggggaucacauauaauugcagucacuagauagaucucaaaaguucuaugaaaaauauucauuguucuagcugggauuuucugcagcuuggaugcugguucauaagaaagacuuugagcuuauaauaauaaaaacacaggacugaggauguaauucaaguuagagcacuugccuaguauacaugaggcccugaguuagauaucuaacaauguaaaaauuaaaaguuaagguuugaagagagauagcucagugguuaagaguacuagcuguucuugcagaggaguaagguucaguucccaguacccaugugacaacuuauaacuauaaaucuaguuugaggggauccagugacaauuucuguccccuuaggcacaaagugcacuuagcauguaaaacuuguacccacaaaauaaauagaaaucuuuuuaaaauuauaaaaagaaaggaugaaaacuuuaugaaaugguuucauucagacugauaacuuagcauuccuaacucugcuauaauauccuuaauuguaugauuuuaagauaauaaaauaucagaaucauaauucugcuaucuuaugagcuaagugucuuaugugcuuacuuucaaagauagaagcuuugugagcucauaaguaauucacauauauaaaaguaguuauauuguucugauaauuuuaaaucuaaccagauggcuauuuuuaagcuauuuccuucucauuaguugauaauuuaaacaaauagauguugaauuuauucuaaucuggaagaaaaaauaacguauuguaaguaaaacaaauaauuuuuuccuucagcuguaaauauuucagauuuugaaaaauacauccugcauuugagucgcuuuucacccagaaagggaauaguugauguccuagacagugagugauguaacucaaggcaguuccuaguaaacaggguuagaaacacagugucacacugaaauagcucucuuagccccuucuugcaaacagcacacaugcaccacaguagaacaaaaauaaggaaaaggaaucaaagccucccuuuuaaguagcuucaggguuacaguacauucuagucuucauaagagcauguugaucauucuuuugcuuaccaaagcauuuuauuuugaugcaugcagauucagagcauccuuauguaaaggcaguuaauagugcuguaucccagccucuuuaguagcauuucccuuucaaacaacaaaaaaaguuuuaaaaaaggauuuagggcuggagagauggcucagcgguuaagagcacugacugcucuuccagagguccugaguucaauucccagcaaccacaugguggcucacaaucaucuguaaugggauccaaugcccucuucuggugugccugaagacagcuacaguguacauauacauaaaauaaauaaauauuuuuuuaaaggauuuaaaagucaguuuaggggagcucuguagucuggaagucagcucauucauugugugaagaagccacuuggcagaugauuaauuguacuuuagggucgccaauaauggaaauuucuagacugccuuuaaaaagaaguauauuugguuauauucaguuaacaauuaaaacccugggacuagcugggcgugguggcacacgccuuuaaucccagcacucgggaggcagaggcaggcggauuucugaguucgaggccagccuggucuacagagugaguuccaggacagccagggcuacacagagaaacccugucucgaaaaaacaaaacaaaacaaaacaacccuggggcuaaagcagucagauuucacagaagccuuuuuggacguugccaccagcagggaacuugaaucccuauuacuaacccaacuaaucuuuucuguaucccguaacccuuuagucuuguugcaaacaugcuacuuuuuuaucuauccaaaccauagcauacaauccauagcagucauucauuagaacauuuuuagauuuaaaaaugauuugugggcugggacuauaacucagugguuaagguuuuaccuugucaugcagaaagaccaggcucaguccgugaacaacaaaaauuauuuuauauuuuuaaugcugaaauauagauuauuuaccauuaucagguuucagggacauaugcauguaucaaggaaggaaggaagaugucauuaauuuguauugaguaaaacucauguuuuuacaaaauaaauuauauuaacuuauuuccaugacagguuauauaaacuaggaagucaaguuuuuuuaauaaauauauuuguaguuaauauaccaauggaauucauaguuaacuugugcuugggaguaggcccugccucucgguuccauuuuccaucaaguagagcuaaacuucaggcacuuccuaaaaguguuuccgaauugaaugacuguugauggugucuuccaauauaagacucauaaagauauuggcaagacauacuguauguagauaauuuuuagggacucuuuagcaugcuaguacuugaagaugaagaucauuaacucacagccaguggugaaggaaaggcacuagcucaguggaacaacuuggcuuuagaauggugaggugccuggcucagagucacacagaccaaagacuccagagucccuucauauauaacuacugcaccugugauacagaugaucaaauaaguagcuccauuuaggauuuaggauguaauguugaaguugauacuaaauccauaagcgcaaagagguagaacuuugacaauauuccuauuuuauuaguuauauaauguacuauuauugggagaagaagccuuccauuaaacacaaaaaucaaauugaaauuugguuucagcuuuaaagagaguggagucuggaaaauacuuuuauuuucuuuagaaaacuuuuuuuguuguuguuuuuaaguagauggaaagacaggcuccauccaccauugaggauuagaaguggagcagcaucaggggcauucaugcucagucugacuggcaaugagugucuggaauaggaaguugcaacacugaacuuuggggcaaagcauugagaaaaacauuuugccaguuacagccuuuuucuuaaaaaaauuuuuuuuaagccaaaacauuuuucuuuguacaaaagaaacuuuuuguuuaggacuugcuuggcugcaaaguugucugcuggcuaacuuccuauuuggaugcuauggcugaaaguugcugguacuguugugcacgguaaugugucuugccuucuuguucugugaacauaagaaaauucaaguguugggaaaccuacaccugaauauuccacacuccccuuguauugauauacauacuguuuaugugaagaauggcuuaauggcaucuacaggcuggcaccccuuugcuaauguguguagucuuccauguugaaagugucccauguuuagagugucccuuuaauuaaaacaauagaauuccuaaguaaaaggagaauuaacuaagugguaaucauguuagucuaagcuaauucauucuuuguaggaagaauggcucuuuucaacaguugaguuaaugugcuucugggaucuagaucacauguuuucagugauuaugguaggaauguuuacauaaauaguaaacuuucacucuuucuuagagauuguuuaagugggaaaauguagagaagauacuuugaaaaguaggguaaacuauaagcgauuuuacaauucaaauauguucauuugauauauauguuuaauucacuugaaguuuuuuuuaauugugucacuuuuuaauccucuucuuacauaauauucuaauucuugaaaacuuccucagucaauuuccaugccagauuucuagucaaguggugcuuugucuuauuccacacaaauuuaauguuacuguauuuuucaaaauaggcuuaaaauugcccugguuugguuuuuauugccauuuauuguuugcuuguuuguuuguuuaaauuauuuuuauuuuauguaauuggugcuuuaccuacguguauguaaaaggacgguguuggguccccaagagcagaacuuacagacaggugugagcugccauaugggugcugaauugaagagcagcccgugcuuuuaacugaugagccaucucuccagcucaugguuugguuuaguuuugugugugauugugggagugggacccagagauccaccccugcaacucauugugcuccuguacaugugauggacagugaagagaguggccaccaucugugacuuacaaaacuagagcucugaacuacagcucuggucauucugccuucuaaaauucaccagaugugcugaauuagaugugucagggaagcuaguggacagacccuugagcucuauccuuggagauucugaguuaaugaacaaaagauucagcuccauaaauacaagaugguacacacuuuaaugcugguacuuuacagggcgcgaggggauagugcagauagagacaaguggauauuuguuaguucaagacaaaccucgucuacauagugaguuucaggccagccaugucuaucuacauagauacauagugagagacucugucucaaaagagguuuaaaaaaaaauuuuuuuuuaaagcuccuauagccaagccauggugguauaugcuuuuaaccccagccuagucuauagaguaagauccagggcuacauagaaaaaccuuaaaauuaauguggaauugaaucccaguguuggaaaaaacuuaauucagaaacuacuugcagugacuuuuaaauauauuuuauuuuauuuuauuuuauuugauacagucucacuuuguuacccuaccuuccuggaauucacaguagaccaggccagccuugaauucagagaucuaagccgggcaugguggcgcacgccuuuaaucccagcacuugggaggcagaagcaggcgagaauuucugaguucgaggccagccuggucuacagagugaauuccaggacagccaggacuauacagagaaacccugucucaaaaaaccaaaaaaaaaaaaaaaguuuuuuguugguuguggggguggcaguaauguuuuauaguuuuguuguuugcuuguuuugagacaagguaucauaacacaagcuggccucaaacuucuaaucuuacugcuccuaaguacuugcuuaaugaucuuacauuucccaagugugggaucacaguugugugcaccauacccuacucaagagauuuuuuuuuucauggagauuuaaguacaugugaaacauugcaagguauauguuuguuuguguuuauuuuuguuuuguuuuguuuuguuuguuauuucugcuuaauguuuucacacuauaaaccuuuuacuuccagccuaauuuuuuuucauuguguuaguacauauccacccugcucaaguuuguuaggguuacaguuagccagaaugucuucauuuuccaaaauucuaauggagaucauuaaaauuaaaacacugauaaacuguagcccuggcuguccugaacucucagagaucugccugccucugccuccugggugcucugagagucaaaugcaugagacacgauggcugaguguuugaaaaaagaaagcuaguagacauuuucuuauuuauacaauaacccaaaucuguuugaucagcaagucguguaguguauauuauuuuaguagguaacaacuuucagguucucuggaguuuucuacuguauuauaaguugcugauuugugaaacacuaauggcuauuaaugccaugcugucuacuaauuggagaguucuuguuuagagcuuuugcaaaaggcuuguuauuucugcuuaauguuuucacacuauaaaccuuuuacuuccagccuaauuuuuuuucauuguguuaguacauauccacccugcucaaguuuguuaggguuacaguuagccagaaugucuucauuuuccaaaauucuaauggagaucauuaaaauuaaaacacugaugaagauguugccuucuuuggcuccacgagggaaagucuguuaguaaugagagcucuaacauccuauaucucaggcucaccaaagaaugaacaaggcaguguucuguuuacccucaaaacuucacaaaacacuguccaccacagcugguuaugaaaucauuauuagggagcaugcgugugccucucugugcgugugcgugugcgugugugugugugcucgcgugcacaaauguaucaggcuuuugguuuuucaagaauggguuuuucucuauguaacuggcuguccuggaacucuguagaccaggcugguuuugaacucacagagaucugccucccaaguacugggguuaaaggcgugugcuaccaugccuggcauaucaagggcuuuaauaaggagcugaggcuguaguucaguugauugaguaccuggcauacaugaaacccuagaggagguagagucaagagaaugaguaguucaugaauauucugagcuacauaauaaguuugaggccagccuggaacgcagaagacuuugcaucaaaaaaaguauuuaauaaaaaauuuucagucugccagguagucaugaugcucauaagaaaacccacuagcauucugacagcaagacuucuagccuaaccucacaguuuugccuuagauuguucuauacccaguucaaaacuauuggagugcucaggguucaggggaaauuggagagaaaacagggcauaagaaacuggcaaguucacuuccuaccaaagcacacaguguccucacuguuauccuaguaauuacauauuuugugaucaucguuucuauugugguuucuuuuucuuuuuauggaauauaucaguuccauuauuuuauuuguuuauugauuuuguguauuuuggucuuucuucccuguauuagcuccauaaagaacagguuuuuuucuguuucauuuacugcauuaaauccaguuucugaaauggugucuggcaugugauagacauaauuaauuuacuuugcugacagucucaucugcgagucuuucuucugaaucaucugaaauuccaugucuauaaaaugguaggcuaugcugucuuuguaaggucaguuuugcuugccucaggguuacauuccuguugggaaagauucagcauuuuaaccuagguacagggauucauuuaccuuacaccucuuucaugcugaggaucucagguauguagugauggguauacacaguuuacgacaucuaugucaucauuuuuuucggccaguuuuauaaucagacuuaauucuaugaccacccaccccauccuugaagggguucccacugccuagguuacagcuuuacuguucuaaagcucagauccugugacauaaaauuuauugaugugacagaauaaaacaacuccuguuuuucuauuuggagacagggucucucuacauagcccuggcuguccuggaacuuacuauguaaaccaggcuagccucucacugacagagagagaucuuccucccucuggugccccaaccccacccagugugcuaaaggcaugcaccacugcuccuggcuaaugaggcaacaacucuuuuauauggcauuuggaaacaucugauguuugaugauuaacaucugauguuaguaugauuuucagacucaagaaagaccugcugccuuucuaaaucaagaacaacuugagucaggcugcuaacucuuccuucucagauugugaggacuguaacaggggaucuguagagccaguguguucugaauuguucaacucacaaaggaagacauuacagcaagcucuauuguauagauuacauuguuccuauagaauaacuacccccccccaaaaaaaagaauggaaaaacuccccaaaucucccaguaccaucaccccuuuauuaugggggggguuaacuaauuaaaaaauaguuguccugaaaaauaaauguuuugucauucgaaauuuguagcaugauacuggcuuuuguuuuauuguuggcacuuuaaugcauguuuuguaggauaaccauugaccuuugguuuguuauguacuuuuguguguguguaucuguucauacacucugugugugugugugugugugauauuuuuaaaaauaaaaagcaugcugcuuggccugacuagcuaauguguguacuugcaucugguaaaugaucuuuuuccuuuuaaauucugaccauagcgggauugagcucucuuugcucugaugagccaccuucaaaaaguaugacuuccuccuuucuuucaucuucugaaauacauaacccugacccuacaacaccgcuuggagaaaagagugaaacauuagguagccaguuuguucuagcuaaaggaaaagaccccuugguucuucuagauaagaaaaaacuggacucaccucaggggaccaacaaggacagaguagacgcuccgguuucucuugcaacuggcauuccuugcagccacccuucuauuccagacaguuucccagagcaaccugcuuuucugucaaaagaaauugguccagcagaagaguggguaguuaaagaccaagaacccaagaacccaaacaagguuccagauggggaggacagaagugcacuggauuuugggcagucuaaggcagaacacauuuguacauauuccuuguccccaucugaacuuccaguagccaguguagaaaaagauucuccugagucaccguuugaaguaauuauugacaaagcaacauuugacagagaauuuaaagauuuguauaaggaaaacccaaaugauuuggguggcugggcagcucauggcgauagagaaucccccgcagacuuguuggaaaugaaugacaaacucuuuccacugagaaauaaagaggcagggcguuacccauccucuguacugcucgguagacaguucucacacacuacagcagcacuggaagaggugucuagaugugugaaugauaugcauaacuuuacuaaugaaauacugacuugggacuuagauccccaagcaaaacaacaggccaauaaaacaucuugcaccacagaaaguacaggacuagacaggagugaacuucgcucagaaauuccaguuauaaaucuuaaaacaaacccucaacagaaaaugccuguauguucuuuuaaugggagcacucccauuaccaaauccacaggugacuggacagaagcauuuacagaaggaaaaccuguaagagacuaccucaguuccacaaaagaagcugguggcaacggugugccaggcaguucucagcuucauucugagcugccuggcucuaugccugagaaaugggucucaggcucuggagcagccacaguggaaguaacuuuaccuaaccugaggggugccuggccuaacucugugaugggggaagucacagagguugauaguucuggggaaucugaugacacaguaauagaggacaucacagaaaaaccugacucccuuccaagugcugcugcaaaaacaagugaaagggaaaucaaagagacucccagucgugaaacugugaggagugaaaugugugaaaacucugagcagccgcaggcccagccagaaacuccuacucagaagagucuggaaggugagguggcuucacaaguaccuaauacccugaaugaagucacaccugaaaagcuugauaugacuaacaaccccaaaguuugcucagcagcaccuccaaguguucuuaaugagacaggauucucacuaacugugccagcuucugccaaguuggaaucuuugcuuggaaaauauguugaagauacagaugguuccuccccagaggacuugauggcuguccucacaggagccgaggagaaggggauaguggauaaagaggaaggugauguuuuggaagcaguguuagagaagauagcagacuuuaaaaacacuuugccuguggaacucuugcaugaaagugagcuaagugguucugaaaccaaaaauauuaaaagcaaauacagugaagacagcagagaaacaacuggaggugccccuacgaugucucccgacuuagagcaggagcagcucaccaucagagccauuaaagaauuaggagaaaggcaagcugagaaggugcaggaugaaggaauaucuucuggaggaaaacucaagcaaaccuuugcuccacagucugggccacagaguucaucugacauccuagaacacacagaugucaaaacuggaucugaucuuggaauucccaaaaauccuacuaucaucaaaaacacuagaauagauucuauuuccagccuuaccaagacugaaaugguuaacaagaauguucuagcaagacuucucagugauuucccagguaaccauuuacaacagaaauucugcauguggcugaugcugcugugauuaucagacuaccacuuuuucauuuugcuuuaugcccuguaagaaaaggcagacuucccacacacacuuagugaucacuuaacuuagucucucuauaucuguauuuccuaaagccacagacuuugggaacuaaccuucugaguucuguucuguuucaagguucuucuuucuuuauaaguggccuaaauguggcuauugccuuuaagaauaucaccacguucauauuuauuuaccaguuugugauuuugcugcuguuuguuuugaaacaagguuaccccaagcuggccuggaacucacuacguagcccaagcuauuguugagcgcauaguauccuucuucagccucucaagggaugagauuauaggcccagucuguauucuuauuuauuuuuaaaguucaguuuuuaaaucuccaugauaguaaacauugauagguacuuggauuuuuuuuuuuuuuaaagaggggacuuguaaauuuuaauuaguuaucaaagauaaaagaauuccugcagggaaacucgguaaauguaacuuuuaauuaauuuacuguauuccacaggguuuaugcuuugaaaguaggugaccauuauuacaguguucuuuuggaguaauacuuaagagaaacucauucauucuuauacuucaggccuacugaacagucuccagacaacaggacauuuaauaguaccagaagaucuucauguuucuuuuuuauuugaaaugaucucuuuccuaguagauggcuugcaggaaaauggcuuuaaaugcuguuuauuuugcaaaguguauuaguuacuuuuuauuucugugagaaacaccaugaccaaggcaacuuaaaaaagaaaguauucauaaauaaguaaauaaauaaaagccgggcaugguggcucacgccuuuaaucccagcacucgggaggcagaggcaggcggauuucugaguucgaggccagccuggucuacaaagugaguuccaggacagccagggcuacacagagaaacccugucuugaaaaaucaaaaagaaaagaaaagaaaaagaaaguaaguauucaaaaaggcuuacuuagcaccauagucauggcacaugccuuuaauuccagcacugggaagacagaggcagaugggucucugagccuggucuacagagggaguucuagaacagcuagggcuaaagggguuagggacucgcuuauaguuucagagagaaugacuucaugacaaucaugguggggaucauagcagcaggcagacaggcagagcucuggagcacuaacugugagcuuacauuugaugcacaauuaggaaacagccaauuggcaugggcuuuugaaauuucaaagcccacccccagugacacaccuuccccaacaguaccuauuuguccuuaccaaaacaguuccaccaacuagggaccaagcauucaaauauaugcaucuauucgggccauucucauucaaaccaccacaguuaagggguaaaaaaagauucuuaaagcucuguauacagccaguguuaaauuagacuacuacuucagugauacaucaguaccuuuugaauuccuggguugcauugguucucauugcaaccauuuugagugaugaagcauauagaaauuaggucauaaagccuccugucuaauucuggcauuuuuagacuucagugugaccuuagacagcaagccuagcugguucauugucuuucuuugguacugggacaaugguaguuauuuuacaauguuuuauaguguuauaaguaaagaauuuuguaaguauuuucgccuagaaugagaaauaaaaagagauguagaaguuaaggauauuucacugaccagauucuguuauugguaaauauuuuuaggugguaguuaaggcagauugacauaguuagaagcuuaaaagucacucuuuacacguggugacuuacaucuaucuguagcuccaguugcaggggauucaguguccuuuccuggcuuccucagacacuguacacacauaguacacuuacauacuugcagguaaaauaucaguacacauaaaauuaauacuaaauuuuuuuuaauguuauucuuuuuuuuuuuuuuaagauuuuuauuuauuuauuuuauguaaguacacuucagacacuccagagggagucagauuucguuacagaugguugugagccaccacgugguugcugggauuugaacuccggaccuucggaagagcagucgggugcucuuacccacugagccaucucaccagcccccaaaauguuauucuuuacaaauuucaaaauuaaaaaccuuagcaguuauuuuaugaccaaaucuuuaaagauguaaaacauuucuguuaaaugcaucaacuuguuuucacacaguguguacacaugacauguacauacacauaaguagaaaucuuuaaaauaaaaaauuuuuaaauaagagccaggugugguggcccacgccuuuaaucccagcacuugggaggcagaggcaggugaauuucugaguuugaggucagccuggucuacagagugaguuccaggauagccagggcuacacagagaaaccaugucucagaaaaaaaaaaaaaaaguuaaauaaaaauaaaaucaugagacuagagagaugguucagugcuuagaagcacuugacuacuuucagagguccugauguccugaguucaauucccagcaaccacguggcagcucacaaacaucuguaaugagaucugacgcccucuccaagugugaauaaugaccaagcccacucagucaacaggcagugcaggagugaggauugaaaggaaacaagacaguuagacaacauuguauggugaccccagucaauucugagacugaaggcaaauuuuuauuuuccaauccacuuuuuauaccauuuuuaauuacaugcaaguauuuugggcaaagcaguacaauaaggaacuaacaaagcagcaagcaauuacucccaugacaguuguuuaaaagggcuuguuauacugaccaaaauacuugagcccacuuccucguccaagacccaaaaucuugccugaagccuaguucuucuguuccacccuaagacuaaaauuccugccuugcccuacuucccuauuacagccuaaaguuagauucuuuuuuuuuuuaauuauucauuaguacacuguagcugucuucagaugcaccagaagaggucgucagaucucauuacagaugguugugagccaccaugugguugcugggauuugaacucaggaccuucggaagagcagucagugcucuuaaccacugagccaucucgccagcccuaaaguuagauucuugcugaaacuuacuuccuuauuaugcccuaauguuagauuccugccugaagcccauuuccuuguccuuggccaaugucagacuccugccaagcgguaccccaaaaggcuuuccagagaauaaagacagagcacacauauacauaaguuacaugaguaaauaagucuuuaaaaaaaaaauagggccagagagauggcucagcaauuaagaacugacugcucuuccaaagguccugaguucaaauuccaguaaccacaugguugcuuauagccauccguaaugauaucugacucccucuucuggaguaucugaagacagcuacaguauacuuaaauauaauaaauaaauaaauaaauaaauaaauaaauaaauaaagucaccuuuuuauuauaaccugguaggguucuauuggacccaguguuucuguauaugacuauacuuaagaauaauuuaaaagaaagaggucugaaggcaguauagaacauaaaaaaacaaacaguuucugaaagaguuaacauggaauacauuugaacaauuaaauuuaaucuauuuuucaugcuuuuaaccagaaaaacaggcuguaguugggaccugaccaguugagagaaaagguuuuuuguugcuuugggcuguuuguuuugagacaggguuuuaucuauguagucccccaaguguggguuaaaggugugcuaccaccacccaucaaaagaagauaaauuaagucauucucaaugaggagauauuaaaagggaagaaguauccugaaaaggagagauccagaggacaaaagccuaaauucuauaaaauaaucucuguguaaacuuuuucugaucccugaucuacauguguacaugagagaaucuaggcaauccagcuaaagauggaagaacggaaccaugacuugaucugcaccagugacaauuugcaaauagucuuuaacaaaauguaauggcaugcuuaaaacaacccccaaaaucaauacucucagugguuguaagcacuuguugauauagcaagaaggcucagguucagcuucuagccuccuuaggcuaggcaucugcacucacuuagugcacauacagacaagcaggcacccacccacauguacauaugaaauaaauacaaucauuuauuugcaugugggaaaguguugacuuggggucugucuguauagcccugacugaucuggagcagucugugcucaagcucaaagaaaucccucugccucucugccucugccucccaagugcugggacuaaaggaguuaaauaauuucuuaaugcaugcuauauggagaacuauaacagaguaguuacauuaagcuguaaaacauuuuaguuauagugucuagaauggaaaucaaaacuaacuuuguuaaaaccagaaaaauaauucaguuuggaaaaggaucucuauaaacuaaauucauauauuagaauuaaaucaaggccagccuagucuauauauaugaguuccaggacagccaguugcauaaugagacccuggagagggggugggggaaagauaauuuauuauagugaaggaaaaauguuuguauugaaugaaaauaaagggaaucucagccuaaaaauagaaacagaaauugccuagaggaaccccuagaacuauagacaucugaaauuugaaacucacuaagugaccacaauagcaaaaugggaaagagaaaaucugugaguuugaugaauagggaauuauacaaccugaaauacaagggaggaagaaaauuaccuucaaaacuucaguaaucuguggaauaaucaaaagauuguguaaucaaagucccacagcagacuagagaagagcuuuuugaagauaaaaugaucacagacuuccuagucaacgaaguacacaugcuggcuaaagcucagcugucaccuacuaggauaaguccaaagacaacucucaggcugagggacuggcuaggacucaguggguucagaaacugauagcauugcuaacaguugauugcagcaaaggaucacacaggaagauaccaggcgagcuuucagcugucaacacucucaacgcagggaaguauccaauucuucuacaacuaugaugacaaaauauaaagaguugucauccagaauuguuuguuaaguccuugguauccaggauaacaagccguguguccuuaacugcuacaugacuacucagacgccagcaucaccaagccaaaauaggcauuugccauaaaucauauuaccgggcuaugcuuaaucugaccauuaugaaauagcauagcccugagaucucaggcacauaaaauguuaaaaaaaaucaucaucaaauaaccaaagugagauauuuuauccuccucuccugcuuccaccuccagagugcugggaugugcaaccauguccaguuuuaacccagauuucuauauuaaauaauaggagacuaaaaaucaaggggcuggagaaguggcuuagcaauuaagagcccuaguaguucuuucagaggaugcucucuucuggccucugggcacugcguauaugcaguacaaauacacauaggcaaauacuauuguacauggaauaaaaaugaucuuuaauauauaauaaagguuucuuagaugugaaaaaaagagaauuuguuauagaugaccuggacuacaagaaaugcuaaaggaaguuuuccagauuaaagaagaaugacaucaaucccauuaagcacuaaacgcaauaggaucaagaauucaaggaaaaggcuggcaagauaacucaguggguaaagacacuuguuggcaagccugauacccugaguucaguuccccagaaccuacaugguaggagagaaccaguuuccacaaguuuuaugcaugauagugagcucaaucccagccugggcuacauaaagaaaaccuauuaaaaaaaaaaacaagaacaguggacuuaaagagauggcucauaaacuaagaacacuugcugcuccuacagaagaucuaaguuugauucccaguacccaugucagggagaccauaacauccuguaaauucaacuccacagcucuggccuccacagguaacuugcacucacuuggagcacacauagaaaauacacuuaaaauaacucuuuuuaaaaagugugaaaggaaucuauccuauauaauuuauaaaacaaucacuagcacugauuaaugaauguaacaaaauuuaagaagacauacuggcuaaugcucaaaacauaaguaauagaaaauaugucuaaugugcaugaggcccuggguuugaacccuagaacuacaauaaaauaaaguacucaagggcuggagagauaagucagcaaucaccuaugauuguagcuccaggagcucuuuucuaccuucuauggggaaaugcacacacacauaguuugaaaaauaaaauaccugggacuggagagauggcucaguggguaagagcacugacuguucuuccagagguccugaguucaauucccagcaaccacaugguggcucacaaccaucuaugauccgaugcccucuucuagugugucugaagacagcaacaguguacuuauauauaauaauaaauaaaucuuuaaaaaauaaauuaaacuugagauaagaucuuggaaaaaaaaagaaaauaccuaaaacucacuguauuguuauacacuaauagcaaauaauuuuuaaaaacuuugaaucgggguggguaguugcaagucagguaaggugguacaugcaugaaguccacuugggaagcuaaaagaggaagaucuugaguugagagaaccugcaacccugucuccugcccccugccuccucucccuucccccccaguacauaauauauuuucauuuaaacaucacaauuaacaaaaaagggggaggcuggagagugcuccagcuugguggcuuagagacuuguuacagaagaccaagguuugauucucagcauccgcauuguuuuuuaauuaagaugugcuagaaacuacagauuacugcagaggaaaaugaaggaagagcuaaggggaaaagauguucuaucugcauuuggaagacuggcagucauuaccaugucagugcuguccagaauguggguucaauauaguguggucagaguacaaggauuuuucugccacagaaaauugaaaguccaaauggaauucuucuguggaaauacaaagaacuuagcaaacccaagcaguauuggaaaagaaaaauuaagggacuuagaauauucaagauauuauaaaacccuaguaauaaagacagcagugauguugaaaguuaagcagagcacaggggguauuacuacuaguucagugauuuaaacaguguuaguucuuauucuauaggucagaaauguagaugugggucaucugcugaucuucugugcaaagucuugcuaggcugaagugaggucugguucuaaaacugguguguguguggcugugugguccagaauuguaaccucaucugaagcucaagagcuugucaucagcuucuuugguugcugacagaauuuaggucauggagguugugggauuagaucccuacuuuuaguugugggggggugguaagagauggcuggagagguggcuucgugccuaagagcaugcauuguucuuggaaagacccaaguucaguccuagcaccuacauugagugacuuauaacuaccuguaacucuugcuucaucagccacuuggacucaugugcacauacccacacagacaccaaauacacauaauuaagaaauuuuaaaucuuuuuuuaaaagauuuaggucuaggcaugguggcacauuccuuuaaucccagcacuugggaggcagaggcaggcggauuucugaguuugaggccagccuggucuacagagugaguuccaagacagccaggacuauacagagaaacccugucucaaaaaaaaaaaaaaaaaaagacucagauucaaaauauauuuacaaauaccuuggccauaucuaggcucuucucugacuauaaucauaacuuagauaacccaauuauuuuaaucuacauucugccaugagccgguuaccuguacucagguaccauguagccaucuccucacaucuucagagguggaucucccgggucugucccagaauccuuucucuggauguuccaccuucaauuuccuaacuaauccauaggccaucagauuuauuauugaugggugccacauucauacagacaucuucucuccaggauguaggugcugggaacugaacuagucuguaagauaaguacuccuaauggcuaagccaucucucaccccagaucacaacucucacuagcuaucaacugaaguggaaagugcuggucguguuuagcuucuggagcugcccucagguucuaguacucacgugguugcucacugcacugacuagccucuccuaaucacagguucuacucauaauugagaacaagugggacauucuauacaggacacauaaaccaaguggcaagucuuaggcaaugccuugggauguugcccaccaguucuaacaucacaugguauacaaaauuaauugaaaaucagucaguaaacauaaaaacuuuuuuaaaaaucuuacaaagccagggugguggcuaagguuagauaagaggacuuggguucagcccaggcugaguaaugagacuguugcaauggaagagaagaaaaaagaaaaaaguaucuacauuguauggggcuagacaaaggguucuuaggucauuggauguacuaaucucagaauaacuuaauuagacuuuaucaaaaccaaauuuuuaauuuuuuuuuaaauuuuugcauaaugaaagacaucacuaauaagucacugccuuaagaaaguucaugccaaaauguauuuauuggacuaucagaaauuggacuaaacaaacuaauuauacuucccuguuaauggcuaguuuuuggcuaucccacuuugugcucccagcuggucgcaggcgcacaccugcccaggagcuaucucaguuccacagaugaaagacucacacacauuagcucauuuuuaagcugccuuauuauagggucuguggcugggcucuucaaagccuuccagcccuuccuucaagcccuuaccuuuuacuccuagcucaauauuucuaaaucugcccucaacuuaguugcccaguuaccuucugugaagcccauaggucuugcugcccaagacacuuucaagcuuccuucccuggaccucuuuucuuuuccgccuacguuuuggaagaucuccccuacagcucugagucugucucucuuccccuaaauucuccuccuccuccuagccugcgggaaccuggaauuccugccucuuucuuuccacucagccauuggccacuggcaucuuuauugauagaucaaaacccaauugugggcaaggaccuccagcaucaguaaacacagauucccaauuaaaucaaagcaucagacccacuccucuacauuuaccagaagauuuuacacaaacaacaguaauacaguguaaaucuguccaauacugaaucucacacaguuuaaauaguuaccacuauccauucauucuaauggcucaagcuaaauacaguuccuagugaagggggagugacagcgagagucucauggacuguggcugagaguauaaaugaggaaagcuggacagauucuugaaaaacaauacccauuuguccuacagccuagcaacuccacuauagaggaguaaaaacuccauauacauacauauauacacacacacauauauauauaugguaguuuuacuaauaauguccuaaaguugaaacaauaagggaauaaacauuccuugacauagcuauguuuguguauagaucacaaggacaacuuacaggagucaguuuucuccuccuaccuuguggauaccagggaucaagugaucuuaucugcugagccaucucuccagcuggacauagcuagguuggauuuuuuguuuuguuuuuguuuuggugcuugcaucaauauaaaucucauauauuaugcucagugagaaccagcauaaaauaauuuguacugugucaguuaugucuaugugacuguagaacaucugugugacuguagaacaucugugugacuguagaacaaaagaacugggacagcagugguugcuuuugaguugcugacuuuuggguuagucagcuuucuacuacugaagcagaugccugaaauaacuugccaggcucauaguuggcuuuguugcucuuggaccuuuggcaucaccaaaguagggcaaacgugcugaagcaaaacugucagccuuauggccaaaacacaaggaagaaacucagacccccucaauacuccaugaccuaagaccuccacuagacacccaaaccuucccaaacugccucucugggaaucagccuuuaacugaaugggccuuugggaguaggugugggggaucgagauacaaacucuauaaugaaaaaggugcaccuucaggaguguggucuuuuguacacuuugaucgaaauugaacagauguacauauuguacauguacccaaugacuauguuuauguaguuugcuguaauuuuacauuuaaagaaaaacgugaaaagaauacuccauuuuaguccugguucucaagcugaaguagauguccugauaaccacuguuuauuuugacaugcuuguuuaaacacuggagugagcagaaggauacagugcaacaucaguggauaacaucaauguguuuguacuuuggagguggggggggugggguucaaagcagggaggguuucuuuuuuguagccucaacuguccuggaacucacucuguagauaggcuggccucuaacucacagagaacucugccucuggagugcugggauuaaagguauguaugugccaccccaccuggcuaaugugcauguaauuaaaugcuacugaacuacucuuuaaaaauagcccauguugcuuuaugguauauguauuuaagcacauuguuuuagauauacuauuuuauguguuugagucuuuugcuugcacauauguguguguaccaugugcaugccuggugcacuuuaaaguuagaguugggcauuggggaacucgaguuaacugacaguuguaagcugccauaugggugcugggaauugauccucaguccugugcaggaacacaugcuuuuaacagcugagccaauuccagccuauuagcacuuuuuuguuuaauguagaaguuggacaugauggcauuuagcguugaggcaggagcaauacagugagcuugaguccagccuuugagacagagugagccccugucucaaaaacaaucaaacaaaccaaauaguguagguguguagcucagugauauaguacucacucuuggggccuuugguuuccaucccuagcauugccugagggaauaaaauauaggugguugguuaaccugaaaugauuaucagcuaugcuaugcugggggcaauaaaacagaggggaguaucuguucauuacccagaugcccacugucuuaguugagguuaguauugcugugaugaaacaccaugaccagagcaguuuggcaaggaaaggguuuauuuggcuuacacuuccacaacacuguucaucacuggaggaagucuggacagaaacucaaacaaggcaggaaccuggagcuggugcagaagccauugagggcugcugcuuaccucuugcucccucucaaucugcucucuuauagaacccaggaacacuaguccagggguguccccgccacaguggccgcucucacaucagucacuaaauaagaaaaugccuaaggcuuggcuacagcccugucucgaggcauuuucucaacugaggcuuccuucucucuaaugacucuagcuugugucaaguugacauaaaacgagccaguacaccacucuuuuuucacaggagaguuauuugcuuuuaaguuauuugcuuuuuugaaguuuuuaaggcuucaaaggucagggauauguauguguauuuaccugcgucaacuaacagaaaaagacagacaagcugacuaccacucggguuugaggcuggcugaggugucccacacuggcagaggauguaagggguaaaagugggaggauugcacauucaaggcaguucaguugcuagaguacuugccuggcauauaggaaccccaggguuugaacccugguacugcucaaguggggcaugggggcacaugcuguaaucucagcacuugggagguggaagcuggaggaucaaaaauucaagguucugcuaguuuugaguuugaggccagccuuggcuuuaugagaaccuuucuuuaaaauguuuguguguuuaaauuuguuagcacuuacguaguuuuucaguuagcgugguccagugacucugcucuauaaauucuuuucuucuuuguugagacagacucucacacuguaacuguagcccagacuggccuuaaauucccgcuaauccuucugcuucagccucccaagggauuucugguguaauuguuuacagggacaggauuucagguguacucuauuuaccacgcccaucuucuauacaguuccuuaauuaacaaauucuguaaucugauguguguaaaaacacacccagauuuaguaggggaagaaaagaaaaaaaacaaguccuugugucuuuagccguuuauuaucuagcugcguccuaaauaagggagguuaagaguuucaaaaccaccugcuucacagcuuggggagggcuagucucacaucccuguuguaugugcuuuacaaauuggaaauuggggguaaagauaaugggagguuuuugguuuugggguuuuuugguugguugguuugguuugguuugguuuugguuuuucgagacaggguuucucuguauagcccuggauguccuggaacucacuuuguagaccaggcuggccucgaacucagaaauccgccugccucugccuccugagugcugggauuaaaggcgugagccaccacgccuggcugacaaugggagguuuuaaugauuaaaaaaaugacuuauuuuuuaagaaucuaguggguaucaauuugaaagaggucucuacaaaugucuuuggccugcugcuagacgcugcugcggacaaagcaagacugugcacauguuugacagugagagcuuuuccugucagugaucugugccacuuggaggaguaugugcugagguaaugguaaauaugugguagagaaaacuuaagccuuaucaacauacacaaaauugggaucugaauuuacagauaucuaguaucuuuugcaacuuaaaaagugauuuaauuuaaugaaaaccaugcaauuuuuaaaaauaugaaaaucuaguccaauggggaaaaugccuucaucauuuuauuuuaguacaauauuuuuuugaaacugaacagucaccaucaccuuuuauuuaauuuagcagugcauggaacuugggaccuuagcaugcuuagcaaggaagucuuugcccauuuacugcaaaacccaucugcaagucuuuacccauugcugcaaaacagaucuuggucagaaaauccaaaguuaauuuuuuaagacaggaaguuaaaauugggagaagcgugcccugucagugagcauccucuuuauuaaugagccguucccccucuuguagucggaaagcccgucuuuaacugagaaagaucauuaguuagugcuacaaauggaaaacccuacucuaaacaaaucaaccagcgugacuuuccccccaucuaaaucuuauuacauguauugaguauuagcaaauuaaaacaaaaaacuuaugcaaagaaaauaaaaccuugugucaaucuuaaguuacucuucaaaaauaaaauuaaaguuggaguuuugucaauuucaucccuuccuuuuucaguauaaucauuuucuacccuuacuuaagaaugcuugggagaagcuccacaugguggcacaagccuuuaacccucgucuggggaggcagaggcagacagaucucugaguaccaggacagccagggcuacacaaagaaccgugcuagggaaagcacgguugauccuuguugauccuuggagauuucuauauuuaaaaucaaaccaaacucuuucccuaaauuugguaauaaagcauugauaaggaagucagcaaagugucaaugcugcuccugacugaacuugcggaacuggcagcuuucuucuuuugagaacgccauuaggcucccucuuuugguauauuauggguacugcagcuggcgaccuuaaaucuccuagcaaguaguagaaaaccuuuguuuucaauaauaaagauaaaguggggcccucagaccaggccugggcgccuggaguugcucccuagagccaccgcgcugugcugcugcugcucgcgcggcuccuuaaggccacugcaauaacggccgccuuggcggagcucuucagagcagacagaugcagcugcugguaccuaggcagcaugcgauggguaacugcugcuggacgcaguacuuugggcugcaccgcaaggaagggggccugaugcagacaggaggaagcagugcaggauccaaggguuuuagagcgugcccgagaggugagcacuuaaacacaguuugugcaccuacucauaagugauggcuugagaaugagacacacauacacaaagcauccauaaaccaccuccuaaggaagaagcaguuaacuuguaggagaggcauuauaagucgauugcugcaaaacagaucauggucauaaaauccagaauuaacuauaagaaaggaaguuaaaauuggaagaagcagcuggguacugccugccucugagaagacagggcaacaaaguagagaaagcacgugaggcaggaaagguacagcugugccaugauguacuacuagcacggagaccaaaguuauugaccagaagauaaguauggaucuugccagauacacaguauugacauaaaguaccaaaagcagcuguaauuuaacaacccaaacuaaguuagcuugugauaugauagcccauccuuagaugggaccagaauguuuacaauguuucucauaaggcagccuuucaaaacaggaagacauucccuaggcagcacuuagaaagugcugagcaagaggggaaaggacuuuguagggcugagauggaugacaguggugacucuugaguauugcagccuugugaguccuggcuuaagaacuguucuagaaucagucuaaaacagaucaacagauugggcagaaugaaauuuugugauccugcuuagcaguucugaccuagugcuuaaaaguggacuagaaugcauuagugauaaaugcugagccuuuuaaaggggagcaggcacuacguuguaaaugcuuguuuuacaaggagugaagaugauggaacacagcuaauggcuucagaaugaguguagauuucaccaucugccuucugcuuuucaagaccaauugaagggcucauuuuauccuuuaaauuuauuuuaaccuuuuauaguauucuuacccuuguuggguuuugcauuuuaaaccuuggcugauuuuacuuugucugaacaaaccuguuuuacuauguaacugaaaaucuuuuuuuuuuuaaagaauuacuuaaauauuuaauuuauaugaguaaacuguagcugucuucagacacaccagaagagugcgucagaucccauuacagaugguugugagccaccauaugguugcugggaauugaacucaggaccucuggaagagcagucaaucucuccagccccugaaaaucuucuaaaaaguguuuuuguuaagucuuagcagcuauaaagagagcugagugaggauggccaguuauguuuaggauacuguuauucccacucuccagcuucauuuauuuugaugaauucuuuaauuuguuuuauucuaaacacaguuaacuugaggaaacccuaagaaaugcaggguaugguuucuuuccacaucaaucacaaaugcauauccuaaugugauauugacacauucuaaacagggauacuauauuuaaaaaaacaaaaaaaacagccgggcgugguggcacaugccuuuaaucccagcauucgggaggcagaggcagggggauuucugaguucgaggacagccggggcuauacagagaaacccugucuucaaaaaacaaaaaaccaagcuacucuacauguuauagugauauuaagauuaauauauaacuacaaauuuuagauauauugguuucuugagguuuuuuccuauuuuaaaauuuucuuuggggcuagagagagggcucagcgguuaagagcacugacugcucuuccagagguccugaguucaauucccagcacccacaugguggcucauagccaucuguaaugugucgggagacagcuacaguguauuuacauguaauaaauaaauauuuuuaaaaaaauucucuuugaaagauuuuacccaaaacauguaaauguggaugauugaagaaaacauaaaugauaguaauacagguauuuaaaaguaaaaauccuuuugguaugaaagauuccauugguucuacuacucuuugauuuaauggcauggaacuaguauaucaauauauauaauuuguggaaagcagauuuucacuaaguuuaugaagcaacauuccaguuagaggaauacuauugagaugacucagaaggaaaggcagcugcucccaaaccugaccugaguucauggccagaaccuauaugauuuaaggagaacacuguuacugugucggacuggagcuccaaacacucagcagagaugaaaaugagcaaggcaagaauuuucaguaauagccaggcuaccugcucuccuugggaccagaagugagcaagugaccccagcuauaguggacagacucuuguaaagguauuuuaugaccuuugcaagcaagcaaagcuuaacagaaauggaacuuuucggacuagcauuuagcauaaacgcauuguuacauuuuuaacaucauuaugggcugccaauuucagaaagccuuguuuuucaagucagguagaccuaguuugaaggaguuauuuguggucuaaugauuugaaaaacagucuguacaguaggaacauaaaucucauuuuaccugagaaauacaaauaccaagacuuuuggaaacaaguccagaaacuuaacaguagggagaauaaaggcccuguuauuauuuaacccauauuaaaaucaguagugaaggcagaaaugggaggggucagcuucuaauaagcaccaacccuugaaaguguuugguagcacacacacagguaugcucauaaaugcaugcccaaucgugcagcacuaaauaaauaaauaaauguauguuggauuuuuaaacaaaacuaaacaaaacaggaauauaaaaugcucccuggauuuggugaggauugagcauggguuucuguaagcacacuuaccugggcucuccuuaguauguuuucuuuuuugucuugcagcagcaacagggcaauguccugaaaagggaaguucagauagcaagaggaacucaaggcuccugcugugcugacauagcaugcacuguacuugaauuauagugagaucuagguucuguuguuguuuucaucucagagaugaguaugacacuuuagcauguaaauauacauuaaaucauacuguuguguacauaucaauauaacugaaguuagagcuucaucauugaaaaucacuuaaagauguugucuggcccuauuuccugugcuaaugcuuuuuuuuuuuaaguuguauuuugcaugagauaaaugucuuguuuuggcacaaacuacuguaguaguuuguuuuaggcuuucacuuguaucuguaucugcuauauguauaagucccuguagaggccagaagaagaaucagauccucuggagcuggagauacaggcaauugugaacugucugauguggguacugcaaaucaaacucuggucccucagaauugcagucacucuuaaacugaaccaucucuccagcccauugacuuuuuguuuauaaugaacuuucugaaggagugguaacugcucaagauuauaaauaagcccauuuuugcauguaagcaucuuuuuuuaaaccuuaaauuuaaaaaaauguaugaccacuguauuaggauccucuagaaaaacaacuuauaggauggaaaaauauauguauguacauacaaauauauacgggauuuauuagaaugguuuaucugcuguaguccaucuggucuaacaauaaguagacuaucaacagaaaguucaagaaugcaguaguuguucagaccaugagucuggauuagauaucuuagcuggucuucaguauucaucagaaucucaaagaaguaggcucuaaugucaguaaaggaauagacuugccagugagaccaagcaggcagagaacaaaagcuuccuucuucugugcccuuuauauaggcugccagcagaagguauggcccagaugaaagguggaucuucccaucucaaaagaucuagaacucaggaggcagaagcagguagaucucugugaguucaaagccagccuaguuagagugaguucuaggacagccagagcuacacagagaaacccuguccagaaaaacaagacaaaacaaacaaaagaucuggauuaaaagugggucuucucacuucaaaugaaaaaaaucccucaagguguacccagccacuuggguuuuuagcugagagagagagagagagagggagggagggagggagggagggagggagggagggagggagggagggagggggagagggggagagggggagagagagaagagagaggagagagaaaagacccugucucaaaacaaaacaaaacaaaaaugcuguacuggcaguggaaacagaugauuucaaaacuacuguggcuucuugcuagauugaacaucuauucuaaaggcuucacauuagacuuugacagcuacccuuuugucacauuugucucuuaauucuaccagagagucagcgagguaaacauugccaaaugauuugccaccccuacacacacacacacacacacacacacacacacacacacacacacacaaacacacagagucuuuuuuuuuuuuuuuuugguggucuguacugaauacauuuggcaaauuuccauguugaggaacaguauaaggaaacaaagggaaguuguagucacacuggcucuggguuaugaguuuguucugucacagaucugaagagucuauaaaagauaaacgagguggaggugcuccuagaagaaacaaagcuguaagaucauucagagugaugggauacagaguguagggcaggaaguaacugcaggccaaggccaaaugaagcaaagcugcaaacugagguuugagguguagcacaauauugcccuuuaucugccauucccuaaugcccuuuuucuggucuaggcccaaaauuccacugguugagccuagagcuuuucuguauuguuaugcaguuuauauucugcaugccucuaaggggcacuagucacaugugaauuguacaucugacuaucuuguauaacagcuuuccagcagguggcaguaaaguccaugaggacacaguggcucuuuucaacuuugcaaauguagaaauccguuuauuuucuuucuguguaauaaaauuagauuuauuaauuuuauuuauauaaguguuugccuauaaguaagaauguauguaugcaucaugugugucccuggugccuauggaagccaaaagaggucuguuacucuccuggaacuggaguuacagaccguugugagccaaucuguggaugcuaaauucaggucuucuggaacugcugagccaucucuccaguccgcuguugguuacacugguaauuguuuguuuccuugaauauuuauuuauuuuauauauauggguacauugucacugucagacacaucagaagaggucaccggaucccauuacagaugguugugagccaccaugugguugcugggaauugaacucaggaccucaggaagagcagccagugcucuuaacagcgagccaucucuccagcccuacacugguaguuuuuaagaauauagauuaguuauuuuguaggacauuucuccagguaaguuugucuaguuaccuucucuuuuuaaaaagguacauguuuggggcacauaucaucaauuuguuugauugguugaugacaugaaaccuuucugcauucuguauugaaacuauacuuauagacaugagaacucgacauaggugugugccugacuuuugacuauaggaauuacccugcuuagcgcuggcccuuuuaggucuccuucaugcaguucccuguaucggcucaguucaaucaugugcaccugacuggaacccuguuuucucccgauuugcaaaauccacuaccuggaacucaguuucccagcaggaaucucaaaaccucuccuuccuaguaaaucacauaaguuuguugcauguagguaauaauacacucuaccugcacuggacuugaaacagcuuuagggagauggugccauuuucuucacuuuacaauggagaauggcuuagaauggugaaaaguagcacagguagaaauggccaagacucagacucucaucuguccaacucuagaggccuuguccauuuuuguaaggcuggacaguuuagcaagacccugugucuuaagaauaaaaacagucagauaugugucacaggccuacaaucccagcucguaggagaucaggaguuaaagguuggguuacaaaaaacaacccauaauaacaaaaucaaaaguaaagaggugccaggauacuagggagauagauggcagccaguaaagcacagcacagccaaggugguccuggguucucuaacuucuauucccccucucuuggcagugcacgaucugauuuucuggcgagaugugaagaagacuggguuugucuuuggcaccacacugaucaugcugcucucucuggcagccuucaguguuaucaguguggucucuuaccucauccuggcucuucucucugucaccaucagcuucagagucuauaagucugucauucaagcugugcagaagucagaagaaggacauccauucaaguaaguuugcugagauagcacaugucugaaguucuaaccugucucuuacagauagauggcaaaagcagucccuaaauacuugccaucacccuaagaaguaauuagguuaguaucugagaacuuuuaacugacuagagacucacacuuaaggcuaauaaauccagagcuauaaauccagagcagggcacagaauagcuugcccagggcagcccucagucagccauuguguccauguuucaguacuauauaguaacagcuagaaacagcuuugaauuccaaguucuagaaccaggggguuuuauuucugauuuucuuuaacucuagugcaguuucccugagucuaggggcaguuauuuuuacccuuuaaaauaauauuuauguauauggcuguuuuaccuguauguaugccuguacaacauaugcauguggugccuuugcaggcaaaaagagugcaucugguccccuggaacuagagugcggguuguaauuauaaauuaauauaguaauuguugacuuagugaauauauuuuacaagcucagauaucuuuuugucgggaggggggguguuagagacaugggacgguuuggagacaggguuuguuuguuuuguuuuguuuuggugggacaaggucucugugugucucccuagcuggcaaagaacucacuguguugauaaggcuggccucaaacacagaaacccaccucccucugcuuccauaccuggaaacaucucauguuuaaaaccuuuauauuuauaaacaggaaaaugaacacaugccucuuacucuucugcucuuccaagaguuugagcuccucaagaugucuucaaaccugauaagcaguagacgcucaguagcuguugugugaaugaacagguuaugagcacaggcuuaccccucagaacaagaaugccagacauggucacuguggcaugccaaaaucgcagcauuugggaggccaaggcaagcagagcucuuuaaguucaggccagccuuaucuauacaguaaguucuaggggcuauguaguugagacccuuugccugccuauacaccuaccaccacccuuuuuuuaaucucagccucugaaaacacaguguguuauauaguuugcagcccuaacauauucaugauugcuacccuccucagucuuuccuuugcuuuuuuaaacuaugcucccugcccacagcuuggagauugagccuaggaccuuacacauacaaggcaagugcucuaccauugagcucuagucccaggccuuuuuuguuguuguuguuguuguuguuguuguuaaguuuuuguuuugauggugauugcuugacacaaggucucucuacguagcuuuggguguucuggaacuugcuaagacaagguccuagccagcaagaugcucagcagguaaaagcuugacaaucuaagcuugacaaucugauuucagucccuaggacccacaugguggaaggagagaaccaacugccacaaacugucccccgaccucuacuugugcaccauguguguacccacuguuuuagacaauguccuauugcugggaagagacaacaugaccacagcaacuuuuauaaaggaaaacauuuaauugggacuaacuuuugagagguuuaguccuuuacaguucagaguuuacuacaguuuaguccauuguuauggugggaagcauaacaguguacaggcagacauggugcugagaccucugucuggauccacaggcgaccaaaagaggcaguaugaaccacugggcuuggcuugagcuccuaaaacgucaaagcacacuccuaguaggccacauuuucuaguaguaccacugccuaugagccuguggggucauuuucauucaaaccacuacacacacacacacacacacacacacacguacauacacaugugcauuaaaaauaaaacaguguauuuggacaguaggucgguaggaaacuguuaaagaaagagaaaaagagaaggacaggauagggccagagaaaugacacccaugguaguucucugaacucaacaugcauauacacacaaacacacaaaugaauuuuugguuuuuacuuguuuuauaaugcuggggauugaaccaggaucucaugcaugcuaggcaagcccucugcuaucugauguacagaguguauuuugauauaucuacaccagauaguucuucauuguacauucauagauaacuggcauauuagcuuuuaucgaguaaaggacagcuguguccccuacagaguucuagaaugcugauuucacacuaaaauaccacugugcuguugaagaauuuccccuugugugucacaugugcgacuguuuuuucuuccucggaagggccuacuuggauguggacauuacccugucuucagaagcuuuccacaacuacaugaaugcugcgauggugcaugucaacaaggcccucaaacucauuauucgucucuuucugguagaagacuugguugacuccuugaagguuaguugcugggcuuuaauuuagagguaagccgggcagugguggcgaaugccuauaaucccagcacuugggaggcagaggcaggcggacuucugaguucgagggcagccaggacugcacagagaaacccugucccgagggggggugguaaaauagggcauauauaggguuuuaucagaaaagagaaaauaacuaucaacagaaaaugcugccaccuaccagcauuagaccagcauuagaccagcggucaucagcucagcacccugaaauuauggaccccaagacagugaguuuucugacuauaagugcacaugggggaaucugugucauaaaacacugcauugaugcaaaccuaguuagcuugaacucggggguauguuuauucuuauuuaacccucugacacugaccuucacagcuggcugucuucauguggcugaugaccuauguuggugcuguuuuuaauggaauuacccuucugauucucgguaaggugacaaggaaagugugucuuugugcuuauuucuuuaaagacuuguaagacuaaguguaaaugccgggcgugguggcgcacgccuuuaaucccagcacucgggaggcagaggcaggcggauuucugaguucgaggccagccuggucuacaaagugagugccaggacagccagggcuacacagagaaacccugucuugaaaaaccaaaaaaaacaaacaaacaaagacuaaguguaaaugcugagcuagaugguacagaccaauaaucaaagcuguucaagaagcugaagcaggagaaucaauccuucaaggccagccuggcuaaccuaauaaggcccuguccagggcaaccaggcaugauggugcauacaacucugaugcccucacuagguagacagacacaggaaggucaggaauucagcaucauguuaagcuucacaauauguucugggcccacugaggacauaaaaaccaucaauaaagugaacagccacaacaauguagcugaggacuggagcacuuugcuacagaucacguaugcagugugaucucuuacucuguagagccagccugugcauuuacagugugguagacguuaguguagccugggcuuguggccgagagcuuauuaaaugcuuucacaaaggauuucaaagcaaccgugaauaaagagcacuguuuaaauuugguuuaaauauggggaccuugcuuuuagaaaccacuuguaguuuagaaguugacaccugucauacaaagaaaauagccuguuagggguuuuucaacacuacccuuaucugcucucucccagcuauccucaauuucgagagcucuuauuuuuccuuuuugauuguuucucuguacuucaugaagaagugucugugcugcuugagucucacguuugcacuugcuguguuuuuauugucuuacagccgagcugcuugucuucagcgucccaauugucuaugagaaguauaagguaggcauuuaucugugguagauaugcugaguaaugugugacuggcuucaguucauuuuaaggaaaguaaaaaacggauagcaagagagacuggaggccuagauagauguucugagucauagggaugaauugcccauuccaaaaaggaagguaaaaaagaugauuuguaaagcuaaucuucuaaaaacuaaacugcacuuccaaggaaauguuagugugagcagauguuuccauuguggacgggguagauuaucucugcaucugaagaccuuuugggagugucagggagauggcucaguugguaaaaugucacacaagcaugagaaccugaguucuuaucucaggcacccacauaaaaauaccugguguuaaauguacaccugcaaccugagcccggaggaggaucucugggacuuauuggccagccauucuaaccaaaucagugagcuauagguuuagugagggacugaacugucucaaaaaauaaaguagaugccuagggauguagguuagcuggugaaguacuugccuagcccuagguaaauugugucuagggaugcgcauccauagcaugugggaggugagucaggaaggugagagguccaugcuucagccuuauuuacaugguaaacuggaggccucaucuuuaaguuaauuaaauugauuaguuaauaacaagauagagagcaauugaagagaaaccuuagaucaaaauuuugccuccaaagacacaugcacacucauacacauaugcacuaauaugcacauauaaaaaauauuuuuggcucuuaauuauuaaaugaauuaauaaugcccaggagucaaaaacacaucacaacuacagaauagauuaaaucugcaauuucuaguacuuagaaaaguacuucaguguuacuacagaaaauaccacauaaguucuacuuguacaaaugauguguaauuuuuauuuugaaguguuguugaaaucugaaaacagaacuuucacuucugaaaaacuggacaucauuuuuauuuucugggauaaugaauacugggauuuuuuaauacuugcacuaaauaagagaauagugccuuuugggggaaauaagaauauuaccaaaauauauauuguaugaaauuuuucuuagccccuuuauugcccagcugagccuucuuuccuuccuuucuuucuuaaagacacagauugaccacuauguugggauugcccgggaucagaccaagucaauuguugaaaaguaaguguacuuagggaccacguucacuguuucccauguggacuccucucccauauuguuuagucucuuauauaaaauguuacugucaaacguaacuaguuuucauccugaauaaaacuuuagcuuuguuguacuuaagaagcaucuuugggcuuugugguggugguuugguuuguuggguuguucauuugguuuagagacagggucuugcuguguagcccaggcuggccucaaacuuaauauccuacccuccagcucucaagauagaaaugaucaagguaaauacuuuggcugucaaauauguuugguuauuuaacccuauuuucauauguauccaaguuaaggcaaucuuuccugucuuuucuaguaaguaauaaaaagcuuagauuccgucauuguggugaacaccuggaguacuugagaggcagaagcuggugaaguugaagguccagccugaauuccaagauagccagggcuauguagugagagccuaccucaaaaagagcaaacaaaaaucccuguuuugcuuuuuaaaguucuauaagauaucaugaauuuuuuuuuuuuuuuuuuuuuugguuuuucgagacaggguuucucuguguagcccuggcuguccuggaacucacuuuguagaccaggcuggccuccucgaacucagagaucaaccugccucugccucccgaguacugggauuaaaggcaugcaccaccacacccagcuucaugaaaucuuuuuaaugacuuuuuuagauauuuuuaagauuuauuuauauaauuaaauaaacaguaugcuguuuucaugcacaccagaagagagcaucagaucccauuacagaugguugugagucaccaugugguugcugcaaauuuaauucaggaccucuggaagaacagccagugcucuuaaccucugagccaucucuccagccccacgauaccaugaauucugaauuccuuaucugauacugugaaucagggaacuacuuuuacuuugaauggucacagcaagaugagcccagcacugacuuagcauguucuccuuuuucuguuuccuucagcucuucuuuaagaagugaagugcuacagcuguugacucugaaccuuccaugccccagauuuuagugucuuuucauguuaucaggaggaagcugaagggguuaggaguguaguuaagugguaaagcauuugcuuagcauacauggccccagauuuccauccacagaacaaaaagaaagaaacugaauguaagccaggccgguggguauugaugccacaauccucaccugacuuguuugcuucauugugcgcucacacuaacugcagguugaaggcauccauagauaccuggugcuguucaccagagcuggacugcuuuguuguugaaagcguuagcugauguguauaauucucagugagaugucaccucuauggagagcagcucugacaacacugaagguucaaaugaccacuucaccagggucaaagacagcucugauguccucuugccagaccuuguaguucagagaaccaugaaacuaaccagccaugcccuuuuuucacaccucgucuugcugacuugucauuccuucuugacgcuccuuuucuuguacuucacaaagggaaagacaugggcgcucacaucaucaucccaagaccuuaauacucugauucuuccuggaucccagugaagggcccagggaucacuguagugagacagaaucaggcccugcaguaagggcaguguggugggaccccucaggcuuguuccagacaguugagccuuaccugacuucagccaucccugagaaacagaccuagaacaaaccuauauuaaaaacaaauauuuucaguuuucuuuuucuuuccucaauaggauccaagcaaagcuuccuggaaucgccaaaaaaaaggcagaauaagcacgugaagcaagaagugcaucaguuacuaaaacaccauuuaauaguuauaacaucaucacuuguacuaugaaggaacuugcucagugucagcuagaguuugguuccaaguuguuuguucauuuuaauuugguguucucuccccuccucucccuuuacccucaguaccaagcacaagauguguuagacugaaaaaagaacugaucucuuagaaccguaaagaauaaagauugaaucagauuacuagaauuaaucagaccauagugggguggagcuuuacauguaccauaaaaggagaaaaagagaagugucucuaggguccucucuccaguuccaaggacucguauacagcucccauuuauaauuuugcccuuauuuuuaaguuaggaaauaaugauuaacuuaugaauaaauaguauggggcaagagugggauuucuuccguuggguuuguauggcccuccagucccaccuuccugccuuacacauaagcagcuacucuuacugcuccucuucuuccuuaaugaaagaacucucagcucugaauaacuuacagaacucccagaaugccaccugagaaauggggguuggggggacaguggguggagcagucagcaggagggcagccaccacccucucugcggcugcuccuagggaaggaagggcucuggggcugggagggccguguacagcccuuggucugggauccauguguugguugagaaaucauuccagagugugcuuuccccucucccugcccaccuuaccucacguuuaauaaauaugguuguacuuuucuuauuaugaaauaaaugucuguaacugcuguacacugcuauaaacuuguuaaagaaaaauaaucugcaugugggcucccagccauugaguuauuguaauccuaucucagucuguggaggaggagguacaagaacaugaaaagccuuccuucuauuucuucccugcugcuuccuccugugcuuugcagugcuuuagccugaggaccaaagccccacugacugcaagucauguaucuguuggcguccagaggccuggcugacugaagagguccauuucuagaagcaggacaugcagcugcuuggagucagugcaguucuaaaaggaucuccauuuucagacauauugaugaaauaguucauaccaugauccacagugcucauuuggaucguguuuuccagaacuuuuagguuguggguggccaagcaagaccaggugguacugauagauacaacagaacuuacaguggcaucaguggagggguccaggaucuuaauuucucagaccuugcaucucuccuucagcauggaaauccagucagcuugaaaacuggcauccaagaguccuucauuucucaaacccugccugcccuauugugaggaaguaggagcuggggauuucaagguauuugauggucacaaaguucugugacuguaaaaguaggaauuagucgucuuuccaguccuuuugggaaacgacucacagacugcgauagguagaaugccuuacuccaucuucucaaguuccuuugccccuguacauuuugaaucuuucauuuccacuguagacaacacucccaucaccaugcucugcccucccaggaagugaacgcacccauggucuauggggucuccuaacaagggaccucguucugcacuggaagccuccacaguuugcucuuuucuuuguugcugcugcuguguuaaaauaauuggaaagguuucuguguuacaugagaggguuuuuucgguuuuguuuuuuuaaacaaagacucguagagaugaaaaaauuacuaaugaaauuguguacgugucugugcgugcaacauaaaaacaguaguaccaagaagcucuuuuggucccuguaaaacugcaaauugauguauuaauuauaaauaaaaaacacagugacugucucaucagucugcaacuuuauucuuuguacaguuugggugaaguaagagcaaaggcuuucacucacucccacccucauuccaggaauuuugagaaagaacucccaagauugcaaggauucccauggcacugagcacaagcugcacuacguuuguuuuccaaaaugaaguuagagacccgguaaaggaugaccuuagaagugacuggggugaaaggcaccugccuggggaugggaaggaagguuccccacuugccacaggaagcagccgaaagcugaaacugaacugguuucaugcaugucuggucugacaucagaacuccucugacuugcucugcccccaaacuaaguuggcugugacucauaaggcuggauucuagauuuauucaacauaccucuggguugggggggguggggugguacuuuaugacugaugcaaacaacuucacaaauacacauacaaauguuugaauagugucacuaaguaacauggcauauaaauauguauccagaguaacauuuacauaugggucauaauagcaagcauaucauuaacaaaacaaugaaggaacuucaccuguucaugucagaauagagggaggagacccagcagccccuugaggccauaggucauuauggcagaaucacugcagagguacuugacaaccaccuugggaguugcaacuguaugggaaaggccuaucaggagggcccaagaaugugucucuagcaagcgucuaaaaugaugcuacccugaagacugcugaaaucugccccagcuaaccugaacuucugcagugagcucuggcaaucacgacaaucuguggcuccaauuuauguagaggugggcgagaauaaucacccucagcguaaaacaugcagguggaaagcaaaaggguaagugcacagccuggcacuauccauagucucuguucuuaagauuuaauacugucuccaaaacccuggccggucaaaacuggaauuucacugagccagcagcuguuccagaauaccugauggccucaaaacaagcacagauaagcagccuaauucugcuggggaaaccucagcggcagggaaagugggccccaccuggaguucugacuggcaagccugcacugcugaaagccgccugcauccucauucccguaagugcaguacacaagugcugugggccugcagugcccaauacccacuuuaacaggccuaauagguaaagaaaucuuaguaacuugccagauuggaagcagggcaauauagugcaaagcucacugaacugggaguugggaguugagauuugaaaggaaucaguuugugagcuccagggucccuucccacugacaaucuugaauuauaaaaaauguuauaaaauccgugguauaaaauccaucucgaucuagggaacugggccugaggcacuugaaccuugagcuccggcucuggagggugagaagggauuucuuuucuuguuuucucaccacaagggcugcacuggccccagaacccaggccccacgcccugaccaccgcacccugacuuuaaagggagggcacagugccugcagcgacuucucuuugugaagagcagacacuggaccuggaggcaaaaaggccaggggaacauggagauaccuaguauaucccaauccccucaccacacucccaucucaguucuuccuccaccaccucacagcuuaucucugauacacgcauaauaaauaagacauuugcacguaagggugauugggccaguuccccucuccccuucauauaaaaagcauuaaauacaguuucaaaauaaaauacaaacagcaaaaaagggccugaucuucggaccaccuguucuccacgggagaaugaaaucuacauaccccucucggaccugccugggagacugaggggcccuuuuggcaccauggggccuggcgcuguuuccggcaagagaaaaggaggcagagacccggccccaagcccagggagcugagaaccaguagcguguccaccgagggcaauucacguucagagggggcaguaguagagcccuaccaccccagugcccugagguggaacgguacuggcacuggaccaagaguauucccgcagccuucaccguguggguaacagaagcccucugaacaggagggccuaaagaaaaagugcuaaucccuuuaugcccccggucccgaaggcguggcacuggcccaggaugggugcgcucgcuguccuaggccagccggggaaauugguccagcagacugggccccaccguuccggccccgccccgcccccugcucagucccaauucaccgccugggccuccgagaggccaagaauuggaccccacagccugggagccgagagccgcgcccgcuggcgugaagccacacagaacugggccacuggccagggcgcgcggccagcgcguccuuccuggcuuccuugcgcccugccuucaacccuaauacugacuggcugcgccccuuccccggccuggcagcacugcgcccucagggacagccaagagugcucacugcgaacacuggggaggcgcuuuggcuuuucgggaagcggggagcaccgcacaaagagugccuggacccccgggcuagugcgcgccugaggcgcaaguacuagcuggcacagcaaagugucacgggacgacugcagcggcgccaucccauccccaucccaggcccgggccccggccccagccuagcccgaccagcggggagguggggaauccccgggccugacaucaaggucucucagcccaagggccaggacagcgcagggugacugcuacgcgcgacacaccgcgccaggcuugagauccgcgccgcugucucguggugccggggcggguggcccaaagcccucguggccguagcaacgcagcgcugccuccucauaggccucuaaaauggucuggcgcuccuccggggugaaguccauggagaagggaugcaccugcagaaugugucgcuugauggugcucaccuugagcguggccagcgcgcccccgcacaccaugcacaccagcccgcgccggcugccgucguaguccaucaaguauucgccccgccagcgcggcugguaguugcgccgcugcucccggcugcgcggcggagguggagguggcgguggagguggcggcaguggcagcggugggaaggccagccccccgggcuccuggcugucaucuucgucguccucuuccuccgcgggucucuccgacggagcuccaggggacagcggcgcgucgccuggagaagaacaaagggcugccuuggagcgagugccaucaaucaggcccagucccuguucuccacugcucuucaggucccauccucccgucucucuacagccuuccauccucaccacccuucccuccgagcccugcccucucucccuugccaguugcuccgacccauccacaggcucaccccaccacuccuccucuggcuccgccuccucugccccuccccccuccucagaggcugaagcugugcugggggcgacagggacgcugggcgacuccggccugggcagccccagggccagcaggugugcggccuuuucgcuccacuccugggcgaugagagcuuugacuggcccgcugaggcuguuggagccgggguggcgcuggcggaugugucgcuugauggugcucaucuugagcgaggccagcgcgcccccgcacaccaugcacaccaggccgcgucggcagccguccagcuccaugagguacuccagccgccagcgcuccugguaguggcggcgauggucucggccccuccgaggccgguucgggaugcccucccucucgcccucgcccucgcccuccuccuccuccgccggcccgggccucucaggcacccagccagccucuuccuuuacgucuggggggcugagauccugagaggagggggcuccagcagcgggggcggagucccggcucuuucuggucagguccugggggacgaggucaucgucuguuggggaaggggugaaggagaagggcucagccuucuggcuguguuguccuuacccacacaagaggguuccauccuugcuccucaccccagccccaagcuagccggccccagccagagagagauggguggaaaguugaaugucugugugugaagggaaaauaggccugcagcccucaaccaaauauccc

SEQ ID NO: 9141 - RNA, 9881 nt, Mus musculus
cuuaaaauaacucuuuuuaaaaagugugaaaggaaucuauccuauauaauuuauaaaacaaucacuagcacugauuaaugaauguaacaaaauuuaagaagacauacuggcuaaugcucaaaacauaaguaauagaaaauaugucuaaugugcaugaggcccuggguuugaacccuagaacuacaauaaaauaaaguacucaagggcuggagagauaagucagcaaucaccuaugauuguagcuccaggagcucuuuucuaccuucuauggggaaaugcacacacacauaguuugaaaaauaaaauaccugggacuggagagauggcucaguggguaagagcacugacuguucuuccagagguccugaguucaauucccagcaaccacaugguggcucacaaccaucuaugauccgaugcccucuucuagugugucugaagacagcaacaguguacuuauauauaauaauaaauaaaucuuuaaaaaauaaauuaaacuugagauaagaucuuggaaaaaaaaagaaaauaccuaaaacucacuguauuguuauacacuaauagcaaauaauuuuuaaaaacuuugaaucgggguggguaguugcaagucagguaaggugguacaugcaugaaguccacuugggaagcuaaaagaggaagaucuugaguugagagaaccugcaacccugucuccugcccccugccuccucucccuucccccccaguacauaauauauuuucauuuaaacaucacaauuaacaaaaaagggggaggcuggagagugcuccagcuugguggcuuagagacuuguuacagaagaccaagguuugauucucagcauccgcauuguuuuuuaauuaagaugugcuagaaacuacagauuacugcagaggaaaaugaaggaagagcuaaggggaaaagauguucuaucugcauuuggaagacuggcagucauuaccaugucagugcuguccagaauguggguucaauauaguguggucagaguacaaggauuuuucugccacagaaaauugaaaguccaaauggaauucuucuguggaaauacaaagaacuuagcaaacccaagcaguauuggaaaagaaaaauuaagggacuuagaauauucaagauauuauaaaacccuaguaauaaagacagcagugauguugaaaguuaagcagagcacaggggguauuacuacuaguucagugauuuaaacaguguuaguucuuauucuauaggucagaaauguagaugugggucaucugcugaucuucugugcaaagucuugcuaggcugaagugaggucugguucuaaaacugguguguguguggcugugugguccagaauuguaaccucaucugaagcucaagagcuugucaucagcuucuuugguugcugacagaauuuaggucauggagguugugggauuagaucccuacuuuuaguugugggggggugguaagagauggcuggagagguggcuucgugccuaagagcaugcauuguucuuggaaagacccaaguucaguccuagcaccuacauugagugacuuauaacuaccuguaacucuugcuucaucagccacuuggacucaugugcacauacccacacagacaccaaauacacauaauuaagaaauuuuaaaucuuuuuuuaaaagauuuaggucuaggcaugguggcacauuccuuuaaucccagcacuugggaggcagaggcaggcggauuucugaguuugaggccagccuggucuacagagugaguuccaagacagccaggacuauacagagaaacccugucucaaaaaaaaaaaaaaaaaaagacucagauucaaaauauauuuacaaauaccuuggccauaucuaggcucuucucugacuauaaucauaacuuagauaacccaauuauuuuaaucuacauucugccaugagccgguuaccuguacucagguaccauguagccaucuccucacaucuucagagguggaucucccgggucugucccagaauccuuucucuggauguuccaccuucaauuuccuaacuaauccauaggccaucagauuuauuauugaugggugccacauucauacagacaucuucucuccaggauguaggugcugggaacugaacuagucuguaagauaaguacuccuaauggcuaagccaucucucaccccagaucacaacucucacuagcuaucaacugaaguggaaagugcuggucguguuuagcuucuggagcugcccucagguucuaguacucacgugguugcucacugcacugacuagccucuccuaaucacagguucuacucauaauugagaacaagugggacauucuauacaggacacauaaaccaaguggcaagucuuaggcaaugccuugggauguugcccaccaguucuaacaucacaugguauacaaaauuaauugaaaaucagucaguaaacauaaaaacuuuuuuaaaaaucuuacaaagccagggugguggcuaagguuagauaagaggacuuggguucagcccaggcugaguaaugagacuguugcaauggaagagaagaaaaaagaaaaaaguaucuacauuguauggggcuagacaaaggguucuuaggucauuggauguacuaaucucagaauaacuuaauuagacuuuaucaaaaccaaauuuuuaauuuuuuuuuaaauuuuugcauaaugaaagacaucacuaauaagucacugccuuaagaaaguucaugccaaaauguauuuauuggacuaucagaaauuggacuaaacaaacuaauuauacuucccuguuaauggcuaguuuuuggcuaucccacuuugugcucccagcuggucgcaggcgcacaccugcccaggagcuaucucaguuccacagaugaaagacucacacacauuagcucauuuuuaagcugccuuauuauagggucuguggcugggcucuucaaagccuuccagcccuuccuucaagcccuuaccuuuuacuccuagcucaauauuucuaaaucugcccucaacuuaguugcccaguuaccuucugugaagcccauaggucuugcugcccaagacacuuucaagcuuccuucccuggaccucuuuucuuuuccgccuacguuuuggaagaucuccccuacagcucugagucugucucucuuccccuaaauucuccuccuccuccuagccugcgggaaccuggaauuccugccucuuucuuuccacucagccauuggccacuggcaucuuuauugauagaucaaaacccaauugugggcaaggaccuccagcaucaguaaacacagauucccaauuaaaucaaagcaucagacccacuccucuacauuuaccagaagauuuuacacaaacaacaguaauacaguguaaaucuguccaauacugaaucucacacaguuuaaauaguuaccacuauccauucauucuaauggcucaagcuaaauacaguuccuagugaagggggagugacagcgagagucucauggacuguggcugagaguauaaaugaggaaagcuggacagauucuugaaaaacaauacccauuuguccuacagccuagcaacuccacuauagaggaguaaaaacuccauauacauacauauauacacacacacauauauauauaugguaguuuuacuaauaauguccuaaaguugaaacaauaagggaauaaacauuccuugacauagcuauguuuguguauagaucacaaggacaacuuacaggagucaguuuucuccuccuaccuuguggauaccagggaucaagugaucuuaucugcugagccaucucuccagcuggacauagcuagguuggauuuuuuguuuuguuuuuguuuuggugcuugcaucaauauaaaucucauauauuaugcucagugagaaccagcauaaaauaauuuguacugugucaguuaugucuaugugacuguagaacaucugugugacuguagaacaucugugugacuguagaacaaaagaacugggacagcagugguugcuuuugaguugcugacuuuuggguuagucagcuuucuacuacugaagcagaugccugaaauaacuugccaggcucauaguuggcuuuguugcucuuggaccuuuggcaucaccaaaguagggcaaacgugcugaagcaaaacugucagccuuauggccaaaacacaaggaagaaacucagacccccucaauacuccaugaccuaagaccuccacuagacacccaaaccuucccaaacugccucucugggaaucagccuuuaacugaaugggccuuugggaguaggugugggggaucgagauacaaacucuauaaugaaaaaggugcaccuucaggaguguggucuuuuguacacuuugaucgaaauugaacagauguacauauuguacauguacccaaugacuauguuuauguaguuugcuguaauuuuacauuuaaagaaaaacgugaaaagaauacuccauuuuaguccugguucucaagcugaaguagauguccugauaaccacuguuuauuuugacaugcuuguuuaaacacuggagugagcagaaggauacagugcaacaucaguggauaacaucaauguguuuguacuuuggagguggggggggugggguucaaagcagggaggguuucuuuuuuguagccucaacuguccuggaacucacucuguagauaggcuggccucuaacucacagagaacucugccucuggagugcugggauuaaagguauguaugugccaccccaccuggcuaaugugcauguaauuaaaugcuacugaacuacucuuuaaaaauagcccauguugcuuuaugguauauguauuuaagcacauuguuuuagauauacuauuuuauguguuugagucuuuugcuugcacauauguguguguaccaugugcaugccuggugcacuuuaaaguuagaguugggcauuggggaacucgaguuaacugacaguuguaagcugccauaugggugcugggaauugauccucaguccugugcaggaacacaugcuuuuaacagcugagccaauuccagccuauuagcacuuuuuuguuuaauguagaaguuggacaugauggcauuuagcguugaggcaggagcaauacagugagcuugaguccagccuuugagacagagugagccccugucucaaaaacaaucaaacaaaccaaauaguguagguguguagcucagugauauaguacucacucuuggggccuuugguuuccaucccuagcauugccugagggaauaaaauauaggugguugguuaaccugaaaugauuaucagcuaugcuaugcugggggcaauaaaacagaggggaguaucuguucauuacccagaugcccacugucuuaguugagguuaguauugcugugaugaaacaccaugaccagagcaguuuggcaaggaaaggguuuauuuggcuuacacuuccacaacacuguucaucacuggaggaagucuggacagaaacucaaacaaggcaggaaccuggagcuggugcagaagccauugagggcugcugcuuaccucuugcucccucucaaucugcucucuuauagaacccaggaacacuaguccagggguguccccgccacaguggccgcucucacaucagucacuaaauaagaaaaugccuaaggcuuggcuacagcccugucucgaggcauuuucucaacugaggcuuccuucucucuaaugacucuagcuugugucaaguugacauaaaacgagccaguacaccacucuuuuuucacaggagaguuauuugcuuuuaaguuauuugcuuuuuugaaguuuuuaaggcuucaaaggucagggauauguauguguauuuaccugcgucaacuaacagaaaaagacagacaagcugacuaccacucggguuugaggcuggcugaggugucccacacuggcagaggauguaagggguaaaagugggaggauugcacauucaaggcaguucaguugcuagaguacuugccuggcauauaggaaccccaggguuugaacccugguacugcucaaguggggcaugggggcacaugcuguaaucucagcacuugggagguggaagcuggaggaucaaaaauucaagguucugcuaguuuugaguuugaggccagccuuggcuuuaugagaaccuuucuuuaaaauguuuguguguuuaaauuuguuagcacuuacguaguuuuucaguuagcgugguccagugacucugcucuauaaauucuuuucuucuuuguugagacagacucucacacuguaacuguagcccagacuggccuuaaauucccgcuaauccuucugcuucagccucccaagggauuucugguguaauuguuuacagggacaggauuucagguguacucuauuuaccacgcccaucuucuauacaguuccuuaauuaacaaauucuguaaucugauguguguaaaaacacacccagauuuaguaggggaagaaaagaaaaaaaacaaguccuugugucuuuagccguuuauuaucuagcugcguccuaaauaagggagguuaagaguuucaaaaccaccugcuucacagcuuggggagggcuagucucacaucccuguuguaugugcuuuacaaauuggaaauuggggguaaagauaaugggagguuuuugguuuugggguuuuuugguugguugguuugguuugguuugguuuugguuuuucgagacaggguuucucuguauagcccuggauguccuggaacucacuuuguagaccaggcuggccucgaacucagaaauccgccugccucugccuccugagugcugggauuaaaggcgugagccaccacgccuggcugacaaugggagguuuuaaugauuaaaaaaaugacuuauuuuuuaagaaucuaguggguaucaauuugaaagaggucucuacaaaugucuuuggccugcugcuagacgcugcugcggacaaagcaagacugugcacauguuugacagugagagcuuuuccugucagugaucugugccacuuggaggaguaugugcugagguaaugguaaauaugugguagagaaaacuuaagccuuaucaacauacacaaaauugggaucugaauuuacagauaucuaguaucuuuugcaacuuaaaaagugauuuaauuuaaugaaaaccaugcaauuuuuaaaaauaugaaaaucuaguccaauggggaaaaugccuucaucauuuuauuuuaguacaauauuuuuuugaaacugaacagucaccaucaccuuuuauuuaauuuagcagugcauggaacuugggaccuuagcaugcuuagcaaggaagucuuugcccauuuacugcaaaacccaucugcaagucuuuacccauugcugcaaaacagaucuuggucagaaaauccaaaguuaauuuuuuaagacaggaaguuaaaauugggagaagcgugcccugucagugagcauccucuuuauuaaugagccguucccccucuuguagucggaaagcccgucuuuaacugagaaagaucauuaguuagugcuacaaauggaaaacccuacucuaaacaaaucaaccagcgugacuuuccccccaucuaaaucuuauuacauguauugaguauuagcaaauuaaaacaaaaaacuuaugcaaagaaaauaaaaccuugugucaaucuuaaguuacucuucaaaaauaaaauuaaaguuggaguuuugucaauuucaucccuuccuuuuucaguauaaucauuuucuacccuuacuuaagaaugcuugggagaagcuccacaugguggcacaagccuuuaacccucgucuggggaggcagaggcagacagaucucugaguaccaggacagccagggcuacacaaagaaccgugcuagggaaagcacgguugauccuuguugauccuuggagauuucuauauuuaaaaucaaaccaaacucuuucccuaaauuugguaauaaagcauugauaaggaagucagcaaagugucaaugcugcuccugacugaacuugcggaacuggcagcuuucuucuuuugagaacgccauuaggcucccucuuuugguauauuauggguacugcagcuggcgaccuuaaaucuccuagcaaguaguagaaaaccuuuguuuucaauaauaaagauaaaguggggcccucagaccaggccugggcgccuggaguugcucccuagagccaccgcgcugugcugcugcugcucgcgcggcuccuuaaggccacugcaauaacggccgccuuggcggagcucuucagagcagacagaugcagcugcugguaccuaggcagcaugcgauggguaacugcugcuggacgcaguacuuugggcugcaccgcaaggaagggggccugaugcagacaggaggaagcagugcaggauccaaggguuuuagagcgugcccgagaggugagcacuuaaacacaguuugugcaccuacucauaagugauggcuugagaaugagacacacauacacaaagcauccauaaaccaccuccuaaggaagaagcaguuaacuuguaggagaggcauuauaagucgauugcugcaaaacagaucauggucauaaaauccagaauuaacuauaagaaaggaaguuaaaauuggaagaagcagcuggguacugccugccucugagaagacagggcaacaaaguagagaaagcacgugaggcaggaaagguacagcugugccaugauguacuacuagcacggagaccaaaguuauugaccagaagauaaguauggaucuugccagauacacaguauugacauaaaguaccaaaagcagcuguaauuuaacaacccaaacuaaguuagcuugugauaugauagcccauccuuagaugggaccagaauguuuacaauguuucucauaaggcagccuuucaaaacaggaagacauucccuaggcagcacuuagaaagugcugagcaagaggggaaaggacuuuguagggcugagauggaugacaguggugacucuugaguauugcagccuugugaguccuggcuuaagaacuguucuagaaucagucuaaaacagaucaacagauugggcagaaugaaauuuugugauccugcuuagcaguucugaccuagugcuuaaaaguggacuagaaugcauuagugauaaaugcugagccuuuuaaaggggagcaggcacuacguuguaaaugcuuguuuuacaaggagugaagaugauggaacacagcuaauggcuucagaaugaguguagauuucaccaucugccuucugcuuuucaagaccaauugaagggcucauuuuauccuuuaaauuuauuuuaaccuuuuauaguauucuuacccuuguuggguuuugcauuuuaaaccuuggcugauuuuacuuugucugaacaaaccuguuuuacuauguaacugaaaaucuuuuuuuuuuuaaagaauuacuuaaauauuuaauuuauaugaguaaacuguagcugucuucagacacaccagaagagugcgucagaucccauuacagaugguugugagccaccauaugguugcugggaauugaacucaggaccucuggaagagcagucaaucucuccagccccugaaaaucuucuaaaaaguguuuuuguuaagucuuagcagcuauaaagagagcugagugaggauggccaguuauguuuaggauacuguuauucccacucuccagcuucauuuauuuugaugaauucuuuaauuuguuuuauucuaaacacaguuaacuugaggaaacccuaagaaaugcaggguaugguuucuuuccacaucaaucacaaaugcauauccuaaugugauauugacacauucuaaacagggauacuauauuua

SEQ ID NO: 9142 - RNA, 958 nt, Mus musculus
guucagcuuggugaaccauugaguuuauugaggccacuuauagguacacgggugacucaaaggcaguuacaucaccaggaagucccuugggcaguuuauaggcaacuauacaaauuaaaaaucucaccuggagcgugggugauucacaaagaaccugcacuccugaugaguuccaugggcagcuucaguaauggaagaguccuucuggucaauuugcucuuggauauacaccuuccuccaaugagucuccuguggcugauucaagacagcaauggucauguccaccuuagaagaaacaacuacacaauagccuagaagaucuaauuugguuuaaaucuaaaagcuagaagagaguuuccuaacagucuugagaguuugggggguaaaggggcucaaagagggguuaaagaaguguaaacaggauuucuuuagguaggcuacgaauaauuuuuaccucauaaccuuuggcauaauugcucaggaaguaaagauagcugaaaggcuuggcaggguguagagauagagggaaguucaggguaggccgaaggaauaaagaaaacauuugcugaaugaacgaaacaauggugaggaaaaaucaagucacuggggugacacuaccuccaucuauaggauuuguuagaaaacaguauuuaguuguggcaaauuguauuuucacaauaugucaaguaugaauaaaagcauuucccaacaacuuccuuuuguaaaguaacuuugaaucacgguccuagaagucuaaaguuuacaaaaggugggucauggcucagaauagucugaggucgcgcgaaaaugagacagagacucacuauguaguucaggaagguauugaacaccugauccuccucuccuggucuccaguacugggauuaccagcgugccacccggagccugacuuaguaaggucuuacuuuagcuuuuuguuuguuuguuuuguuuuguu

SEQ ID NO: 9143 - RNA, 45649 nt, Mus musculus
uaccaccaccuguaguccuggccagcgaggaacaccagagcccagcacgcgggccgggugggggcucccggcgggaaccggguggccaaagcccggcccugguccccggguuaggcgccgggcagggucuuccgagagcccuccucauuuuuuucccuuugcaaggccuaaugggaguuguaguucagcgguaggaagacccacucggcccaguccuguccuccguuuccucuacgccccggaugagggcgaacacccgggucagaggggccgggcccaagaaaacgccgaacuacaauucccgauggacccgacauuccaguacgcagucacagguacccgcggcacgauccccgcuccggcgcacgcgcaccgaacgguggcgggacucggccgcgugcgcuuucccgcccucgucacgcccugcgccaucggcagggcugucuccugagcuguaggcuuucuccgcgcgccccuccuucucgguuucuccccaaguccaggcuccgccuguuucccuccuccagggcagccucaacccgcuccugucuucucugccucugcuacuucugcugaaggaggaggcuccauguuguccccucagcgaacugcagcgguggcaucgagaggagcaggugaggcguccaauuuucccgggacccgguccgugguuacccacgcugccucccagugcuucggcuccgaggugacaagccgucccugccgccgccuuuuuugguguggcgacgggaggccgcaccgccgggugucucggcucggaauucagggccggggcuccuggagcggggaacguucccagucuccgccgggagcccgcggccuccugcggccugguguucuggcccgucgagcuccgcccugugcugggcagggcgugccgggcgguggcgcgcuccgggucgggaagcgagguuggcgguccgucuuaacgggccgggaucggcggaaggcuuuauuguugagccuuaaagugcuggaaugcugcggugcagccuuggaguugaaagguuuuauuuuaaacgaaaagaccuugagauacugacaaguauuaguaaaguucguuuuccacccgcgcuuaucuccauguuuggugauaaaagaauuggccuaaauuugguuguuuuguuuugcaaguuuuuuguuuuguuuuuuuuuuuuuuaaaguaaguuugguuccuuuggcuuugccggagacauaaaaugaggugguaaaaguacuaaaugaaaaccaaauagucccuccguaaauucauggaugcaguuucgccugucauuuuaccuggcacugugcuuguuuaauggguauggcccugaaaugauugcaaguuucaguugcgaaaucuaaaggaaaaaaaaaagaagagucaacaguaguguuugaagaauuuuuuagcaaaccccagucuucaaauuugaguacgaaguggaauguuuugcaaaaggugaagaaaaaaaaaaaaaaaaaaaaaaaaaccccuagcagucuaaaacgucaugguucucaguuuuguuuuggagaaguggaguuaaguaaaaccuacguuaaggauuuguacucuaugucaguauucagcuuacauacaaacugcaacaucaaaugagggcuguuuugcuuccuacgaaaaccagcuuguauucuagaaauuccugugcagcuuuuacaugcgugaggggauguaugggugaaaaacauuuucaccuagugaagcauaaggccaauaccaacauuguuuuauuuucgguaguuuacugucuuuuguaauagucauaaccauaagaaaaacaguugagggguggugguggcgcacgccuuuaaucccugcucuugggaggcagagacagguggauuucucaguucaaagccagccuggucuacagagcgaguuccaggacagccaaggcuacacagaaaaaccuugucuggguucgggggaacaaaaugaaccaaacuaaauaacaaaacaagucacccccugaaaacaaacaaacccacaaacaauaacaaaacaaaacagaagagggaggugugguuguaugccauaauaauuuucuuaguguuuaguaaggaagaacaguuugguuugugcugcuagggauugaaugcaguuuugugcuuuuauagcccuuaacccuaguuuuuagggcuccucucaacaguguuaaaaaaaaaaaaaaaaaaaaaaaaaaaagucaugguucucacagugagacccugucuggaaaaaaaaacuaaaaaaauaaaaacuggaucucacuguguagccaugguuggucuggaacuucuuuuuuuuuuuuuuuuuuuuaaagauuuauuuauuuauuuauuauauggaaguacauuauagcugucuucagacacuccagaagagggagucagaucucauuacggaugguugugagccacaaugugguugcugggauuugaacucuggaccuucggaagagcagucgggugcucuuacccacugagccaucucaccagccccuggaacuucuuuugaagaugaacuuauggagaucugacuaccucuuccuaguuuucagauacccacuauucuuagcacaacuuauagauccugauuuuauuuauucaggggccaggaaacagugaaaaagaaaauccucauuuugcauauuuauaauaaaauuucuccaaugguagguguaugcauuugaauaauuuauuugauagaaaauaaacauuuguuagcuauuaguauuuauguugaaauauuuuuuacaaauuaaaaauguuuuuauuuaaauuucuuuugcuagagcaugcuagauguaucucacagcuaaaaguauguuauaaauaaagugauaggcuuuacucauauaguaagcaagcaaaggauuggaguaagggcaugguuaucugaaauggugaaucuaagcugaguaaauauugccaauuaagauauucuuguuuuuaagcaccuucccucuaaaagaaaccuuucuuuaagcucgaugagguggcccacauuuguaaucccaguauuugggaggugagacagaauuggcauggauuuggugccaggcuagacuacauagugaguuccaggacagcuugagcuacagaaugcgacccugucucaaaaaaaaaaaaaaaaaaaaaaagauaaauccaaacaacaacaaagaaaccaaaaccagacuaaaacaagaagaaacuaagaaauaaaacaagaaagguuuauuuaacuguaacuugacuaauugaaacauccagauuagauuuccuguguuuaggaaagaggcaaguacaaccacucuauucagaagcaggcacaucucugaguucaaggccagacagcacuacacagagaaacccuaucuugaguaaaacaaacacaacagcagcaacaaaaaacaaaacgaaagaaauuugucuccccccaucccccaccccccagcccccugggacuggagagaugaugguuuagugaguuagaggguuuacugcucauguagagaauagauuugguucucugcaccacagcccagucuguaccuucugcuacaaggggucaguuguuaccuuuuggccuccuugggcuucugcauguguguacugcucauaaauucgagagaguacacacauauaugcauuaaaaaaaaaaaacauagccagguaguagcacacacauuuaaucccaggacuuggguggcacaggcauguaccucucugaggccagcccggucuacagagcaaauuccaagacagccagcauuacacagaaaaaaaaccugccuugaacaaccccccucccugaauuuuuuuuuucucuagcugauaaaaggcugaauaguuuuuauuuuuguuuuaagaugaaggacuuuguguugccuaggcugucuuugaacuauagauucaagaaauccccaucucagcaucuugaauagcugugacugcugguauauaccaucucaccuaacuuuugauuuaaguuuuagauucagaccugucuuuucuuuuuuuuaaagauuuauuuauuuuauauuuauaugaguacacugcagcugucuucagacacacuagaagaguaugucugacuguacaguacacugacugcucguccacagguccugaguucaauucccagcaaccacaugguggcucacagccaucuguaauggaaucugaugcacacucuucuggugugucugaagacagcaacagugcacucacauacauaaaauaaauacaucucuuuuuuuguuuuguuuuguuuuucaagacaggguuucucuguguagaccaggcuggccucgaacucagaaauccgccugccuccgccuccgccucugccucccaaguucugggaucaaaggcgugcgccaccaugccccggcuuaaauacuucuuuuuuuuaaaaacccauagcacauuagauguuucuguuugcagguagaacaguuuuguuuagcaucuuaugcuaaagcacaacgauuguaaaugaauugggaaaagcuucccuccucagugcuuuaacuagaauacgcauuuccccaguguucuggugguuggguuugagcagcuucaugggaacaagcuuuucuguguaucuccuggcacacuuuuugccuuaagggaaagugcaacauagaagccagaaagaacaacaugcuguaguuaugaagucuggagaggacuucuuuuuuuuuuuuuuuuaagauuuauuuauuauauguaaguacacuguagcugucuucagagacuucagaagagggagucagaucucauuacagaugguugugagccaccaugugguugcugggauuugaacucaggaccuucagaagaacagucagcacucuuaaccacugagccaucucgccagcccuggagaggacuucuuagcauacuuccuuugucucugauguuuucucuggcuuugugaauuaaagacuuugugcuuuaaggacugccagcaaaggcaaacauggaaaugguaugcuucuuuuuggguguguugcucuugcccuuuagagaauauguuauuucagaaggggacuggaaaacucaggucauaacuucaccaugagucauauagucuacuuuguaacuuuguuccugugcuuuuaagaauccucuggaggggcuggagagauggcucagcaguuaagagcacuggcugcgugcucuuccagagguccugaguucaauucccaguaaccacaugguggcucacaaccaucuguaaugagaucugacgcccucuucuggugugucugaagacagcuacaguguacucauauacauuaaauaaauacauuaaaaaaaaaaaauccucuggagcccggcgugguggcgcacgccuuuaaucccagcacucgggggagcagaggcagguggauuucugaguucaaggccagccuggucuacagagugaguuccaggacagccagggcuacacagagaaacccugucucgaaaaacaaaaacaaaagaguccucuggacagagaggaugaguacugacgagguucuagcacaguagucacaguaguuuuuuuuuuuuuuuaaguuuuucuuuccuguuaaaauuuuuuagagagugauuuuauguguaugaguguuuugccugcaugucuguauguaugugcaccauguacaugccuggugccugcagaggucagaagaagguaucauauacccugguaauggagcuauagauagcugugagcugcucugugggugcugggagccaaaucccaaguccuacaagagcaacaacugucuuuaacuacugagccaucuuuucagcuucucagugguacuuaacagaaggugauuuuuguguuugugucuuuuuuucuuuuaaagauuuauuuauuuuauguaugugaguacacugucauuaucuucagacacaacagaagagggaaucagaucccauuauagaugguugugagucaccaugugguugcuaggaauugaacucaagaccuauggaagaguggucagugcucuuaagcgcuaagccaucucugcagccugucuaugugccuuuuagaaaugucuguagguguuuuuggaugucaaccuuauggguaauacugauaccauuaguauguaguggguacagaguagggauaggauccccucucuccacaaaggguuuuuuggccacuaguugucaguauugccaaaauugccacgcuugaucccacacuguuuaauuaauccauuagauuuucugaaguagcaaugguaacugcuuucaguuagccauuuucauugaacgaaucacuguucagauguaauuaaauguuugaggaccacuuaaacucacucauucuaggacugggcaguaccauguaccugcugguagaguacuuguguagcaugcacugagccaugaucuguauuccagaaccgcccaugaaacugggccaauggucucaauauucaggaaaugaauucagggggaucagaaauucacgguuauucuagcaaguucaaggacacccuaggcuacaugguauuuuaucucaacaaaaaccauacagguuuuauguguguaucuguuuguguauuuguggugcuugggaucgaauccagagcccuguggauguuacucuaccacugagcuauacccuuaguuguucuaauaauguucuuagaguuuaacuugaaauaaaauugguuuuguguauucuuuuguaaaauugaaaaggcuaaccaugauuacuagccaaccuaugcugugcuuuuuaaccuaugccguuuuuuuuuuuuuuccuuuccccauuggcaagggacacaagguuucucuguuguguaccucugguccuugaacucagauucuccugggaucaaagguguccucuauuaggauccugugccagauuguuuuuguugguuuagauauuaaauccagggccuacucuauccuaaccuugugcuacaauauugaguuacaaucccaggcuucccagcuuccucuaccccagccugggcuggcuuggaacuugcugaguagaccaggcuggccucagaaauccugcuccacugcuuuccaagugcugggauuaaaguugagaaccaccauuacuggcuguguuuuuaaggccuguaauguaggaaucagugcuguaauauccauguguagaaaaauuucuaauuuaccugucagucuuuuaacuucauuuuucauucagugugagugauugucauuuaaguguggaaacuauauagaauguaguuuacuagggauauuguuugaguuggccuauuaaaccucuugguuaguguggacucgauauauugugccaaaaguaaaggauaagucaguaguucauaaguaauuaggagaaagguugugaugucacauaagcuguuagacuacuuuuuuuuuuuuucucuuuuuguuuuuucucuguguaucccuggcuguccuggaacucacucuguagaccaggcuggccucgaacucagaaauccaacugccucugccucccaagugcugggacuaaaggcgugugccaccaccacccggccuagacuacuuuuucauuaaagauuuuuuuuuuuuuuuuuugguuuuucgaggcaggguuucucuguauagcccuggcuguucuggaacucacucuguagaccaggcuggccucgaacucagaaauccgccugccucugccucccgaguacuggggaagugcugggauuaaaggugugcgccaccaccacccggugcucuguuuauuuucuugaaguuuauuaugugaacauggaugcaacuauagauuucgagaauaauauccuccuuucccuuuaaagaagcaguuauuuuccaaaguacacaucugcacacugagacaauacaugacaccagagauuguaagacuuagacaaauguggacaaaagauacgagauuuaugaaaucaagaauuugagacucuugagagauaaggcagaucugguagcucaugccuguaauccuaacagauaucugggaggccaaauaaggaggauugccaugaguucuaggcuagcuugaacuacaaugugcgacccugucucugaaaacaaccccaaaccaaaaacacaacagaaaaccaaaaaaguagcaguuagguuuuagagcuaaacaguuucugccuggcuuuguaguacaaaugaagaaguugaacugaagugguuucuuuagggcagacccagggccagaacucugguauuguuguuauagaggcuucucuucccugcccacugccucauuacagugaugcccuuugcucuuaauccuugcacuguaaugccagcacccuggaggcugaagcaagaagauugagaauuugaggugauccugggcaagagccugucuaaaaacaaaaagcucaaauaaaaaaugcccccaaauaaagcagaaacuucaguuauagaagagacaaaugaugguaagacuugguaauauauugcauauagggagauaaggcugggaaagugcagaggacuugaauggaguaauugagaggaaacauuuugaaauacuaaguguagacuuguaaaauguuacuacuggggaguuuugaaaggagacuggaggugaaccagucagaucacagaggcugagugguagaacuggaauaaggacuugucuccugacucuucaggucaguguguuugcacauauuccuccugcuaguaugaguggaacguuuagugacucuauacuuaagccuuugaacaugucgcuucagagguuagaaaggaggggaguuauagcaccaaaauacaggguggaaaaagaaagaaaaaugguaaaaaaugagcauagaguuaaaauuauaaauaaagagcucauugaagcuggucauaguggucaugccuauagaaguggaaguagagaggucaggaguucaaggacagccuuggcuacauuuugauuuugagacccucuguuucucccaaaaagcucagugagagaguaagaacuauaggagauuacagaagagcauugguauaugucagccacugagggugaggaaagaaaagaacuccuguagggagaugccaaagagcaugcuaagauuuguccugaauagagguuuuaaguugccauuucccauauaugucagaugcuaugcuuuagccuuuuauuuuauuuauuuacuuauuuauuuauuuugacacagcuucucaguguauaggccauccuaggcuugaacagauaaucuagcauaguuuggguuugaaucagccauuguucuuacucuuccuccuucuugcagcuggguauuagguuuauaaauggaggcugaaguuguuauguuuucuagaguuaugcugagacaaggucauaggcuuugguuaugucacaguuuuuguugucugcuguuuguggguguuguucugggaacuuggaggucauagcauugaacaaaagacaaaaaaauccugcccucauaguacuuaacauuuuggaguagagaaaaccaaaauugaggccuuguccucaugcuagagccuauuuuuuauucaucuuaucauacuauuuaagagggcaggucagauagcuuccaggugaaaaugcuuacugcuagcccguuguccuguguucaacuccugggaacuacaugauagaaagacaacacuaauuccucuaaguuuuccucugaugucuuuauaugacaccagugcaaacauacauacagacacauacacaacacacacacacacacacacacacacacacacacacacacaccacacacaccacacacaccacacacacacacacacacacacacacacacacacacacacggaugaaaauuuaaacuaauaacucagagggagagguaggugauccagacaagguuaguuaaaaauugaagucuaggucaagagcaagaagcauuucaggcguugggaauaagugguugcauaggucaucuacuugaaauuguggaguuaagacaggacaagauaagacuugagccguagcuuucucccuguagaaauaccaaugagaacgaauuuuacaagcaggaugagaacagucaggauaguauagggaauagugauaguacuuacaggauggaagcuuagcuuugagcuaucaguccauaaauuguuuuauuuuguauuuuuuguguugcuagggguagaacacaggacuuuaugccucugcuauugagcugcaucccucccuuguaauuuugaugcuuuuaauguggcugucuccguggugcacuuaggguuuauauuuuggcuuuuugagacaggguuucucaggacaguucugacuguccuggaacucguuucuagaccaggcuggccucgaacuaagagauuugacugccuuugccuccugagugcugggauuaaaggcgugcacuaccacugccuggcuaugauauacuuaauacguccuaagggaugagguagugauguaguuaaaggagcagucagaggcaaucagugacugccagguggaaagaagaaagggcaugcugguaaggaacaggacucuuaaguuuucauauuuuuuuuccaauguccucuaugagggcaaguuuuuuuuuuuuuuccucucucuguucaguacuacauauucuaaguucccuagacaaguaugcacacuacugcugagauaaacgaucuaaccccuaagguuuaauuaaggaaucuuuuuuuaaauuaaauuuuauuuuuuuacuuauucauuuuacaucccauucacugaccaucuuccagucaccccucccacauucuuuccccccccauccucccuuuccccucuucucugauuggguaggggcuccccuugggcagucucucacccuggcacuuaaagucucuucuaggcuaggugcuuccucucccacugaggccagacacggcagccuagcuaguagaacauaguaaacauacaggcaacaguuuuugggauaacucccauuccgguuguucuaauuaaggcaucuuaaugauucuggagucuaggauaaaucagcaaaggcccuuuaucugcuaucuacagugggagguuucaaaaugaguuuuguuuuguuuuuguuguuguuguuuguuuuuguuuuugaaaucaguaauaaaacccuguugucuuuaggaagcgggaugguggugguaugguuaaaaaguggggugcuuaauguauauaaauugauuuguuggugauguguacauuucaaaauaauuuuguguguguguguguguguguguguaugugucucaaagagccacuguuagugaacauggucccuuuuagcccugaggauguuaaugacugcuuauauucccaaugaaggggcaugcagggucaccccagcacucacacuaauaauggcaugcuuuucuuuacucuugcuaauguauugcaagaaccaagagaggcaagagaguaacaguuuccuuuucauucucccuguccucagcaguaugcaacuuuucuuguggugcauuucauuggauauaacuguaucuuuuugucacuggguuauuccauccugccuguagccuguacagucuuaacuuucaugucuuuuggcugauagugccaccagcaucuuuaggaucauagccuuugacuguguaauacugcauaucacccauguuggcuaugugucauucucauucauuuaugcugaaauagaaaaauagcuggaauugaaaguucuaguguaaaaaucuugggagauucuuguguugguuacuugguuugguuguguuugaaaguugcuauguuacugaguuaaaguaggaaccauucugucccauaaaagugaacugguggcacuucugcaugaaguuuaggaccugacucuugugcacugcagugcucuaggguguuguccuccugugccugagccucacugacucguuuccauuucugcaucuauucagucagaaaggggaaaaucuggaaguugccuguauuuuuuuuuuuuuuccaguuacucuacuagucaaaacuuccaugugucauaugguuuggcaauuuauuucuuuugggcaguucuauguccugcuaaaacguacauagaggauggggaugaauuagacaguaaugacacauuguuguuaaaauuccaucccauaaacaaccucuguuuacuacuucuccuaagggcccaaccauaaaccaagguacaauucugucaagaguacacuggguaaguuuauugagcuuccuuacagggcauagggaaaaaauuucuuacaggggugugagggcuccuucucccaauaggaaagccuuuaccuagaauguuaguucaaauaagauagaguugcauacaguagguaucuuaggguuacuauugcuguaaugaaacaccaugaccaaagcaacuugggaggaaaaaguuaauuuagcauaagcuuccauguuacaguugagcaucaaaggaagucaggauaggaacucaagcagggcaauaaacuggaggcagagcugaugcaauagccaugcaggaguacugcuuguuggcuuguuccccaugcuuucuuauagaaccuugcucagcccacuuucuuaacagaacuuaggacuaccaaccagucucccauaauucauccaugacucacuaauuaagaaaaugucccgggcuggagagauggcucagugguuaagagcacugauugcucuuccagagguccugaguucaaaucucagcaacuacauggugacucacaaccaucuguaaugagauccaaugcccucuucuggugugucugaagacagcuacaguguacuuauguauaauaaauaaaaucuaggaagaaagaaauaaagaaagaaagaaagaaagagagaaagaaagaaagaaaauucccuacaggaugucuacagccugaucuuagggagacauuuucuugauugaagugccuuuuucucugaugacucuagugugugucaaguugacacaaaacuagccagcacuaguaguagguagugacuggauacuaaggauagggucuugugacccccucaaaccuccacaaagcaauguaaacagucaacaagccuaacugggauaaucguuuuugccagaggucaacagcugaacaucccaagguggcagauguuugguugcauaaguacauauauaugcaaaugccauaauguaacccauuacuuuguaugaccgcccgccucaaaaagagaaacacacacauacacacaaaaacccaacacuguuacauaacaaggagaaaucagagauuauuaggguguugacacaaaaacucagcuuucacuauaaagagaaauaagagauaguuuguucuggagccauauuugaaugaccaugaucugggaauauaaauuuagacuacccuaaaucuuaggaaugaaguuuuguaguuuuacguaauguaaaaaaaaaucaaggcaaguuuaaaauacauugauggguacagcagagaaauaguacaacaagauagaggaagcuuuucugucuuugcugucugaugacaacagguuggugaaagcuaguggucugcuaaguuaauagauucuaaaagccuuuuuaucuguuagucaccagauacuaguugauagauaguuaagguaucuuaggguuuccauugcugugaagagacaccaugagcacaguaacucuuauaaaggaauacauuuaauuggggcuggcuuaccauuucagagguuuaguccauuaucaucauggcaggaagcauggcaguaugcaggcagguaugcugcaggagccgcugagaguuuacaucuugauccacagccagcacugugugccagcacugugugccacacuggguguagcuugaugaacucacccuacagugacccacuucuuccaauaaggccacacaugaauuuaugagggucauacauauggaaaucaucacacaaggaauggcuguucugggagccagagguaguccagauaaggugauuggcuuguggaucuggacauuccaacucugcacauuacuacaguucuaaucagucagcacucuguacagacacagcuucgaaguauuccuguugacugagggaaugucuucccugccacaguugaauuuuguuuuguaagcuucuuugaguucuguacauugacacuggcuuuuccuuaagaauaaauuucuaaggugcuggagagauggcucagcgguuagaagcauuaacugcuauuccagagguccugaguucaauucccagcaaccacaugguggcgcaccaccaucuauaaugggaucugauucccucuucuguugugucugaagagagcuacaguguacucauauacauaaaauaaauaaguacaucuuaaaaaaacccgauaaauuucccagaguuuucuuuuuuuuuuuuuuuuuaaauuacaggaauggaacccagggacuugcaugcaugcagugggcaaaugcucuacuagugggcugccauccccagcccagauuuucucaguucuuuuauaugagagacuaaagaccuuugggucuuggauuuauuugcugcugugccaacaauuagucuaagauagcuagaaguaguggcacaugcuugugaucacagcacuugggaagcugaggcaggaggauauugaguuuuagaucaucuugagauacauaauagauuccagauuuuuuuaaaauccccuuuccuguguguguguugccugugcacucacuugcgugugugggcacacguguguagguauacuuggagguccaagguugacaucaggaaucaucuucaauuacucuucuaccuuuguugaccagugucuguuacucaaauccagagcuuacagauauaacuaguuagguuagccagcuugcucuggggagucuaccuugugaagguagaacuauaaccauccuggauucuggagaucagaauuuucucaagcauuuuuuuggaagaacagacaguguucuuaaccucuaagccauuucuccagccuuuagcuuuuauuguuauaauaagccuuaaucagcacuauagcugggcagguaacugccuucuaagcuauuaguaucuauuuccccauuaauaaccccaaauuaaaauucaccauguuagcugggcagugguggcucagcuuuuaaucccagcacuugggaggcagaggcaggcggauuucugaguucgaggccaagccuggucuagagagugaguuccaggacauccagggauacacagaaaaacccauauacuccuuuuacaguuauuaugguuauuguauauguuaugugccuuaugaaagcuuuuguucucuucaugguguguguguaaaacuuauuauuauuuuuuuuuucuguuuccuaaaugggcauaggugaugccauggaaaauggaaaaccugguccagugcagguuguuuugguucauaaagaacaacauuccuuugagcuagaagagagagccuuggccagcguccuccuccaagaccauauccgagaucuugauguggugguaguaucaguggcuggugcuuuucgaaaggguaaauccuucauucuggacuuuaugcugcgauacuuauauucucagguaagaaagacuuaguuaauuucaaaguagaaagugagaaaaauaaggucaugaauuauucuugauguauaaaaucacauaagauuuggugagggggcugggagauggcucagugguuaaaagcacugacugcucuuccagagguccugaguucaauucccagcaacuacacuguggcucacaaccaucuguaaugggaucugauucccucuucuggugugccugaagauagcaacaguguacucauauacauaaaauaaauaaguacaucuuuacaaaaaaauaagauuuggugagugguugggguauguaauauagugguccaguguuugucuaucgugugugaggcccugcauuuuauucccagugccucugaaagugaaagcaaagauguaacagaacauccgauuucuccucuagaaggaagguggucauucagacugguugggugacccagaagaaccucugacaggauuuucauggcgaggaggcucugauccagaaacuacugggauucagauuuggagugaaguuuucacugugaagaagccauguggaaaaaagguaaggauguuaagacaaagaaaaaaaagaaggaaggaaagagagaaaagaaaagaaagaaaggaaagaaaagauuuagauauuauuacagaauaacuaaaugaaaacuuguguuucuuuuguuuucuugagauaggaauuuuuuugguuuuggauaaguuugccagguuggucuggaacucgguagguaacacuaggcuagccuugaggagucauccugagauggcgccuucagcugccugugcucugggaucauagguauggggagaggagauggagucacaugacgaagccugggaaauccgacucuggagaccagcauuagggugcagaucucaguuuauugcccagcauauaagcuuauauacaguguuugaaccaaucccaacccccuaauccuuguccauuuguaucucaccacaucgucacuggccuccaaugaaagccaugccugaugagguuacucugaaggaguggggggaguauccucaccucuuaggacuucaugaagacaggggaagcagcugugccuuggccucgguucuucuuugcugucucacugguguucuaggagcagucuuagaucuaugccaugugacgcagaucaggacucuuagaggagucccaggagccugcggugccucgcucuccacccccacauauaggugcacacuaccuugcuugucacuagaugagaacuguaacauacgcuguguuaauccaaucaaaaaauaaauuagauucuuuuaaauccaugauaauuccuaucuccuaauguaauugcucuuuuuuccuguugaguuauuuugacaguagauccuacagugugcuuauuuaaacccuuuacuaaguggaaagcuugaugcagggaggugucgauauacauuuuauaauaaaaauuuuugcuuuguaaagcugacuacucaaaccuuccuuccauuuuugaauuccuuuaaugaaaaagccacucuaauguuaaacaaaaguguuguaaaacaaaagaaagcaacuauuagagcuguaugugcuauuuguacgucuuaggucacaacuuagaggccagcuugagcuucuuaaaauguacauaaaagagcuuggcauggugacuugugccuguaaucucuguauucaagagguugaggcaggaagaucggcacacauuugcggccagcaugggcuauagaaugugggacccuguuucaaagacgacaacaaaaaaagugguuuggaaguuuacuguguuagucugugacaugagaccauuuccaucaaugcugaguacacuuguagcuucugcuucucagagagcugccagugaguccucuuguuuccucuuugucucauuuucuaguuagcagacacaugugauuguaagcuuuuguuuaauuggaucucaugcugaugauucaggauuuauccuguacaagugucugauucaguggguuuuagaauaaaccuaaagcugaacagguaucgucaccaucugacucuaaaacauuuuauguccuuaaaagaggccuucuuccagcuccuagucucugcuaauucacucucgccugggcugucaggagcugcggccugguggagaacuuggugugcuugcuucaccuuccuuuuuuccugccaccuucuccuuuucccugccuucuugucuuuuuuugguauuggggauugaaccuaguguguucuaucucucaauuacaucuccucgugaagcugucuguuuauguuagauaagugagaugauauguguuuuuuggaucuggccucuauucagccuaauucucuuauagcauucaucaguccuuuacucucuuccaugacugaacaauauuccacuguauaagaauacuguacuuuuuuuaauacaucaguugugacuauuuggacuguguauaucuuugguguauuauaaauaaugcugucuguacaugccugcaaucuuaguacuuggggagcugagacaugaguuucaggcuagcuugacauccugucuaaacuaaccucuuccaucaaacaaaaacccaggguuagagaaguaggucaguggcucaagggcauuuguugcugcucuuuucgaggaccuggguccucuuuuuuuuuuuuuuaagauuuauuuauuauuauaucuaaguacacuguagcugucuucagaugcaccagaagagggcaacagaucucauuacagaugguugugagccaccaugugguugcugggauuugaacucaggaccuucggaaccacugagccaucucuccagcccuggaccuggguccucuuaaacacucauacacacaaaacacucagguggugauaauuuuggaguuuugguccuuugaaaaacagaaauauuaccagaauguguuuuccuuuugauuccaggugugcaaauauggggcuucuuuggcucugauuugccucauacucuagcagaagcauaauuucgccagcugcagauaguuuuugccauuaugugauauuuggaauucuggggacuuuucagaggguguguaaauguuguuggguuguuugguugcuguuggucgagauuuguuaaguaguuaugcccaaagaagaaacaacaggaagacuuuagauauccugacagugaagaucaaacuugucccaaggaacuugacgcccuuaaucagcaggaaguagucuggugaccucugaccucugacuuuauucagggccucucuucuuuccucucugcucuuuuuucuuucuuauguaggguuaaaagguuguaagguuagaagagaaagaguggcgaaggguggaagauagaaaaacccacaaguagccaaauaacaacuacacacucauauacacaagaauaaaauaaacacaucuaaaaaauaauuaaaaaauacuacccaccauaagcaucuauguacaagcuuuucuaagauuggaggucucuuguauaucuccauguuuacuuuuccugucugugacagguacuggagauacacaacuuaagggaggaaagauuuauuucagucacagcuccagaaauuucaguccuuagugcuauuacugagggcuagagaccaaucuguacaugacaggaaucaugauuaugcaggguugacugucaugaugggacgcucagggugcaacagauuaacucacuuugcaguugacaggaagcuagagacaggaggggcccaggcaagcacaugccucagagcuaugccuggaccaccuacuuccucacucaguaugaacucaccagugggucaccguugaugagaugaaugccucacacugaguuaccucaguuagacucaggagcugaggaaccagucuucaacaaaagaacuucuuggggaaaaugcuaaauguguuucuguaucacauggcaacucugacuggcuuuaauuaauuaauuaguuauuauuauuauuauuauuuugguuuuucaagacagggucucucuguguagcccuggcuguccuggaacucacucuguagaccaggcuggcuucgaacucagaaauccaccugccucugccuccccaaugcugggaucaaaggcgugcgccaccacugccuggcugacuuuacuuuuuaaacuugcuuacuuuuuuccgucuguauggguguuaggccugcacguauuucugugcaucgugugcaugcauccuacagaagccaggacagggcauuagauccccugagcucggguuauguauggaugcuaggaaucaaacucccuuaacuacugagccaucucagcagcucccgugacuaucuuuaaacaaacaaacacaauacuuaauauauucuaaagagcucuaccaaccugugugccuacuggcaauguaggaaauucuaguuuuucacacuugauacuaguuuuuucuucuucuuuuucuuucuuuccuuuucuuuugaguaagguuauacacacacacacacacacacacacacacauauauauauauauauauauauauauuuuuuuuuuuuuuuuuuuuuuuugguuuuuccagacaggguuucucuguguagcccuggcuguccuggaacucacuuuguagaccaggcuggccucgaacucagaaauccgccugccucugccucccgagugcugggauuaaaggcaugcgccaccacgcccggcaagauuauauuuuuaaaucaaagccggucuccaauuugauaccuuaaccuccugaguucaauaugcguuacuuauuuguucuuuuuauguguauuaacuuauuugauggcuugcacauaccucugaauaguccccauucccugcuugagacaucuuggggugugugucuguguauauuuuuguguuggugcauauguguuuaugugcuuguguagaagugucaucuuuaggaugcuguuuaucuugagacagugucucauuggcuuggaguuuaccaauuaagcucgacuguuggcccgggagcuggggguucuucugcuuugcuucuccagaguugggguuacagguggacaccaugaaguuuuaggauuuucacauggguuguggggacucaaauucaggucuucaugcugugaggcaagccuuuuacugacugaaccaucgccucuccaauuacaguguguguguguguguguguguguguguguguguacuuaauagccaacuuagcagguaugaaaugguaagucauugugguuuugauuuucauuuguauuuuacuagugaugaauaguauugaauuuuuuuuuucagaugcuuaagagccauuuagacuucuuuggagaaaugucuauugaaaucaaacccaaaguuuacaaaaauuuuuauuuuauguguauugguguuuugcuuauauauaaaucuguaccacauauguaacugguaucugugaauauauaauugauauaugugaaggucagaagagggcauuggauccucuggaacuggaguuacagaugguuauaaacugccaugugggugcuuggaauugaaccuagguccucuggaagaguagcaagugcucuuaaccacugaacugucucucuaguuccugacuuaacuuuguaaacuagcuuacaaaguagcagguuucauuaugauuucucauacauacuuaaguuuuaguugacucuuuaucucaccuccuccauuuuguccccauucccauuuaaauauuuucaguucccaguguuccuucuuccacuuucaaaucaugugccuucuacuacucccacuuuucuuaaacuucccagggauggacgauagggggaggggcuaccugggagaagaacugagaggaaaggugggggcugacaucaggauguacagugaauaaauaauaaauaaaugaaaaguaaaaggaagaaaaagcuucccuuuccuucucucgugggcccuuuucuagguuuuggccucuacauauucauccacauaaauggugcauauauaaaaaaugagaagccggaucugcaugugaaagaaaacaugguguuugucuuucugaguuuaugucaccgauguuaauauacuauuuuucauucccacccacuuuuuugggaauuucauuuuuguuuacauuuaccacauuuaaauaaaucuagggugaguucauuuucuuuucuuuuucuuucuuuuuuuuuuuuuuccugagacagggcuucucuguguagcccuggcuguccuggaacucacuuuguagaccaggcuggccucgaacucagaaauucgccugccucugccucccaagugcugggauuaagaguucauuuucuuauugugaauagaaaaguagugaacacagaugagcaaugaacauaucuaugguagcguauggaguccuugguaugcauauggugguauagugggaucauacaggaauuccauuuuuaauuuuuaagccacugauuucuauagugacuuuuguaguuuacauucucaauaaauaaauguuuuauaacuuaauuaaaaauauuaaaaaugaaaugccugguggauagugagauaaguggcugguuaugacauugauguuuuccuuugguggcauaauuuuauccuucauguuguuccauaugcuuguguuuuguagcaucucaccaggucagagcacauagucccuagugaagugcucuuaccaaagcaggaaccgaauugcuuguucuuacagaaccuacaagcaguguugggugacucauguaaauguugcuuucagguuuuccuucugauuuuuugagacagggucucauucuauagccuauccuggacuauuccuuauguauuccgggcugaucuugaacauacgguuaucuucuuuccucagcuucucgagugcuggacuacaggauuacuguauacuguagggauaaacucuugugcaugguauaaaaguaucaccugucaauaaagagaugaauagccuauauagcaaggcaggauacaguagaagguggggcaucugacauagaagaauucugguacggaguugugcaggagauucaccacccagacuuggaggaagucagauguaugaaacugaggagagauaaccagccacauggcagacauagaauaguauaaaugggcuaauugaguuaugagcuaguuggggaacaagccuagcuuaaggccuaggcauuaauucauaaauaaacaagccucuguggcaguauuugggaacugggguggauauagaaagccuaaaugguuacuguguacuuuuaauuuacucuuugcagucuccucuuuuucauuuucaccuuuuguuuuucuuuuccuuuaagguugcaguuguucugauggauacccagggggccuuugacagccagucaacugugaaggauugugcuaccauuuuugcucuaagcacuaugacuaguucuguucagguaagauuccccucugucacuuuccuuugucugcuucccccuucgccccuuccccccuucuccccuuccccccuuccccccuuccccccuuccccccuucucccuuccccccuuuccuuacuucuccccuuccucccuucuucugaggauugaaccuaggauuuugaaaaaugcaaggcaacuauuuuacagugagcucuguagucugucaauuauuuucugcuaaugcaauuuuugugguuguauuuaagugguuuuauuuuuuuuacuuaauuugguuuuucaagacagggcuagcccugacuguccuagaauuuacucuguagaccaaccaggcugaccuugaauucacagaggucugucugcauccugagugcugggauuaaaggcaugugccgccgccaccuggcuaugagugaucuuuuuagacuguuucaguuugcuuuucuguggcugugauaaaccauucugauuaaagugaacuuggggaagauaagguuuauuuggcuuacacuucaggucaugauccuuuauggaaggaagucagggcaggaacucaagauaggaauuuggagcuccggagucaggaaccauggaagaguggugcuuacugacuguuuccugcuccugcuuagcuacuguauauaguuuacacacacgcgcgcgcgcgcgcgcgcgcgcacacacacacacacacacacacacacacacacacacacacacacacagauuaggauuccuacauauacuugccugcuucuuucugaagccacacuaaguauaauaaaauuaagcuuaauagcaaauuuacaggacaaggaagacaugaaauaguaugacaguacaaagaacuacauauauauuuauauauaguuuuuuauuucaggccuaccugccuaggaauggugccacuuacagugggcuagacccucccauaucagucaacaagcaagaaacccucuuucugguucagugguuaagagcucugacugcugcucuagaggaccugggauuaauuuccagcaccugcaggacagcucauaucuuucuguaacuacacuucaggagauccaugguacuaagccugcaugugguacacauaccugugcucauguacccacucauacacauaaauaaauaaaucuuugaaauauuuuuucaguuacaggcauaggacaaucuaauugaagaacuauucaguugaggcuucugauuucccaggugacuucaggguugugucaaguugucaauaaaauuuaauuagcauagacuauaugcauaacuuaagcucuuagaggcacaaaaauaauuauuuuuucuauuuauuuaauuauauacaaaauauuucaagaaaaucucaaaccucuuaaaguauuuuaaacuauuauuuuaacuaguauuuuaaagaaggaauuuugugauuuuagccuuauauuuuauuuuuuuccaaaagacagauaauacugcucucucucucuuuucauuuggaaagcuccauccaguguuauuugggacuuguuugaaguaagacagaguguuaucaaucuugauuuuguuuucuagauuuacaauuugucccagaauauucaggaagaugaucuucagcagcuacagguaacaagaaaugguaaugggacuaguggguaaaugauaaaauauuguguguuuucuaucguguguggaaucuagacaguaagagggugugucugagugcaggaaggagaccagagaggaggagggauaggaugaaaaggcuguggcugggugggugcugggaagagaggccuggucacugaagugccugcugugcaagcaugaaaacuuguaauauguagcacucacguaaacaaccagguguaguagugcaugccuuuuaccacagcacucaagagggagaggcagguggaucuguuuaaguuugcggccaggcuggucuacauagugaguuucaguaugguggcugcuaaccccagugauggagagguagaaauagguuaucugaagcucaauggccaguagucuaggaaauugcuuagcuuagguucagugagacacugucucauaaacuaaaguugaaagguauagaagaaacccaguaauaaccucugguuucacauacauauguacauauauacacuaacauguacauuuacauguacauacacuauacacaucacacaaacaacagcaacacagcacagacauacacauaaaaacagaagaaauaaaagcaaacagcgguacauaauguaugcuccuaauuuuguguuuugagacagggucucugugcguccagggcagccaaggcuucugggguugaguuuggguuggguucccaggcuuaagugcugacagcuuuuacuacugaaggguuugcucagcuucaaggcuagauguuuguuguuaucagcuaugcauacuuacuacucuugcacucauuucucugguagagggcagagaccuugggacagacuuccaaacauuucuuuaguugauagucccacuuccuuaccccucucuggaggaacucugcuuuucauuucuuaguuguuuaaagagucuauugagagaguauuuuacuucuugggccucuguuuucucccauuuguuaacagggcagaaaaagucagaacuggacgcuugccaucuguuucuuuucuucuguggugcuugugacaaguucuuuguacugccuuauuucauguccuccguguccugugaauuugauguuuaaacuuuauuuuauuauacuuaguguggcuucaugaagaagcaggcaaguguaugugugaauccuaaucuuagugcauccauucagacauuugaguugggcagcuacuuacaaugguggcaggacuuuugccguuggagauaacagaaugcaccaaaugggaauguuucugcauacuggucugagugcucacaguaacuaaaaaauguacuacgcccagccaaauaaauauuuaaaaaauuuuuaagauuuauuucauggggcuggugagauagcacccgacugcucuuccgaagguucggaguucaaaucccagcaaccacaugguggcucacaaccaucuguaaggauaucugacucccucuucuggagugucugaagacagcuacaguguauuacauauaauaaauaaauaaaucuuuaaaaaaaagauuuauuucauguacaugaauauuucuuuuuauaaaaaaauauuuuuauuagguauuuuccucauuuacauuuccaaugcuaucccaaaagucccccauacccuucccccaacuccccuacccacccacucccacuuuuuggcccuggcguuccccuguacuggggcauauaaaguuugcaaguccaauaggccucucuuuccagugauggccgacuaggucaucuuuugauacauaugcagcuagagucaagagcuccgggguacugguuaguucauaauguuguuccaccuauaggguuacagaucccuuuagcuccuuggguacuuucucuagcuccuccauugggggcccugugauccauccaauagcugacugugagcauccacuucuguguuugcuaggccccgugcaugaauauuucaacugaauguauaaaugugccugguguuggauccccuggaacuggaauuugugacccuccguguggaugcuaggaaucgaacucugguccuuuggaaaaacaagugcuuuuaaccucugagccaucucacuagcucccaaauauuugcaaaagaauacuuuaaaauuauuuuaaauaaaguccuacaaguuauuaacuuauuuuuucuuuuuuuaaagcucuucacagaauauggccgccuggcaauggaugaaauuuuccaaaaaccuuuucagguaaagcacugugaaugucauucuuaucuuuguuuaguuuacaguucacaacccagaucugccuguuuuuauuauaaccuguaaacuacaggguuguuuguuuguuuuuuguuuuuuguuuuuuuuugagacaucuugcuauauugcuuuagcauguccuugcccccuuugaaaagauuagcagaaaauauuacaguaauaacuguaauuaacuuugaauaugcacuuauacaguguuguaauucuguucugcucugucacgauagacacugauguuuuugauucgagauuggaguuucccuuaugaauauaacuauggacugcaaggaggaauggcauuuuuggauaagcguuuacauguaaguaggaaaucugaaugguuuucuaaagguaguaacuuucccauuugcuuuagaauauuguuuuuaaagcauaugauugaaaaugauacucuuacauuuuuaugaauauuagcauaaaccuguauaauuuuuuguuuaaaaauuuuaaaauuacauguauuacuuguguugugcuagagaaagaggagagugcuucaguacuuaugugaaagucagagaacaacauauggaaguuaggucucucuucaccaugugggucucagggauuacacucagguuggcagacuugauggcaaguaccuuuuaccugcuuagcagaaagauggcuaucuuucuggcccuaguauaaguuuuuuucaugguaaaauugaagagccaggguauauaauauauaggcaguguggagaggaacucuaagcaaaaggcuuuuuauaauuauaauuuccaguuauuuugaaucauucuacaugugccuuuagaauaucauauuuagaauuguaguucuguucuuacucaauauuauuugcuuuggcaaauaacacgucuagccuguucccuaaaacagaagaccuuugucagucaaugcuagcucauuggauccuucugaccaacaagcuuucuguucuucuuacauguugcgcaauaccuuugacaaccaagucuuuagauucuacucucuguuagcuaugggagacucgagcacauucauacacuuacuacuuuuugggggucugguuuuucccauuugucacucugaucugucauuugggaagucuucuuucuucugucuuuaugcuaguggcugcuggugaagaauaccaaauugucuuuggcuuguaaacuugcuugacuuuccuuggcaggugaaggaacaucaacaugaagaaauucagaaugugagaaaucauauucacucauguuucuccgaugucaccuguuuucucuuaccacauccagggcuccagguggccacaagccccaacuuugaugggaaauugaaagguauguuauagacauugcuaguguacaugugauuggaucuuuggaaucccauaauuugcaguaagagucaguuaugaaucgaauggauguuuaugagaaugaauauggucucauggaaagaauaguauuaguacaguucagauuucccuccugaguacuaugaccaucagaagcauuuugccuguuucacuaacugaaaaugaaguaauguucuucagggcucuuucuuuuuuucaggguuucucuguauagcccuggauguccuggaacucacuuuguacaccaggcugaccucgaacucagaaauccgccugcuucugccucccgagugcugggauuaaaggcgcgugccaccacgcccagcuagggcucuuucuaagaaacagcuuuugcuuuauaagagaucagagugcuaaaugaaggaagacuaaaacauaagacauucaauauuuuuucaaguaaaaauaucuuccuggggaaaaguaccauguuacacagccaaauacuguuucaacuccuuugugcuuuuaccaaaaccugaugcugggucauuagcuaacgucaagaauugcugggucagugguagguuagagaacccgaguugggaugcuuggguaccauuguguuauuuuuguuccuuauuccuggaggcccugagucaccuaauggcuggcccacaguuuauacuugucaagcaguuuguuuauaggcugaucugagucucuuaauuuccccuaaaacacuguaauaguagcuguuagcuuugcaguccaguuggguuuccaguguuauacaaaaugcuuuauuacuaagcucacaguaauuccaugaaguuacaucauuucauuucagcuucaggaagcuggcaaaaaugagaaaaguuaagcaacucaaagugcucagcuaaaagcaguaggacagaggugaacaucuuaaagccugcaccguggaaauagacguucacuguuguuuagaggaagucuuuagagaauauguacauguugaguuaccagggcaacuugcccuuuaagaauagccucaguaaauauauaauuaauaaaauaaauaaauaauauauaauuuucauucuauucgauuuaguugaucuaagaagagaaauauauuugucuaagucaauauguacagauaugaagcugagauggcucaguagcuaagagugcucuuggguucuauuuccagcacccacauuaaaugguucacaacuguaacuguaguuucagggaauaugaugcccucuucuggccuuccugguacugcaugaacauaaugcacuuguguaugugcugccacacacaaaacugaaauggacacuuagcuuuuuuuuuuuuuuuuuuuuuuuuuuuagguuuuuuucuguguguaugagugucuugccugcuuguaugaauauauagcauguaugugucuuaugccugcagagcucagaaaagugugcuggauucccuggaauuggagccucauguagaugcugagaccugaaccugggucuuuugcaagggcgacaaguaugcuuaacuguugagccauuuucucucuuuucuucuucaaagauuuauuucuauuuuuauucaauguguaugguguuuugccaguuuauaugccuaugugccauauaugugcagaggccagaaagagggugucugagccuuuggaauuggaguuacagguauuuuugagccauuaucuaguugcuggaaaucaagccagaauuuucuggaagagcaaugcucuuaucugcugagccacuaacuccaccccuaaccucuaucaauaaaucuuuaaaaaagauuuacaggccagcuggucuaagugccuugaaacaaacugaauuugaaagcuguaaccuuuacugucuguuugacacuugugugauguguuaagugauuggcagcuuuccuaaaggggauacugugagaucuuguuacucagugauugagauauucaagagcaagaccuggguuugguagagauaccugcuuggguaaacaguggagguagaaccuguuaccuaaaaacugggagaaaauuuuuuagaguuaaguagggagaaaaaguuaaggaaguuaagugcacuccugugcacgugugugcacgugugugugugugugugugugugugugcacguguguguguguguaacgauauagauuccuuuuuccuuuuuccuuuuuuuuuuuuuuugagagguaggaucucuagcccaggcuggccucaaacucacuugguagccgaggguaacuuugaacuucucuuccugccucuacuuccugacugcugggaucaagguauucauccgcauccgugugccugacuaguaauguucucucaggguuaugacacuucauuuuagcuguauuuuuuaccaaaucuaaacuguuggauuuuugauuguuuugaguuaaggccuugcuauuuagcauugcuuaacugggaguugauauguagaccaggcuggcuuugaacuuggagcaguucuccuguuuucacuuucuaaaugcugggacuauggacguauuccaccacccccagcuucgauauuuuucaauaggugagcuuagggggauaggucagugacuuuucaugucgugcccucguuuccuggggagcucagguuaccggguauaaguauagaaaaaugucaguauuucccaucuucacgcauuuugauauuucaaagccuucuauuuugaaacucaguucauuuuagcauuuuuauuuagaaaguaggcaguuuuuaaagguugugugacugugaccugaaguuguauguuacugggacucauguuguuugcauuucugugguugucuuuagugagucacuacaagcugggcagcuuaagacaguagagauuuauuccuuuacaguucaggagaccagaaguuugaaguaguggcugguuuccuucaggggcucugacgagagccuaucccgugccucucuccugacccugggaggugauggcaauccuuggcauucauuggcaguuucuguguugucacauggcuguccucucucacucuucuuccuaccagcccaucauucugaauuuaagaccucuucagcuauuauaaauccuccuguuuagugaaucaaauuuuuggagcaccuuccaaguaaggucauaugauguauguuuugggaggcagcacaguuuugcugaugguuuauuaacuaaauguuaaguuaaauacuuguuuauauuuauaagacagggaggaaauuuaagguaagcaauuuccagucucaugacuaggaaucauuugcuuccuucauucaagauagaacaauauacauauauauauuuuaauugauuauuuuguagucuuagcuggccucuggaauucacuauguagaucaggcuggcugugaacucagagaugccgaccucuguuucuggaauggcaggauugaagguauauaccaccauggccgagauagaacuguaagauacaguuacaggguuuaagucaugcuuuuuuaaauaugaaaaggcaaguccagaaggacuagggauaugcggcucaauuacagaggcuucccuagcauauaugaauauguaaguguggucuucagcauugagcaaaaaacaaaaagcaaccagacaccaaacucaaguucaaacccagacuuagacccuaaucuccaaauuccaaaacccaaauuauugaaaauauguaaaccauuauaacagucagaaaagcacaaauauauuaguauguuaucgguuuauuguuuuuuuuuuguuuguuuguuuuguuuuggcguuggcuuuugguuuuugguuuuugguuuuucaaaacaacauuucccuguguaacccuggguguccuggaacucaauucuguagaccaggcuggugucaaacucacagagacccacauaccaaggccuggguuugguagucgaggucagaagacagguuuguggaggugagucucuucuacacuuuagugggauccaggucaguagacuugcauagccaaaccucuuuuacccacugaggcauauuauaccuacuucuuuuuggagccagugucuugcuguguauggccuauaacucauuauaauagcccauacugaccuugaacucaguccuucugccucagucucucaagugcuggauuuucagcaugcaccuucaugcauggcuuuauugaguuucagugaagaauaaauucuaaguugaaaaaaguagaugauuuguaaauacuuagcuaggacuagcuuaugagucacacagguuuuuaaaaguuuuggagauggguucuugaugcacagaauucaagcuggccucuaucuuuuuagauagccugggauggccucauccucccaaguccuaguauuguagguaugugucaccguaucuggcaccacaugugauugacuuuauugugauacacuuguaaguggaacuguuguggggauagcucagcagguaaagguuccugcugccaggccugacgauugaaauucaaucucuggucaaacaugagcuuaguuuuggugucauagaagcugagcuguuguuucuugcagauagaggaucacuugguuuuugagacuguuuccucagaagcaggaugcugugucaucagcauaaagaaaacuuuucgcuggagcagggagauugcuaaagcagcuauuuaaguguuuccuuuaccaaacaccagggcuuagucuuuuauauugugagaaacugggcuugacuguuaagagacaguucuuuuaugauuuaaaagcuguuauuuuggaauagccuuaguagagacaugaguagucugagaucuguaagucuuagcaucugcauucugcuuggucccuguguuuuuuaaauaguccuucaaggugaugaaaguugaaaccauaaaaacguuuaaaaauagaugauauauucucaugcuuuaaaagaggaccagaaguuaggugguauggacgcagcggcucacaccuuuaauuccaguacucgggaggcagagacaggcagaucucugugaguuagagggcagccuggucuacaaagcaaguuccaggacagccagagcugcacagagaaacuguuguuucaaaaaaccaauggcucagugaauaaaggcagcugcuaccuagccuaaugaccagaggucaguuccuuagacucacaucguagaaauagagugacuaccacaaauugaucucucacuuccacacauacucugugucacauauacacacaaaugcacacaugcauacacgcacaacugcacaaauuuuuaaaauuucccaaaggauuaaaagguauucaaugaaauucuauuuucuguaagguccuauaguuuaauauacauaagcauacuguagaacaguauaguguaucaaccgcuuuauauacuuucuucaguauaaaagaaucaguauaaaaggauuuaagauacaguuuuuuagauuuuauguuauuuuauuuuuuauuuuauguguauggguauuuuguuugcacauaugucuaugcauugucugaguguagugccugcagagacagaagagggguuagagccucuggagcuagaguugcagaccauugugaguuaccauguagguucugagaaucgaacuccucucuuuuggaagagcagcuagugcucuuaacugcugagccaucuccaaccucaaguaugagauuaauaauuuguccuaccuuuuuauuucuuaaaauuuagcugggcgugguggugcaugccuuuaaucccagcacucgggaggcagaggcaggcggauuucugaguucgaggccaaccuggucuacaaagugaguuccaggacagccaggacuacacagagaaacccugucucaaaaaaaaaaaccaaaaaaaaaaaaaaauccaaaacuuguauaaaucauacuucuggcaauucaguucuccugcaucgucauaguuggguuugucuguccauacuuugaggaaagggcaccucuacuugaugaguccccugauucugccugagaaccuggugcaaacugcaaagagugcaucguuuuccugacauaaugcucuuuuuaucuugagguggccugggagccacugagaagauacuuagaagcaaauagcagaagguacaaaugcuucuauuucuucaaguauuauuaucauuuuuuuuugagacagaauuaaugcacugcagaugagcuccugggauuaugggugugagucacagugucagcaagagcuuucucuuuuaagacaaaaucuuagcaaaaaugaggcaaacgaaugaauaguggcuuccuguuuauucuaagggauaguguaugggugcagcgaaggcauggggcaagugaagagguuguuuuguuuuugaauacauucuuuaauucuuuaaaaagugauacuaacuugggaggcaaaagcaagaggauuguaaauuugaaaccagcccuggguaaauagucaggauucuguccauaaaugcaagccaaaccaaaccauguaauaucuuaaaaagcaagggaauaaaccagauaucccagaauugaaaacaagauaagggcauucuguauauucuucugaacuggaaaggacuuaaaugugacgggaaggaaggucacaauguaagugcaucaggacggcagucuaucagcagccggaccucagccagaagauagcaagcauaaucuuaacccucuuucuguaagaugguugugugcucauuuuggcuccuugugucuuucuuuuuauagauauugcuagugaauucaaagagcaguuacaggcucuaauaccauauguacuaaauccaucuaaauuaauggagaaggagaucaaugguucaaaagucaccugccggggauuguuggaauauuuuaagguaaauaugaauuuuaguucuaauuugcuuuuuguaaaauugacuuaauauucugggggagauggucagaggcauuuuaugaccuuaguguucuuacagaagcaggccacuggguggcaguaugggcauaagaaccaaaugacguucuucgcacucucuuagaguagucauuacugugucuucaaggaagaugguguggacaggaggugguuaagagguggcugugaguaggagacgcacauagaugggaugcagcucucuccagguggauggucucuauccacaggucauggugaggccauugugcauggggccugaguggaguccuggccuugguaggcugugcugcuugagaauauuuauauuauagauaacuaaaaaugcuaacaugcacgcagagguguguugugcuucugcuaauucuugguuguugaucuaggauuuuaggaaaaugcauuuguguggucccacuauuuuaaaauaugagcaaaauauuuuaguuauauuuuuguaauaguuucuauguuuauauuuuaaggcauauauuaaaauuuaccaaggagaagaucugccucacccgaaguccaugcuucagguaauaaagucuuugguguucuaagugacaucuucauuugcugggauugacccaaauauaacagcugagaccugaaggagagcgaggccacucuucucaccuugacucuuaagagcacauuuacagcaaguguaugugcccucugccuugucuguguucucgauggagcagucaauacagcuggggcuguucuccuugcauagcauacugggaaacauugcuuugcuggauacagcugaaaaggauucucuggucauuugcuuaaaacuguuuuucacuuucauaugcugaauguauggguauuucuugcuaaauacugauuucuuuaguagcaaaauauuuucacaaaauccuuggaccuugugacuuguagcauaaugaacaauuuccuucuucuccuccucuucuuccuuuucuuccuuuccucuuccaccuucuaccugcuuccucuuccuucuaccuuccucuucuuccuccucuuccuuccauccauccauccuucuccuucuccuccuuuuugaggcacugggacugagcccaaggugccuuacacuguauagguuacguaugagccucaucuccagcccaaguaggcaccuguuagguuuaaaauugaaguaaaggaaauuauauuuucuugagcuuuagagguuugguuuaugcuaaagauucuuaagugucagaauagauguuuuggcacaaaagugggugaaaguauguauuuuaugaguugaauuauauggaaauauaaagaauaacagaaggcuaacaaggaaaaaugggaauaggaagagagauauuuuugcuuuguuucuuggaaaauguuacaaaaaguauuuuacucuuuuuuuaaaggccacugcugaagccaauaauuuggcagcugcagccucugccaaagauauuuauuacaacaacauggaagagguauguggguaacaccguguucugaagugucauuuucccagcauggcugcugacuucaaaggcccaaauuugauccuccucaauguauccuuuuuguuuguuuguuugacacagggucuuauguaauaggcuggccugagaaucacuguguuaguggaaggugucugauuguacugccuagaccucacuaaugcugugggcacaggaaugugcuuuaaaagucuguuuucacuuauuaauccuuguguauguaugccauagacaugggugcucuugggccagaagagggcaugggauccucugaagcugaaguuccaggugguugugaauggccuaauguguguguuagaaaugcaaccugcuugucuagaaaagcuggaagcccuccuuuaauucaugagcugucgcaucuuaagaugaugaguuagaaagcugucuuucaggucacccuaguaauugggaugcuccuaauuauuacuuuuuaaguuuaaucuuucuuuucuuuugaaacagagucuuucuauguaauuuggaucuucuaguuauuuuuauuuuugucaggcagaguugugauauguaguccaaguuggccucagauucauagcaauucuuuugccucagucucuuaaguccuagacaaaugugugcugccauaucucuucuguuaagauuuauuauuuauuuauguguauaucucuggaguggguaccugaauacacagucagacauuagaucuucuggagcccuagucacaggagguuuugagcuuuaugaugugggugcugggaacugaacucugguccugcaagagcagcaaguguucuuaacuacuaagccaucucuccagccuccuagugucugguucuuaaccauuucuaaccaagcuuuuaauuaaucuuuauauuuuuauacaaagacuugcuuuguggcugugguuggccugaaauauguuauguugaccaauuucacauuaagcuuguauggaucucuugccucugcuuucuaagggcugggauuauaggcauauacuaauaugucuggcuuuggucugggauauuugucuuuucugacuucccguuuaagcagaaucucacguagcuuaggugggccucaaacauuucauguagcugaggaugacuuugaauuuucugauccuucuguaacuacuuguggaagguugggauuacagauauguaccaccauacugauuuguaugauauugggauuaaaccaagggcucugugcauacuaggcaaguacucuaacauauagguuauaucuuagucucucuugaauauuuucugaaguuaauuucuaagcuuuuuuucuaaacucuuaagagcauucaaaucuuuacugugacuuuuuacuuacuuuauuuggcauguacaagaauauucagcauguguuuuuguuauuuuuagauuugugggggagagaaaccuuauuugucuccagauauuuuagaagagaagcaccuagaauucaaacaacuugcucuggaccacuuuaagaagaucaaaaagaugggugggaaggauuucagcuuccguuaccagcaggaacuggaggaggaaaucaaagaacuguaugagaacuucugcaagcacaacggcagcaagaaugucuucagcaccuuccgaaccccugcaguucuguucacaggcauagcagcauuguacauagccucgggcuucacgggcuucauugggcuugagguuguggcccagcuguucaacuguaugguuggacugcucuuaauagcacuccuuaccuggggguacaucagauauuccgggcaguaucgugagcuggguggagccauugacuccggugcagcauauguguuagagcaggugaguagagcuggcugaggcugaggcugaggcugaggcugaggcugaggcugaggcuguggugaugugcuucugaaguaagauuugaaagaauuucauagugagaaaggagggugagcccacuuugugaugggcuuuacauuuuauucuuuuuuagaauauugauauuuaauccugaugucuuguuuuaaugccuaaaaguggcccuuuaaugcaaaaaggggucuuuaaucuacuguuucucuugggucaguuuuauuuuuaauguguaccagugcuuugucugcauaugucugugcacaauuuguacagagugcccagagaugcaagaagaggugggucccuggagcuguaguugcagaugauugugagcaugggcagcucuaauuaugugcucuucagauccaguuccuguaugauucuuccauccucugaugaauuuguuucauugauaaaauagggacuuaacacuguugcauuuuaaaucuuuuugggauagaaaauguauggcauugccuucauuuagucauuacauuuuuauguguauauuuuuaaauuaguuuuuugguuaacauacauaauaauggguuuguuuauggcauuuucauacauaccuucauuuauaucuucaaaaaggaaauguuuuuugagauugucaugaucucuaggguuuuuuuauucuuaauguuuauuuaaauuuguuauuauuguguguguuggguuguauaugauaugugaauguagaugugugggacccagaucgcacgauauggaggccagaggacaacuccguagagucaguuuucucugcucaccuuuagguggguucuggagauuggacuuacaucauuaggguugcagugauuacccagugagccaucuuguuagcugauuuuguuuguuugagacggagucuccuaucgaccaggcugguuucagacuucauguauaggagaggaugaaccugaacucuggaacucuugauucugcugccucucaauggcuucuaagugcugcaaaugcugugguauaggcucacaguaucugcuacaccaggaugggcuccaguguucauauuuuauuuuuugagacagggucuuugugcagucuaggcuggcuugguacucacuguguaauacaaucauaaucuuucuaccuuagcuucccgaaugcugagauuguaggucuguaccacuacaacuggucacuuuguauguuuuuaggacgaguuuuuuucuuuuucugugacguaaguagauuaguuagguccacaguaugaacaggggagacucaaccuccucagcaggggaagagaggcuccguugacacuuaggagucagcugccaucaugguuuccucucaccacggucgucucaguccgucugccuuuucagcaugcugcugaugaggaaagauuauuggaaguuaccccccaggacuuagcuauuucgugccguauuguaauuuauuaacuaacauauugacuaaauggacuuuugcaggcuucuucgcauauugguaauucuacucaggcugcaguaagggaugccguuguugggagaccaccugcugauaaaaaaucucaauagcaucuuaaugggaagauccaacaagagcccagucagcuucuggauuucugccaaugccaucacggguccaauuccagaggaauggcagaucugagaccauucuggaagaucugagacagggcacuguaauaaaugaacugacuucugcucugguuuccaacuccacuuggcuuggaagcaguucuuuuucuugcuguuacagacucaaggcuacucuuuucucuguucucugcuuuuugcacuuuaagggguggggguggggcuaaaaggaaaacagaaaugcagcuuuugagucuuugaugugccacauagugccuuuucagaccagugcaucccucugcagccauggaggcuaaggaacggagggcaaccucaugaaaugugguuuuggaucaaugugguuuuaguucuuuuguaccuuugaagauuugucuuuuuaaaaguuuacaccacuugaaaaaggcucagaaagaaaggcccacugaaaugaugcuuuauuauccuucaaaaguuuucucccaguacuggugauugaaccuguugccugaguaugcuaagcaguugcucuccccugcagcugcccccagcccacuugacugugcagacucagggcuugcaauuacucgauucuccgcggcugagcuucccaucguccucucucccuaagguccugaguaguugaauacagacuuguggugccauccuugcuucaaaagccauauuuauaugaguucucuuugcuaugcagcaugaaagacguuaagucacuuaguacucuguuucagauuguaaggccuuacaccgaggaggcuggcaguuuugucgacauugcuuucuuauuuuuauuucuauagcuucuuucuagaaaagaggcaaacuauucuuaaaaagucagugguucauaauaaaaggaacuagauacuccauggaaauuguaguuugaaugaaccaugagaccucugauaaagucaccuugaauuugugucuugguuagauucacuguacauuuaugucacuguacauuuaugccacaaaaauagucauuuucaacagagaaaaggcaugaccaaauauuacuccuuuuaauuaauguucacuuucauuuugccuagcgguaauaccaaaugaucuaaucuaaagucucuaccuaaacucuguguauguguguguguguaugugucgcaugguguuucccuggcguguagaccaggcuagccuugaacucauagagauauuugugccucuguguaccauugugccuggcccuaaacugcuuuuuauucuauauacuaucuaauguucauaauaucaaagcuagacuguuaauuuuauuuaguaaguuuucccuuuuuuuuccuccaucgaagaagaaaguguacucagucuagccaaacuauuuaaaauaucucuuaagccagguggcauuagcacacaccuuuagucccaacacuucagaggcagaggcagguagaucaucucugugaguuugaggccaaccuggucuacagaguuaaauuccaggauggccagggcuauccagagaaacugucucaaaaaaccagaaaacaaauucccucucgauucuucuuuugguuagucuagcaguuugaaaauaauuggcuuaggaaggauaauugcuaagacucucauauuuauuuuuuuacauuuaccuugauuaugugauaaaguuuuaucuauugcuuuuuuucuuugacuuguaguagugaauuauuguggaccuaaaccuucugaagguauagaagccuugauuuuggagauaaugugagauuuuguugcaggaaggagauacaggguuuuggcaaagccuaguguaccuuuuauguacauggaguaugagaggaagguaagagaaaaggaagucuucauuucauuucucuuuaaugcacaacuuucuuguuaguaacggcuuuccagucaaacauuuaaugaauccugaauuaauauuaaguauuuuauauauuuucauaccaucucauccugaaaauguuaguaguuuuuccuuuugcugugacauuugggaaugguuccaacuuguuuuaaaacuacucacugcucgugagugauggcugacuguaaggggcuugaaacucacuccuggcguagugcagaguuuuuagguaauguccccuauccgaacgcuuguauugaguuaaguacuccugauacugagauaaggucagagaggguuuuggggacaggguuuuguuauauagucuaggucagccuuuaacuuacuuuguaguuuagacuggcuuugaauuugagguuuugcugccucagacuccccaagugcugagcuuguaggaguguguccccaugcccaccucugguucucuuaaugaugaggaagacgauguggggaaacuuugccauugcuucaguauuacaucuguguguguguuuaaagugaguguuccauuaauuagcuuacucugcuccugggacauguauauaaaguuucuuugaggguuggccuguuuucuaacuuuaaauuguggauuuucuauuacaauuuucaacacaaaaugccuuuuuaugacuggcuggaaauaguucugaggagacucauaacugguugaaagagucucagccuuugcuuuguggcucugggacauggugaaggagucagaucagugucccuauagguguucuguacaggcaauauucgugcacuucugucacuaaguguagcacauuuauaugauauaauggagauuucauuaaaaauaacucacuuuaggaaaagcuaguuguugccaagauguccuuguuuuuguuuugggugcugggggugcauucacagggcucuguguaugccaggggcuagcucuaugcaccagguguagcgcuuuagugugccucuuaucaaauggauaaaauuacaacuuugauucuuucacugagaaaucucucaugauuuauugcuuacugauaaauuuugagcaucucuuuugaagaauaccaaaaaucugucucauagaugcuugugacauuucuguccucuuucccucccucuaccccuuucucuuuuucuuuuucuaugcagcuccagccagagguuuguguuugauaccugcuguauacugggucaggccucugaauguuuaugcuugauucacuuucucucacucauuaagacagacacgcauuguauuuuccauguaguuucuuuaguaggucacacacagugguugguaccuggaauaugugaaugagacaaaaauucaguagguuaauauaagcccaagcaaaaggaaccccccucccaucucccaagugccauggaaauaucaaaaagaccuauuuuguuuguguaaguuuuuuggaauauaguugaguaugauuuuauuuauuuuuuuuaaucagguggccaacaucucuguauuuugcaaccuagcaaguggaaccaguguguuuuuugucaggagugaggccauaagcaagccucauuuagcaaagugaaaaguauucuugucucauguggccugccguagugucuacgguuauuuucaucaggaguuguacuguggcuccaucuuggacacugguucuuaucuaccuuuucaugcuuuagauuaauguacaggguguacuaaaagaaaaugggacucugcuuuguagcuagggauugcugaaguggcuuugugcuguggcccugggaucaucauuuauaaacaucaguaggugaaagguggguggguggggguggggugaaugauggagacugagcugacccauggacuggaaguacccagacaggagggcucuucagcauuucuagcagcuuuaccugagcucugccuccaggucugcucccccuagaguuugcuauguuuagaaccaucaggguauccuaauucagaugauuguccaagcuuuuuaaagcugucauagugccuucucuuaaugccugccucacacacaaacagguaauugggaaaacauuuuaaaauuuuugagaguguccucuuucucacucuaaaaaagccccauugggcacugugacuugaauuccuacaucuuuugcuguuuuguuuugagaaagggucucaguguaaccuugucuguucuggaacucaccauauauauagaccacgcuggccuuaagcucacagagaucaacuugucucugcgaaucccgaaaccuuuaacacacagaaaacccuaauguauuaaauaccuaaugaauaaaaaggaugagaucauaacuaugaaagucguuaccuauguacuccacagcaggaaccagaacgcuuucuuacaggaaagaauuucaugugccagagcugguguaaugcucuuacaaagugaaggucacauuaaugcccaaaccuuauagucaggugaucaaaauuguuaugaauguaaaccuuacaagagguaaaucuugaauauacacaguuguucucaauuuuauuuuaaaaaugguuuguuaugcuuucugcuaggucauuugccuuugaauggcuuuaagacuauaguuuucuuuaaagcacaaugggaaucaaugaugcuguacauuuaauggauuaaagaucacaccaccgugucaccuguguguguuguuacuguacuuucuuguggaaggaucuauagaacagaguggggauuggucaggggaguuggugaccuggucagagaugggaccacagugacauugagccugguuagcggugaucuaguaaggcuguuguccaaugccuugaaagcagugacuagacaggagaguuguggacucacuaugcagccuugucacucauuggcuggacucagaguggaguucaggcuggcuuugaacucauagcaaucaccagccucugccuuaagagcacugggagugggcagugguggcgcaugccuuaaucccagcacuugggaggcagaggcaggccgauuucugaguuugaggccagccuggucuacagagugaguuccaggacagccaggcuauacagagaaaccuuguuuugaaaaaacaaaaacaaaaacacccccccccaccccaccccccccaagaaaaaaggaucacugugauuagaggaguuugccacuacacugggcuccuuuuuuuuuccuugucagaacguggucauggugcauggugaacaaugccuuggagaacugugaaagagucuccaguaauacaggcagagagccuuuuaccucaagugaauuuuguuccccuugauuguuuacaaacaugauuuugugccuccugcgacaaaaauuugcaaucaacuuuuaagacauguuucuuuuuggauguuggaagauagcuguagagcucaauuuggugaaaggcuaugcugaaugcuguccucagugugcucugaaucuggauauagucuucuucugccuugcuuuugugcuuucccagacauaaucuauaguacuugccaggcaauuguguuauauuuguucucuccugagaaaaguuuuuaaauugggcuguucugagaaagggcugcucuguuaauauuuaguaugugcuuacuggcauuuauuuacauuuuuuucugaacucaaccuucguugaaucauuacuuuuuuuuuuuuuuuuauuacauuuguguauaaaaugcacugaaacugaaguaaaguugucugcagcauugaau

SEQ ID NO: 9144 - RNA, 676 nt, Mus musculus
gcuagcagucaagugugccuguguacaugauaucaguuccuuuguguccaaacugcaucaucauacaacgguauucuuguagugucauagauaccaaaguaggcagcuugguagaugauaaugcccuguacugacacauuaaagcuugguucaucaggcccuuaaucccaucggauuuguagaucuuaaccaggcagucaccaaggccuuugaauucccuuucagcuccagcuuuacccacaucaacugcuagaccgguacaggcaaaaucaagaggguacacaaagcacaaggauguagccccaguggcaccaccugaugccagguucccugcaaaguagcaccaaaacuggguccucuuguccacaccacccagaaagaucugcuuguauuuaucuuugaaggcaaaguugagagccuggguggggaaguaucugaugacauuggccagguucccacaccagaaggacagucucccuguuccuuggggauaugaaccacgcagucuauaauguucuuguauugcuuaucugcugugauuugcuugcuggcaugaugcaccugcugcagcagcuugacccucucgaugaugggugcuaccgcugucuuggagauggccgaggccacuccacaagccaagaaguccuuaaugaaggacacaguggcaucugucaug

SEQ ID NO: 9145 - RNA, 676 nt, Mus musculus
caugacagaugccacuguguccuucauuaaggacuucuuggcuuguggaguggccucggccaucuccaagacagcgguagcacccaucaucgagagggucaagcugcugcagcaggugcaucaugccagcaagcaaaucacagcagauaagcaauacaagaacauuauagacugcgugguucauauccccaaggaacagggagacuguccuucuggugugggaaccuggccaaugucaucagauacuuccccacccaggcucucaacuuugccuucaaagauaaauacaagcagaucuuucugggugguguggacaagaggacccaguuuuggugcuacuuugcagggaaccuggcaucagguggugccacuggggcuacauccuugugcuuuguguacccucuugauuuugccuguaccggucuagcaguugauguggguaaagcuggagcugaaagggaauucaaaggccuuggugacugccugguuaagaucuacaaauccgaugggauuaagggccugaugaaccaagcuuuaaugugucaguacagggcauuaucaucuaccaagcugccuacuuugguaucuaugacacuacaagaauaccguuguaugaugaugcaguuuggacacaaaggaacugauaucauguacacaggcacacuugacugcuagc

SEQ ID NO: 9146 - RNA, 5277 nt, Mus musculus
augaggcaggggugauguuuuuauuugaagacaaaaacacccaguauaagaauucguauguaaucugcaaaaguuuaaaaacaaggagaggaagacuagaauccaaaaggccuggggagaacaaaggagggugguagguucugcauaggaaggaucaggccacaaaggggaacuguaacagcaagcccucauaaggauucaggcucagguuuuccagcuucagggagguguccuccucacggcuuugccgggcacugucgguacuaagcaaaaguuuagcgcuggcuggcaggcuuaugccagcagggagguuggaggccccuagccuggcugaccggcccgaaucucggaaguugagcaccaccagguaacgcucauucuggucccagugucguauguaggagaagaggucaggugaggaagacagugcauggaagucaccgugcaacagagagcgcuccuuaccccgaaggucacucagccgccggaacuggguaaggagggagccagggucuucauucuggcccugaaaaugauagacacacacagaaggaaggaaugagggggaucucuguccaucuguacagcaccugcccacccugaggggcaggccucaacugcuuaccuucacugucauguugaggcuuacaggucuugggaugugaaagaugcuggacucauuccacggcaugaguggggccuucgcaggcuaacaaacagagaaugugggacuuaaaaaaaaaaaaaggguggguccauuccccuuccucccauucucuuuccauuucaucauuuuguguuguucucugcugguucugcagguaugaugccuuuguggcauggccccgggacaggaccucaucuggucaccacuacaagauguaccuuucugcuuguccagacucucaccaagcuucaguucccagagcgcucaaagccucuagccaauggguguaaaauacuaccguccaacaaagaaauguucugaacaucuuaccagauaccagacauuuccuuugaaaauagggcuuuggggucuggggaguugauucaauggggaaaagcaccaugcaagcugaccagcuggguuugauccccagaacccacauaaaggcuaaaggcaaaaacuuacuccacaaaacuguacugaucucauguaaguaccuacccccaccacccacacaaacacacaagcauucccagcugagugccauuccagaacugggcuauuuagugucugaggccagcccaggcuauacaaccugucugacaauaggaaaacccuguuuaaaagauacacacuugccacauaguucacaaacgacugacaaaguuccaccucaugguuguugucugucugucuguugccacucacagaugccauaacgugauaaacacuauuucccacacugugcugggcagaagacaagugguaccuguccaggaagggcacccugaaggccaagcucauccccguagcuaaaaacaggagucccuggcagagugaagagcagcagcugguagagucggagaagaugguccgguauaaagucugcgaggaguccugcuugcgacaccugcaggaggauacaccuuugagcauguccacccuucaucuaccacuucccaccuuccccuaaacccaccagcaugcuacuuacacuccagcugcaccauuggcugccaguggcauucaaaaaccuagugacuagggauucaguacgcuccccagugaaaguggaauuugacagguaggagcuggucaacagcaggucgcugguggauucaaguauguugacaauuugcugcaggucagaggacucagucccugcaaucaaaagccugcacaaagcaaggauaggagugugauuagaaaaugucaggagauaaagaauaaaagagaagaguucucgagacuaggaaacucgccucucgaggcucucacaaugggcucagccaggcaggggugcuggguaccuaccuguccucacuuaaguucuuggugauauucugccacucagccaaguacaagggugcauucuaguagagaaaagcagagucagaacagggaacaccaccucgccguggcugagacccacucuucucaccacagcuuuuugccucucaaugcagaaagggcacucaccaucagcuuucccacaucccggaauuggaaaccauccacaccguccugcaaccaagaacucagagcuuccuacaggggacaaaagaacaggcaagaucaacauacaagcaagcccucaccuaccucaaauuucccugggaccuagaguaaacaggguucagucucccagugucaaagguuagcccuuggugccccacccaugcauuuacuguguaauagcauuugucuauuuucugucuugccuuuggcaaaucacauaccuucauuuuuaacagcuacagaaaugacccaagagaaaacaugcacgcacagcucuaacacuuaacacuuaggauguggggugaaaaugcccucaaauuggagaugaagaaauuggcugagagaagacgcggccaagauuguaacuggggaagagcacagauaggacccugaggcaaauguacuugcuccucucuuuguuuccugagguuuagaguguaugcucuucuacaagagcugcugggagcaaggccaagaaugagaaguuugaaauucaaaacacagccugagggcuguugagacaucugaaaagaagccagcucuguagaacaggcccaggccugaagguuuaaacccuggcuucaacugacagcacagaacccagccccacacuuccuuucuucccuucucacuugcucucccaucuucaccugaggcuaccaccugaaagacauaucaguaacuuuucuuucugacuucagaccagucuccaacucacugcauaacugaggcugugcuuaacuucucauccuccugccucccgccaacucucaaguguaggcuacaggcuuucucuacuacuuugaacucucuuaucaguaacuuuuaacaaacuuccuauuaaguauaggaucccagcacaugggaguuuaggauuacccucagcaauggagaucuagaacacaaaucucgcagcaacuagcaagagccaaacugggugauuauaggagucucccccacauacuuaagaauccaaaagugucagcaccugccuuuccuuuguuauguccacccuggaccugccaguguccuaaaacguaggcaucagaagcugggaugacauuagaagcuuuacccuagccuggugaguaccaaguuuaagccacuaccucaagguaaaggcagaccagagaagacuccuugagacuuccgguuuggaauacaugaagugacugcaucucaguuucuucaguaacagauugucaguaacagacaauauuuuguggguuuacuaaacaaauuagaaaacagcuauaaaauacuugggacaggaggcuagagagagagcucagugguaauagcuuccgcagagucaagagcuugccccuuuugcagaggagccagguucaguucccagcaccuacguagcagcagcucacaacuaucuguaacuucagcuccaggggauccaauauccuuucuugacuguccaauacccuuucuauuuucugucuugccucuggagacuccuauaaucacccaauuuggcucuugcuaguugcugggagauuuguguucuagaucuccauugcugaggauaaccuuaaacucccaagugcugggguaccaaacaugcacauagugcacaaacacucaugcauaaaaacaaaucuuaaaaagcauucauaguggaguuaacucuuuaaaaaauaauaaaauaugggggaagauaaaauaccagauacacaguaagacucuaguacuuauaauuucagacugggcucaguuccaaauacaucaaacaaaaacugggaaaccagucaggucaggguucccacagagaaagaaaagacuuccuaucacaaaaagaaaaauuaaacuuccaguuccagacugacaucugagaaauucccuuccuggcacagccucacuucuagaguaaaggaaacacauacacacacacacacacacacaaagcagucagaacagaaacaagaagaacaccgugcaccugggccuaucccuccggcuaugggaagagguauuccugcuugggagaaccacacagugcacaggaggcuugcugugaauaaauccacacagcaccaacaucuguaugcugucggccauaaaaccucaccuucauuuugguggcuacaaugucagccugagcagggaggaaccacgcauucuggcccugguaguugggagugagguccaaaaugaugugaaugccuagaaaaauaacgaguugagagaacuccuuuggggaagaagaggaaacaaggaacuugaacacagguuacuaggugaaccuacauacgguuugcacagaaucugaaggaaacccacaaaagcccucaggugguuuuauacuagagcaguuccuccuccgcccacacacacacacacacacaaguuuccauacugagguuuugguuucuuucuuauuuuccccucccaugaagucaggguucuguguaugugggcgggcugccugaggauaaauaagccccuacaucuccuucccaagugugggguuauaggcacaugcugcuuguguugugcugaggaaucaaacucaggucuucauggauccuagacaagcacucuuacaaacugagcuacguugucagcccucuauagugaacucuaaagcagcauuugaaucucuucuauauauaggaucuacuuuauacauuuaaaagccauuuauuuuaucgagccauggugacacacuuaagucuagcacucgggaccaggggagcucuguaaacucucauccggccuggucaugguagucagguacaggccaaccaauuacauggugagacccuaccugagaaccaaaaccaaaauaaauacauaaaaauuacgcucacgcaugaagcacauuuuuuaguguaaaucauaacauauucccccuugugccugacacaaaaaaacugagccaguuaggagaaaaaucagacaaaaacucuauccuguuucugggccagaaugccaaacccuuucuaguuccuuagaaagaccuacucuuuuucuuggcacuuuguagaaggucuuuaaaaucuuccugggagcccaaagugggauuaaucuguuucaggucgguuucauugauuucauccuucugguucuugugaauuggg

SEQ ID NO: 9147 - RNA, 5425 nt, Mus musculus
uaguggcgcgccggaagugcaagccacgggcuggucugcgauggcgacugccucggcucgcuggaaccaugugugggucggcacugagaccggcauccugaaaggugaguauuagaguuguuugugggacagugcaggggucgcuuguuugucaccccagcgugacugacguccucgucccuuaggggugaaccuucagcggaaacaugcggcaaauuucacaccguccggacagccgcggcgggaggaggcagugaaugcucugugcuggggcacuggcggcgagacccaagugagcagccucuggccgggccggagcuaagggaugccugacagucuugcccuucuuccaucauuccuuucucugcuggcagaucuuggugggcugugcggacagaaccgugagguacuuuaaugcugaggaggguacauuccugagccagagauacugcccaggcggggaaggcacguuccgaggucucgcccaggcggauggguaaggaccacccacauucuagcccagguuacauagcguuuggggcucucuuggauugaacugaauacuuuaaguuaaacacuuuaggugauacaaucacugggauaggugauugcaaaccaagguucuuguuuacguucaucccuauaacaugcauucaucggacagcgauugaaagcaugaaggaaaaguauaaggauuuugggaaaaacacaugccuuaauaaaguuugcauucuagauagaauuuuuuuuuuuuuuuuuuuuuuagauuuauuuauuuauucuauguaaguacacuguagcugucuucagacacuccagaagagggagucagaucucguuagggaugguugugagccaccaugugguugcugggauuugaacuccuggccuucggaagagcagucgggugcucuuacccacugagccaucucaccagcccucuagauagaauuuuuauccuggcuccuuuauaacguucugugcacauaauuuaauguuuuugaacacguguuuaaguaggauugacaaaaauauaagauaaugaagcuuccaaagugguggcuaggaaggaagagucaccaaaguuaguaaucugggagcagcuuuucuagaucgaugaagaaagaaggcugcuuugguaauucaacaggugagcuccagacagguuauauagaauggaguuuugaacuaggucuugaaguacaaguauauaaucuugacaaaagagauacaaucuaaaaagcagauacugagcagagacuaaggaggaguuaacauacuaaaacgcuacauacauaggacaaaugccauuuggaggcugaagucaaggaaacaucaguauacauguaaguuuggcauuguauuugguugcgauuaaauggaaagggcuuuuguacugaguugagaucuuaucuccuagauaauagaguguauuggguuugaauaggaagugucauggacagagcucugagccuguaggagcaaggaguaucacaaaggcucuuugccacagcccaggcaagcaaucuagagcuuaagccuaggguggcagauguguggaagaacacagacacaguugugcagagccugggaaacggcuugggcuuccagggaagagguuuauguuaucguuguuuggguuggguuguuuauuucugggggcugggggagggaagguauguauguuuuguuguuuaguaucucauguagccaggauggccuugaacucacuauguagcucagacugacguggaauuccagguucucucuuuacuccccacacugguagcugugcaccauaaaaccuggcuuauacuuuguaaaaucccaauauucucuugcuugcuuucagcacccuuaucacauguguggauucugggauccucagagucuggugugaaaaugacaaagaggcguccucugacccaguaagguuuaccugucccggugguugaaaggaugggagcuaggguaggggucugauggggaauuugguaaaggaaagauuaagggcuuugagacuaacucaucucugguuauuuucagcucuuggaacugaagguggguccugggguguguaggaugcgccaagaucccacacauacacaugugguugccacaugugggaaagaaaaugcuuugaaaguaugggaccuacaggggucugaggagccuguauucagggccaaaaaugugagugagugaugaaggguuggggagaugcuauguuugauugagguuggggaagugaaagccacugacaugaccuagauggcuuuggggguauggaggauuggaggaaacaggucaggcuuaucaaacuuugugcccauauguaccuuccacaccaggugcggaaugauuggcuugaucuccgaguuccuauuugggaccaagauacacaguuccucccugggucacagaaacuugucacaugcacaggguaccaccaggugaggcucuuuuuacucccggauugaaguagcuugaauucagaaaaacaacaaaaaaagugucuccugauagaguagguagguugcaugguguaacucugccuggguuaucaaaggagcucauacuuucuuagucaacaaagcccauggcugagccuacuacuuuccccuuacugcauuccaggguggaauucugaacucuggguuucuauuucuccuuccuagaagggaaagcaaagggagugcuccuuccacaggagguuccacagggaacagauaucaugggugaacaucagguugucugcaaaacaauuauauaauccuuccaugaaguacuaaccaggcucaugagaucugacaguauuaggcacagucuagcuaguauggucauagaacuuuguaguccucauauagucugauuugcuuugggggccccuuucaugucucagcuccaccaguuuugugugagugcuuagcuagggaucuuuguggcuaauuccauuugaaguugugagacucuggcaggguugggucacuguugucauuugucuaguccuggacaugaaagucugauagaggugcuaggccuuugcucauaacaugugaggagcuccccauugcucccucagcaagaugaagcguuccuguucgaaauucaccauuuucuagcuuuucuaucccuccacugcccauaagacuaugcuuaugagggcuccugagcccuuuccgcaguauucugagaugagauuaaguacauaccucaaacgagaaagccgucuugccaggcaugguaguauguccacuuuaaucccagcacuggggaagcagguggaucucugagcuugaggcuaaucuggucuacauaacaaaagccacggcaagcaggacuaugcagagaaacagucucaaaacaacaacaaaauaauagucuucaaaaggauaaugauaaauaagauauuggggggccacuguggguaaggauacuccugugauacucuaguuuucuuuuagguccgugucuaugauccagucuccccccagcgccggccaguccuagaggccaccuauggagaguacccacugacagcuaugacccuuacuccugagggcaagugaguggugagggaaagggaaagugcucuggaauggauccagaagucauacugaucccccucuuugguauccuccuuaguuccgucaucguagggaacacucaugggcagcuggcagaaauugauuuucggcaaggugaguggaccauggguugcuugagaaggggagagggcaaagagaaaggucacuacugacagggucacugugcccugucagugucacagucacucucuggguucaaguuccgauuucacuaaaaacucuaaccuuggacuaguuauuugauuccuaugucuuuguuucuuugccuauaaaacugaauugucauugguaacuccuguuucuagguuauucugaggacuaaguacugauauguaagugauuugaacaguaacuaacuacauauucaguggcugguuagcuaacacccaugcccuacauccuucuccagggcgucuacugggcugucugaaggggcuugcagguaguguucgugggcugcagugucacccuucaaagccccuauuagccucauguggcuuggacagagucuugaggauacacaggauccgcaauccacgugggcuagagcauaaggugagcgcccaaaccuuuggcacucgccauucuaacuuaccuuuucuggaaccucuccccuuuccugugccccacaucaaaaaguuuccgucucagcuuaucuggacucaaaaaccccuuuuauuuuacagguuuaucucaagucucaacugaacugccuucuccugucaggccgggauaacugggaggugagcaacuaguuaggugugagaauuuuggagccaaaggcaugauggcaagggauucucuguggagagaacaggaggcugcuagaacacaggccggggcuuucucuuuacuguaacuuaauuuccuugaggaguccucaagccuuuacaggcuauugccaagggugaaguccuccagaacacgagggcauugguuucuagauuuucauccucuuucccugacuccugaauguccuucuugaucaucaggaugagccccaagaaccucaagagcccaaccaaguacccucagaagacacagagacagaugaacuuugggccucuuuggaggcagcugccaagcggaagcucccagauuuggaccagacacaaggugcucuccaaagaaggaagaaaaagaagcggccuggauccaccaguccuugaagccccuugcucauguuguuaauaaauagcccaacgcgcguacugauccuggaccuuuugugaugggagaaacgccuuguaggugggagggguucccucaccuagcugcgggagaccugacaucacaaaagcuaggcccagagcuaggcuggcuggggagggugacagaguccugcgccuuucggggccaugggcugcugucaggacaagaaccguugggccucggaugagcaagcaagggaugaaguaacagaggauggcagggaagguaggacuagauacaaaaaacgggucucagguccuggaaugggagccggaggugccccaaagggacugccccagagguggggcuggagagaacagaagugaauuaaguggacccuguggugcuuguaggcaacgaaguggacaacucaggccgccguaaacaaagaucuaacgaaagucuccugaucaccgugcuguggcgcaggcuauccauguucagccgucgggaguccucgcggucaggcaagcaggacaaucagaugcaggaacgcaaacaugagggaagccacaaggaaccagaaaaaggcugacuacaacccuggucuuaguccuccccaacaccagagaauaaaguuaauauugcgaaucugcugaaaacac

SEQ ID NO: 9148 - RNA, 5425 nt, Mus musculus
guguuuucagcagauucgcaauauuaacuuuauucucugguguuggggaggacuaagaccaggguuguagucagccuuuuucugguuccuuguggcuucccucauguuugcguuccugcaucugauuguccugcuugccugaccgcgaggacucccgacggcugaacauggauagccugcgccacagcacggugaucaggagacuuucguuagaucuuuguuuacggcggccugaguuguccacuucguugccuacaagcaccacaggguccacuuaauucacuucuguucucuccagccccaccucuggggcagucccuuuggggcaccuccggcucccauuccaggaccugagacccguuuuuuguaucuaguccuaccuucccugccauccucuguuacuucaucccuugcuugcucauccgaggcccaacgguucuuguccugacagcagcccauggccccgaaaggcgcaggacucugucacccuccccagccagccuagcucugggccuagcuuuugugaugucaggucucccgcagcuaggugagggaaccccucccaccuacaaggcguuucucccaucacaaaagguccaggaucaguacgcgcguugggcuauuuauuaacaacaugagcaaggggcuucaaggacugguggauccaggccgcuucuuuuucuuccuucuuuggagagcaccuugugucugguccaaaucugggagcuuccgcuuggcagcugccuccaaagaggcccaaaguucaucugucucugugucuucugaggguacuugguugggcucuugagguucuuggggcucauccugaugaucaagaaggacauucaggagucagggaaagaggaugaaaaucuagaaaccaaugcccucguguucuggaggacuucacccuuggcaauagccuguaaaggcuugaggacuccucaaggaaauuaaguuacaguaaagagaaagccccggccuguguucuagcagccuccuguucucuccacagagaaucccuugccaucaugccuuuggcuccaaaauucucacaccuaacuaguugcucaccucccaguuaucccggccugacaggagaaggcaguucaguugagacuugagauaaaccuguaaaauaaaagggguuuuugaguccagauaagcugagacggaaacuuuuugauguggggcacaggaaaggggagagguuccagaaaagguaaguuagaauggcgagugccaaagguuugggcgcucaccuuaugcucuagcccacguggauugcggauccuguguauccucaagacucuguccaagccacaugaggcuaauaggggcuuugaagggugacacugcagcccacgaacacuaccugcaagccccuucagacagcccaguagacgcccuggagaaggauguagggcauggguguuagcuaaccagccacugaauauguaguuaguuacuguucaaaucacuuacauaucaguacuuaguccucagaauaaccuagaaacaggaguuaccaaugacaauucaguuuuauaggcaaagaaacaaagacauaggaaucaaauaacuaguccaagguuagaguuuuuagugaaaucggaacuugaacccagagagugacugugacacugacagggcacagugacccugucaguagugaccuuucucuuugcccucuccccuucucaagcaacccaugguccacucaccuugccgaaaaucaauuucugccagcugcccaugaguguucccuacgaugacggaacuaaggaggauaccaaagagggggaucaguaugacuucuggauccauuccagagcacuuucccuuucccucaccacucacuugcccucaggaguaagggucauagcugucaguggguacucuccauagguggccucuaggacuggccggcgcuggggggagacuggaucauagacacggaccuaaaagaaaacuagaguaucacaggaguauccuuacccacaguggccccccaauaucuuauuuaucauuauccuuuugaagacuauuauuuuguuguuguuuugagacuguuucucugcauaguccugcuugccguggcuuuuguuauguagaccagauuagccucaagcucagagauccaccugcuuccccagugcugggauuaaaguggacauacuaccaugccuggcaagacggcuuucucguuugagguauguacuuaaucucaucucagaauacugcggaaagggcucaggagcccucauaagcauagucuuaugggcaguggagggauagaaaagcuagaaaauggugaauuucgaacaggaacgcuucaucuugcugagggagcaauggggagcuccucacauguuaugagcaaaggccuagcaccucuaucagacuuucauguccaggacuagacaaaugacaacagugacccaacccugccagagucucacaacuucaaauggaauuagccacaaagaucccuagcuaagcacucacacaaaacugguggagcugagacaugaaaggggcccccaaagcaaaucagacuauaugaggacuacaaaguucuaugaccauacuagcuagacugugccuaauacugucagaucucaugagccugguuaguacuucauggaaggauuauauaauuguuuugcagacaaccugauguucacccaugauaucuguucccuguggaaccuccuguggaaggagcacucccuuugcuuucccuucuaggaaggagaaauagaaacccagaguucagaauuccacccuggaaugcaguaaggggaaaguaguaggcucagccaugggcuuuguugacuaagaaaguaugagcuccuuugauaacccaggcagaguuacaccaugcaaccuaccuacucuaucaggagacacuuuuuuuguuguuuuucugaauucaagcuacuucaauccgggaguaaaaagagccucaccuggugguacccugugcaugugacaaguuucugugacccagggaggaacuguguaucuuggucccaaauaggaacucggagaucaagccaaucauuccgcaccugguguggaagguacauaugggcacaaaguuugauaagccugaccuguuuccuccaauccuccauacccccaaagccaucuaggucaugucaguggcuuucacuuccccaaccucaaucaaacauagcaucuccccaacccuucaucacucacucacauuuuuggcccugaauacaggcuccucagaccccuguaggucccauacuuucaaagcauuuucuuucccacauguggcaaccacauguguaugugugggaucuuggcgcauccuacacaccccaggacccaccuucaguuccaagagcugaaaauaaccagagaugaguuagucucaaagcccuuaaucuuuccuuuaccaaauuccccaucagaccccuacccuagcucccauccuuucaaccaccgggacagguaaaccuuacugggucagaggacgccucuuugucauuuucacaccagacucugaggaucccagaauccacacaugugauaagggugcugaaagcaagcaagagaauauugggauuuuacaaaguauaagccagguuuuauggugcacagcuaccaguguggggaguaaagagagaaccuggaauuccacgucagucugagcuacauagugaguucaaggccauccuggcuacaugagauacuaaacaacaaaacauacauaccuucccucccccagcccccagaaauaaacaacccaacccaaacaacgauaacauaaaccucuucccuggaagcccaagccguuucccaggcucugcacaacugugucuguguucuuccacacaucugccacccuaggcuuaagcucuagauugcuugccugggcuguggcaaagagccuuugugauacuccuugcuccuacaggcucagagcucuguccaugacacuuccuauucaaacccaauacacucuauuaucuaggagauaagaucucaacucaguacaaaagcccuuuccauuuaaucgcaaccaaauacaaugccaaacuuacauguauacugauguuuccuugacuucagccuccaaauggcauuuguccuauguauguagcguuuuaguauguuaacuccuccuuagucucugcucaguaucugcuuuuuagauuguaucucuuuugucaagauuauauacuuguacuucaagaccuaguucaaaacuccauucuauauaaccugucuggagcucaccuguugaauuaccaaagcagccuucuuucuucaucgaucuagaaaagcugcucccagauuacuaacuuuggugacucuuccuuccuagccaccacuuuggaagcuucauuaucuuauauuuuugucaauccuacuuaaacacguguucaaaaacauuaaauuaugugcacagaacguuauaaaggagccaggauaaaaauucuaucuagagggcuggugagauggcucaguggguaagagcacccgacugcucuuccgaaggccaggaguucaaaucccagcaaccacaugguggcucacaaccaucccuaacgagaucugacucccucuucuggagugucugaagacagcuacaguguacuuacauagaauaaauaaauaaaucuaaaaaaaaaaaaaaaaaaaaaauucuaucuagaaugcaaacuuuauuaaggcauguguuuuucccaaaauccuuauacuuuuccuucaugcuuucaaucgcuguccgaugaaugcauguuauagggaugaacguaaacaagaaccuugguuugcaaucaccuaucccagugauuguaucaccuaaaguguuuaacuuaaaguauucaguucaauccaagagagccccaaacgcuauguaaccugggcuagaaugugggugguccuuacccauccgccugggcgagaccucggaacgugccuuccccgccugggcaguaucucuggcucaggaauguacccuccucagcauuaaaguaccucacgguucuguccgcacagcccaccaagaucugccagcagagaaaggaaugauggaagaagggcaagacugucaggcaucccuuagcuccggcccggccagaggcugcucacuugggucucgccgccagugccccagcacagagcauucacugccuccucccgccgcggcuguccggacggugugaaauuugccgcauguuuccgcugaagguucaccccuaagggacgaggacgucagucacgcuggggugacaaacaagcgaccccugcacugucccacaaacaacucuaauacucaccuuucaggaugccggucucagugccgacccacacaugguuccagcgagccgaggcagucgccaucgcagaccagcccguggcuugcacuuccggcgcgccacua

SEQ ID NO: 9149 - RNA, 15640 nt, Mus musculus
agggguguguucuuucugucucugggcuaaaaaaaaggcguggcgcagcagccacgucaccgaguuaggaguacgucuaggugacguggcggcuccuguucuuugguccggcuuccacugcuuacaaguccuucgaggaggcggcaacgaucugggaagaguggcgguggugguggcgguaggaaacagaagagguaggguuucgcuucaguaggaguccagccucugucguucggcucagcuccgggcagcggcuugacgggggaggggggaagggagccaggaguaaguccugcuggcggcuccgcguaagcgaauaccucgcuguccaaucaggaaaggucuuguuaaggaaaaacuuggccccauccaaucaguggcugcagucuuccaacaggcggaacuuugacggaggugggacuuccuguuucaaauaaacacuuuuaagaggguuuuuucgccucccccuccgcccuccgaaguguguccaccucuggagaucgguugcuguuuucugugagagggggaaggaaaucacguauaccaaaggcaggauugagaccugggcuaacugcaaaggucugccuggaaguucagggccgcaggaccaggcuguggcuguuuucucgacuuuaggggccccggccggagcucuggcagucagagccaagucggaaggagacucugaggaggcuucgccuugggccuggaggaagcugaccguucucgccguguccagggugcaggaucugcggguggccgugggcuccaaagucugucaaauacgggaaagggccuggggauuugcuaguugaggggagcguuuggggaaagaggcugucuggagaaugacauucuccucuccacaacagucugagguuaugcgacucgaugaucccgcggaaacgcuacggaucuaagaacacggaucagggugucuaccugggucucucaaagacacagguucuguccccugcaacugcuaucaguagcagcagugacagcacuccuuugcccacuccgguggcccugguccccuccccucccgacaccauguccugccgggaucggacccaggaguuccagucugccugcaagucccugcagagccgucagguaagaagcuggaguggaaaggcaggcgugagcccauuuaguuaaugcuuagguuuguuugguaguugucuaaacuuaauuuacaacucuuagauagacuaaucuuaucaguaggagaggaggaauugucuucaguaauuucaagaauacuuuaaguaaguugcccuaaauaccacaaaggaugagucaggauuuaaaccuacaucuaauuuuuuucuuaucuacaaaccacugauaaauguagauugucugaugucaacagcgcuagaguguuuaguggguuaugugagggagcagugaaaagcugagguaaguagugacaggaacuaaaguagcaacuuuuugauacaauucagaauggaauccaaacaagcaaaccggcucugcacgcagcccgacagugcagugaauuuacccucauggccaggugaguugagaggggcguugugguggggugauacagugucuuaaguauaucugccugugaugguuuggcugaguggaauugguuguguuggagguuaugguaacagccucuuuccugcccuuuaccacaaccuucucacugaugaucauuugcaggcgcauugggaaagaucucagcaauacauuugccaagcuggagaagcuaacaaucugugaguguuugggaggccuuuccuaggugggacagugaaacauaguacuaggaggugaggcucauggagguuuugucuuauuuuuucuauggugcuggggauuuaaaccagggauguauaccuuaaggcaagugucucuacuacugaacugucauccuagcucuuugagccuugcuauuuacccucaccuguccuaauguuucaucugucucugcaguggcaaagcgcaagucccucuuugaugauaaagcaguagaaauugaggagcuaacauacaucaucaaacaggugagcugcuagccaucaggagagcccagcauucuaauuagauuacuuccaucauuuuccaucgccaugaauccccaggguaaguaucuagacccauguccaaacacccugcuccuccauugagucaguagacacuuaggucaucuaguauuuauaaagcacuguucuagaugcugaugaaacaacugggaagcaagagcauugucuucaagggcucauuuuccuugagaguuacccagcaucaaaagccuuggcuuaaaaugagguuaggugucaguauagaaaagaucuuacaaaaugauuaaugaagcaggauacugggaaagauugaccaaggauaugaaaucugauuuggacucagcuuauguagagguaggcugaggggucuauaugcagaaauucagccagauaguauaugucuuuaauuucagaccucaagaggcagaggcaggugauuucuguagugguagagauguuuucguuuuaaucccagguguagguauguggggcugcuucugucugucuguagcaccugauugugauuugccagcuacagauaguuucugugauugugugauguuuggaauucugggaauuuuucagaggguauauaaauguuggggccauucaagaggcggcguuggugguuauuucaaggggaguuuaguagucaugcuggaagaacuaagaaagaaauuagguuuacagaucucucuuuucccucucccuucuuucucuccuauuuaguugaauggaguauguauauguuauggaggugggugaggaagacugggaaaaagaaacccacaaaguagcaaaggcaagcuacagaucucugaguuugaggccaaccuggucuguaauuauguuguuuuguuuuuuuguuuuuuuuuuuuuaagauuuauuauaugcuaguacacuguagcugucuucagacagaccagaagagggcgucagaucucauuacggaugguugugagccaccaugugguugcugggauuugaacucaggaccuucagaagagcagucagugcucuuaacugcugagccaucucuccagcccuguaauuauguuucuucccuccaucccuucuacuuuccaaaagaaaagaaaaaaaagaaaaaaaaaugggagcaaaagauacagauagcccagagcagauucuuuguuuugguuuugagacuguacuuauauagcccaagcugguguuuuuguuuaagacaggguuuuccuggaacuccauuuguagaccagauuagccucaaacccagcaauguaucugucucuauucucugaguacugggauuaaaggcauauauaugccuaccaugcauagcuccauccugguauuuauuuauuuuauuuuucaagacaggguuucucuguguagcccuggcuguccuggaacucacuuuguagaccaggcuggccuugaacucagaaauccaccugccucugccucccaagugcugggauuaaaggcaugugccaccaugcccggcuucugguguuuacuuuuugauucuacuucagcaccccaaacacagggauuauaccauguaucaccaugccugcccaggauuuuucucucuguucacauguauaucacaaaugcguauaguaguguccagccugacuguuuguuguuugccuagaugagugacuggcaagaaguugguuguuuaacugagugacuaguuguaaggaacauuguggacuuugauaaugaguguagaaucaucuugacuggucuggaggacacaguuugaucuggaauguggaugggacgggcuagaugcuuagaaggcagcugguauggcucucuaauacaaauaugcuggucucccaaagaguagaccccauuuaaugugugcuauggugauguaagaguauaagauuacuauugggcuauuacuacuuacugcuuaaaaacuaucccacugcauucuguguugcuuuauucaguuugcuccaagggcaaugggaauggacaauucugggacucuuguugcaaacccugcagauaccagugcugauuuucuuucaguuuucauugucccacugcauucugaagaacuugaaguggcuuugucacccacuuggauugugaccuugugugaacuccuaacuucugaguugucauugucuuaucaguaaggcagaucuugugaugaucuuuuguuugcuucugucaacugaugacacuggcuuuuucaaggccaagaccacugaauugguugauccaagcugguguggguaaagugauauuugagguauguuucaguagugaagaaaagcaauucaucugaagaacugcugggaaugcauuccgaaaagugggaaugccauuuagaaaguaggcauagccaaaggaaaggucucaggugugggcaguguacaacagguuaggagaacacaggaguagaauacuauagaaguacucaguggccaaacagguccuguguaggcaucucaggcauuuagguuguagucuaaguugugugcuaagcucuugacuuuucaagcagggugaugacaauacccugaguuugauuuugaagaucacacugggcacuguuuaggcaacagggcuuuggaaggcagacuagaaagaggcuuauaaggcucuuuguuuugugagaguagacaaggugguugggguacacaagguagaaauggacaugguauggauguguuuagaauauauacuggacaaaaacaaacguggcuaugaggaaaaggggaauucagaguugugaguuuuuuucuuaguuuguuuuugagauagggucuacuauauagacccagcuggcccugaacucauagauucuaucuaucugcuucugcauccuaaguauugagauuaaagauguacaccaccacaucugcuuaaaacuuuaaaaaaaaaauaugaaugaguguuuugugugucuggugcuuaugagaucagaacauggcauuggauacucuagaguuguagcagcagauaguuguuggaaguugaaucugugucuucuacaagaguaguaagugcccgcuuuccagccuguuuguauuuuaagguaaagucucggggccugagagauggcucagugguuaagagcacuggcugaucuuccagagaaccggaguucaauucucaacauccacauggcaccucccaacugucuguaacuccaagugcguuagggaucugacauccuuacauagacauacauaaggcaaaacaucaauuuacuuaaaaauaaaucuuuaaaacaaaauagucucauucuguaacuuauagacuggccuuacauucaucacagguuaccugccucacgugggauuuuuaaguauaagcuaccaugacuagcuaggcaucuggugacugguggugcauuuacuaaaaaggagaaagcagcaaaggaaaugugaccuugagagaauagauuaagaguuaaguagaagaaauuuuuuuuuaugcaagaagcuuaaauaguagauaaauaaaaagcaguuaaugggcguuguuuguuuguuugggugcaagaaaagaaacgcaggaccuguguuugcugcuccccacucccagaccuuuuacuauauuugauauaguacugaguauacaguaagcacuuaguagaugcucagauuuuaccuguccagucaguauuguagacuuuaugauagcauguagguguacuaaggaguuggugagagguuagaagcuuucaucuggaguuccugugugggaaaugguacugaagcuagaacccaagggaaggagcuguuauggcaaacaaacccaaaagugcauuugggucagaaacucgaggaagguagagagagcucagugaaagugaguccagggucuggagaggaggaagguccaaccuacuuagaaagucucuagaaaugccuagauuuuaccaaguauuuuucucauacucacuauuuaaaaguuuuuaaguuauauuuguguuuucggggauggaugccugagugucauagcaugcauguggaguugugagucccuugaauggagguuuugagcuucuuuaucugcugagccaucuugcuggcccuuauaccuguggcccccacccccccaccuuaaaaaaaaaaaaaguuuacaauguauaaaggauucugucugcauguaugcuugcaggccagaagagggcaccagaucucauuauagauaguuuggagccaccaugugauugcugggaucucaggaccucuggaagagcagacagugcucuuaaccucugagccaucacuccaguucucaugcuccauuuauuuuaauguacaugaguaugcugucacugucuucagacacaccagaagagggcguuggaucucauuacagaugguugugagccaccaugugguugcugggauuugaacucuggaccuucggaagaucagucgggugcucuuacccacugagccaucucaccagcccuagacucacuauucuugaugccuuccauucugguacuuuccugggucauaguauaucaagacaaauuuucuuugcucucauggggagaacggaaaugcaggugacacauaagccgugauaggaagucacuguauauuacuuugaagaaauaagucauagcaauaagucuuuugcaauauuagaaauucuguguaaaaauuugcuucuuugaugcauguaggaaacuagagugguuuuuaccuuuuccugaguaauauuuagguacucugucagcauguuguagguacaguuuugccuuuugaaaggguucuguggccucacagggugaaguagagcaggaaggcggggacagaacagucauuuacauaugaucaaaccccaaguucccuucucugacuucucugcuaggaaugaacagagcuagaaaagucuagugucaccuucugaccugacuagacgcguacaccauuagcugguuuccucuugacuucccugccagagacagccagagacucuucacagagauggucuucaugacugaagacucccugccuaaugcuuuucuucuggucucuuaccaggauaucaauagccucaacaaacaaauugcucagcuucaagauuuugugagggccaagggcagccagaguggccggcaucugcagacccauucuaacaccauugugguuucguugcaggugggaccuuggggauggaggagggaggagaggaauaacaaaauacauucuuugacccaauuguccuugccuuuuagucaaagcuggcuucuauguccaaugacuucaagucaguucuagaagugaggacugagguaagugggaucaguagguggguaaggaccuauuguaggguccacagacccacuuuccagggacucaggagccguguauuccuccccaacaucagaaucugaaacagcagaggaaccgucgggaacaguucuccagggcaccagugucagcccugccucuugcccccaacaaccuugguaagucaguaguagcacuaugggaagccuaggggcuaaguucuucuggguuugguggcauccuuuagacuucagaguguaaacacaguagaguaggagaacggagcugccagaauggugcugugcauuaucucagaggacaaacuugguuuugaaacuuuaugaucuacacuuaacccuugugccuucucaugggaaacaugagacauaucauguagacauaucagaaaaaugacagugucugacuuuuuguacuuaguuacauucucucuaauuuucacaaccagccuuuggaaaagcaacuauuguuagcuccauuuugcagaugaggaaacugagacucagaucaaauaaucuauucagagcuggauuuaaaucuaguggguuuugaauguguuuuuauuuuuaaagcuagggucucauguagcuugggcuggccucuagcuuguuagcugaggacuaaacuaucuccaccucccuaugacuaguauaacaggcaagcaccaccaugcuuugcuugaaccaugccuauacauucucauguaugcacuguguguguguguguguuuugagagacagacagacaguggcagucagacagugacagucaggguuucucuauguugucuuggcuggcagaucagauuggccucagacucauagagacccccuugccucaaccucaagaauucuggcauuaaaggcaugugcuaccaaugccaagcccugaaccugcuuuuaaccauuaaaaugugccauguccuauuuuccucccaggagguggucccauaauuuugggagcagagucccgagcuuccagggacguggcuauugacaugauggacccuagaacaagccagcagcuucagcucauugaugagcagguacccaggcucugaaaucuggagaaucaguuucucuauugucuucuuuguuccccugaguguuuggaaugugucauggugaaaaagucuuaaaaaccuaggcccuaguucaugguguuuucuucuucugaaggauuccuacauccagagucgggcagacaccaugcagaacauugagucuacaaucguugagcugggcuccauuuuucagcaauuggcacacaugguuaaagaacaggaggaaacgauucagaggugagacacucucaccccauacagugcagccuucucuucuccauggauugauauccugaagucccuagggacaacuugguguucuuuggaagaguggagugaauccugccuacccacuaguccuguuccccugcuucuacucauuccauaagaauuuauuuaggggcugguguggugguguaugcacgccuuugaucccagcacucuggagacacaaacaggcagagcucuauaaguuugaggccauccugcucuacauagugaguucaaggacagccgcugaggcuacagagaaguccuuuaaaaaaaagaaaaguaaaagaaaaugccuaccaugcauaaagguuuaggaucuguccucagaaucauagagaaaacaacugguagggacagccaacuggcucauccggcaaaggcauuuccugcacacgccuaguaacacgagaaugguaacugcugccagauaaaggugaaagauuucagcgccacaggguugucuugugaucaccacauccaugccuccuaccccauaauaauaaauaaaaauguaaaaaaaaaaaaaaucaaacagcugagaagggagcacagugugcugaccuuaaaguacagcuacucucgaggauuguuugaaccaaggaguucaagacaaugacaucagaccaccaugaucugcuauguggaugcugggaauugaacucagaacuuaagugagugcucuuaaccacugagccaucucuccaggcccacaaccauauuuaacccuaguuuuaggagauccaacgcaggcaucaggcauuuaaaaguugauuuaaaaugucagcagcagaaaaugucagugguacuguuguagcagccugagaaaucuguagagcccgcgggaugugggugcucgcuccacaaggcagggugaaacaaagcugacuuuagagagcagaaagacggugaaccugagaagggcaaggacaguucuuaugaagcuugucugcucauuauguugaaaacuccugaggugcuggcucagcuguuaagagcacuggcugcucuucugaaggacccggguucaauucccagcacccacauggcagcucacaacugucuauaacuucaguuacaggggacccaacauucucacacagaugauagccaugcagagaaaacaccaguguacaugaaaugaaaauaaguaaaucacuuaaaaagcaaaaaagaaaaagaaaauuccugagguguaggcagcuaaauguguaucagaacggggugcaggaguuuccugauggaugcccuuuuaauuuccugacuguccugcaggccuugcaguguccuauagcuucaaguuguuugcuggccuuguuacugcucuuucaaaacagaaaagcuugguucuccaguguuauuuggaaaaaccaaauaugggcuucaguggcacugcuuauauuacuuuguauggaauaacuugaaagaagaugcuguguaacuuguaucucauuaggaagcauuuaaugucagauugcauuuauaucagggaggacagauaucagaaacagucuuccaccccaugaucaacuccaggaccuuguacaugcuggacaguauucugccauuaaguuacacacucagucauuguuuuuagcuuuuuuccucuugagugagaaacucaaggcaaagcucagcagauaaguuugcuugcuauaaagccuugauggccugcauuuggucccuggaacccacauuguaaaagagaaccaguucccacauguguccuuugaccuccacaugagggccauggcacaugcauacucauacauacacacagacauacaaaauaaauauaaaagaaaaauucuuuuuuuuuuuuuguuuuuuuuuuguuuuuuguuuuguuuuaaaagauuuauuuauuuauuuauuuauuuauuuauuauauguaaguacacugacacuccagaagagggagucagaucucauuacgggugguugugagccaccacgugguugcugggauuugaacuccugaccuuuggaagagcagucgggugcucuuacccacugagccaucucaccagcccuaaaagaaaaauucuaaagcucucucuagacauaaauuacacuagauuaugaagguuuuuccagucuguuauguagcccuggcaugcgacucuuggaacucugcaugagugacugacuucaucuuagcaagagauuaaaagcccuguaucaccaucccugccugggccuuaugugugacacuuuuuuuuuuuuuaaagauugauuuauggacuggagagauggcucauugguuaacagcauugacuacucuuccagagguccugcguucaaaucccagcaaccacaugguggcucacaaccaucuguaaugcgaucugaugcgcucucuucuggugugucugaagacagcuacccuguacuuagauauaauaauaaaucuuuuuuuuuuaaagauugauuuauauaugugaguauacuaucacuaucuuuagacacaccagaagaggguauuggauaccauuauaguugguugugagccaccaugugguugccugaaauugaacucaggaccucuggaaauguagccacugcucuuuaccacugaaccaucucuagccaguuuucuuucuuccuuuuuuuuuuuuuuuauaaacacaggguuucucuguguagccguggcuguucgagaacucccucugaccaggcggugguggugauaacuugucuucaaauuuugaaguuaaaaguugugugccaccauaccugguuuuguuuguuuuuuuuuuuuuuucaagacaggguuucucuguauagcccuggcuguccuggaacucacuuuguagaccaggcuggccucaaacucagaaaucugccugccucugccucccgagugcugggauuaaaggugugcgccaccacgcccggcuaaauaauucuuuagagaacaaaauuaaaugcauuuacacuaaaaaaauguaaugaagggcugggcaugguggcauaugacuuuaaucccaagcacugaaagguggaccucugaguuugagaccagccuggucuagguaguaaguuccaagacccagagcuauacagaaccugccucaaaaaacaaaacaaaguauggccaaaagcuaugaaccucauacuuuggccucucuaacauauccgaaaaaagaaccacaauuccacagauuccguuugcaaaagucaagguguguuucaucuugcauuauagggccaugucuaacaguugucauuagaugacuaccauuuacagaauaguuaugugagcucaaauaaccuuuaugucaguaggcagcacaauccuaguggauugucacacuuuuauaugcaggccacggugucugaaacaucuugugacauaggaugguacuuggauuuuaaauucuuuucaaggcauguguguuguguuguaugaacaugcguagaucagagaaaggaucagauguccucuuauuacucuuucuaucucucuuuuuuaaaauauuuuuaucuacuuuuuaauuugagacaggguuucuauguguugcccuggaacucuuugucuagaccagacuggccucaaacucagauuagccugccucugccuccaccucccaagaacugggauuaaaggugugagccaccaugucugacuacuuuuuucucuuugagguagugucucucccccauuagcuuaaaacuuguuuuuguuuuguuuuguuguuuuuuuuuuucaaccaccaaaaccuagcucuuugauacuuuuuuuuuuuaagguuuauuuauuuuauguaugugaguacaguguugcuaucuucuaacauaccggaagagggcaucggaucccauuacagaugguuaugagccacccaugugguugcugggaauugaacucaagaccucuggaagagcagucagugcucuuaaccacuuuccuacuuucuauacuuaccugcugugcucugguuaugggcacaguuaagacuguagccagcuugcugugugugugugcuggaauucaaauucagguccucuugguugccaagcaaacacuuuccuacugagcugucuacucagccacuauauuuggguuuuaggauugcauacguagauuggcuggaaguuuuguuugcuuuaguaaguuuucaaaauuguccuuccucugaggagugguuccuccaagauaauguucucugguuaguuauaagaguuguauuauccuuugaguuccugucuauauuaagauuuuccuaaccaggauuuucugacuaauuagcacaaugcaauacauguucauuacaaaaaaaaaaaaaaaaaaaggaaauguuaaugaguaaagcagcauuuggggugcuccuagauuggaaguucauuuaauucacugaaaauugagacuucaugaaaggagguaggguuuauaucaguuaccucaauuuucagauguggaagacugguuaaauaauucaaucauaagcuaauaacuggaagaacguuuuaaagcuagaggcgagcaugaucuacuacccucaaaaaaugugugugugugugugugucuauacacacacacauacaagaguucacacaggcuggacagugguggugcacgccuuuaaucucagcacuugggaggcagaggcaggcggauuucugaguucgaggccagccuggucuacagagugaguuccaggacagccagggcuacagagagaaacccugucuugaaaaacaaacaaacaaaccaaaaaaaguucacacaguaugaaacacuuuuuacuuccacauauuguaaucaccuuuccauaucaauaaauggaugucuucaaucuucuuuuuaacccaguguccuucuguuuaucuccuggcugucuccaggaucgacgagaaugugcuuggagcccagcuggauguggaggcagcccauucagagauccucaaguacuuccagucaguuaccuccaaucgguggcucauggucaaaaucuuccucauccucauugucuucuucaucaucuuuguggucuuccuugccugaacccuccucccucauucugagccacuccauggagggcuugggauccuccugggaggacagguggcuacuauugccacugagccugugcaaggugguugggagaaaggccauuuccuuggaacugcuaagaauggccagugucccugauuccccacccuugucucuggccacucuguccuauccucaggcccaugaaacacacugguucuggauuuggacucugcugugaagaggcugggaacagaagccagcuaggggccagugggggagguugucuccaccuugagauuuuuauaagccuauaaccagccucccccaaacguaacuggcagcaagaggagaaaacgcccuuccuucuugagaggcaagaauccucaagaaguauccaagggaccaacuucaucaucugggucagcuagaacuugacugccgccuucuccucaccaugugaggugagggggcucugagcccuacaguugccugcacaaaccugacuuuggcuacuggugacucucaauaugccaaacaugcugcagccuauuuccucccaauuacagcaagacugucagccucacuaguguugaugucauuucugggggggggggggggacuucagcaaaaagcuaaccacugcccaauaccagaaccaaaaggguuaagucagugacucugaugggccccuacugauaggcaggguagcuccggagcucuguacacacaacuccccccuagaagcgaguagccaaguacagcagcacuucauaagaguuuuccuuuggacuaaguggguucauaauugggcggcaacuuccaagacaguacccauaaguuugagccuguuuuguaucuucaaaucaagucaugcuccaugccuaccagcaccccaucugcuucccccucccacagcagcaucuggauccaaggcugcaauaguccuagccacaccagaaaaguuuccuagagcucuuggguuugacauuaaaguuucagucaacacuugggaguuggaagcaggugaauuucuugaguuuguggccaacuuggucuacaaagcaaguuucacagaaacccuguuucaagaaacaaaacccaaaacuagcaacuuucccuagcuaccuaccuagcugaccugggucuaccaauuaggcuucaguaugacagacugagugaagugaagaucaaggcuuaaggcucacuagaucccugauuuuguuuugagauggucuauguaguguucccuaucucugaacuggacaaaguauugauaguaagacuaaagcuuuuuuauuuuauuuuauuauuuuauuuuuuuuggaggaagggucucuacauagcucuggcuguucuagaaauuucuauagagccaagacuggccucaaacucaaagaucugccugccucugccuuccaaaugcuggguuuaaagaccugcuccacuacacccgacuugacuuuuuuuuucauuagucaauuuaaaagaccuuuuuucauuagucaauuuaaaaaccuacgaaggacaggauuucguuuaauucacacuuggguuucacacugggcaugauacugugcuggaggaagaaaaguucgcauuaguuaagguuccugcuccaguggggcuuacauuccaauuuucuauuucgucauaauucgucguggagaugagaaaagcuaagagggcauaggccagcggcuggcaaggaacugagcugcgacuuacucgcugccgggaucccaccggcggggacugugggccguuacucccguucagaggccaggucuccauucuuguguguagcccucgacccugcuccucuugaguucagugcuaacgcagaggguuuagcuccgggaccgggccagcgaagaaauaggaaggcggggccggccgauaggccauccggccggagcuccggccgugggcgggccucggagggccuggccacgcccccgagcg

SEQ ID NO: 9150 - RNA, 29285 nt, Mus musculus
auguccacacaagcagcugccacaaaauaguuuauuaagggagcaagggaaaagguguaugaugggaaagcgcuggaaugugaggaauucacccuuuguucaggaacuggagcaggucgggcguugccugaggcuacccagagucucaggggcaagggcagaugcugaggcagagguagguggguuggccucugucagcaaagcugcaucuucccaggagccugaagcagagccagaaaagggccaaacaaaaugugagugagacaggcuaggaggggugggauagcauccccaccaccaucacuccaucacacauccccaccaccaucaccccaucacacagugcccuccccaucacacagugcccuccccaucacacagugcccuccccaucacacagugcccuccccaucacacagugcccuccccaucacacaguacccuccccaucacacagugcccuccccaucacacagugcccuccccaucacacagugcccuccccaucacacagugcccucaccaucacuagccucuggcucuugcuccuccucuccauucaggggccgcuucucugguuucucuuccucagacagcuggcccucuucagccaaagggaaacagaggugagacagaaggugagagccaggcacugcaggugagugcuggggaugaggagcgaggaagaggaacugaacauaccuguuccugagggaucuucagggcucucaccauccuccgucacauccgacugcuggguagauuccugaccuucagguuccacaaacagaggacagcuagggucagugguuauccuuggcuugcagugccaacucuaccucuuccucgaauccuuaguuccagaguacugcauacuucauaguggaggcaggccaacccucuaacccagccagccuacccuucaaggauacugucaaccaaccagguuaccuggcugauggcgcgagauccgacgcggggccccguggugugaguuaucccuuugucggauauuaaccuguggagcaguaaccacugagcagugaggccugacuccccuccgcagcaaucauacccuagcccuaacaugccccugaccaccaagggaagaaaaacggggccuuugccccuugagaccugcagagagaagcgguggcggggccagacagcaccccacacccacugcauauagcugaagagcacgaugacgcugaggaacgugaaguugcuggccacacccacgaaggcgcaggucauggggaaguuguacagcagguaccugaggugagaaacagggucaggaagggaacagcgguuacuggauagcacucgacacuaucacuccaagaagauuuguaggacagccugagugaggauggcuggagcugccuucugccacuguggcacccacuccccugcccagguuccagaccacccugcaccagguucuaauaaaggccaaggauuccaggccaucucagaaucacaaggccacagcauuucaauggcuucgacuguaacuccucuagucacuccaauacuuucugagccaguccaacaaggcaguggauugcacggagauuuuauugggccagagugguuguguguguauacggaucucacuuuguugucugagaaccaggggcuagacacgggacuacacccggcucaucggauacuuuucguuuucccuuuucauuauuuauguugagagucuugcuuuguaguucaagauuucuugccucaggcccauccagugcuggaacgaaggggucugucaucuccuacaggauauucacaucuguauaugucugaguauuugccuggauguacguacacauaucacauggaugccugguguccccagaagaauaaaugagaucuccuggaacuaaccuugugggugcucuuaaacccugagccaucucuccaagcccccuucacauggcauuuuuaagaagcucucuugaaaggugacaagcacagugaagccagggagaaccaccucuggccuuuguaaaauaugaugugauuguuacuggucaccucugccuggaacucucuucauuuuagggcaggguauaggaaagcugucgauguuuccuuccguggcuuuuuuaccugagcccagugaagugggcauggauccggagguaggcuccauacaucuggaugcgcuugcuguggaucucaauaauugcuccaguuguuggcacauacugcgagggugcaaggugagagcagagucaguaugaggucuacuuccagucuguggcucuugcaguugacuguccaugggcuucucagguacaaucuugggcucguugaagaguugucuccuaacucugucagccacuuaccgaauucucccuauagucagaguagaguucuacuuccaggagcugcuucuguucagcgaagccaaacagcaggaggcuggagaacagcagcgugucgagcaccuggagcagcugcgagcgguaaugcagcaucaccugacggccgagaggacagauuggggacaggcgcuggguccaucugcccaugcuaagcaacacgcucgcucgcucauuccaggcucccugcuccuucacuuucucucucuaacuuccagucaccaccuacccaaccuuuccaccuguucuaguaacacucccuacuuccugaccccauuuccuaauuccaacacagagaaagccccucucaaaaauuaccucccugagguaagcagucugcuugcacguggucugccuucugggcugggaucugugucccagcaucccaccuaaagcuuuccucaaauguggugacucuguugacaguuuaccaauggggcucaguguugaaugaguguucaacacaugcuaguaagaacccagcauuucuuccuagucuuguuaggaagaaguuacucuaaaacucuagcaauuaagucaguuaucucaaagcugguauguuucuggugucugcuuguuuuaagaacagcuguauugggcuggggagauggcucagugguuaagagcacugacugcucuuccagagguccugaguucaaccacaugguggcucacaaccaucuguaaugggaucugaugcacucuucuugugugucugaagacagcgacaguguacuuacauacauacaauaaaugaauaauuuaaaaaaggauaccuguauuauuuacccugaauuugggcacaccauaggauaccaguguuuggcaaauguuaagcuuauuaaacagcuucuucacuuaucugguuuaggccugaucucagagccaaggaggucuucuuuugaaacacuagcccgauauucugauucucccaucauuguucaaacauuccaguauuguccauaaacacuuacugagcgugaagaaguggagaugauucggccaccucugguauaacaugaaacagugacuaagaacaugcccaagucuugauucacaggggauucgggcaguucaagcucuaaggugacucgauauggcuguccauacaucaguaccugcccaagguaacacacaucuuguuaaaaaaaaaaaaaaauugugguguuuugagacuggccuggaacucacucuguagaucagguuggccucaaauucagagagcugcuugccucugccuccccagugcugugauuaaagguaugugccaccgugccugguaugucuuaaucuauuuuuuuuuuuuuuaaaauguacugucucugcuuaagaacucaacaaaaucccuuuggucuucucauuguuuaaucaugauuugaugcugcccccugcuggucacuggacacccuggcuuuccagacuucuauuuuguuugcugguuugauuuuauuuggggccuagggguuggguugucagguagagaacccuguguuuuaagugggucuugcuacauaucucuggcuagccaagcacugacuacaaagccucaaauucauagaacuucacuugccucagccucuggcgcugacauuuuaggcuugcaccaccacauucacccugugagcucuuaggucugucuuggacuacuauguuuacgagaagugcccuguugcauuucuuuuccaaaagugaacagucacauugccaacuggggcaucugugauucaggccugugugccgccggagcugucccccugggccuagucugcccucacuugcuaauuaagcaagugcugcucugccucccuagucagcucuugcacaaucacugcaguggcagaucaucuuguuauccuggucuuucuucauuuuuaaaggcagagugcuuauuaauuuaaaaaaaagauuaaguuugucuauuuauaucaguaugcgugcaacacugaacuuauuaaaaacaauagaacugccuggggcggcagugcaugguuuuaaucccagcacacaagaggccaaagggaggaggagagcuguggauucaaggccaaccugguugaaauggccaguuccaggccagccaaggcuacauagugaaacucugucccaaauacaugcaucgaaugauaugacgacgacuguauaccuuaagagguaaacuguaucucauauaaauuuuaacuuaauaaaccuauuaagagggucuggagagauggcucagcaguuaagagcacugacuacucuuccagagguccugaguucaauucccagcaaucacauggugacucacaaccaucuguaaugggaucccaagcccucuucugguguguaagaaaaaaaaaaagaaaaaagaaauccaagccuggcacgguggugcccacuuccuaacaaucccaacgcuuaggaagccgagcacgucugagguuacucacuuccagucuggauugguacauggcguaccuuuaacuccagcacauaggaggcggagacauagugaccauaacuuuaagguaaacuacuuuuuauuuuuuaaauaguccaggcuagccuuucugccucuaccucccaagcuccuuuguuuuuuuuuuaaugagaggccuugaacuaacuuauucaggaugcucuuaacuccuaaacucaagauauccucccuugcguggugauggccacacuuaggaggcaaaggcaaguggaucucagcgugcgaggccagccugggcagcauccuucuauguuaaguauugugauuauagaugugugccacugugccagagcugauauucuacuauaaagucaguuucuucuuaaauaccacuuuaaaaaaauguucaaguuaagacugacaacuagaaaaaccucauuuaauaaaaaaugacauuaauucucaaaguccuuuuuuguuuuauuuuuugauaucaagggacauuuuaagcuuguaauucuauuuuuuaucagagccucuagagagauagggucuggcuaugaagcccaagcugauaucagauuuggaauaaucucccugugucuuuuuccuccuagugcuggcauuacagauauguaucacagugacugggaccaacuuccagauuuucuuuuccacccguuugcgucagagccuuucucuucaaucucgguugcucaaucccugcucuccccaucuuccucaagcaaucaaagccucugucuaguucucauacucacccgaucacguccacucuuagccagugagacauuggcaacagggaaagagcagagagaggcgguggaggaaucacagucuguccuaaaugagaagggaugaacaaugcuuugugaggugccagccugcccagccuaccugcucacacaccuagucucuagggccccuccccucacucaucccuuuuccccauuacaggaaauggagaacagaaguggacacuagagucaggagauccuaauaagacuuucauucucuuccucaugagaacagaacccauagggaggagccgaaggacacucaggguuucuauaggcucccuugaagaucucagggcauguggauuuuagggucccucuccuaaagagucugauucagcaguucuggacuagguuggaaaaagaaauucauccuaaaggaccuauggauaugucuuuuaaagauaaauuauacgcaaaacugcacauaguauaugguacacagcuccuaccucaguauacauacauauaccccauguauguaagacucgugcucccuuggggcuggagagauggcccauuggucaagagcacugguuacucuugcagaggaccugaguucaauucccagcaaccacguggcagcucacgaccgccuguaacuccaguugcaggggaucugacaccuucacacaaccacacgggcaggcaaaacaccaaugcacaugaaacaaaaauaauuauuaaaaaaggauucauguucccuaaguguuuacaugggucuaccuuagaaaugacaacacaagauuagggauuugggacaggggaaaaaaagguuuuaaaccaaugaucauaaaagcguuuucuguauauguuaauuugucucauagccauugcugggagacauacagagacuuuggcagugugaguaaaauggauaugaacucgaaggcuagguuagcaguaggacugccuuggguuacugaauguaccauugggggugaguggcaguacacuaaaaggcaaaggagguauuuccuaauagcucacguguuaauaaagccaguguaauucuuagaugccauggcaguugaauuggcucaaagguuucaugcaaccucaacagaacagacgcugagcccuacuuggucuaaaagugauuuuuuuuuuuuuucgagacaggguuucucugugcaguccuggcuguccuggaacucacucuguagaccaggcuggccucgaacucagaaauccaccugccucugccucccaagugcugggauuacaggcaugcaccaccacugcccggcuaaaagugacuuucuuuuccuagucuuuuuuuuuuuuuuagaccccuuugagacaaguucucaaccugucuuccaggcuggccuggaacucaugcuaauucucccaacucagccuccccagacugguauuacacacgugaccaggcucuuuuucucaguucuuaaccacaauuuccagcagaggcagaccuagaacccuaaagcccuaccagcccagaccugcucaagccuuggcucaggagggcagaaguccugauagcacacuagaauaagauuucacccucggucaauacugggauucaacagaggagagacuccacaagucccugaaguaauuuucaaguuaagauccaucuacuugaauggagcagccuucucaccuguaguggaagugcacagggcugagguggcugaccgucggcauguaggaguaguagaaggagccauagaggaacacagacacccaaagcaaaagaaggauggugcagaagagcaccccaaacugcagcaucagccugcgggcacggccugccaagacguggcccacuuccugggcccacaguaaggcggggacuggugggucauugaccaugauggggacagcagggggucuggccccagccucaggcuuugaguuccuggcuggucuuccacagggacgauacccuuggccaugggauagggcagcugaagguuccuggagaaagagaagggaaaagacaguuucuuuuccaggguagcuggagacaaaaaagcuuauucaacuggcuuugaaaacuagagguagcagggcaaagcaaagucauugcuucacaugcgcuucucuuccaauuacuccuucaccucccuccacugagugugcuuccagccucuuccuccaguuucgggagccugggacaaaccuccuugauacauucacagaaguauaacguacagagaacgaggccuuuaaaucucucucgaaacccagaugacauggauccaaaaugccagagguuugcaaggaggugagugacuugccuaagguugcacagccggccagucuggcucaaagccagcagccuuagagcagucaaaauugccucccaagaguuucuuuccucugccuggaccugugcucgcucacggaggaagugaccccuacccccgcacagcacccuguggccgacgcugcggcgcccaccccugggguaaugcgguguacaccagaucgccaccgcggcgaggcagacucaccggccucucgcugcccaggcaauauacagaaggcaguuccggcugccgaggaagccccgcccaacugucaaucgccuacaggggcugagccuugcauagagggcagagccuguaaaaugcuuugcuccccagugucucugcccauuacacuuuaguuaagugaccaaaggacccauuauaaucuccaacgcagucugggacuccuugguccuccuuuccaggccucaaccacaacccucugcccauaccuuuaccaccugucuuuucagugugauugaauggaggugugaaauaaaugcugauuuuguuuuguuuuguuuuguuuguuuguuuuuuguaaauucaguagaguuccuugggccuguaggaguccaacuggagcucagagagccuugcacccugccagaaucugaaucuuguguguugugugcgcagauggugccguccgcuagucaagcguggcggcauuucaaccccuuucagucuccaguuuuuaugcugcgugauugaccuucugugacccacgugaugcagccaaccucaaaaucccuacaaaaaaccaugagacuagauuucugaugguggcaucgucuggauaacguccuccaggaggcaaggccaaugcacaucuuuuugaauaguaguaauccacucaaauuacaugaaaaauuuccaaucgauucccuauuuccccagugccaacucuugccacccuacuccccacuccgagaagcccaccuguguucacaacauucacacuaacucucguggcaaggugccuuaccucgucuuugucugauccuuugaucuggucucugcaugucucucuugccccagcuucucuucuuugauguaucauuucuuuagcuaucuuccugauggguuaccucugggucucccagcucgcgucacucacgugguagaaaguggugaucuagaagcugaucaccuguagaguguuacauuuuccuagcucugaagaacggugggucacugaaagaaaccaagauucaggugcuaagugcugugucagggugggggugggggugggggagcagcagcccagcugaugucagacuuucaaaugagcagggucuuccgcaguggggacagacucuaaugcaggggcugucacaggcccagaccaccccauuugagaggggagccugcuucugccucaggcccuuuggggagcuaucuaguuuagacuaaggacuuguacaauggcaggggcagguagugagagagcagcagugagggugugcacaggggaugcaaacagcagacugacucccccacuguccaggcaguugguaugcgccagaaucagcagcuccuucuagcauccuucauccuucagguaccagccaucugggcagaacuuaagcuguggagacugagaccaccccuccaaggaucucgucugagcaucucuagugaccuucucugcauuaacugucagugcuacggauauuuuuagcuccaaguccuggcaggguggggcaccuaucugaggcaggguuuggugcccccuccccacugacccuacaucccuggcugccgcugcuguuacuucaggugaguagaaagcagcuuuuuuucucuucagggcuugaggggggacagguggcugaugugauuucaucaggguggggcucuuucugacugaggcuuucauugcugguaacauauuuggcucaaagacuuaaaauccuuaaaucguuuguauaauuugaugaccaggacccagggguuaggagaauauuucauuuuaucuucuccauucucccuacuuaaaaaaaaaaaaaaaaaagaaagaaaaaaaaaccugggauggccacuggagaaugggggcacaaucccaggugugugguugugaagagcugaguguuucagcugacugucuuuacuccaggaugaaaggggagacccccguuaacagcacuaugaguauuggucaagcacgcaagaugguggaacagcuuaagauugaggccagcuugugccggauaaaggugggugcgacccuggcucccaucagcccuucagggcucagcuguggguuugcaauacccuccccuccccccuccccccaagaaaagaugcuucuuuucuugacacccugaggucaguggcagaaacugggcuuugucagcaaaguuguucccgaggacuggcguugggggagagggcugucucaaagggcacuagaaacaaaaagauagucuauuggagaagagaacugcagucccuuucaggaauucugguuaauguaucccuuccuggcuggguuccagguguccaaggcagcagcagaccugaugacauacugugaugcccacgcuugugaggacccccucaucacuccugugcccacuuccgagaaccccuuccgggagaagaaguucuucugugcgcuccucugaagagcgguggaccuccucugaacucaucgcccccucccagacccgcccuuagauuggaaauuguaguagaucacuucuacccgcauuuacccggagauuauuugaagcacaaggcccuccuuacccaugucuaccccaucuccucacccuuucaggcuaacuccaagcaccuucuacucuaucuauaaagggaccccgcuaaacugccaaaauccugccuguuucccucggugauccauccguucaggcaauggagagggggaugcccgggugcucaccuggagcuaugaaagguaaaggcauuugaagaauaaagucauucagagccucagaggacaacgucuguguuagcguucuugggaaagaggauccuuaaucgauacacuugccauauccagggaacagggccagucgagcccguuagacauuguaaggauuggagaucgcaaaguauaaggugcccgagcgcccccagugggggguuguuaaaacgagcgcucagaagccgcggagcauucacacgagcgcgcaacguaagcggcgagaaccacacaagggcgagcaggguggguuuccgcaggcccagggacagcagccccggggggagguggcccgagaggccguggggcgggacagggcgacucggcgcggcagccaaugcccaagauggcggcugccuguucguacccgcauggaggcacgcgccgagggugcucuuaaaauggcgguccccagcguucccaauagggaacgaucccuuaugcgauccucuggucuuaaaauggcugccccugcccucucaaagucagagucagguucucugucccauagaaucuggaacuagacaugcuuuggagaccaaucacggggaguggggauggggagacaccuaaagcagucauggguucuuaaguucaguguggugaccaacacuccggagguguuggacacacacagaggcagauggaucucugaguuccaagccagccacgacgacacacaauacacaaugaaauccugacuuaaaacaaccagucacuaggacugggacccaagaagcccagagugaguuuugcauaagaaucucgccugaguagagguucccuuugagguguauguaauaacacaaauguguuaaacaggccaucuuggagcacccuguuccuuggucucugugggaucuaaauaaguaauaaauuuguuuucuuguugaauuggggcuuuuuuauuuucuccucaagguaacugaaaacaucacaaggguucagaaugucgucugacuggaaaccaugucucaagaaugccuccuagagugagaucccggcaaaggguuaggggauccaggccaccgccuagaagcuuuuuggucugagugaacguacauauauguuuuggauccugggcuacauuuaaauguccuaguuguuuuguuuuuguuuuuauucuuuuugguuuuucgagacaggguuucucuguauagcccuggcuguccuggaacucacuuuguagaccaggcuggccucaaacucagagauccgccugccucugccucccugaaugcugggauuaaaggcgugcgccaccaugcccggcuguucuaguuuuaggugacaaaucguucuggguaggaaggucuaacuauucccugggugucauaaccaaauggcugaacagguacagguguuugacugcaggcccagugaguuucaaccaucaagguggugggggagaacucaagaguuuuucugacuccacaagaguacccugcacacucucucucuagagcgcgugcaugcgcacacacgcagacuucaguauuuuauaaccuuugcuccuucuuucuugugaaaaccccaggaaggauccuuguuauaaucccugccugcuuacaaugucuagaaugcaauaggugccuaauaccuaaugaauguuuuuuucuauguguauaugcuuaaacuguacacagggaguagcaagagacuaaaaagacuaaucucuaucagcucagaugugguaaaaagccaaaagugcuuaaaauguguuauuagguuaauccuugcccuaccuuauccucuaaaauacccaucuuaguuuucucaugcaauuugauaccuauucaaauuaggagugacuaucugguugaggagaaccaggccuagcaacucguacagacaagguguaagcuguuucagaguagggcuagaagaggguucucaaaggagucacaugguggcuuacaaacugaccuuaacuccacuucaagaggauccaaugcccucuuccuacucugcaugcaccagacacaagcaugguacacacagauauaugcagacaaaacauucauggguauaaaucuuaggaauagaccaucaguggauugagacagggucugaacuccugauccuccugccucccaacuccaagugcucagauuacauucauacaccaguauaagcuacuguuguuuuugaaacagggucuugcucuguaggccaaguugaucuggaauauucugguuuugaauucauagcauuucuccugucuuggccuaucuaguguuaggacaaaggcauucgauaucacgucaggcugaacacuaauuauaaucagcuccaaaaugccaauaauggagccuaagaugguucaguggguagaaguuccugucaucaagucugaugacuggauucaauuccugaguccuaaaugguagaaaggagacucccaagucauccuucgaucuucacagguguacuguggcucaugcgugcuaacaggcaaaaaacccaaaguccuccugagccugguaugguugcagccuaggcuacaauagccaauacccagcuucaaaacaacaaacacaaaacaaaguuucuguagcuuucauucuucaaauucaauagaaaaaugaagacuuuccuucuuagguaauaucacauacuuaauggauuucauaaacaaaacaucaaaaaucuaacugauuauuuuagcagagcccaagaguuaaauuuuccauucuaauggcucaagaucuuaguacaagagggauagagagauggcucagugguuaggagcacuggcuguucuacuggcuguagagaaucaggauucagaguuccuagcaccaccauuuaaaaggauuuuuuuugugugugucuauuuuaaaauuuuguauuuaugguuuuguuuuuaaauguugugugguucagauacaccagaagagggcauccgauucuauuacagaugguuguaaugugccaugugguugcugggaauugaacucaagaccucuggaagagcagucacugcucuuaaaccacugaaccaugucuccagcccuagcaccaccauuuaagcucacaaccaugggacacugcaguuccaggggauccaaugcccucuucuagccuccgaagguacugcauaugugguagacccagaugcagguaaaacacuuguauauauaaauaaaauuaaaaauaaagauguuacucuaagcacacaccagguugacagauuccuauguagcuagucccaagugaaggcguagagaagagcacagcugucauauacagaggccauccucggcuguaaccagugcaucuugauaacuaagcacuaaaaaauagguggcuuggcaugucaccaaaguuuggcaauuuguguuugguccuuggaaccuguauaaggauaggagaaagacuccacaaaguuguccucugaccaccaugugacucauauccccauuuucugcauguacacucgaucccugugcacuucugugcacauaccaaaauuuaaaauaggugauuaagaugguuauagugacaaacauguauaaaugcagcauuuuggguuuuaaggcaugaugaucaagaguuccaggccagucugagauacaaggagauucugccucaaaagaaauuauuuugaaaaaauacauuuuaaaaauaaacaccuccaugaucauuccagucagugcagccacaggagauaggaaaauucaauccaaaugguuauuuauucuaaaacuggaacuacugugucuacauuuuuugccagaaugguguaaugagaacaggguaagaguuacauauguaaacaaugacacaguuacauuuuuaaaaauggaaccccccucccccguuuuuuuacuggccacuuccaagaaugcuuuacagguugugcaaaaacauuuacaggcuccaugugguguuuguuuguuuacaagcuuuuccaucuacaacuacaacagacaucugauaaaacacuaaacaacucuuuuaaggaaaacaaaaccagggauuccucuuauuaccauaaucuacaccccacacccgucccaauaacauuucuuuucauaauaaaaacacaagacagaaacaaaaugcagacguccacuuugaugcaggagaccuccugaacagacccaacaaggauguggcagugucauucuccauuccacuagaaaaacagcuuuuuuuaaaaaaaaggacuuugacuuuucugguguugaaaaucaacagcgaguauacucucugacccauguugccucaaacuucaguguuaaguuuuugcacuuuugagggcucuaccaccuaaaauccagaucacagaguaccgucaaaguauuauuuguuggaggacuaaacaucugaagggacagcuucugccucuggaaauuaaguuuccuauucuaacauaaucuucuucuaaggggauuucuuugggcuccaguuucuaucuuccugcccugacauuauaaacaaugcuuucuugaacucccuuucuaauaccagcgaguuacaaaagaugcaugcaaucauuccacccacugccacacacaaacccaucuguggcaccauagggacaagugcaauagaaaagacacaguaugagcacgcuucucuccucccaggcccacugcagccuuggaaagagguccuugagcagaacgguguguccuaacaaaccaggacucagaaugaggucugcacacccugagaagccuugccugcgugggaaggacaucaggacagggaagauucaaaucucagcacaaguuuaaacaagagaacugcucaggcaaggaaguggaagugaaguauguccuaguaacucagcccagagauuuucucaccaggaaguguuguaggaugcuguugcugaguaagcuuuuagcuaagcaagaugaugauuuaaauugaagaucaauauugaaagcgcauugcuauauccugcucacauucuugaacccagcaaccuguagcuauucugucaagaacugggaggguguuguuaaaguuacaaacuauaugaucccaaaugaagucucuugauaagaggccucucugaggacuugaagggaagcacccuugaaggaauccuguuucaacaaguugggaaaagguguuuccuugcacacacccauacacacauucacauagucuuuccaaguuucugcagcccaacugagcugccuccuaaccccacaaccccuuucuacucucuaccuguguaucaaaacaaaaacaaaaacaaaaaacagcagcagggcagagcccccuacauuguauaaaauaguugcaauucucagcaccugggccugacagcccacaccacaggauucaccuauauacauaucuugacgcaguaaacaaaagucuugcugcguuucugugagcugaaacccugagaaucauuccuucccucacacuuguaagaggcaggcaauauuaguaaaugauuccagagaucucuugccucuaucaacuaggaagacagagacuagggacuggcaaaucaccaucuucagacuaagggcuguguucccacccuccuccagacuuuauaggaauuuacugaauauaauauagauagggacaaaguauuaugcucugcaguccccaagagcccccguucccccuuggccugggaauccuauauacuagaaccacccaacuagcagucucugugccuuaggcagacagcacaaaggcacaauauaaguggacaaucuauuaccucaauagcccaagaaggaaagguugguaaagaaaauacaaacgguuaguuggugcaagugauucauaacagccaauuguuuauuuccacugcccuguucacaggcacccccucugccccugcuccugucuccucuguuuccgcuccuaacugcuagcagauucccucaugcuguuccccuucuccccacaacacucucccuuacugggcuaccaauccaccugucuuagaaugcuggaggugucauuuuuaguucuuuuccuauccagcugcaggguacagaauaggcagcucuaagugcugcuuucugugcaaacgguuuuuuugauuacaaauaaccuaacuagguuugaaauguuuuauagaauaagacaauauuuuuuucaacaaacuuuaaaaaaaauguacaguuuuguuuccacuccccccucccccaccccuacuugcacacccuccccccaaccaccccucccuggcagcucagccccaccccgacagccccuguuuuccuugguuguguuuuagggggugccuggcacccccaaagauucagcuucauggcugacaggcgaaaacagcaggggcuucaccgauacccuugguaaccguaguaauuccuguaguaucggucucuguccuguugguggugguaguaguaauucugccacuagaagagagggaaaccccaucacuuagagccagagcuggcugacgaugaagaggcacgacacucauccauccagcggguccuguccccuucacccucaaucuacccaagauaauacucacaucccgguuguauugucuguaauagucucuguaucuguuguacucauaaucucgacuguagaaucguucauagucaccucuguaucgaucauagaaauuacgguagcccugaggaaggagagagaggaguguugacgauauaugggucuucaaaaguacaccccaguuucccauuacugaacaagaaauauuucaucucgacacuguaagcaggguaaauucuuuucccggguuaaauucuuccagauaaacauauuaagugggcaaaacccuaaagcccuaagaaaacagcccaaaccccucugcucccccaagucaauaggaauggcuucacagcccagagggaggagcagaaggagagcugcacucaccccucuguuuccagacugcccccaguacugcugcccguaggcccgguugucguagccucggcgcugcccgcccacuggaagagaaauggagagggcgcucagacagcuggcaugggguccuggcuccacaucugaguggaaaucaaaaagcuggagccaaaggcaauacuacgggaggaggaggcuugcucuggccuggcucacacacuguuaauuaaagcaccagccaggaucuuuuauuaaaagagucugagaggggagggcacaagaauagacacaagaaaacaaagccacccugauucugaagcucuccaauccugcaaaaacaucuuagaugacaaaaggauacauggcagauguagaaacgugaguaaaaacugccacucacaggaucagacucucagcccagaaaggggucagagaugucugucauauagccuauaccuaucacuguacagaaagaaaacaaaaucugcauuaaucaaggcuaggaacccguuauucccagugucuaggacauagcuagcacuaaccaccuucugauuuacaguugcacacacauaaacacauacuuuaaaaagagcaauuauaaauauacacuggggauuuaacugacaaacuaacuagacauucugagggaaaauuaaucccacuaauaacuaacuuccuuuguaacaaucuaaaacgaggaagaauccauucaguuuugucugugaaacuggacugauuuaauaaagcaucaagugaucuuaagaugagaauuagaucucacugcacauccuuaagacugcagugaaguggggaaccaacuugcuugccugcauggaaaccaggcauaugaggaggcucuguacuguuucaagggaugguauuucugccccccaguaacuauuuucuggcugaaagacuauggggaaagcuuaugaagcaggggguaaagggcacaacaagaagaaagaagcuucaucaggaaagcugcucacugugggcagccaggucucuaggacucaccauagccuuggccucggcuucgguucugccgguuucucuuguugcgguuguuccggcgguuuguacgcuucucagaggggggcaguagcuuccuugcuuccuccuuguauuuaguaacaauggguugagcuuccucuuuuuccagcuccccauaugucaccucauccauauagucgcauuucucaggcagagagaaguuggcuauaagaauaagagagaagcuugugggccuagaaagugcacagacaggguaagaaugcaugaaaaucuaccagaggaagcauacuuuaguuuugggugguuuggggaucaaaccagggcuuugcaaauguuaauuaagugcucucucacugagcuguaucaaguuuuuguuuuguuuuucacuuugagacuuaaguuauaaggcuaucuagccuuaacugccuuggccucuugccucuuugggaacagcauuauaguuucgagucuacacccaguuauuuauugagacaggagcuuucuacauagcccaggcuauccuggaacucacuauguacaucuggcuucaaauccagagauucaccucucugaugggauaaaagaugcaccaugcccagcuuuguuguuaauagucuaugucuaaaucacacugcuccuuugcagacagggucauucagugggauuucagaaguacacaggguuccuggcuuguuaucuggguaugugaguacugggaucaaaacuccaggcuucaagggcugagacagguuagcucuuaugucuuuuuuagacauaaggccucacgcaucucaggguggucugaauguuucuaccuccugccuucugagaacugggauuacaauuauugcuguuguuaccauacuuugcuucucuuuugaguuuuuuuuccuccacuccuuugaaauagcuuuauuauuauguauaacucgggcuggacuuucgcuugcuauacaguuugugcccacuucaaacucaagauccuccuggcuuacccuccccaagugacaggacaacaggccuguucaucaagcaagccaagccuaacacuucaaagcuuaacucaguaaugcucuaaaaugugcuaagcucauaccaacucauccugaaauaaacaaacaacugcuuuuuugagacauggucucauguagcucaggcuggccuggaacucccuuauauacuugaggaugaccuuaauccuccugcuuccaaucucacaaguacugagaucauagguaaguaucaccaugacuuucucccccuuuguaaaggcagggucuguucauauagcgcaggaucaucuagaacgcacaacaaucuucuugccucagccuucugaugcuaggcaagugcuacuaugccuaaacacaaacuuucguuucccuaaagugcaauagcacaagauaaggggcuaucuggaaacuagauuaacaaguucuuaaguaaucugcaauagauucgcagugagcuaucaggaacacaggcuaaauguaaucgagaaaguuuugguguuacuuagaaaaaaacugcucaggagagauaacucaauauuaaagcaucuuguuguccuuguagaggacccaggcucaguucccagcacccacacaguacuuauaaccaucucuaguugcaguucaggggcuccugaugccgucuucugacuuccaagggcaccaccacgcacacauuuaauacauauauguaggcaaaauacagaaauaaguaaaccuagagagagaaggguggggagagggagaagaauguggucuuaaguagucugccuggccuauaacuuccugucuagaccagguuggucucaaguucauaaagauguacuugucucugccucugcuaggaucaaaggcaagcaccacccaugccuggacaagaaguaacauuauuagagcuucaagcugggacugaggguauaggugaggguaucacacuugccucacauguacaaggcccuggguuucaauucucagcacaacccacuccauauauacacacaguuacacaaagaggcuaaaagcaucuccuugccacuaaaggccucucaucuaucaguuacacaugauggccaauuauacuaucugccuguauuuggacaucaaguucauagacugugucauagugaauuugauuucaauuaugauucucacauuaauccagcuauccguaucuuauaaaacuguacuaaauuccuccaagugccugaauauuuauuugccagguauguuaaaauuaauucuuauaaguucagaugcuccuggucaucgauaugagaagugacucccacagccagggguuaugaguuuccauagccagcaguucacaggguaagugggcaccuaagcuaaaggaaaaacgaugaaaaauacgaucucaggagaacaugaagcaaaaacaaugaacauauuuaacacugccuuaaaaggacaguacacucaggcaaauaccaaaucaagaaaauaaacaaaaaugaaaacaaaacauaaaccuauuagcaccccagaaauuaaggcacagaagacagacuucuaucacuacuguauuuaaauuuaaacccaaacaaucauccuugccauuuucauggaguaucaauccuaauuuuaaaaucugaguuaugagggugaaguucauuucauaugcugauauuucccaaugacgagggcagugcuggacaaauaaguaaauaccucuuuaaaucacugacucaagcgcuuccuuaacuucaaguaucuuguuuggauuuaaacaucucauuucucauucuaccauuuuuuuuugagacagccucucauuuagcucagauuagcacucaucuuccaagugccgagauuagaggcaugcaucacccugacuuuuuuccaaccccaaauaugguccuacuguaucaggauggucucuccuaacucauagucuucuuuccugaacaucucacgggcugggauuacaagcacaugcugccauguacaguuauuuacccccuugcucucuacucauuaguuuaccuacagugguucuaacuauuaaauugcucuuaaauguacaccuuagauguggagagucacucuuggugauaagcaagguugcacuaaccagggaguggauucucucauccguaaaauuccagcucaccuuucaucuccagcauuauagacucaggcacaucaucucccuccacuucuuuccucaacuccagccuccucuuccaaucuuccucauuaggaacaacuaccaccaccuuccuggagaaugucuugaacagcaguaacuuccuucguuggccagaguuguacacauuacacuaguaacaggaguaauaacauguuuaagguuaaaagucacuacucaacuuaugaaagaaaacuuuaucuuuauaacuaaagcaucagauuagaagucaauacacaauuuccuuuaauaauaaucacuauuaucauugcguugugguaaucaggaccaaaacuagagcucugcauaugcuagaaaauuguucuacccgugagcuauaacccccacucuccuuuaauuuuugagauacuacuugacaaaugauauuucacauaucaggaaaacugaaguuagagagguaaaagacuuguccaaaagcuaggauagauugaagaauucaaauggaaugaaugaauccaaaucuccuuucucuccaucuaccaccugaguucagacacucucaguaaacuguguaaguauauuacauaacucacaagcagagagucauuagguaaccugagucuauuccuuaauuccguucuacaugugaucccagacuaacuuuaaaauagauacaagauuuucaucucuggaucccccuugaaugucuguauaccugaucaagaauaaaauuccucuuugaucgugaagcaaucuggaccagcuuacuaaggcacugggaggcuugcugaacuaagaggucucggcuuuugggguccaucucuggcuccucaagucccuucaucugaugagugagaaaugcaaagaguuacacagcaaguuuaagaguccaagucagagagacggagcauggcaggguaggagaagaaccaagaugguuuuggacauguguccggguggcauuuaccagccacaaguagcuaugauuucucaagguuagaaauauugggauaaagcucuuaucauuaucaauuggcucugaaauuauuguauuggcaucuuguaaauugugauauuauugauacauaaaucugaugguuuaaaaaaaaaaaaaaagaguccaaaagucaacuauucaaauucuacaagugucacaugaacucaucacacuguuaauuuccuguaguagucacuucuauauuuaaccuggauuuauuucagauuguauguuugcagaaauuugacaauccaggagagguggggcauaucuuaacacacugacaguguguggugucuuuguucucauacacuucaaagaccccccccaucccugacuaagaacaggcuaucagagauuuucagugucuccacagcaaacaccguagcugacuagucaccuuuccccaccucucagcaacugacccucauuugcgugagaacagucucagcucccagaacauuguaucuucucucaggguugucuuuugcguauuucagugcccacugggucuuuccagauccaggaagucccaccaucagaaucaccugcaaguaaaagaaacaggaaugaaauaaaaaucaaucaauuuuauaaaaucuuucuuuagaaaaucuuguuauauuuucccuauccaaguuugaaaguacauauccaccacucuccuaaagcaugaagccuagacuugcgcauaccucacacuccucuauggucuugggagggacugcaguccgcacacguuccucaacaggcacagcauggaugaacacaaacucuucugguggugggaaaaagggcuccuccuucugaccaaaguuuaauucuacgacacaauucuugcaaaggacaugggguagaagggcucgaucugccagagacuccuugcuaauucggaaugccacacccaagucuucuccauucuuggagaaggaaagcucaacuucuucagucucaaaauucuacaaggacagaagcacaggagcacgugcagguugauaggcuuuaaggacaaucacguauuaccacuuauuuauuuauuuucuaauguuaggaggauggagagaugggucagauaggagagaacuguccugacuuccacauaaauauuuugauaugcacccucucccacaaauaaauguagaaauaagcaaauaaaugaaugcuggggcuauugcacaucucaaauaaccaagcaaugcaucaaauguauaaaaguccauauugauaggaagcauagcagaauccucuuagccuuuuaucuacccuuugcuacaaauucacaauuuucaggaacacucacagcaaaacagccaauaacaucauucuccccaaaagucuggccaaauuccucaaacugcccguuuucugccuugaguccucuuccgucaaaaccguaggagaacucgucuucaccuaggagagucaacgaucaaucaucugccugccaugucuccagaguaggcgagaugguaacaaacacaaacaagaaguuacaaaaucaccuuaccaagcugugaacaggaaaaaucaacagaccacccaacucuaaggagagagacuucugugcagccuucuuucauugggagauucugaguuaccuggucaagucagaaaaugaauucuuagaucuaugacaaaugcagguacaaagucaagaguuacaaauucauauacaaauuggaaaauaaaaaaaucucagcucaauacuagaaaaagaacuuuuacuaaaccuaaaucaaaguuugugggccugggacuauagcucagagauacagugcccaauauguacaaggcacuaagaucaaucauaccagcacauaaaacaaacaaacaaacaacaagccgggcaugguggugcauaccuuuaauuccagcacuuaggaggcagagccagguggaucucugaguucgaggccagccuggucuacagagugaguuccaggacagccagggcuacacagagaaacccugucucgaaaaacaaaaaacaaacaaacaaaaaccaaacaacaaaacaaaguuguaagagucaauuuguuguucaguguuaaggguauguucaagcaggcugaccuuucugcacuaaugaaaugguggguaggagucuaauacacaguuuaaauuaauaaacgcuuuaagaaugacuuaccuuggcuucaaagcauacuuuucccuuuguuacuccauaaguacuucuugccccagaccaaaggguagggaacuuuucugagaagagcggcuggccuccauaucggucuuugcuuauuugaaaauggagauccgagguaucuguuaagaagaugcaacuggcuuacugcaacgcucaacaccaagaagugcugagccaacaaauacaaacacuguccagguacccacaccacgacauuuuacucucaaaagucacuuuuagauaguccagaggcuaauaaugcaggaggaucacaagguggaauccagccugaaauacacaacaaagcccuaucugaaaacacaaagcaaucuuuauacauacacguguccagguucacaagcgucugguccuccucuucaucuuuugcuucuucuucuggaggugguggggacuuugagcuacaggcaggaaagcaaaugcaacauaaccaaagcuaccuucuuugucugugagguauuuguguggcacuguccauuuuaaacuauuggugaauuaccaaguuccagcagacagcuucuuucagucaaugagaaaagggaauacgaguuuccaucauagauuuacucuaaaacuuaugccuauaaggaccuaguccaguuuucaauccaccccuccuuccacacugcaaucaacaauaggaauaccaaaagcagagcagacacucccaucaagggaguguuucccucaccggcugugguaagccuccucucggaauucauaguaagcucggccauguucauccuucucaucccgcugucucuuuaccccccgccgcucaccaucugagccugcugguuuugacuuuucacuaucuuggucaucuccuacaaaagggagggaaagaaaaucaguaguuuuuauacuggagcguacaaugagcucagaacuaagagaaucuaaguaaaauuuaggaaacugaggguaucugauugagacaaaguguuccuauuauauccauguuuuauuuccaaauuucaaaaucacugauuaagaugggcgggggguggggguagguugggauggaaaccacuaugggcuuauuaaauuggucaauuuucccauucuaaauuuaucuacuucaaucaagccaaccuggcacaucuccccacugauaugacagaaaagcaucccuuaagucuuuuaaaaaccuucacaggugaauuucaauucucaucagaucuggaguuaugucaaguacuuaaugacuauuuucuagcacuuuucagcaguuacuugacacagaaaucucacauuuucuuuaagagacuaccuuuucugcauuaaaaugcacagucuuacaguggcagguguauuuuuaacaggaacuugaaaguuaccagagaaauucuuaggucacaagcaaaccauaaauaacacugcaucuuuacugcaugaaauuuggggcaggaaggugguguuauauauuaaguaacauucuuuuguuguuguuucuagacagggucucacuauguaguucugcuuguccuaaaacucacuauuuagaucagacuggccucaaacacagagaucugccugccucugccuucaagugcugggacugaaggccagugacaccaaaccuggcaguaacauucuuuacacggaguaacacauggaauuuuuccuuaggcuuucauguuuugaaggcuuaaguguuuucaacaauuccuuuaaaacacucccuuauucuuuaaugcuuuugaucugcuauuugggauaacacaaauuaaggguuauguaauaggaccucagucccaggacaucggacacaacaaaaaccccgaacacuauacuuugcauacaaucauuguaaaauagauuccaauuuuauaacacuaagauccagaacaaaaaccaagaaacaacgaaacaguacaaaaaacucuaaggcaaaaaaaccuacuuggaaguaaaacuuagaagcagcucucccuccugacagucacuauagguuagcucuaaccaugcaagcauuucaaaaggagaaagucguuaacuccugggggaaguuuccacaaaccuaccacaagguuacuccacuagaaccccuaaaucauuucagcucaguuaguuaggagccuuaagggcaccaguguagaauaagucuauaaauaugcuuauuuacagccuggacaggagacuuaaaauauaaacacaacagggacaaaguaaaaagccccagucaaguaacuaacauucuacuaaaauguuacuagacuaaguuucucuuugcuaguuaaugauuaaacccaaaaggcucacacacugucuccgacggcuuaagcaggaaggagcaagguuaaauauccagagucucuuugaagacuaacuuggguuugacagagcagcauuucacggacuguuuuuugcuuaacauuuuuaagguaaggaacgaacugucaggccuuagcuuccaacuggucucgggagagcgccaauuuuucagcauauuugcggcuaaagguauucugcuaaagaggggugggcaccagaagacugauccacagguagcucgaaagccacacacacacacacacacacacacacacacacuuccauccacuaacaccaaggaaccacguuaggcaggaaccucccuccugcaaacaguguaaagacaagacgcccaaaccuucaaaaagauggacagcggaugaaagccaccuucccaggagaaucucaucaaaaagccacuagaacagugcacuuucgggcaaguggaaacaaggaaucagauagcgcggugcaggguggggugcuggaucggagacgcacccggcagguugaagcccggcuuggcugccaguuccucaccuuguuccucuacggccuugucacccggugccucggaucccggagucucgucuccgcuccguuccuccggcccgucuuccucccccuugccguugucaugcucuucgccaccauuuaccccaccugacccagccguggccuccgccggugugucggaagcuucggacucggccuccauggcugacgucuccgggggcuccggaggcggcugcgcggccuggcccaaagccugagcagguggugguuccucgucuucguccucaagcagcgccuccucguccuccuccucgucgucguccuccuccuccucguccccgcccgggccuccgcccgacgcggccacaggccgaggcuccgccuugcaggccccaccgggcccggccccaccaacgccggccucguccuccagcaucucagcauccagugccuccugaagacgcugcgccagauccauuuugaggccgcgcgaauccaggccccgccgcugaagcuccgaccgcagcucggucacuuucagccgcuucaccuccaucgccgccgucgccuccuccgccucccgccgccuccuccccugcgaacugucgaccgagcccgaccgcgcaggcgccgccgccgcccgccuccgccucccgcgccagcacugagcccgcgcuagcaagcgcacgcacacagaggcagaggccgcgcugucuucgcggcguguuuaugucgccuuccuccugcccugccccuuucggcucacugagcgcaaaacaagacggcgaggagcagcuuccgacacacucuguacucgaccgcgggggagugcgcgccgaggacgacggaguucccucacuuccccucccuccucucagagauccgggccaaucagcgcaagcggccuaaccgcgcagccgcacaggggccugagucgggcaaggcuggcugcggcucaagugccucguagcacggaagcgugagcgcgcuccucuuuccguacuucagucguaggcucugcgcagucgcgccggagucccgcccaucucaggucucuuacuuccugcccgcucccaauuaccggagcacccuagggcuuacucgauguccucucuugcuuauucuuugacuguaacuucugagacuaguaaccgaagccaagcuggaaggauggguggugcaggguuuucguagccaggagggaaaggccuuuccagcaucaagggagagagagagagggagagagcaaugccgggaccucuuucugugcuuaaacaucuacccagcaacagaggcgccaaccccaccccuuccuucucucguuggccagcuugaaucguagucuguugcucugauugguccuccgauaucgugcggcuuuuuuuccuauuggagaaguggccgggaauuuuuuuuuuccggguugguccgcugggga

SEQ ID NO: 9151 - RNA, 2511 nt, Mus musculus
gucacaggcccagaccaccccauuugagaggggagccugcuucugccucaggcccuuuggggagcuaucuaguuuagacuaaggacuuguacaauggcaggggcagguagugagagagcagcagugagggugugcacaggggaugcaaacagcagacugacucccccacuguccaggcaguugguaugcgccagaaucagcagcuccuucuagcauccuucauccuucagguaccagccaucugggcagaacuuaagcuguggagacugagaccaccccuccaaggaucucgucugagcaucucuagugaccuucucugcauuaacugucagugcuacggauauuuuuagcuccaaguccuggcaggguggggcaccuaucugaggcaggguuuggugcccccuccccacugacccuacaucccuggcugccgcugcuguuacuucaggugaguagaaagcagcuuuuuuucucuucagggcuugaggggggacagguggcugaugugauuucaucaggguggggcucuuucugacugaggcuuucauugcugguaacauauuuggcucaaagacuuaaaauccuuaaaucguuuguauaauuugaugaccaggacccagggguuaggagaauauuucauuuuaucuucuccauucucccuacuuaaaaaaaaaaaaaaaaaagaaagaaaaaaaaaccugggauggccacuggagaaugggggcacaaucccaggugugugguugugaagagcugaguguuucagcugacugucuuuacuccaggaugaaaggggagacccccguuaacagcacuaugaguauuggucaagcacgcaagaugguggaacagcuuaagauugaggccagcuugugccggauaaaggugggugcgacccuggcucccaucagcccuucagggcucagcuguggguuugcaauacccuccccuccccccuccccccaagaaaagaugcuucuuuucuugacacccugaggucaguggcagaaacugggcuuugucagcaaaguuguucccgaggacuggcguugggggagagggcugucucaaagggcacuagaaacaaaaagauagucuauuggagaagagaacugcagucccuuucaggaauucugguuaauguaucccuuccuggcuggguuccagguguccaaggcagcagcagaccugaugacauacugugaugcccacgcuugugaggacccccucaucacuccugugcccacuuccgagaaccccuuccgggagaagaaguucuucugugcgcuccucugaagagcgguggaccuccucugaacucaucgcccccucccagacccgcccuuagauuggaaauuguaguagaucacuucuacccgcauuuacccggagauuauuugaagcacaaggcccuccuuacccaugucuaccccaucuccucacccuuucaggcuaacuccaagcaccuucuacucuaucuauaaagggaccccgcuaaacugccaaaauccugccuguuucccucggugauccauccguucaggcaauggagagggggaugcccgggugcucaccuggagcuaugaaagguaaaggcauuugaagaauaaagucauucagagccucagaggacaacgucuguguuagcguucuugggaaagaggauccuuaaucgauacacuugccauauccagggaacagggccagucgagcccguuagacauuguaaggauuggagaucgcaaaguauaaggugcccgagcgcccccagugggggguuguuaaaacgagcgcucagaagccgcggagcauucacacgagcgcgcaacguaagcggcgagaaccacacaagggcgagcaggguggguuuccgcaggcccagggacagcagccccggggggagguggcccgagaggccguggggcgggacagggcgacucggcgcggcagccaaugcccaagauggcggcugccuguucguacccgcauggaggcacgcgccgagggugcucuuaaaauggcgguccccagcguucccaauagggaacgaucccuuaugcgauccucuggucuuaaaauggcugccccugcccucucaaagucagagucagguucucugucccauagaaucuggaacuagacaugcuuuggagaccaaucacggggaguggggauggggagacaccuaaagcagucauggguucuuaaguucaguguggugaccaacacuccggagguguuggacacacacagaggcagauggaucucugaguuccaagccagccacgacgacacacaauacacaaugaaauccugacuuaaaacaaccagucacuaggacugggacccaagaagcccagagugaguuuugcauaagaaucucgccugaguagagguucccuuugagguguauguaauaacacaaauguguuaaacaggccaucuuggagcacccuguuccuuggucucugugggaucuaaauaaguaauaaauuuguuuucuuguugaau

SEQ ID NO: 9152 - RNA, 3821 nt, Mus musculus
auuccucugucagaacccaggcauccuggccuccagcugaaaccgcugcauguggcuuccccucucccuggccccgugacucagucccucugagggaaccagcccucuucuuggcacacaggggcuaggugaugacaucagaguugaggaguauaaaaguucucaaccaaaauagaauugaagauacaaccugacaguggccucuccgccugauagccacggauaucugggggcaaacccucacugugacgaggccuacccacuggugaggggcuacugugggucccgggaagagggugcacagagagaagucugaauugccugagcgggauuuguacaaaugcagguagggagggaggacuccagugcccaccgccgcccuuucuuccuucaucuccugccuucucucuggauuuuuguaaaucuuacuaagcauugcucuagauugguuauuucucaggauggcuguggacucaguccaccuuucuuccccaaacugaauaaauccuuuccucuaccucuuuccccagcacuuuuguuuauccauuagaugccugcuucuagcacuuugcacggugcuucccaaacaucucucucuccuguggggccguauuucauuauuuuuaucccaaacaaagcagucauuugugauguuaauaauucuaaugauuuggagguguagacagaguugaagggcagccuuagaccagccaaaaauccagaacacuggcuucugaaaagccaguugacaaugacuguaugucucagcccaccucuuucggucuugauucuauguuguacuuuucacauaguguacuuuucacauacuucacauagcccuggaagacagggcugacagcauuuacccauucacucuuucucuuccagacuccauguugggcucucuuucccuucuguggcuggcagccaugaccaccuccuugguuucccaaccucagaucuugacccuggaagacuaccaggaaggggaagaggaugaugugacaguagcuacaccuuccuuagcuguccguugcgacuaugaccguugccgccaccugcagguguccugccaggagcugcagaagguugggccaguagccugccugugcccagggcucuccagggaagaucaacagccagagccuccucgccugggagaagugcaaauaauggcugaagaaggcuacgcagugguucacuggugugcucccuucucuccagucagccacuacuggcuucugcuuugggaaagcaacggggcuccacagaagagugccccucucaaugcuacaguucgaagagcagagcugaagggacuaaagccugggguugcuuauguccuuugcgugguggcugcuaaugacgcaggugagagcaauguuccuggggcagaagucgaggguccugagaacuggacuggcccuuccuuugggcccugucgcaaguuuaucaugccgccuaagccuguuacccuggucuaugcagccgugggagugggcacagccuuagcucugcugagcugugcagcccugguuuggcauuucugccuucgugagcgaugggguugcccccgacgucaagguauggcccaagcgucagaagcucucugacaggaguccccucgacuacaaacaacucaucuggagagcccaacccacucccaggaggaguguggggcuuguugccaccuggcaaccagaggcacagccaagccagagcggaagcccaggcaauuagccucagcacugagggcuugguuagucccuaacuggucacuauguuccuucccuguuggggguuagaaaaaguagcaauuauuccuuggaggucugaugaaaaugauuuaagcuuuauggguuugaagggguaaaauuacagacauuauacaugaacuuauauauagccaguuaaaauggagcuauuuaaaggccuggcauggugguuuacaauuuuagucuccagcacccuggaagcagaggcaggcggaucugaguuuccaaagcagccugaucuacauagaaagauuccaggccaacccagauaauauagugagacccugucucaaaaagaguaaaacagaagcaaaacaaacaaaagguggggcgggauagagagauuguucagcaguuaagaauacuggcuauuuuuccagaggacagaauuuuauuccuagcauccacauggcagcucacaaccaucuguaauuccauuuccaggagauccagugucuaauucugaccucugccagcaucaggcacauacauacgcacacauacauacauacauacauacauacacacacacacacacacacacacacacacagagagagacaaaacacucauacacauaaaauaaaaauuaauuugaaguguagcuguuuaaaaauguaaacuguucauagcucauaggucucucacagcaagcagcagacuacauuuggccuguuggcugauuugccaacaccuaucauucucaaagggacuuugugacugucgguggcuucccugcauauuuugagaauaagcugaguuuugccaacaccuguuauucugaaaaggacucugcgacuguggguggcuuccacgcauauuuugagaauaagcaggguagauguggagacuggagcucugucuuucugcuacuuguuguuuccuuccuaaggaugauccugcucagacuccaccuggggcuauggaagcuggggauuaaaaaucagcaugggcuggaggagacagggcccaagcuucuggcuacauaaguuaguggucuuguuuguuuuggggguuuuuguuuguuuguuuuuucaagacaggguuucucuguguagcucuggcuguccuggaacucacuuuguagaccaggcuggccucgaacucagaaauccgccugccucugccucccaagugcugggauuaaaggcaugcgccaccaccgcccagcagugguuuuauuuguaacuaacaguuuauaccaaugacuccccacaacuuuguguaauuguuuuuccacuguauuaacauuaaagggaaucuaaaaucauuacauuuucaguuucaugaucuuguuuaauuccauauagauuuuuuucauuaugacuuagacuuuuggccaagauuaaagguaugacuauuuuucaaaguaauauacagacuuuuguguuguguuuguuugagacagagauucacuguauagcccuuuauagucccaaacucccuauguagaaccaguuggcuuaaaacucacagagccugccucugcuuccugagugcugagauuaaaggugugugccaccacccugggcuguuuugguguuugguuguuuggaaacaaagcuauuauuacccaaguucucaauaagugaauaagggaaccuaggaaaaaaauuaaagccaccccugaagucagauguaaugguacacagacuuuaaucucagcacuuuggaggcagaggcaggaggaucucugugaauuggugaaaaaccugggcugcagaguuccaggccaaguaggacugacuaccuacccagugaggccuugucacagaaucgguuacuugcucagguuuucuuugucuauuauucucauugaaaguaucauuguuuaagcuagguggugguggugcacccccuaaucacagcauuugggaugcagaggcaagcagaaagaucucugugcuggaggucagccuggagguccauagagaguuucaggacagcagagcuacacagaaaagccuugucucaauagagauagauagauagauagauagauagauagauagauagauagauagauagauagauagaugacaaaua

SEQ ID NO: 9153 - RNA, 4378 nt, Mus musculus
caccuuuuaagauuuuuuuuaauucgagugcuuguacaugcuuaugaauaacaggugccauauaaauccccccacugcuaagcagcuagucaauccuagacaaaccuauugcaaacugaaaagguccuacuuuaacugcccucccuuuaucuucucauauugcccuucucagaaaggcaguucuggaaggagccaggcauauacagaacucaaagggucuauuuauuaggaaggaaacgucagugcuuuaucaaagaugaagagguuagaaagagauggugggauggagaacccucagcugggacacuucuuggccacaaugaggacagcagaaggcacgaguccuaaagauggaaaagaguuugaauuacaaggauacuuagggccuucaaauuucuggacucuauaguaugaguccauuaaaccccuucuaucccaacugacuacccacccuauccaccccaacugccccucauuccuuuaagcgcuaacuccuggucucacauaacauacccaguuccugcagaggccguuccauaucagccucugagaaagcccgucuggggaagccacugagcaacugcacaggguccugguccuguccaggcuccuccccacggugaagcuccacguagagccucacagcugccagcuguucccgggcccggaaagucugggucagugaagucccaucaggcagccuaaccuaaaaggcaagagaaagaugcaguacuaugagcacugaaacugagugaggacuaaguaugggguggcuuaugccuaaagccucagcacuuaggguuaacagcacaggcagauuucucaagauaagccugguuuacacagcuucagggcuggaagaacaaauucaaggcuggcaucagguacacacacaagccccugucuuaaaacagaacuaugacuaagcagggugaggccagauaauggcaaugccuauagucacagcacacagaagaaacaggaagaucaccagaagcuagaggucagcuugaucuucauagugaacuccaggccaggacuguguagcaggacccaggcccaagaauaaaauagagcagagugguggcacaugccuguaauccuagcacuuaggcagagggcagggauagcucaaaagucaagaccagucuagucuacguagugaaacccugucugaaguacccaagaaaggaaaggagguacuagagcuggcucugcuucccuuggagcaucugaaccaggacaaauacuacuuaaaggacccgaugaacaaccacucaugcuccaccgcagcaggugaugguaauggauucgauaccucacaagacaagauggaauuacuuuuaaaagucacugugaggaccauauuaugaaaauagcuguguaaugaaucuaaaacugcuuaguaaggaugaaguaaggauuuaaauaagaugggcaggugaaauuugaucuuuccaaagaguagaggagauaggauuucaaaagucauguacaaagaagggagagauuuggcaaaggggacuuaagcgugaacagcucugggcugucuggcacuuuauaagccaacacgggauuccagaagcaagacggucacuugaaaacaguaccuguauacgacacuggucauacucccgcuuaguagggggcuccuggcugggagaagaaggaacaggaccugggucuguugcugguggggaugaccgagaacccacacuaccaccauacugaaagacaaaauggaacacuaccucagagggagcacacuagucuagcauguauaaagggucacccuccaguacaugggccaaacacacacacacacacacacacacacacacagagguuuggcaguucacagcuuuuaguuagaguacuuggaaggcugacgcaggagaauacuaugagucugacacuagucugggcuagaguaaaauugccucaaaaaaaucaugcuaagcacacuuuaaggaaauuaacccacauacuccacuauacccagacuuucuaaucacccaccuucuuggcucucucugcuuugucccuuucaauuuuuucucgaacccuuugucuagaauagagacaggaagaaaauaggucagacauggacaaggcaaaucuucauuucuuucccaauuagcgaccaaugagacuucagaccuggcagcuaacucuucagccuuuucccuccugcgcuccuccgcagcccggcgcaucucaucuuccugcaguuucugucgugcaacugacagcucuugcccuugucuccuccgcugcuuuucucguucuaaagcuucucgcuccucucuuucuucacguucccgcugcuuuugugccacaaguuccaacauucuguuuugcagagaagaaagagguaaaguuggacauggagugggaaggugaguuuagacugagaaauuaacaaaauaagggaauacgggcuccaagacagaggaaaggaaacaaaaccaaaacaguaauauaaagaggacaagcagggccagaccuggugacacacgccuuuaaucccagcacuuggaaggcagaggcaggcagauuucugaguucgaggccagccuggucuacagaguuaguuccaggacagccaggacuauacaaagaaacccuaucuugaaaaaccaaagaggacaagcuaggugguagcagugcacgccuuuauucucaguguucagaaggcagagacagguaaaucucaaguuugaggccagccuggucuacagagccaguuccaggacagucagggauagagacucuuggcuugaagaaaaaaaaaaaaacagaacaaagccaaaaaaaaaaaaaaaaaaguguaguuuaaagguagagcacaauauaucaugcauagacccuuguggguuuuucuuucuuucuuucuuuuuuuuuuuuuuugguuuuucuguuuagcccuggcuguccuggagcucaccuuguagaccaggcuggccucgaacucagaaauccgccugccucugccuccgagugcugggauuaaaggcgugcaccaccacgcccagcguggguuuuucuuauuguuguuguugguuuuguuuuuaaagaaagggcauagugaugcauaucuauaaucccugcauuugcaaaggagaggcaagagaguugggauuucaggggaaucugcagccacacaggaguuugagaccaguccugagcuaugugagauguuuccuggugacuugcagcacacccucaaaaccggaaaggucagguucuaugaucagacuuguuuguauuugagaggaaggaagaugacccaugacccuugguaaagugugucacugggcuaugguggcccaggccuguaaucccagcacuagaagaauguggcuucgaauuuagccuaggccgcauacgggguuccagcgcagccugagguacacagcuggacugcgucucaaaaaaauaaugcaaggcacagugaaggccacaucucagcacucuggaggcggaggcaggaggauccggaguucagccugggcaagaguuaggcagacuccaaacaaaacacacacacacacacacacacugaacuugccagucaccucuuggucuguucuugucucuccucuucagucaaaaugggucugcuuucuccagcagcagacccagagccugcaaacaagcaaccaggauuaguauuuagaauaagaucauucugauuuucucggggcccuuucaaggucucuagaaucacaagaugucucccagucaggaccuucagggccaacuugcucugagggcguggguucucgucccaggacauggcugaggggagucuccagaggcucauccacaucggggucgucuucaugcuccaucagccugcgcggagaaaguaggcagggguugguuagccuggaggccaccuugcccagcggcucccaaacucccgccacccgugcgggucgcccgcucaccaauccaucgcagccucgaugcccugguucccugugagggccagagccuucucccugggggcagaaacaccgugaauagcgcccaccagccauggugacagucaggccggccaggcccgcggccucccaccaccggcuagggggaggcucccuuacgcgcguccccugggaaagcccaucucgaugaggcucuccagagccgucagcuccgccauggcgcccgccuccgccuccgcggggaccugcggggaccagaaggaagaccgcaagggucagcccggggcgacuccgcccgcgacgccgcccucccggcgcucgcuaacucacggggcgggagacccagggacgaggggggaguagacagugaguggggagagcggaggggaagcggaagugcccggucuguuugugucacguggaggcag

SEQ ID NO: 9154 - RNA, 924 nt, Mus musculus
ccgccccucuccuaggucgcucuagcccgcauagggagcggugagaugucauggcuuccuucuaggcugcgggaggaagcggacggcaccucuuuuguaguguaauccgccauggagguggcucguaaagcacuuguggcaguugcagugcuaggcgggggagcuggcguggguucuauucuguuugcucuugugaccccaggagaacuacagaagcagucgaugcugcagguaaaaacaaccggacuccccgagcugggugugcgugggacgagccccugucuuuucgcccagaaugcaaacauccuucuugcccgcaggagaugccggaaagggacucgcggcgcagggacgaagcagucaggaccacggaacuggugauggcuacccugaaggacgccgcagccacgaaggagaacguggccuggaggagaaacuggacaguuagcggggauggcaggucagcaugacaccagagcucgcccguggucacgggaaccuguaaggcuccuuucuuggugcuccggacauggagucgggagauacaccaggacucucuccaagucacugggaacugcgguugggggaacgccuuuaaagagcacaucgccugacagggucggauguguggaaccaacggaacuaauaaaugcaguucauccauuaaguggauuucgcagcuggacaucuaaugcuuagagagcugugagagagcgcaaugugcgcugaagaccuaggcaacugcaugccauccuaccccugagaguucuuaaguccaauaaguuuucugacuauucaaaauaggucauaugaucuaaguuugcuucugcaacuguuggguaaaagacuuuaggaaaaagucugguuuuguaugucacaauguguguugugugaaugaaaaaugaaagucggaagucaccgaac

SEQ ID NO: 9155 - RNA, 3645 nt, Mus musculus
ugaacaacuucuucuucagcuccugcggaagaaaaagaugcgcauguaagguucugcacacccacccgggauccuccgcaccuaacaaccccagccccuaacuaauccuguuuccaaagaggaaaaugccgggaagcaaagggaaacaaagacgcaguucccacucccacaguucagucaccguccggggacgauugaucuuuccucccggaggugccauggcuacacuccgcggcucauuccaaaagccgcacuuccgcuccgcucacagguuccgccacacgcaaaagaccccgcccucugaugccuccgaaccaaucgcagcuuggaggcgggcaccagggguauauaagguuguuccgcgcguugcggggccuuuccaagggugguuuucacgugagucuugauuuugucuuuauaugcgagggaacuacugggaacugggccugacuuuguagauccuccuuuucuuggcggggaccgggcgugcggucccgcuccccguaauguacggagguagaagaaagggcucuggcccucucggcguuaugucuucggugcuugcggcuucccguucgcggguucuauccucagacgccggaacacuuaaccgugcagaaauguagcuaggucccgcaguccccucuggguuacucaacgcuuuuuauuuuauuuuaggucgacauugacgcucccggagugaugguuaacauuuucuuugcuguuuauuauugaaucaauaaagucugugaacccuaaggacccuguguucgcuaccuuuuuuuucugcgacucguaauuugcaaaucuuuaggaccgaaagcacauguugggagugauagugacuauucacuaaagaucucuggucgaucuuguggggggacuuaauaagcuaaaucucaaccaggauguaaaucuuuaugaguauagaaagugcgcuccuaaaggcaugggaaucaaaccuguaguuaugguaaaaagccuagcguaauggugcgcacguguaaucagcagaacuaaccugggguagcaugcacccuuaucuucaagcuuccuggcauuuaaacuggcgguaggcacagcuuucucacuaagauauuggaaguaaaacuaggaucucaauccuccacaggcaugcccuguggauguucucgggguggacuugucuccgugcugggaccuacauaaacagccuuauacaaggaggccauugccauucccagugcagaaucugggagcccuagcauccuuagguuccucacagcucuccagggauaauuguugcuaagcgagauuugccugaggauucaaggacccuccuuuucagcugcccuacuagaaguaagaaaaaaaaaauccaauggcuggacuggguauaaaaauuaagcccuaaaccgggcaaugguggcccacacauuuaaucccagcacuuggcaggcagugacaggcagauuucugaguucaaggccggccuggucuacagcgugaguuccaggacagccagggugauacagagaaaccuugucucgaaagaccaaagaauaaaaguuaaggccuuauaagacauucaguuaaaucucaaaagauuucugagaguuuccauucugcuuuuguuggucaaacauagaguuggaauuuugccauuguaugaauagcuaguaauugagaguguuuuccugguuugcacaauuuguguccugguucauaaaccuggagccugaggguaauacuggguuaccagguggggagaccugacaucauuacuggcugggcucaaucugaacugcagagcuggugugaauuguguguccugcagcuuagaguaagccaaagagcuuugaaaacaauaauaauggagaugaaauuggaggaaaaaaaaaaacaccaauacuuacccccaaaaguacugagaggugggaaauggggauauuccauaaaucguguucuauagaugcaggacccuguugggucccaaagaggacagagauugggaguuuccugacccucuguaucuucaggaauccagaaggcaucuuguucuugaccccagccaaguccaggguuuauuguucuuaaaggagaugugggauccugugggauccaggcccaaccugggagaagaguaaauauucuugauaugcugugucuuuaauugauuugagacaaggucucuccauguagccuuggcuggucuuuaacauguaacaggacaagcuggcuaccaugccugacccagauaaauaaagauuuaguuguuuuagugugcauaaauguuugccauaugcaugucugguacaugaggauguuagaagaaaucugauccccuagaccuggagcuacagaugcuugugaacuaccacaagaguucuagaaaacaaaucuaggccccucugcaaagguagcaaguucucuuagaacugcugagccucauuauuugugugugaggcaauagaguuuuauucuaccuuuaauccaguaccgggucaguggaacuagucaaauuucuaugagauccaagcccagcuugugggagugggguugguaauuugugcauauuuguauuaggaggcagagacugacaucagguaucuuccucaauugcccuucacuugauauacggagagcuugccuauggaguuagucuagcuggguaguuugcuugcuccagggaucucaaccucuagaguacacugcgauugcggguaagcugucaugcacaacuggucuguccauauagauaacagggaucugaguucaagugcacaugcuuucagaacaagcacuaccuacugagcugucccucuaucccuauucucucauuuauaaagggaaauugucuccuuuaauugaguuguucugaaaacucuuaaaaguauuuagcauugugacuggagcauaaugcacacacacacacacaaaacccaacaacucuuuauguuuuuguuuuuguuuuucgagacaggguuucucuguguagcccuggcuguccuggaacucacuuuguagaccaggcuggccuugaacucagaaauccaccugccucugccucccaagugcuaggauuaaaggcgugugccaccacacccggcaacaacuuuuuaauaacaacauacagccguucauuaaccuccaaaauguuaauuaccucuagauagauacaggguaauuacaucaucuuccuuccccaguaaugagccauuaaaauauuauuagacaccagcaagauccgagccaugcaagauaaauaauaaaucauaucuccagaacaaaaagggacaaaagcaaauuaaggcuacaggugaagcucaguagcugauaaauuaccuaacaugcaaaaggccuucauuuguggggcuggucaaacagcuuagccagcaaaagcucaagugagccaaguaucagggugcuuaauugcuaagacccacauccaucguuguccugcuuaacacagggucucaaugcauagcucugguuguucugcaacucgauguguggaaacucagauccugccucugccucgaagugcugggauuaaaagugugcaccaccaguggcccagccacauaaacauuuuuuaaaaagugcuuuaaagcccuggguucaauccucaacaguacaaacaaaggaaaacaaaaaccaugcaca

SEQ ID NO: 9156 - RNA, 18706 nt, Mus musculus
gccggaaggggcgggcacuaggguacguggcucaacgugcacaggggcggguagguucgggucaaggagcaaacccgguacaagauggcggcaauagcggcaguggcggcgcguaggaggcggugaggagcccggaacccgggggcgcguccggacggcccuagaucccccgagccccauauugcuucuuuuuguaugccuucccaucacccugcuacuucuggccucgcaacgggcucuuuguccucguggugguggccucuggcuacagccucccagcggcagauucacgagucgcugcggcccuugucugugggguuccugaaucucgccgggcuuagaaaggcugaagcugggugcugucuucggucuuguccgcucccagccgccccuucucccuuggcgguucgggguggucaaugcuuucgucuccuuccugcagugcgcagggcugucgaggcagguagggggacgaaaugcaucccagccuguaaaaaagcagccuguugccacacugcuccuuuuucagguuggaagcaauacgaugggcagaucguccuguauuccuuccuugcccucccgaccagccugggccaguuucauuaguguucauuugcugggcacggcuggggcaggguccaguaaguucacagucugcauggauaauguugcucaaacacaacauguaucaaauaauuuggccuguucucuggaguuuuguagaaccuuaaaaaaagcuugaaaacacaucagcgccguaaagcgcgguacaccuaacggauguaaagggucgggagaggcguguacugucgacagcaguguaaaaagggugaaucauauacucaaguucuucuccaauaaacagauguaacuuacccuaaaguucauacuugacuuagcucaugaacaccucucguuugggaugcuuaaggcauuccuagagccaacaagucauguugaaaauauucuuuaccaaucauuuccuuacugacaucucuccaaaccuauuuuaaagacuugaagauaggguuccagggaguauuuacgagcuaaacugcucacuaccgcuacauaaguagccauuccucaggacccaggcuguaucaaugccuucugauuagauuuuucuaguagcauugucuucuguuugucuuacagguacuucuuccuccaaagccuagcacgcuaguuccuaguguuuucucacuuugcuggcugccuuuuuucacuacugguggcugccugccagcuuuccaaaauuuccugcuucuagggaacuuuauuaacugauccccuucacaauuuccuuuuggugcuucuggggaucaaacaggaccugcauucaccucacuauaugguaacuuucuuuuaccuuccaaguagauauggaggcuggauaacuguguaugauaagcccuuucuugguuuuauugcuuagaagaaccauaucuucuguguugccuugccccaacccccuucuuauucauuuauauaaugagacaaggucuugucaaucuaggcuugucugaccucgaauucacuauguauguggaccaggcuuggcuucaaaccuguaagagauccaucugccucugccucugucugccucugccucaaagugcuaggauuaaagggugugcaucauuaugccugacuucccccuuuuuuaaaaugaguuuucuguuuuuaacguuuauuuucccagugugaguugugugcacauguaugugaguuuaccucuguacauguauggaaugaguugcuuuucuccgucccacauguggguccuggauaaucaagcuuagguaauuacacguggcuacaagugcucuuagcuacuaaaccuucuuuuuuuguuuguuuguuuguuuuuguuuuuucgagacaggguuucucuguauagcccuggcuguccuggaacucacuuuguagaccaggcuggccuugaacucagaaauucgccugccucugccucccaagugcugggauuaaaggugugugccaccucugcccagcuucuacuaagccuucuuaugaguccccucuguacucccuggggaacacaucuuaguguguuccuguauugcuuaaaucauagucacuggaagaacuuguuuaaaaggcuggugcuauaagcugagaauguagcuggauguagccuagcaugagugagacccugaguucacucuucaacacugcaaaaaauuuaaauaaaacuugugguccaagguuuggcaguguuuguuuaauacauacaacaaguguuucuuggauuucaagaugggguuucacauagccuaggcuagcccuuaaauuuaauauguagcuaaggaugacugaacugucuucuuguuucuacuucccaaguacugggauuauaggucuguacuaccacacuuggcuagguucucuuuccucccucccucccuuccccuuuuacccuucccucucucccuccugcucauacucaaucaguuuuucucuccuuuccuuuccucccucccucccucccucccucccucccuuccuuccuuccuuccuuccuucgggguuucucucuuuagcccuggcagucauggaacuugcugugaagaccaggcuggccucacaauccugucuuugccugggucacacauuaacagacacuaaaaucugagagucccuuuuuaggaaucauuuaguagguaaauaaccuccaaacuaaaaucuuauuauuauucuuuauguguuuuuauguuuuccuuuccuacaugcaugucugugcccccauguguaugucugaugccaaaagaggguguuggauccccugaaacaaauuacagaagauugaacuggcauguggguacuaggaaucaaacccaggcccuuuugaagaacaucgacagcuacuguucuuagcuacugagcugucccucuagccccaaacuuacuuaaaugagguuacuaaaccauagucuuucauuugaugcaccuugugggagugacaguuuguggggaccuggaugugaggcucuucaguuuagcacgucugcucugcuuugcugacgaucagugugcugugcugugcacuguguggaagucauggucguagccacagucagggcuaagcuccaggcucuucaccucugcguagcuguucaaaagucauggcugauuauuccuguauggcugaauuuuccaucuggaaaaaaccuccugaccuaaccugacuaagaaaaacaaugaaagaaagggggaaaauaaauguauggaaaguaguuuugagucuugguuacguguuaggguuagggggugcuuauuuaugcauuaugauuauugagauagguucucacugugcugcucauauuagucucuccuaugcucaagugguuccuaacucuggcccuagccucccaaauagcuguguacugcaagcauauagcaugccauagagaguuuaaacagucacuauuuuaggccaauuaaaucagucucugaagguguugcuaggguauugauucuuuuaccacugcagucauuuuaaagcuagggaugcaucgguuagcuaggcucaguguguuuuucagcugucacucugaccuuagugaugauggugauuuguuuugaaguugcagaacuguacaucaaaggaacugggugucuagcguucuaggaccuuaggaguugugauuagcagauugacuccaucugaugacuuaccccugaaaggcauaguuagcuuuguucuugugauguacacacaugguacaccauuuccuuugggauuggcuguuacugcuccuuuccucugagaggcugauguaacuacagucaguacucggccucuaaaggccacacagacagacuuuguccacuuacucuuggguuguuuuuucagggacagugugaacaaaccaucucuucaagacuaacuuuucuuuuucuuuaaaaaaauuuuccuuugagacaggaucucacuguauagucuggguugaccuggaauuuacuguauagaccagacugaccucaaauucauagagaucugcccugccucugcuucucgaauccgagugcugggguuagaaaugugcuccgccauucccacucagaauugacuucguucuuggucuacuuggcuuuuuuccuaauuaauaggauugcuuuuaugaguugucuguuaggguuauaucaagaaggugaagcccuucuugaccagaguguuaacuguucuucuugucuuuccauaggucuugguuaaguuuggugcuggcauacuuaggggucugucuggggauuacacuugcuguggauagaagcaacuuuaagaccugugaugagaguuccuuuugcaaguauguuucuagaagaggugaauggaaaguggggaccugggaggugugugugggaggugaggugggcuguguaagaaagauaauuuuaaguagagucaccuaaggauauugagaugcucucuaaccuuacuucccaacucuugcauuugacagacggcagcgaagcauucggccaggccucucuccuuaccgugccuugcuggacacucugcagcuugguccugaugcucuuacaguccaucugauccaugaagucaccaaggucaggcaagacaagaaagagugguagggauggggaaaugggugguaacuugggaaagaaaaacuuguaaauaaaugucuugugucaggcuuaucuugagacuuuuacuuuuuuauguuuaugaguauuuugccuuccauguuggucuuuguacaauuguguuugcagugcccauggagaccagaagaguauguuagaucuacugggaugugaguuacagaguuguuucaagaacuggaguuauagaucaguaugugacugcuaggacucaaauccagguccuuuggaagagcagccagugcucuuuaauguuugaaccaucucuguccuggagacguuuaauuuggaagaaaucugaucucagguuccuuaggccaaaacauuauaaacuuaaauuugcaauuaaaaaaauuuuuuuugcaagaauuuuuauaggauucaggaaaagagagaacacuaguucuguguacaaaucaaagaacucagaaagagagaauauugguguguguacaaaucaaacauuuaaguaaaucauaaauuuauuucacaacaguucuuugguacagaaauaacuuuacugguuuuuguuuuuuugucuuuucuagcaggguuuuucuguguagcccuggcagaccuagaacucacuguagaccaggcuggccuugaauuuacagagauccgccugccucugccuuccgagcacugggauuaaaggugugcgucaccaucacugucauauuuuuguaagagcagaaaacuuuguauguauaguaaaaggaucacaguugauaacacacagagucuccagucugagccauagugguuuaggcaguguucauuggcauugugugccgugauggcauuugaaguacuauguuggcauauaaauauaguguguugagaaccauggcuucagagaaguugggcgauguaacaugggugagcacggcuaggaaaagcuuagguucauuaugaguuugauuuucgguuuuguuuauuuuuguaucauguaguuucaggcugucgucauacuaacuuuguagcucagaaugacuuugaauuucuaaccuucuuauuuucauuuucugaaugcugggauuacaggaguguauaucaaagcagguuuuauacugugcuaaucuugaacuaggcaaguacacuaucaacugagcuucauuuuugauucugauuaaaauuuuuccauuacauauugagaaacuacuugucagguuuuucaugacaaccccccuucccccauugaguuauaccuugucauagggguuacaaucuauaguauaggaaacuggggcaugccuguaaucucaacacuugggagacagaggcaagaggaucaagaguuuuaagaacagcagcaaucaguugcauaguaaguucaaaaccagcaugaguuacaugagauccuguuucaaaaaaaaaaaggcuagcaggcaugguggugcauaccuuuaauacugagaggcagagauaugcagaggcaugaauuucaggauagcuugggcuauauagugagaccuuuuguuaaaaaucaaucaagagacaacaauaugaacuaaccaguacccccagagcucguaugucuagcugcauauguagcagaagauggccuagucggccaucacugggaagagaggccccuugguauugcaaacuuuauaugccccaguacagggaaacgccagggccaagaagugggaguggguggguaggggagcagggcgggggggggggggugguauagggaacuuuugggauagcauuugaaauauauaaagaaaauagcuaauuaauuaauuaauaaaaaaucaagagaacuggagagagggcugaauaauuuagagcccuuguugcuuuuuguuguuuuuugagacaaguuuucuguguaugguccuggcuauccugggauuuacucuauagaccaggcuggccucuagcucucccgagugcugagauuaaagguguucaucucuacuccuggauuucaccuauuguucuuaagaagaccaagauuuguuucccagcacucauaugauggaucacaaaauaucuaaaaacucuuauuuccaagggccaugcugugggcaccaggugcacacaugguacacauauauacaugcaggugaaacacuuacauacaaaaaaacccaaauuaaacaaaaccaacaaaaccuugcuuuuaaaucaaagcuguaggcaaaaggcugaggagagacgcuaugucauuacuuagaugaugaugggguggguuuagucucuccagcuucaggcgaguuucucuuucugcaggugcugcuugugcuggagcuccagggccuucagaagaacaugacucggaucaggaucgaugagcuagagccccggcggccucgauaccgagugccagauguuuuaguggcugacccccccacagcuagguaacguuuucccgagaagguaucucucugauugcccuuuuccuucccaaggaaucugggugguaaccuaguuucucgcaucagagaagucgagccucaucuuccagcccaccccgcuucucuucuuccucugucuuacuuccucucacuccauauucacucagcagacaggugaaguuuugucuuccugucaggcuuaggcuagguaucacuguuauaaagaagaucacaccuuuguagucugccagccuuuuuuccucuuuuuuucccuugguuguuuagaauacaacuguucaaauaucuauuuuacauuuuuucauacauuuacauagaugauaggucuggcuguaucagucucgcucucucucucucucucucucucucucucucucucucucucucucucgggagacagacucucauucuguaacucagguuugccuggaguacaguauguagaucacacuuaggcuaggcgggcugaccagugauccacagcauccaccugacuucucugauacugggaugauuaugugaagcuaccacacugcauuuuuaucugcuucuggggauuaaacucugcuccucaugguugugagucaagcucuuugcuaacugaucucuuuaccaggccuuaggccuuaggccuuguuuauauguggucuuuuggguuuacuguugugugagauaauaguugacagcuuacacccauucaucucuuuaugugguuuguccuuacugccuuauagaauuuguuaaucuugagucuuuaccauuuauauauuguggguaucuuuuccuagguuguaaccuuuuaauuuacuaaagguaucauuaaagaaaaaaagaaaacagcuugagauuaaagcugcaacucaauuauagaguacuuugguaggcccugagcugaaguuauucaagaaaagcaaaucgcaguaguaggucuggagagcuuuuagcuccgagguagagcacuugcugacccgugcaaggcuccaguguccaucuccuccacacacaccuacacuucauaauuuguagugggguuagauuuauaggaaaguugaaggaaugauuuccuuugugcccuuccuuugugucuugcuaacauaacugucauuccuuugucuucccagaugaauugguagcacugcacuaucaaccaccauauauauuuauuuggguuucuuuagguuuugccaagucuacuuguucugcucuggagccaaaacaccaugcagcauucaguugucacacuucuccagguuucucuggaaugagacaguuucuuagacauuuaauauucuuuuugguguuuguuuguuuguuugguuugguuuuuuuugagacaggguuucucuguguagcccuggcuguccuggaacucacucuguagaccaggcuggccucgaacucagaaauccgccuaccucugccucccgagugcugggauuaugggacuaaaggcgugcgccaccacucccggcuucccaccuacauuuuuauguagguucuaaggauugaagugagguccuuuugcaagcauuuuacuugucugucucuuuagcuuuuugcuuuaaucuuuaagagucuuacuaugcucuggcugguguggaacaugcucuagaccagaggcagcccugucucuucuuuccaagugccggguuacagaugugugcuccuauaccaaggcuugauuuuagggccaguagggugguuuaguagguaaagauccuucugcugaacccaaggaccuaaguucaaucuucuacacucaacaugagaagaggaaaagucagacucccaaaagucuccacaaaguaaauuacaaaaaauaauaaguuuuguucugaguauacuggcauauauguauagguaugcauguaccauaugcauguagagguuagaggauaauuuggggauuggcuggcuucuucuacacuggucuuuggaacucaaacucaggucaaguuuaguagcaugcaucugccugcugggucaucuugccaguccccaaaaauguuuaaagagagaaaggcucuaaugaguuuguuuuucccugggcuaugaccugcugcugcuuguaacaggucucuggucuuugccuccauauauauauguguguauccccuuugaucucucucuucucuaggcuuucagucucuggccgugaugacaacaguguggagcuaacaguggcugagggacccuacaaaaucauuuugacagcacagccauuccgccuugaccugcuagaagaucgaagccuccugcucagugucaaugcccgaggacuuauggccuuugagcaccagagggcccccagggucccgugaguacaggguggggacuucagggaacuuacugugguagugccuagaaaugucacaaagucugguauuguacugugggaagagacugggugcagaacagccagauggggcaggagggugggagauacucucagugaggguaaagacagaucuggguugcaauuuucucuuucuuguacagaucaggaggcagauacuuuugucccugagcuauacacuaggcaccuccucugggaagucugccuggaucugcuuucuccuuccccuucucacaucaucacauuccccuaguguauuuucuuccuauuuauuuauuuauuuauuuauuuauuugcgguuucuuuuccccccaucucuggaaguuugucuacugaaacucacuuuuauguuucuguuuuuguguugguuuugugccuccucccccuucccuacucaucuccuccugcccgccccaguuucucggauaaaguuagucucgcgcucgguagcgugugggauaagaucaagaaccuuuucucuagguaaagccauggccacugguacuguaccuguuccucuuccucacccacccucacgcuggcccucuggggaacuugcccggaccuucuuauucccuccucuucaccaucuguccuucccccucuugguauuuggguccuuguuugcuguccccuggcugugagcccuuuggggggaagaugagugcuggaagugcuuacggaauguaggaagcuuauugcucugcuaagggcuggaggggugcucuguuucgcugugauuccuggcucucacuuggaauacauugagacucuggagagaacuguuagcaagcugccucugaaaagcauucuuuggccaaaccuuuugcagucgcagagugugucuggagaggcguuuuuuauggucugaccaacuugccuuucuaaaguaugaucaagaaaggucagauuuuuuucuaugauggcagcagagccaggacugguauuuagaacccaggucacugaaccaucuugcccaucucuuauagauaucaacagaggcugcugauaugggccuguauguagaaaguacuuccugcuggcauuuucuccucauuuuccucugucaguugucuccccauccuagcucacuggggucccuucccgagcuuuaacagucagucccuuccuucagugcuuucauuccuuuggacccucggcucucuauucccucaccccuccuuccauuagccccucguccccgcccccucuggauuggagcagacagcucuccuaccuuccaggcaagaaucaaaagacccagcugaaggcaauggagcccagccugaagcaacaccuggggauggugacaagguaaguugaagugccaggugguuggaguggagaauggggcugccugggaggccggagaguaaaggcccacaagaaaacugagccuguucucauccuaaaggaugagauuuagacccugagagugggaaaagauaacugggacgugaguggguaucaguccacuuuucuuacagccagaggagacccaggaaaaggcugagaaggaugagccaggagccugggaggagacauucaaaacacauucugacagcaagccuuauggugagaggcugggaaagcccuggacaggggcacagagguaucuugccaaacagaagcucuguaaaucauccuuuucuuucaggccccacgucuguagguuuggacuuuucucugccaggaauggaacauguguaugggaucccugagcaugcugacagccugagacugaaggucacugagugaguccgauaguaacacuaggaugggguuagaaaaggaggcagucagggcuggggauuugcucauacaguuguauauuguagacaagcauaauucccuucuuguaucugggcuaccuccuugcuuaugcacuuguuuuaaagaaagagacuuucguuuucucucagcuaugucuguggaguagcauuugcuuaagcuguagccuggccauugauuagccuaagucuugucugucuaccaccaggggcggugagccguaccgccuguacaauuuggauguguuccaguaugagcugaacaaccccauggcucuauaugggucugugccugugcuccuggcacacagcuuucaucgagaccugggcaucuucuggcuuaaugcugcugagacuuggguugauauauccuccaacacggcugggaaggugagggcauggcaugggagagauguggugagagucugccaugccuuaugcuagggaugcggaugugagugugaaaacacgaaugaauggcagaacuuauuugagagacagucauagucauugcuagguugccuucaugugaagccacugcuucucuggcuugagaagauucccuuguuccuuguccauucuguaggaacacucuagguugcagggguuaugcugccaaucucugggccuggagagauggcucagugguuaauagcacuggcugcucuuccagagaucuugaauucaguucccaacaacaugguggcucacagccaucuguaaugggaucugaugcccucuucugucugaugcccuuuucugucauucaggcauucaugcaaauagagcagucauauacauaaaacacauaaguaaagacgucuugaaagaaagaaaagagcucccagugugagggaagaagacagguauuaucagguuauuauaaggcagaggacuucgggagugguaaauggcaagcugaugugugguccgugaacgcuuccuugaggaaaugagacuuuucucucucuuuuuuuauuucuccccuucaguuuuucgagacaggguuucucugugcgguccuagcuguccuggaacucacucuguagaccaggcuggccucgaacucagaaauccgccugccucugccucccaaguucuaggauuacagggguagagacuugacucuuaaauuaaauuauagugagguguuaggagccagcugugugagacucaggagaaagugcugcuuuuguuucaaguuggcacugaaaagcugacuucccuuugucuccuucacagacccuguuugggaagaugcuugauuaccugcagggcucuggggagacuccacagacagacauucguuggaugucagagaguggcauuauugauguuuuccuaaugcuuggcccuucgguuuuugaugucuuuaggcaguaugcuagucucacagguaggugauauuuccauuucuggcuagcaagugcucuuaaguuuugcuauuucuucagcuccagugacccuuucauuuaaaccugcagggacccaggcauugcccccacucuucucccucggcuaucaccagagucgcuggaacuaccgggaugaggcugauguuuuggaaguggaucaggguuuugaugaucacaacaugccuugugaugucauuugguuggacauugaacaugcugauggcaagcgguacuucacuugggaccccacccgauuuccucagccccucaauaugcuugagcacuuggcuuccaagaggcggaagguaaggggguccuguagcuguguuuggucuucuugcauaggguugaggcaugguagucuccaccauuucuccuucuguucuuuguucccagcugguggccauuguggacccccacaucaagguagacucuggcuaccgaguucacgaagaauugcgaaaccaugggcuguauguuaaaacucgggauggcucugauuacgagggcuggugcuggccagguaggcaggcccauaauugaaggggaggcuauggagcagccaaagagguagagauauuuuguuauguuuugguuuugccucuuugggaauucagaguugguguuuucucucucaggcucagcuaguuacccugacuucacuaauccaaggaugagggccugguggucuaacauguucagcuuugacaauuaugagguaggaaagacuauccauaugccuucugucuuuucuacuuuuccuucaugaaucagcuuuucaguucaggaccauugcuuuuguuugaccuauaacauuucguggggacuugaagaucuuggaggauucugaaaaagacuugguucuggauuucuagaagcuuucuuucugacaguguuuacugucgaccgucguccucuuuuuuuccccccauacauaauugguaccuguguuuucaggguucagcuccuaaucuuuauguuuggaaugacaugaaugaaccgucuguguucaaugguccugaggucaccauguugaaggaugcugugcauuauggaggcugggagcaccgggacauccauaacaucuauggcuuauaugugguaaggaaccgggagaggaaaguuggcagacaaagggaggacaguaguuaaacauggagaauauauaguugucaaccagaugacagauggcauuuguucuucacucucuucucuuucuuccuagcacauggcgacugcugaugggcuaauacagcgcucugggggcauagagcgucccuuuguccugaguagggcuuucuucucaggcucccagcgcuuugguaagguuuggagacuagagcuguggcagcugugugugggaguaaaugccuguaauccuagcacuuaagguugcugagucaggaauagcuuuagucguagggcugccuaaacuguccagguagucuaggcuacccugauguguuuaguaugacucugucuccagggaagaguaagcaaauacagagguguaacacaaaauuaugaagaccagaucagaggagccauaguaucuuuggagagcugcacacugcaaccuccagcuguauauuuugacauaugaaugguauaucuaaaccucgcuuaagccuucuggcagggauggagggggagcacugccuagcuuaugcaaggccuuugcuaaguuccuaguaccaaaaaagaguuguguuuaacuucacucucaucagaguguccuggacacuugucuagugacaguggcaggucagaggauaccuagauaaaggcugaguuccuugcucuauaucaggcuccuuccccuuugacccuuuuaggagcuguguggacaggggacaacacugccgaaugggaucauuugaagaucucuaucccuaugugucucagccuggcacugguggggcuuuccuucuguggagguaagagaaggagacauuugggguuuugauugggauaaagucaaaggaccugggcaugaacaaagaauauuuauaugaauggcugccagcgcuucuucuuugccauuuugcaaccugcuccuucuccucucccagcggauguggguggcuucuucaagaacccagagccagagcugcuugugcgcugguaccaaaugggugccuaccagccguucuuucgggcucaugcccacuuggacacugggcggcgagagccauggcuguuagcgucucaauaccaagaugcaauccgagaugccuuguuccagcgauauucuuugcugcccuucugguauacccucuucuaucaagcucacaaggaaggguuuccugucaugagguaaauuagucaguggggucuguguagagucagauagaugacugggagauaaugaggucugguuugcaucucugggccuauuucuuucccuuuccagggccuuguuuguaagguuuuaauaugaauauggaagagaggucugaggauguaauucaguaguggaguuacuugccucuuaauguagaaagccaugaguuccgucaagccccaaugucaccaaaaaaagaaacaggcaaaugaaauggguaaaagcaguugcuaucaaauauaggaguucagucucuagaacaugauggaaguagagaauugacuccuagaaauugcaaguuuuuuucugaccaccauaucauggcauaugauccuccaugccuucaaaauuguaaugaugacaaugacgacgacgacgaugaugaugaugauaaaaagccuggucuuguuauauaugucuauaauacugaaauuuaggaggcugagguaugagguaggaggaaugaaaguucaaaaccagcuugugcuacauagcaaggcccugucucaaaaagagaguugccaggcugugguggcgcacaccuuuaaucccagcacugggaaccagaagcaggcguauuucugaguucgaggccagccuggucuacagagugaguuccaggacagccagggcuacacaaauaaauccugccucgaaaaacaaacaaacaaacaaaagacaaacaaacaaacaaacaaaaacaagagagagucauggaaagacuaaagggaacaagugugaguaauggaggcuaaccugaagaagauugcccacagugauaaguuauugacaagaauaagaaacaugaaguuacaggauuagguagucacaaaaggcacuuuugagaauauagccacauuaggaaccuguacaaugaaugaaguagguguuugugaucucagggaaggacauuccacagcgaggaggcugcaggugccaaaacacugaaacaagccagaaaaugagaaaagaaaagucagugggccuugggaaggaacugguagacagauugucauuaggaauagagaugaugcuuaugccccuaaagggccuugcaagcuaugugucacugaagugcucaaggaagccacugaaagacagagaacuguggguagaagaguggaguuagggagguaagagagaaaguacagugaccgggcaagguggaguucuguagcugcagcuaaaguccugaauccauuggcugaaagcuccuggauuucuccccagugcaauucuaauugcuagcucuuggaggagagcaucuuugaccucugagaauauaauggcuuccuuuccugucuugcuucuuuccuaggccccucuggguacaguauccugaggauaugucuaccuucaguauagaggaucaguucaugcuuggugagaaaugggaggacagcugguaggagguugggcuucagcuuaagaacaaugugugggauguguauguguggaguuggaguaacuguggcuggacuugugacagacagaucuucuaaugcucucuagacuggcagcaaaugcccucguucccuguuaauucugguauguuuuaggugaugcacuccuuauucacccuguaucggaugcuggggcccacggagugcaggucuauuugccuggccaagaagaaguaaguuacagaauauugugggcaaagaagcaaaagcauggaaccccuaugcacugagugauccaguaucuugucauccacaggugugguaugacauucagagcuaucagaagcaucaugggccccagaccuuguaucugccaguaacuuugagcagugugaguauaucucucuagcugccaucucuguuugcuuguacuucuccagaaggggagaaaauauauaauuuggggagucagagggaaggaacauaagaugcugaaaggccugaaggaguagugcuucacugcagcacuuuugccuuagauccccguguuccagcguggcggaaccauugugccucgauggaugcgugugaggcgcucuucagacuguaugaaggacgauccuaucacucucuuuguugcucucaguccccaggugaguuuccagugggugagagcuaucucaacuauugccuguuuucuaggacucaguccucuggaugugaaugaaggcacucccucuuuggcuuaaguuccucaccucuuccugcacaggguacugcccaaggagagcucuuucuagaugauggacacaccuuuaacuaucagacucgccaugaguuccuguugcggcgguucucuuucucuggcagcacacuggucucuagguaaugggguguccucuaugggccuugccuucaggggugcucagguucgcugugcuuuuguugccuuugaacuucgcuuuggauuaucuuccugcccauuucuccaauuggcauuugcuuuuguugccuccaguucagcagaccccaaaggccaccuugagacaccuauuuggauugagcgaguagucaucaugggggcuggaaagccagcagcuguggugcuccagaccaaagguuagugauaggucuggccuugaaauugggaaaagaagcagagguaggguugacaggguugcaaccuugcuauggagagguagccuauuauugacuguggugcuugccuuucuuccacaggauccccugaaagucgccuguccuuccagcaugacccugagaccucagugcugauauugcguaaaccuggugucagcguggcauccgacuggaguauucaucuucgauaacccaaggaacuuguucugaguugggaggaagggcaugaugguauugaguuaccuuuucuuuugccuuggaguuugacccuaccuagauuucaccuucuaauucuacgacccagauucugucaacaucugggcaagaugacagggcuguccuagggcucugaauuccacuugugaccuagucuuuccuucuguguguuaccaagcccuucauacucaguauccuguugcuguaacuggagcacagucauuugugaagaccaaggggccuugucguucuuuuucucuuccuuagggucccuaccuucuccuuagaccccaucuauucaagccucuuguuuguugaugccauuucuuggaagaagaugagggcagugaacauuaggguuccuuuucuucuucccuguucccuccuauccaaaaugcccauccuuucauuccuuccccugaauguccccuucucuguuccacugauacacugggaccaccccuuacuugguaagggacaaauggaucaagauugagguuccuggagaacguccucuuccuucucaucucaaccuugucuuccuguuucuuuccagagcugcugcauuucucccaucuuagagggagacgcuuccacacaauuaggagggcaagguuauuaaacuucuuuugccccucugguccccuugggacacucaagauagagacaugaguugugguuucacugaaucacggucaccuguauuuauugcugggaagaagacugaggguggggggagacgaucauguguacccagggguggcuucaagcccugguaagcggguugagggaggacucaggaaccaggagaacuauuugugggaauuuuuuuuacuuccucuggguucccaacugugacaaguuuugauaaaaaggagaaacaauaaaaaacgaaacaaaacauaaauaauaauuggaugucugaauuauacuuguaaacugaacaaaaucgcuccaguaaauaguggccuaccauuuuauucu

SEQ ID NO: 9157 - RNA, 18706 nt, Mus musculus
agaauaaaaugguaggccacuauuuacuggagcgauuuuguucaguuuacaaguauaauucagacauccaauuauuauuuauguuuuguuucguuuuuuauuguuucuccuuuuuaucaaaacuugucacaguugggaacccagaggaaguaaaaaaaauucccacaaauaguucuccugguuccugaguccucccucaacccgcuuaccagggcuugaagccaccccuggguacacaugaucgucuccccccacccucagucuucuucccagcaauaaauacaggugaccgugauucagugaaaccacaacucaugucucuaucuugagugucccaaggggaccagaggggcaaaagaaguuuaauaaccuugcccuccuaauuguguggaagcgucucccucuaagaugggagaaaugcagcagcucuggaaagaaacaggaagacaagguugagaugagaaggaagaggacguucuccaggaaccucaaucuugauccauuugucccuuaccaaguaagggguggucccaguguaucaguggaacagagaaggggacauucaggggaaggaaugaaaggaugggcauuuuggauaggagggaacagggaagaagaaaaggaacccuaauguucacugcccucaucuucuuccaagaaauggcaucaacaaacaagaggcuugaauagauggggucuaaggagaagguagggacccuaaggaagagaaaaagaacgacaaggccccuuggucuucacaaaugacugugcuccaguuacagcaacaggauacugaguaugaagggcuugguaacacacagaaggaaagacuaggucacaaguggaauucagagcccuaggacagcccugucaucuugcccagauguugacagaaucugggucguagaauuagaaggugaaaucuagguagggucaaacuccaaggcaaaagaaaagguaacucaauaccaucaugcccuuccucccaacucagaacaaguuccuuggguuaucgaagaugaauacuccagucggaugccacgcugacaccagguuuacgcaauaucagcacugaggucucagggucaugcuggaaggacaggcgacuuucaggggauccuguggaagaaaggcaagcaccacagucaauaauaggcuaccucuccauagcaagguugcaacccugucaacccuaccucugcuucuuuucccaauuucaaggccagaccuaucacuaaccuuuggucuggagcaccacagcugcuggcuuuccagcccccaugaugacuacucgcucaauccaaauaggugucucaagguggccuuuggggucugcugaacuggaggcaacaaaagcaaaugccaauuggagaaaugggcaggaagauaauccaaagcgaaguucaaaggcaacaaaagcacagcgaaccugagcaccccugaaggcaaggcccauagaggacaccccauuaccuagagaccagugugcugccagagaaagagaaccgccgcaacaggaacucauggcgagucugauaguuaaagguguguccaucaucuagaaagagcucuccuugggcaguacccugugcaggaagaggugaggaacuuaagccaaagagggagugccuucauucacauccagaggacugaguccuagaaaacaggcaauaguugagauagcucucacccacuggaaacucaccuggggacugagagcaacaaagagagugauaggaucguccuucauacagucugaagagcgccucacacgcauccaucgaggcacaaugguuccgccacgcuggaacacggggaucuaaggcaaaagugcugcagugaagcacuacuccuucaggccuuucagcaucuuauguuccuucccucugacuccccaaauuauauauuuucuccccuucuggagaaguacaagcaaacagagauggcagcuagagagauauacucacacugcucaaaguuacuggcagauacaaggucuggggcccaugaugcuucugauagcucugaaugucauaccacaccuguggaugacaagauacuggaucacucagugcauagggguuccaugcuuuugcuucuuugcccacaauauucuguaacuuacuucuucuuggccaggcaaauagaccugcacuccgugggccccagcauccgauacagggugaauaaggagugcaucaccuaaaacauaccagaauuaacagggaacgagggcauuugcugccagucuagagagcauuagaagaucugucugucacaaguccagccacaguuacuccaacuccacacauacacaucccacacauuguucuuaagcugaagcccaaccuccuaccagcuguccucccauuucucaccaagcaugaacugauccucuauacugaagguagacauauccucaggauacuguacccagaggggccuaggaaagaagcaagacaggaaaggaagccauuauauucucagaggucaaagaugcucuccuccaagagcuagcaauuagaauugcacuggggagaaauccaggagcuuucagccaauggauucaggacuuuagcugcagcuacagaacuccaccuugcccggucacuguacuuucucucuuaccucccuaacuccacucuucuacccacaguucucugucuuucaguggcuuccuugagcacuucagugacacauagcuugcaaggcccuuuaggggcauaagcaucaucucuauuccuaaugacaaucugucuaccaguuccuucccaaggcccacugacuuuucuuuucucauuuucuggcuuguuucaguguuuuggcaccugcagccuccucgcuguggaauguccuucccugagaucacaaacaccuacuucauucauuguacagguuccuaauguggcuauauucucaaaagugccuuuugugacuaccuaauccuguaacuucauguuucuuauucuugucaauaacuuaucacugugggcaaucuucuucagguuagccuccauuacucacacuuguucccuuuagucuuuccaugacucucucuuguuuuuguuuguuuguuuguuugucuuuuguuuguuuguuuguuuuucgaggcaggauuuauuuguguagcccuggcuguccuggaacucacucuguagaccaggcuggccucgaacucagaaauacgccugcuucugguucccagugcugggauuaaaggugugcgccaccacagccuggcaacucucuuuuugagacagggccuugcuauguagcacaagcugguuuugaacuuucauuccuccuaccucauaccucagccuccuaaauuucaguauuauagacauauauaacaagaccaggcuuuuuaucaucaucaucaucgucgucgucgucauugucaucauuacaauuuugaaggcauggaggaucauaugccaugauaugguggucagaaaaaaacuugcaauuucuaggagucaauucucuacuuccaucauguucuagagacugaacuccuauauuugauagcaacugcuuuuacccauuucauuugccuguuucuuuuuuuggugacauuggggcuugacggaacucauggcuuucuacauuaagaggcaaguaacuccacuacugaauuacauccucagaccucucuuccauauucauauuaaaaccuuacaaacaaggcccuggaaagggaaagaaauaggcccagagaugcaaaccagaccucauuaucucccagucaucuaucugacucuacacagaccccacugacuaauuuaccucaugacaggaaacccuuccuugugagcuugauagaagaggguauaccagaagggcagcaaagaauaucgcuggaacaaggcaucucggauugcaucuugguauugagacgcuaacagccauggcucucgccgcccaguguccaagugggcaugagcccgaaagaacggcugguaggcacccauuugguaccagcgcacaagcagcucuggcucuggguucuugaagaagccacccacauccgcugggagaggagaaggagcagguugcaaaauggcaaagaagaagcgcuggcagccauucauauaaauauucuuuguucaugcccagguccuuugacuuuaucccaaucaaaaccccaaaugucuccuucucuuaccuccacagaaggaaagccccaccagugccaggcugagacacauagggauagagaucuucaaaugaucccauucggcaguguuguccccuguccacacagcuccuaaaagggucaaaggggaaggagccugauauagagcaaggaacucagccuuuaucuagguauccucugaccugccacugucacuagacaaguguccaggacacucugaugagagugaaguuaaacacaacucuuuuuugguacuaggaacuuagcaaaggccuugcauaagcuaggcagugcucccccuccaucccugccagaaggcuuaagcgagguuuagauauaccauucauaugucaaaauauacagcuggagguugcagugugcagcucuccaaagauacuauggcuccucugaucuggucuucauaauuuuguguuacaccucuguauuugcuuacucuucccuggagacagagucauacuaaacacaucaggguagccuagacuaccuggacaguuuaggcagcccuacgacuaaagcuauuccugacucagcaaccuuaagugcuaggauuacaggcauuuacucccacacacagcugccacagcucuagucuccaaaccuuaccaaagcgcugggagccugagaagaaagcccuacucaggacaaagggacgcucuaugcccccagagcgcuguauuagcccaucagcagucgccaugugcuaggaagaaagagaagagagugaagaacaaaugccaucugucaucugguugacaacuauauauucuccauguuuaacuacuguccucccuuugucugccaacuuuccucucccgguuccuuaccacauauaagccauagauguuauggaugucccggugcucccagccuccauaaugcacagcauccuucaacauggugaccucaggaccauugaacacagacgguucauucaugucauuccaaacauaaagauuaggagcugaacccugaaaacacagguaccaauuauguauggggggaaaaaaagaggacgacggucgacaguaaacacugucagaaagaaagcuucuagaaauccagaaccaagucuuuuucagaauccuccaagaucuucaaguccccacgaaauguuauaggucaaacaaaagcaaugguccugaacugaaaagcugauucaugaaggaaaaguagaaaagacagaaggcauauggauagucuuuccuaccucauaauugucaaagcugaacauguuagaccaccaggcccucauccuuggauuagugaagucaggguaacuagcugagccugagagagaaaacaccaacucugaauucccaaagaggcaaaaccaaaacauaacaaaauaucucuaccucuuuggcugcuccauagccuccccuucaauuaugggccugccuaccuggccagcaccagcccucguaaucagagccaucccgaguuuuaacauacagcccaugguuucgcaauucuucgugaacucgguagccagagucuaccuugauguggggguccacaauggccaccagcugggaacaaagaacagaaggagaaaugguggagacuaccaugccucaacccuaugcaagaagaccaaacacagcuacaggacccccuuaccuuccgccucuuggaagccaagugcucaagcauauugaggggcugaggaaaucggguggggucccaagugaaguaccgcuugccaucagcauguucaauguccaaccaaaugacaucacaaggcauguugugaucaucaaaacccugauccacuuccaaaacaucagccucaucccgguaguuccagcgacucuggugauagccgagggagaagagugggggcaaugccugggucccugcagguuuaaaugaaagggucacuggagcugaagaaauagcaaaacuuaagagcacuugcuagccagaaauggaaauaucaccuaccugugagacuagcauacugccuaaagacaucaaaaaccgaagggccaagcauuaggaaaacaucaauaaugccacucucugacauccaacgaaugucugucuguggagucuccccagagcccugcagguaaucaagcaucuucccaaacagggucugugaaggagacaaagggaagucagcuuuucagugccaacuugaaacaaaagcagcacuuucuccugagucucacacagcuggcuccuaacaccucacuauaauuuaauuuaagagucaagucucuaccccuguaauccuagaacuugggaggcagaggcaggcggauuucugaguucgaggccagccuggucuacagagugaguuccaggacagcuaggaccgcacagagaaacccugucucgaaaaacugaaggggagaaauaaaaaaagagagagaaaagucucauuuccucaaggaagcguucacggaccacacaucagcuugccauuuaccacucccgaaguccucugccuuauaauaaccugauaauaccugucuucuucccucacacugggagcucuuuucuuucuuucaagacgucuuuacuuauguguuuuauguauaugacugcucuauuugcaugaaugccugaaugacagaaaagggcaucagacagaagagggcaucagaucccauuacagauggcugugagccaccauguuguugggaacugaauucaagaucucuggaagagcagccagugcuauuaaccacugagccaucucuccaggcccagagauuggcagcauaaccccugcaaccuagaguguuccuacagaauggacaaggaacaagggaaucuucucaagccagagaagcaguggcuucacaugaaggcaaccuagcaaugacuaugacugucucucaaauaaguucugccauucauucguguuuucacacucacauccgcaucccuagcauaaggcauggcagacucucaccacaucucucccaugccaugcccucaccuucccagccguguuggaggauauaucaacccaagucucagcagcauuaagccagaagaugcccaggucucgaugaaagcugugugccaggagcacaggcacagacccauauagagccaugggguuguucagcucauacuggaacacauccaaauuguacaggcgguacggcucaccgccccuggugguagacagacaagacuuaggcuaaucaauggccaggcuacagcuuaagcaaaugcuacuccacagacauagcugagagaaaacgaaagucucuuucuuuaaaacaagugcauaagcaaggagguagcccagauacaagaagggaauuaugcuugucuacaauauacaacuguaugagcaaauccccagcccugacugccuccuuuucuaaccccauccuaguguuacuaucggacucacucagugaccuucagucucaggcugucagcaugcucagggaucccauacacauguuccauuccuggcagagaaaaguccaaaccuacagacguggggccugaaagaaaaggaugauuuacagagcuucuguuuggcaagauaccucugugccccuguccagggcuuucccagccucucaccauaaggcuugcugucagaauguguuuugaaugucuccucccaggcuccuggcucauccuucucagccuuuuccugggucuccucuggcuguaagaaaaguggacugauacccacucacgucccaguuaucuuuucccacucucagggucuaaaucucauccuuuaggaugagaacaggcucaguuuucuugugggccuuuacucuccggccucccaggcagccccauucuccacuccaaccaccuggcacuucaacuuaccuugucaccauccccagguguugcuucaggcugggcuccauugccuucagcugggucuuuugauucuugccuggaagguaggagagcugucugcuccaauccagagggggcggggacgaggggcuaauggaaggaggggugagggaauagagagccgaggguccaaaggaaugaaagcacugaaggaagggacugacuguuaaagcucgggaagggaccccagugagcuaggauggggagacaacugacagaggaaaaugaggagaaaaugccagcaggaaguacuuucuacauacaggcccauaucagcagccucuguugauaucuauaagagaugggcaagaugguucagugaccuggguucuaaauaccaguccuggcucugcugccaucauagaaaaaaaucugaccuuucuugaucauacuuuagaaaggcaaguuggucagaccauaaaaaacgccucuccagacacacucugcgacugcaaaagguuuggccaaagaaugcuuuucagaggcagcuugcuaacaguucucuccagagucucaauguauuccaagugagagccaggaaucacagcgaaacagagcaccccuccagcccuuagcagagcaauaagcuuccuacauuccguaagcacuuccagcacucaucuuccccccaaagggcucacagccaggggacagcaaacaaggacccaaauaccaagagggggaaggacagauggugaagaggagggaauaagaagguccgggcaaguuccccagagggccagcgugagggugggugaggaagaggaacagguacaguaccaguggccauggcuuuaccuagagaaaagguucuugaucuuaucccacacgcuaccgagcgcgagacuaacuuuauccgagaaacuggggcgggcaggaggagaugaguagggaagggggaggaggcacaaaaccaacacaaaaacagaaacauaaaagugaguuucaguagacaaacuuccagagauggggggaaaagaaaccgcaaauaaauaaauaaauaaauaaauaaauaggaagaaaauacacuaggggaaugugaugaugugagaaggggaaggagaaagcagauccaggcagacuucccagaggaggugccuaguguauagcucagggacaaaaguaucugccuccugaucuguacaagaaagagaaaauugcaacccagaucugucuuuacccucacugagaguaucucccacccuccugccccaucuggcuguucugcacccagucucuucccacaguacaauaccagacuuugugacauuucuaggcacuaccacaguaaguucccugaaguccccacccuguacucacgggacccugggggcccucuggugcucaaaggccauaaguccucgggcauugacacugagcaggaggcuucgaucuucuagcaggucaaggcggaauggcugugcugucaaaaugauuuuguagggucccucagccacuguuagcuccacacuguugucaucacggccagagacugaaagccuagagaagagagagaucaaaggggauacacacauauauauauggaggcaaagaccagagaccuguuacaagcagcagcaggucauagcccagggaaaaacaaacucauuagagccuuucucucuuuaaacauuuuuggggacuggcaagaugacccagcaggcagaugcaugcuacuaaacuugaccugaguuugaguuccaaagaccaguguagaagaagccagccaauccccaaauuauccucuaaccucuacaugcauaugguacaugcauaccuauacauauaugccaguauacucagaacaaaacuuauuauuuuuuguaauuuacuuuguggagacuuuugggagucugacuuuuccucuucucauguugaguguagaagauugaacuuagguccuuggguucagcagaaggaucuuuaccuacuaaaccacccuacuggcccuaaaaucaagccuugguauaggagcacacaucuguaacccggcacuuggaaagaagagacagggcugccucuggucuagagcauguuccacaccagccagagcauaguaagacucuuaaagauuaaagcaaaaagcuaaagagacagacaaguaaaaugcuugcaaaaggaccucacuucaauccuuagaaccuacauaaaaauguaggugggaagccgggagugguggcgcacgccuuuagucccauaaucccagcacucgggaggcagagguaggcggauuucugaguucgaggccagccuggucuacagagugaguuccaggacagccagggcuacacagagaaacccugucucaaaaaaaaccaaaccaaacaaacaaacaaacaccaaaaagaauauuaaaugucuaagaaacugucucauuccagagaaaccuggagaagugugacaacugaaugcugcaugguguuuuggcuccagagcagaacaaguagacuuggcaaaaccuaaagaaacccaaauaaauauauauggugguugauagugcagugcuaccaauucaucugggaagacaaaggaaugacaguuauguuagcaagacacaaaggaagggcacaaaggaaaucauuccuucaacuuuccuauaaaucuaaccccacuacaaauuaugaaguguagguguguguggaggagauggacacuggagccuugcacgggucagcaagugcucuaccucggagcuaaaagcucuccagaccuacuacugcgauuugcuuuucuugaauaacuucagcucagggccuaccaaaguacucuauaauugaguugcagcuuuaaucucaagcuguuuucuuuuuuucuuuaaugauaccuuuaguaaauuaaaagguuacaaccuaggaaaagauacccacaauauauaaaugguaaagacucaagauuaacaaauucuauaaggcaguaaggacaaaccacauaaagagaugaauggguguaagcugucaacuauuaucucacacaacaguaaacccaaaagaccacauauaaacaaggccuaaggccuaaggccugguaaagagaucaguuagcaaagagcuugacucacaaccaugaggagcagaguuuaauccccagaagcagauaaaaaugcagugugguagcuucacauaaucaucccaguaucagagaagucagguggaugcuguggaucacuggucagcccgccuagccuaagugugaucuacauacuguacuccaggcaaaccugaguuacagaaugagagucugucucccgagagagagagagagagagagagagagagagagagagagagagagagcgagacugauacagccagaccuaucaucuauguaaauguaugaaaaaauguaaaauagauauuugaacaguuguauucuaaacaaccaagggaaaaaaagaggaaaaaaggcuggcagacuacaaaggugugaucuucuuuauaacagugauaccuagccuaagccugacaggaagacaaaacuucaccugucugcugagugaauauggagugagaggaaguaagacagaggaagaagagaagcggggugggcuggaagaugaggcucgacuucucugaugcgagaaacuagguuaccacccagauuccuugggaaggaaaagggcaaucagagagauaccuucucgggaaaacguuaccuagcugugggggggucagccacuaaaacaucuggcacucgguaucgaggccgccggggcucuagcucaucgauccugauccgagucauguucuucugaaggcccuggagcuccagcacaagcagcaccugcagaaagagaaacucgccugaagcuggagagacuaaacccaccccaucaucaucuaaguaaugacauagcgucucuccucagccuuuugccuacagcuuugauuuaaaagcaagguuuuguugguuuuguuuaauuuggguuuuuuuguauguaaguguuucaccugcauguauauauguguaccaugugugcaccuggugcccacagcauggcccuuggaaauaagaguuuuuagauauuuugugauccaucauaugagugcugggaaacaaaucuuggucuucuuaagaacaauaggugaaauccaggaguagagaugaacaccuuuaaucucagcacucgggagagcuagaggccagccuggucuauagaguaaaucccaggauagccaggaccauacacagaaaacuugucucaaaaaacaacaaaaagcaacaagggcucuaaauuauucagcccucucuccaguucucuugauuuuuuauuaauuaauuaauuagcuauuuucuuuauauauuucaaaugcuaucccaaaaguucccuauaccacccccccccccccgcccugcuccccuacccacccacucccacuucuuggcccuggcguuucccuguacuggggcauauaaaguuugcaauaccaaggggccucucuucccagugauggccgacuaggccaucuucugcuacauaugcagcuagacauacgagcucuggggguacugguuaguucauauuguugucucuugauugauuuuuaacaaaaggucucacuauauagcccaagcuauccugaaauucaugccucugcauaucucugccucucaguauuaaagguaugcaccaccaugccugcuagccuuuuuuuuuuugaaacaggaucucauguaacucaugcugguuuugaacuuacuaugcaacugauugcugcuguucuuaaaacucuugauccucuugccucugucucccaaguguugagauuacaggcaugccccaguuuccuauacuauagauuguaaccccuaugacaagguauaacucaaugggggaagggggguugucaugaaaaaccugacaaguaguuucucaauauguaauggaaaaauuuuaaucagaaucaaaaaugaagcucaguugauaguguacuugccuaguucaagauuagcacaguauaaaaccugcuuugauauacacuccuguaaucccagcauucagaaaaugaaaauaagaagguuagaaauucaaagucauucugagcuacaaaguuaguaugacgacagccugaaacuacaugauacaaaaauaaacaaaaccgaaaaucaaacucauaaugaaccuaagcuuuuccuagccgugcucacccauguuacaucgcccaacuucucugaagccaugguucucaacacacuauauuuauaugccaacauaguacuucaaaugccaucacggcacacaaugccaaugaacacugccuaaaccacuauggcucagacuggagacucuguguguuaucaacugugauccuuuuacuauacauacaaaguuuucugcucuuacaaaaauaugacagugauggugacgcacaccuuuaaucccagugcucggaaggcagaggcaggcggaucucuguaaauucaaggccagccuggucuacagugaguucuaggucugccagggcuacacagaaaaacccugcuagaaaagacaaaaaaacaaaaaccaguaaaguuauuucuguaccaaagaacuguugugaaauaaauuuaugauuuacuuaaauguuugauuuguacacacaccaauauucucucuuucugaguucuuugauuuguacacagaacuaguguucucucuuuuccugaauccuauaaaaauucuugcaaaaaaaauuuuuuuaauugcaaauuuaaguuuauaauguuuuggccuaaggaaccugagaucagauuucuuccaaauuaaacgucuccaggacagagaugguucaaacauuaaagagcacuggcugcucuuccaaaggaccuggauuugaguccuagcagucacauacugaucuauaacuccaguucuugaaacaacucuguaacucacaucccaguagaucuaacauacucuucuggucuccaugggcacugcaaacacaauuguacaaagaccaacauggaaggcaaaauacucauaaacauaaaaaaguaaaagucucaagauaagccugacacaagacauuuauuuacaaguuuuucuuucccaaguuaccacccauuuccccaucccuaccacucuuucuugucuugccugaccuuggugacuucauggaucagauggacuguaagagcaucaggaccaagcugcagaguguccagcaaggcacgguaaggagagaggccuggccgaaugcuucgcugccgucugucaaaugcaagaguugggaaguaagguuagagagcaucucaauauccuuaggugacucuacuuaaaauuaucuuucuuacacagcccaccucaccucccacacacaccucccagguccccacuuuccauucaccucuucuagaaacauacuugcaaaaggaacucucaucacaggucuuaaaguugcuucuauccacagcaaguguaauccccagacagaccccuaaguaugccagcaccaaacuuaaccaagaccuauggaaagacaagaagaacaguuaacacucuggucaagaagggcuucaccuucuugauauaacccuaacagacaacucauaaaagcaauccuauuaauuaggaaaaaagccaaguagaccaagaacgaagucaauucugagugggaauggcggagcacauuucuaaccccagcacucggauucgagaagcagaggcagggcagaucucuaugaauuugaggucagucuggucuauacaguaaauuccaggucaacccagacuauacagugagauccugucucaaaggaaaauuuuuuuaaagaaaaagaaaaguuagucuugaagagaugguuuguucacacugucccugaaaaaacaacccaagaguaaguggacaaagucugucuguguggccuuuagaggccgaguacugacuguaguuacaucagccucucagaggaaaggagcaguaacagccaaucccaaaggaaaugguguaccauguguguacaucacaagaacaaagcuaacuaugccuuucagggguaagucaucagauggagucaaucugcuaaucacaacuccuaagguccuagaacgcuagacacccaguuccuuugauguacaguucugcaacuucaaaacaaaucaccaucaucacuaaggucagagugacagcugaaaaacacacugagccuagcuaaccgaugcaucccuagcuuuaaaaugacugcagugguaaaagaaucaauacccuagcaacaccuucagagacugauuuaauuggccuaaaauagugacuguuuaaacucucuauggcaugcuauaugcuugcaguacacagcuauuugggaggcuagggccagaguuaggaaccacuugagcauaggagagacuaauaugagcagcacagugagaaccuaucucaauaaucauaaugcauaaauaagcacccccuaacccuaacacguaaccaagacucaaaacuacuuuccauacauuuauuuucccccuuucuuucauuguuuuucuuagucagguuaggucaggagguuuuuuccagauggaaaauucagccauacaggaauaaucagccaugacuuuugaacagcuacgcagaggugaagagccuggagcuuagcccugacuguggcuacgaccaugacuuccacacagugcacagcacagcacacugaucgucagcaaagcagagcagacgugcuaaacugaagagccucacauccagguccccacaaacugucacucccacaaggugcaucaaaugaaagacuaugguuuaguaaccucauuuaaguaaguuuggggcuagagggacagcucaguagcuaagaacaguagcugucgauguucuucaaaagggccuggguuugauuccuaguacccacaugccaguucaaucuucuguaauuuguuucaggggauccaacacccucuuuuggcaucagacauacacaugggggcacagacaugcauguaggaaaggaaaacauaaaaacacauaaagaauaauaauaagauuuuaguuuggagguuauuuaccuacuaaaugauuccuaaaaagggacucucagauuuuagugucuguuaaugugugacccaggcaaagacaggauugugaggccagccuggucuucacagcaaguuccaugacugccagggcuaaagagagaaaccccgaaggaaggaaggaaggaaggaagggagggagggagggagggagggagggaggaaaggaaaggagagaaaaacugauugaguaugagcaggagggagagagggaaggguaaaaggggaagggagggagggaggaaagagaaccuagccaagugugguaguacagaccuauaaucccaguacuugggaaguagaaacaagaagacaguucagucauccuuagcuacauauuaaauuuaagggcuagccuaggcuaugugaaaccccaucuugaaauccaagaaacacuuguuguauguauuaaacaaacacugccaaaccuuggaccacaaguuuuauuuaaauuuuuugcaguguugaagagugaacucagggucucacucaugcuaggcuacauccagcuacauucucagcuuauagcaccagccuuuuaaacaaguucuuccagugacuaugauuuaagcaauacaggaacacacuaagauguguuccccagggaguacagaggggacucauaagaaggcuuaguagaagcugggcagagguggcacacaccuuuaaucccagcacuugggaggcagaggcaggcgaauuucugaguucaaggccagccuggucuacaaagugaguuccaggacagccagggcuauacagagaaacccugucucgaaaaaacaaaaacaaacaaacaaacaaaaaaagaagguuuaguagcuaagagcacuuguagccacguguaauuaccuaagcuugauuauccaggacccacaugugggacggagaaaagcaacucauuccauacauguacagagguaaacucacauacaugugcacacaacucacacugggaaaauaaacguuaaaaacagaaaacucauuuuaaaaaagggggaagucaggcauaaugaugcacacccuuuaauccuagcacuuugaggcagaggcagacagaggcagaggcagauggaucucuuacagguuugaagccaagccugguccacauacauagugaauucgaggucagacaagccuagauugacaagaccuugucucauuauauaaaugaauaagaaggggguuggggcaaggcaacacagaagauaugguucuucuaagcaauaaaaccaagaaagggcuuaucauacacaguuauccagccuccauaucuacuuggaagguaaaagaaaguuaccauauagugaggugaaugcagguccuguuugauccccagaagcaccaaaaggaaauugugaaggggaucaguuaauaaaguucccuagaagcaggaaauuuuggaaagcuggcaggcagccaccaguagugaaaaaaggcagccagcaaagugagaaaacacuaggaacuagcgugcuaggcuuuggaggaagaaguaccuguaagacaaacagaagacaaugcuacuagaaaaaucuaaucagaaggcauugauacagccuggguccugaggaauggcuacuuauguagcgguagugagcaguuuagcucguaaauacucccuggaacccuaucuucaagucuuuaaaauagguuuggagagaugucaguaaggaaaugauugguaaagaauauuuucaacaugacuuguuggcucuaggaaugccuuaagcaucccaaacgagagguguucaugagcuaagucaaguaugaacuuuaggguaaguuacaucuguuuauuggagaagaacuugaguauaugauucacccuuuuuacacugcugucgacaguacacgccucucccgacccuuuacauccguuagguguaccgcgcuuuacggcgcugauguguuuucaagcuuuuuuuaagguucuacaaaacuccagagaacaggccaaauuauuugauacauguuguguuugagcaacauuauccaugcagacugugaacuuacuggacccugccccagccgugcccagcaaaugaacacuaaugaaacuggcccaggcuggucgggagggcaaggaaggaauacaggacgaucugcccaucguauugcuuccaaccugaaaaaggagcaguguggcaacaggcugcuuuuuuacaggcugggaugcauuucgucccccuaccugccucgacagcccugcgcacugcaggaaggagacgaaagcauugaccaccccgaaccgccaagggagaaggggcggcugggagcggacaagaccgaagacagcacccagcuucagccuuucuaagcccggcgagauucaggaaccccacagacaagggccgcagcgacucgugaaucugccgcugggaggcuguagccagaggccaccaccacgaggacaaagagcccguugcgaggccagaaguagcagggugaugggaaggcauacaaaaagaagcaauauggggcucgggggaucuagggccguccggacgcgcccccggguuccgggcuccucaccgccuccuacgcgccgccacugccgcuauugccgccaucuuguaccggguuugcuccuugacccgaaccuacccgccccugugcacguugagccacguacccuagugcccgccccuuccggc

SEQ ID NO: 9158 - RNA, 5419 nt, Mus musculus
uuuuuuuugccacuauuacuaugagcugaauugguagucaugaugaggcuuaaagagucuucugugggugcuugggagcuagaguuagucuguguugugaugcucuaagcugcuccuuucucuaagagcaugacuuaccuagccuuuaccaacagagaccuacacgaucguggcccaggcccaugcucacgagggguccaucuuugcccugugucuccgccgggaugggacagugcugagugguggugggcgggaccgacgacuggugcagugggggcccggguugguggcccuccaggaggcagaggugagagaugcgcuggggucuaggaagggauggggagaggaauggucaguaugcuuuugacauucugucauuacuccgcagauuccagaacacuuuggagcugugagggccauugcugaagggcuuggcucugagcugcuggugggaaccacaaagaaugcauuacugaggggagaucuggcucaaggcuucuccccuguuauccagguuuggaagcuaaaagccagggcaaguagggaagggaguuuggggaagagcugugguaacucuguucuacugcagggccacacugaugagcucuggggacuguguacacauccgucccagaaucgcuuccucaccuguggccaugaccggcagcucugccugugggauggggaaggccaugcacuggccuggagcauggaccuaaagguagagucagcugcccuugaucugccacgcuacccgugcucugacucccuaauccugccuuuccuucugugucugggagaacugacuguacugugguuacaggcuguucagauaugaacucuguagagacugguaagagugacugacaccugggcguugcugcugccucagaccucauuuugguucaucuguagcacugcuaggugcuuucgguuucuuccccuuacuaggcucuaucccaggucucucaugccuccuuuucucugguugccuugggaggauccuuuaaaguuacuaagaugacaaagugacauccaacuucucuuauuagaaagccaucuucuuuucuuuuuuucuuuuuguguguguuuuguuuuguucuguuuuuuuuguuuuuucaagacaggguuucucuguguagcccuggcuguccuggaacucucuguagaccaggcuggccucgaacucagaaauccaccugccucagccucccaagcgcugggauuaaaggugugugccaccaaugcccggcaaacuuuuaucuuuaauuaacauuuacauaauacucaguuuugacugugaccuaggcucuuuccucccccaacaccuugauuuccaucugaauccucaugucucuagaauuucagcuuauacuuucauguacguucuacuaccccuuccucaaccccacccccugaagucucucuccugaucucaugggccccuuagaaaaaccauuucuucaauuuaccuuuuuuucuucccaggagacggguuuaugugcugacuuccacccaaguggggcaguugugguuguaggacugaacacagggaggugagagaaugccagaccuccuaggaagaaaagcagggaagucuaggaaggguucuugguaacggggacagggacaagaggugaccaaggcuaacuaaaguguugaaccacaccuuucgggugcuucucuguaacccaggccuccccucuccugcugucaccaagucuuccccauguauacucuucagucugguagcagcccaggauggggaagcagugggcuugggagggguggaugugggugggcgaacagggaagugccaggcugacugacuccacaagguuucugugguuggccuggucugcaguuucugacuucuuucucaggagacaucagaagccccucagcacuucuaugcccuuagccucaucccaucccccagccuccuuccagacaccacagccugauauucugucuucuugcugacucuuugcucagagccucccuggggguaggcucacaucuugccuccuugcuuccuucccuuuuccuuucaggugguugguuuuggacacagagaccagagagauuguauccgaugucacugacggcaaugaacagcucucaguuguccgguacagcccaggugggagccacccccacccuggaccuggguccugcucuggcucuucuuuaucugaauaaguuucuuuguagauggguuguaccuggcuauugguucccaugacaacaugaucuacaucuauaguguuuccaguuguggcacuaaguccagccgcuuuggcagauguaugguaaggaugcugggguggaaggugggauuuguuaacugugggcacaguaacagggguuugaugcauuaagggcuagccuggggaugggaaaugguagccaucuugucaaauucuugacucuuauuccccaggggcacuccaguuuuaucacucaccuugacugguccaaggaugggaauuucaucauguccaauucuggggauuaugagauucuuuacugugaguggcagggagauggggaucauuuaauuuuuuuuuuuuuuuuuuuuuuugcaucaggcuggcuuagaauucucuauguggcccaugcuguuuuugcauuugucauccuccuaauuaugucuccuaagagauuaugugggugccgacaggagguuucuagucaggagggcugaugguaguagaggaacaucaagcagaggggcugauguggagggaaauggagguuggaauuggacauagggauaacccgguaaguagguaagcuacaguuucacacucuaucuucuccaacaagaacucaagggaguugaaaaauggaccaggcauuguggugcaugccauuaaucccagcacuggggaggcagagauacguggcuggaucuuuaugaguucaaggccagccuggucuacauagugaguucuagggcagccaaggcugcauaggaagacugugccucaaaauacaaaacaaaggaaaggccaggcgugguggcgcacaccuuuaauuccagcacuggggaggcagaggcagguggauuucugaguucaaggccagccuggucuacaaagugaguuccaggacagccagggcuauacagagaaacccugucucggaaaaccaaaaaccaaaccaaaacaacccccccccccaaaaaaaaaaaaccaaaccaaaacaaaccaaaacaaaggaaaaagccggcugcaccaagaagacagugcuuuaggauagcuccuuagggcaagugggggaggggcagcugaugagaaacuguuagugcuuuauccagaggcucuaggcaugucuaaggcuacauucucuguuucugagacaggguucccucugucaccugcguuuguagaccaggguggcccccaacucagagaucugucugccccacuaggacugggauuaaggaucugcaccaucaugcaggccuaacuuaaagccaagccaagucagugagaacuugggaagcacacagugggguucauaguggacgcuaugccuaugaucaguucaugucgucaagugagggaagaaugacggcugaguaggcgauuuccaccuaggggauguggcuggaggcugcaaacugcugaggaaccgcuaugagagcagagaccgggagugggcuaccuauaccugugugcugggcuuccacgucuauggugagccaggaucuggaauccguuaggagggcuggggaaacaaggaagaacccauucugcccucagaauccugggcgugugccaccucggggugggggucauaguggcaaauccaggcuaggaggccccuugggauugucuggagcgcaguggcaaccugaagaccugaaacacugcaacucuagguugugguagcagccugacucaggccaccuguuguguuagguguguggccugauggcucugaugggacagacaucaacucccuuugccgcucccacaaugaacgggugguggcuguggcagacgacuucugcaaaguacaccucuuucaguacccaugugcucgagccaaggugaggcuucaggggaccauugggcccagguggguagguuugguacccugccauugcugcaaccaguuguuuuuuuuuuuuuuuucucucaucuaggcgccaagucguauguacucaggccauggcagccaugugacuaguguccgguucacgcacgacgacucauaccuugucuccuuagguggcaaggaugcuagcaucuuucaguggcgagugcugggggcagggagcucugggcccgcuccugccacaccaucuagaacgcccucucuguccccugccuccucccuggacgugugauugaugcuggauggucuugucccucugguacuguggucuggccccacccuggccaaaaccccuaggaccaaggacagucuuuuccugugcuggcuuuuucuuugacuucauacauucccaauugcgcauuuuucuggaggggcuaaccaccccacugcacacaaaauaacaacagacuugcuggcugagccaggcaacccagcuccgacacccucugcucggugaggggcaauaaaaagaaaaaaguaacugccuggugcuuuugugcggcggguccccucaggggcccaguuguguuaggaugaaagaaaaaagugcagggcgggaagagaaaagggaguucagaccaaauaugcaaauaacaggcaaagcggcuugcaaauaaccucaagaagagugagggcgcgcgcgcgccuuucgacgccacugccggggagcugcuaggacccauagugcaaagaguuaauuccggcuccucaccgcccucaggggcggggucgagcugcaacggaaauaaccgagcgcgaggccgcggcugagcgaaaggagccgaguuccuuccggaaguggccgaucugcggggucuugcucuccgaccugagccgagcgcugggccuuguucuccggaucggccgaagguguuccggaaggaggcgaacccggacgcgggcagggcaaaccuugccagcgguuggcaccgcacgacgucugcugggacucggugaggacgcuaggagcuggaaccucacuccggucaggcaggaaucgagcucguuccggaagaagccgaguagaccggagcuggccucggugucccggcgugaggcuauagcagugucgucgucgcgcgggcagugaugagccgcggcggcugagcgagcagaggugccggcugcucgggccccaucgacacuuccgcgaagcgucagccacgcgcugggggcuucgucuggagcugagcuuugcccccgcgagccuccgggaccucuuuguguggccggaggcggcggcgggaacggccauggcggcuaacauguaccgggugggaggugaguaccc

SEQ ID NO: 9159 - RNA, 5419 nt, Mus musculus
ggguacucaccucccacccgguacauguuagccgccauggccguucccgccgccgccuccggccacacaaagaggucccggaggcucgcgggggcaaagcucagcuccagacgaagcccccagcgcguggcugacgcuucgcggaagugucgauggggcccgagcagccggcaccucugcucgcucagccgccgcggcucaucacugcccgcgcgacgacgacacugcuauagccucacgccgggacaccgaggccagcuccggucuacucggcuucuuccggaacgagcucgauuccugccugaccggagugagguuccagcuccuagcguccucaccgagucccagcagacgucgugcggugccaaccgcuggcaagguuugcccugcccgcguccggguucgccuccuuccggaacaccuucggccgauccggagaacaaggcccagcgcucggcucaggucggagagcaagaccccgcagaucggccacuuccggaaggaacucggcuccuuucgcucagccgcggccucgcgcucgguuauuuccguugcagcucgaccccgccccugagggcggugaggagccggaauuaacucuuugcacuauggguccuagcagcuccccggcaguggcgucgaaaggcgcgcgcgcgcccucacucuucuugagguuauuugcaagccgcuuugccuguuauuugcauauuuggucugaacucccuuuucucuucccgcccugcacuuuuuucuuucauccuaacacaacugggccccugaggggacccgccgcacaaaagcaccaggcaguuacuuuuuucuuuuuauugccccucaccgagcagagggugucggagcuggguugccuggcucagccagcaagucuguuguuauuuugugugcaguggggugguuagccccuccagaaaaaugcgcaauugggaauguaugaagucaaagaaaaagccagcacaggaaaagacuguccuugguccuagggguuuuggccaggguggggccagaccacaguaccagagggacaagaccauccagcaucaaucacacguccagggaggaggcaggggacagagagggcguucuagaugguguggcaggagcgggcccagagcucccugcccccagcacucgccacugaaagaugcuagcauccuugccaccuaaggagacaagguaugagucgucgugcgugaaccggacacuagucacauggcugccauggccugaguacauacgacuuggcgccuagaugagagaaaaaaaaaaaaaaaacaacugguugcagcaauggcaggguaccaaaccuacccaccugggcccaaugguccccugaagccucaccuuggcucgagcacauggguacugaaagagguguacuuugcagaagucgucugccacagccaccacccguucauugugggagcggcaaagggaguugaugucugucccaucagagccaucaggccacacaccuaacacaacagguggccugagucaggcugcuaccacaaccuagaguugcaguguuucaggucuucagguugccacugcgcuccagacaaucccaaggggccuccuagccuggauuugccacuaugacccccaccccgagguggcacacgcccaggauucugagggcagaauggguucuuccuuguuuccccagcccuccuaacggauuccagauccuggcucaccauagacguggaagcccagcacacagguauagguagcccacucccggucucugcucucauagcgguuccucagcaguuugcagccuccagccacauccccuagguggaaaucgccuacucagccgucauucuucccucacuugacgacaugaacugaucauaggcauagcguccacuaugaaccccacugugugcuucccaaguucucacugacuuggcuuggcuuuaaguuaggccugcaugauggugcagauccuuaaucccaguccuaguggggcagacagaucucugaguugggggccacccuggucuacaaacgcaggugacagagggaacccugucucagaaacagagaauguagccuuagacaugccuagagccucuggauaaagcacuaacaguuucucaucagcugccccucccccacuugcccuaaggagcuauccuaaagcacugucuucuuggugcagccggcuuuuuccuuuguuuugguuuguuuugguuugguuuuuuuuuuuuggggggggggguuguuuugguuugguuuuugguuuuccgagacaggguuucucuguauagcccuggcuguccuggaacucacuuuguagaccaggcuggccuugaacucagaaauccaccugccucugccuccccagugcuggaauuaaaggugugcgccaccacgccuggccuuuccuuuguuuuguauuuugaggcacagucuuccuaugcagccuuggcugcccuagaacucacuauguagaccaggcuggccuugaacucauaaagauccagccacguaucucugccuccccagugcugggauuaauggcaugcaccacaaugccugguccauuuuucaacucccuugaguucuuguuggagaagauagagugugaaacuguagcuuaccuacuuaccggguuaucccuauguccaauuccaaccuccauuucccuccacaucagccccucugcuugauguuccucuacuaccaucagcccuccugacuagaaaccuccugucggcacccacauaaucucuuaggagacauaauuaggaggaugacaaaugcaaaaacagcaugggccacauagagaauucuaagccagccugaugcaaaaaaaaaaaaaaaaaaaaaaauuaaaugauccccaucucccugccacucacaguaaagaaucucauaauccccagaauuggacaugaugaaauucccauccuuggaccagucaaggugagugauaaaacuggagugccccuggggaauaagagucaagaauuugacaagauggcuaccauuucccauccccaggcuagcccuuaaugcaucaaaccccuguuacugugcccacaguuaacaaaucccaccuuccaccccagcauccuuaccauacaucugccaaagcggcuggacuuagugccacaacuggaaacacuauagauguagaucauguugucaugggaaccaauagccagguacaacccaucuacaaagaaacuuauucagauaaagaagagccagagcaggacccagguccaggguggggguggcucccaccugggcuguaccggacaacugagagcuguucauugccgucagugacaucggauacaaucucucuggucucuguguccaaaaccaaccaccugaaaggaaaagggaaggaagcaaggaggcaagaugugagccuacccccagggaggcucugagcaaagagucagcaagaagacagaauaucaggcuguggugucuggaaggaggcugggggaugggaugaggcuaagggcauagaagugcugaggggcuucugaugucuccugagaaagaagucagaaacugcagaccaggccaaccacagaaaccuuguggagucagucagccuggcacuucccuguucgcccacccacauccaccccucccaagcccacugcuuccccauccugggcugcuaccagacugaagaguauacauggggaagacuuggugacagcaggagaggggaggccuggguuacagagaagcacccgaaaggugugguucaacacuuuaguuagccuuggucaccucuugucccuguccccguuaccaagaacccuuccuagacuucccugcuuuucuuccuaggaggucuggcauucucucaccucccuguguucaguccuacaaccacaacugccccacuuggguggaagucagcacauaaacccgucuccugggaagaaaaaaagguaaauugaagaaaugguuuuucuaaggggcccaugagaucaggagagagacuucagggggugggguugaggaagggguaguagaacguacaugaaaguauaagcugaaauucuagagacaugaggauucagauggaaaucaagguguugggggaggaaagagccuaggucacagucaaaacugaguauuauguaaauguuaauuaaagauaaaaguuugccgggcauugguggcacacaccuuuaaucccagcgcuugggaggcugaggcagguggauuucugaguucgaggccagccuggucuacagagaguuccaggacagccagggcuacacagagaaacccugucuugaaaaaacaaaaaaaacagaacaaaacaaaacacacacaaaaagaaaaaaagaaaagaagauggcuuucuaauaagagaaguuggaugucacuuugucaucuuaguaacuuuaaaggauccucccaaggcaaccagagaaaaggaggcaugagagaccugggauagagccuaguaaggggaagaaaccgaaagcaccuagcagugcuacagaugaaccaaaaugaggucugaggcagcagcaacgcccaggugucagucacucuuaccagucucuacagaguucauaucugaacagccuguaaccacaguacagucaguucucccagacacagaaggaaaggcaggauuagggagucagagcacggguagcguggcagaucaagggcagcugacucuaccuuuagguccaugcuccaggccagugcauggccuuccccaucccacaggcagagcugccggucauggccacaggugaggaagcgauucugggacggauguguacacaguccccagagcucaucaguguggcccugcaguagaacagaguuaccacagcucuuccccaaacucccuucccuacuugcccuggcuuuuagcuuccaaaccuggauaacaggggagaagccuugagccagaucuccccucaguaaugcauucuuugugguucccaccagcagcucagagccaagcccuucagcaauggcccucacagcuccaaaguguucuggaaucugcggaguaaugacagaaugucaaaagcauacugaccauuccucuccccaucccuuccuagaccccagcgcaucucucaccucugccuccuggagggccaccaacccgggcccccacugcaccagucgucggucccgcccaccaccacucagcacugucccaucccggcggagacacagggcaaagauggaccccucgugagcaugggccugggccacgaucguguaggucucuguugguaaaggcuagguaagucaugcucuuagagaaaggagcagcuuagagcaucacaacacagacuaacucuagcucccaagcacccacagaagacucuuuaagccucaucaugacuaccaauucagcucauaguaauaguggcaaaaaaaa

SEQ ID NO: 9160 - RNA, 11509 nt, Mus musculus
uaugacagaaaacaccucugcacacugugagcuaccccuuagcucagcagacacuuucuucaaugguuacagucugggagacacagcuucuaagaauuugguaauaauuaagcccuaugucaccacccagucuguuucucaucuuccccagcuagaacagcaucauuguaggaagcagggcaauaaagacaaaacugaggccaggccucuacuucugcucuucugaaaacuucugcccugccacaaggaugucucaggcaucggcaaaaacuuugaagaagccaccaaucacaaaggaggcaggacaggaaaaaguucaauguucaguuuucuuuaaugacccccaucucccuugaaggguaggugcaggcagcuaggcgacuggcaagacuuguucacuugaagaucuugccuugauugacggcuuugcccacaugcuggaagguccccucccaggaaaaguacucucgaaccagggucuggguuuccucgcucccaggauccaguuuccgccauguauacgacucauaguccaccugccaaucuggacucagcugaggauuuuuaaaaaacaaaacaguacaaaggcaugugguuagacacuggacaucgaggcaccauuucuguccaaauucuagcucagacaugacagcagaugccaggauucccacugauuugagcauacuuccuauauuuaguccagaauucuuccuucauacccacuggccauggcucaagacuccuaguuucccauauuauuaccucccuccccccaacaucuuccuuaccggaaaggcaagcucuuggccucggaagacccaaacaccagaaauggagcugcuguuguugguuccaaagaggauaacacuagcaaaggcauucuuccucaguuuguccaaucgcugaaacaucccuggagggggggaaagggagacuuaucuagucucuggaaucaugucacccacuaccuuggcuccucuuccucccagacccacuccucuucucaccagugaugagguugcaacucaugaaggucugggucagcucuucagggaagcgguacucggcauaccacagggaccagccaucuuuaucaaagugcucccaaaaauauggcagugccacagagaggguguccucauuggaguacuuacgcuuaaacucauccaacacaaagguacuaaagagagaagaaaacauaggagcuccauaaggagcaagcccuaccgagacugcagagcaucucuaggccaguggccuuuucaguuaguacuuacaaguaugacggaaguggucccuguaauguaaugcaauggcagacacuaauagcaugaguaaagagaacaagaagcaugacaugaagagcuaagacauuucucuguccaccugucuugacaugcacagacaagacucagagcauccagugagccaaaaccuuuuaaugucauaaaguuaaaacaagcaauuuaacuaucauuuguucaagguuucauucuggucauguucauuguuuugugguuuuacauacauauuuuuuuagaguguuggguauuaaacuuggaggcggagguucacacacacuuagacaaagugcuauacauucuaguuacaccaccaguccuagcuuuuugaggcaggaucuuguuaauagucccugugaaagacaagacucaaagcauccagugaguccagcaaggaggacacagguggcugcugcccccaggugguggcuaagagcaagguagucuguuuuucucucucuagccucuccuggacaaugcucaagucugagccucccuccccgccauacaggccuucucagguuacaggcuggaaccagaauucggagaacagccaccucaaaucuuuauuuacacccagguccucuaguucuucuuuguccacuaacaaguuuacauacugaaaagcucuuagguccagguuaucuucaaaguaaccugacacuccaggucagcugccaagaaagcuagccagcaugggcacaggagguauuacuuucccauggcucggguccuauuuuuuucuuuccuucaauuauaaauugguccgcaaccaucuuuaaguccaguuccaggggcugugcccccucuacccucuucugaccuccucaggcacuagacaugcacaugguacauauaaaauagaaauaaaucuauagaaacuguuaaaaacugaacauggacugaagaaaaucuguaaucucacuaagugggacaacuaauacuucauguccuuuccuuuggccuuuguuuccaaagaugcagccaugaguuaccaaguuuugugugcaacaauuuaauccugugacaugcuagggcuaauucuuaccagguaugguagagcacaccauaauccuagcauuugagaaaccgaguaacaaaaaaucauggguucagggggcuggagagauggcucagugguuaagagcauugucugcucuuccagagguccugaguucaaaucccagcaaccacaugguggcucacaaccaucuguaauggacucugauccaccuucuggugugucugacaguguacucacauaaaauaaaucuuuaaaaaaaaaaucauggguucaaaaacugccuggaauccuaugugaaaagaauuuuuagcagcuaaaucuuguacuacauacaaccuaccacaaccuguuaaauaaaaugaauuagcagagcgguuuaaauuacuagcauaaaugcuccugcaaguuggggaugaugguugugccauacucagugcuugggagauagcaacagaaggaucaggagcccaaggucaucgcccucagauacaugccaagcuccaaggccagccagagcuacacaagacccugacuccaaagcuacaguuuaaggcucucuuguuauacucaauccuuuaacucuugaguuauauuguuaccuuucucucauuucauagcugagguuaaaugguaaaacuuuuccaagauuacuagcaaagacagaagucugcucuuuaaccacaggucccagauuggucugcaaauguccaggagacaacucaucugagaggccuaaaggccucacaaacucuccuccuuccagcaaaaauguaugacuagaaauuucuucagacuccauguucccccuugcucccaaauagugcagaucagguauggucucugcaucuguuaucuccgcagggacaagaugcugucucaaaaagcuagggcugccacuuuauaagcaugugugaaccuccaacacucuacaaccacaaaacaauaaacaugaccagaaugaaaccuugaacaaauguaugacauuaaaaauacuaaagucaggcugugguggcgcacgccuuuaaucccagcacuugggaggcagaggcaggcggauuucugagugugaggccagccuggucuacagagcgaguuccaggacagucagagcuguccuaaggaaaggcauuguaguagcuugggacugagccaaggaggcucaggaauuaaggccacuucuuugcuacacaguugagaccagccuuugauauauuagaaucuguccacaaaacaaaacaacuggagagagagcucugguuaagagcacugacugcucuuccaaaguuccugaguucaauugccagcaacccacaugauggcucacaaccaucucuaaugggaacucaugcccucuucugguguaucugaaaacagugacaguguauucacauacauaaaagggggaaagaaaaaaaaccuuccacaaaccaacagcaaacaaaaauccuaagggaaaaaacacuuucagcgucccaucauguaacauuaaaaaacagacauuuaaauaaacauccucaaagguaugccagcaagacggcucagugguuaaaggugcuugccuagugacccgacuuugauccccaagacucacagacucauuccaauuguccugacuucauacacaucaacgcugcgccucuacaguuugucuacggcuggcaagagcaggcacacacucacacauaaauuguaaaaaaauuauuuuuaaggagaaaaggcagaaggagcaaagcuguucaaagauuuuguuuuauuucgcuuuguuuauuuccuguccauaauauggaucaacuuacuauguguaagaagugucuagauuacaacaacauauguuagauacacuguagauuuacuuuuuacauaacaaaacuuugcucauuaaaucuauccuggugcaaggcuggagguuaguaauuugaguucaaaacucaauguauucuuaaaaagcagggcugcagauguccugagaggcugagcaauugucuuaaaugagcugggguuccauccccggcaccuuccaaaucuuccaugcacacacacaacuuaaauagcaacuacagcugggcagugguagugcauaccuugaguuccagcacccgggggucagaggcaggaggcucucuaaguuccagaccacuuggucuucagaaugaguuucaggacagccagaguuauacacagaaaacagucucaagcccacccgccaccccucaaaaaaaaaaagaaaaagcaggaaugcuacaucugaagucuucuuggucucauaccaaaaaagcaaacaaaaacuagaaauuaggacucucagacagaagucccuguccuuugguauaauccuugcugcaauuuccaacucuacagucaagaguauuucuacaugcugguuuacaaggcaaucacuuaaaacaucacaaaauguaggugggucaaaacugagccugcauggcugcucuguagucaacuugaccaggcuaaaugagugaguggaccccagcuuucaugucucucugcccuucccaaaacaacuaaagggacggauauuuugucucguuuucccuuuguuuuuccucaguugucccagcaaugaaaaaguauuaugaaauagaccauuauugugcacaggaagguggcuuuaggaagggcagagaugcuagacuuuggggacacaccuguaaugcuaguacuugaggugcaagggcacaagguccagguucaaggcagccuggucugcacaauaacaaaggaaggcaugguggcaugcaucaugcuugggaggcacaggcaggucuauagacugccuuugagccacaggaagacccuaucugaaaaaaacaaaaacaacccccacuacacuccacuuuaaacaggcuuuuguccuucuguuagaaaaauuccaagaggcugaggacauggcucaguggguaaagugcuugcuaugcaagcaugaggaacugaguucagacccucagcacaaccuggacacaugagaccuggacuauacuuacacccaucaguauuguaacaaccuaacaucguagcccuagaugugagaagagcaccagcuuaccucuugggcaggugagcgaaaggguccuuggccuugggcucagcagccaaugccugcucacacucauccaucucuuccucaggagcuggggcagcugccuuuuuuuccuccuuccgcucagccugggguuucuguuucuccucucgugaacccuuuucuuuccuugggguaucuuuuuuaggcuggcucucugcaaacuucuuagcuagcaaaggauggaagaaaguaaacauacagccucuuucuuuuuucucccaaacccggcagcaggcagggaaagugauggcucggacagccuaagaagccucaagaagcaaaacacacaucgucacacagcacugcaguuugauguaaacgucaguuacugggugacacccacguucucugggugaacaaggcuaugcaagucaaaggguugacaggcgccaacuggacccugacccuaucacaugcccagucucuucagacuuaccaucaaacugagccaucuucucacacagcuucaccucccccaagauagcccugaacuggggcugguuaaugcagguaaggaaccaccgguugguauuggggaaggccuggcgaaaagaaggcucuaagaccugccaagagggaauggcagaaacaagaucaauaauggaaaggccaugaacagauuucaaaccacagcaaaagccccuuaccuccagguccacuguccucuccaugccacaucagaaccuuaaaugacuacaccuccaggaagacuccuuuucaaagaaaaguuuucaaagaagacuccuuuuauguguauugaguguuuuaccuacauauacacauauacgacauacaugcaguguucccugaggccguaagacagugccaggaucccuuggaaauggagcuguagaugacugaggcauuauaugggugcugguaauuaaacccuggcggaaggguggccauugcccuuaaccacauaacuguugagcucuuuccaguauucucuguguuucagucagcuuuauuacauaacccaagugagccuuucacaucaggauccucccaucuccacucugcugugcugggaguauaggcgcuuucucccucgucuuuaguucagucgaggauggcuguucccaguccuucaugcaccauugcuacuuaaugauuucauauucugcucuuucaucuauucuuuucuuuuaaaguuuuauuuauuucauguaagugaguacuggugugucuucagccacaccagaagagggcaucagauccuauuacagaugguugugagccaccaugugguugcugggaauugaacucaggaccucuggaaaagcagcuggcgcucuuaaccacugagccaucucucuagccccucuuucaucuauucuuaauuuuaaaaauuucaugccaacaaucccagcaccaagaaagcaaagcagaggcaggcagagcugaguuuuagggcagccuggucuacagagaaacccuaucccccccacccccccaaaaaagauugaaaaggcuguaagaagagccugucuagaguaccggggggggcuaggaauguggcuuaguagcaggugacccagacauuggucaaggcaccggguuccaaaucagcacccaaaugggguagaguggggugacuaccacacuuauuuugcuaugacaacccuccaaaaaaagauacuucgugugugaugcuaggaaugggacauaaagcaugccagguaaaucacugggcuccacgcuagccccgcacugcgacucuaacacacacagaaggcacaagcaacccaagacuagauagagcagcaacacagcacgugcccagcagacacaacacaguccuuccuucaaaccucguccuugaaaaacuuacauucauucuuauguuuuagugcuuuucuuccaaguauaucugugcccacuuagaucauaaaacaccggcuccccgaguuggcguuauauaguuuuaagcugccauuuguguauugggaaauaaacauagccucugcaaaacaagaacucuucgagugcugagccaucucuccugccccacacuaccaucuuacaagcuccuguuugguacuuuucuguaucugggugucuugccugugcguuugucuaugcaccacgugcauuccuagggcucacggaagcuggaacaucagaucuucuggaaauggaguuccaguugugagaagcgugugggugcugagaauccaccagaguccucuggaagagcagcaagcauuuuuuaaaacuauugacucaucucuccagccccugucauuuucuacuuugucaaaacaggaguggguagaaggguaaaucauggagacagaucacagaauucaguuagucacgcaccgcaaguucugcagugacuugaacauguacuugcuguguguuguggccauggaaggauuauaaugaacccugugaggcacaccagucuggcaaacaauggcauuuuuuuuuguucucacuggacuguaauucugaaccagaauggguccagagcugcugccgccuagaaaucagcaacacaauauuaaaaaaaaaaaaaaaaacaaacauggggguugggggcagcuggggauggcuaccugguuugauuccuagcacacacauaguagcucacagccaucuguaacucaagcuccuugggaucugcaugcaugcacacacauaugcaaauacauguagacauaagcugaauaccaccuuggacuuaucacagauaaauaacuaugagaauucuuauaccacugcaucuuuaaacacugaaguuaagacagagaccugaaucugccuccaaaagcucucgcugcugcagucacuaucccugucucuuacaucuuugauuuuugcuuucuauuuuugauaucacuauguagccuaggguggccuuaaaccagaaugauccuccugucucaguaucucaagugcugggauuacacaaguaugagcuaccacacgcagccuuuauccaucuuuaauaagauggaaacagucacaguucucacuguugggaucccuacaaucauuaacuacuggucugucuuaagcaaaaacaggguuacccuaauacaggucuaaccccugucacaugggauauaaaccuuaccuguuuauagagccacaacaggguacagacaacuguaauaucagccagugucacucgcucgcccacuagaaaaguucgagucuucaagugaguguccagcagccccaggauucgcuucaccuccucuuucgcauuuucaguggccuguuguuuugaauacucaagcuuaguggguaccaagucccuuuccucagauccccccaccaacagaacuaaagaagccauuuaaccagccaucgacucaacccccacccucuaucauuagacucuagaaucaguugaaacuuaucagaaaugaaaucacucguguuagauaucuucaugaucaacaugacuuuauuugcaccauacugaugguagccacuuuagucugcauugcccccacacuccugcuaucuuuuccuucaucugucucccagucccaaaauguaggcucugacucuaucucuggcccagcuucuccccaaguuccaaagcguaccuguuuguuguggugcauaaugcccaagguggggaacacccagguacuagcuggaggaacgaugucacugucagcaaagcugacccacugcaccaccugagcugccgccucuggcguacuuccucgcagcuccucauugcuuacugcaaaggcagacauagagcuuagaacuuugaccucaugccaaaaccaagccgggucucugauuccaccuuguccgccacagccgcuucuacagccuuacccccauacccucucacgccuguauccccacaaauuaccauaauaggcaauggcauugcucucaaacacacagaauccaucaucacccucaaaugcuggaaccuguggagaaaguagcagaaaacauaaacacagagauuucucaguagccaauucuccaggcugaauuguucuaaauaauauguuaagacagacaacucuugcuacgcuaauucaugacaucucaagcucagaagugaaaauuacuuaguaucccucaugauaugaauucacaagggugaaauucaaacauagcuaaaguguggugccccauacccuugucugaaaccagccagcaagcuacugagaccccaccucaaaauaaacaaauucagauauggaugccacccaacaaucccacagcuucacugcccaaaucauuaggugccauccagacuuagcauuugccucuauauuuagauuuggauauuuagcucuacucaugcucuaugggguaagaauccaacucucaagacauacuuaguacauacauacagauaacaccuggugaaaauacauuuuauccuacaaauauaaaccaggccuggaacuccugacagucacugaacagcugugaauacaauggaacuucauaauuacaauggagacaggaucuuacuauacuuauaggcuugcuucacacaaucucccugccucggucuccgggagcuuucaaaauuauuuuuuuccuuugggcagucaaguucagaggcuuuaauagguuacauuccuagccccuuaaaauuucuuuaaaaaaauauauauauaaauaaauacacacacacacacaccaugggggccaucuccagaauaauggaauucuagagaucccagaugcuuccccacucaccuugccggcaggaaauuuucggagaaauucaggggugcgguugguuuggccaaaguggaagugggguggugcggagagcacgcggaccugagccccgcuguacugagcagcgaugagggccuugaaggcccuccaauuuucaggguauguguacagggucuacaagagaaagggugaaggauggacuagaggcaaggaacccugaaugccacuccccacgcacacuuccaugcaauuccaaugugcacagcuuagauucacuccuagugaaccgaguaugccccauguaaucagaguccucugaaauaccaagaagaacaucccagcugcuaaauaaagcuuaccgacagaugugaccucucuuaaggacaucucuagaggcauucuucccuucaaaacuucuggucccaucugccuaaacacacgaacacucacacccaucucucccagaacccuuguuucauucauuggcggugacccggagucuaacuacuuccaggcugcuaucacuucaaaagcacacacacagaccaagggauuucaaaguuccccucagaaucgacacgcugaauucuaauguucaucaguuauucuuccugaaaugccuuucuuugcacauggcgaauuagcaacccucugguccuguccugcagugaguucccaguugucucccuacuaaaaucucaccagcaggguccauaugggcucacuucacccccccuuuauuccucuggcucccaaaccuccccgaaggucaacucccaacgugccagucgccccuucccacaaagacccucuccuuuccacguccucguuguugucccacaaaacgguggcaaaaguuccaccaaccugcucagacgccacaccucaaaauggcagugagguuaaacacuuuuuaaagguccagacaauggagacccagcaucuuuuuucuccucaaccccagaacguuccaccucuagccucugagccccagccucaguuccccuccaggcccuagaaaccaugcucuccgaccguacggcuugugaaccccagaucggcucgcggcuugggucugaaacuccccuggcgccgacuggccccacucaggcaaaggauggcgguggauagggugacccuaaucaccggagccggcaaacuuaccccagccgccauggugauuccgcagagaaaggggguggggcugucggugcugccgcaaaguaagccgcaaaggagacaagggaggaggaaaggagagagcaguguggaaacagcggccggaaagcgaggacggcauaaaaggcauacgcacgacaguuccgucuacagccccgcugaguuggaaaaagcgagggguggggcccgcagccuggagcgcagagagcgggcgccugcgua

SEQ ID NO: 9161 - RNA, 87645 nt, Mus musculus
ccggccacuuggagcagcucugccgcggggacugcacuguccgcccugccagacccgccccgacuggggcucgccgucgccagcagucagcacugcgaccucgggcccuucgccggcuauggcugcguccuggggcugagcccgcagguagggaagcggagcgcugggcgguaagguguggggccaggguucgggcgaccaggggagagagggacucggacaaggugcauuugcgguagugucacuacgaggguuccgacuguugggagcaaaccuggccgcuugcggccgccggggcaggcgacgcgucacgcuucgggaguaaagcucuuucuccggaguuggggccaaguuuaacuaaguuagaaaaucgcuucgaagugugcuuugcugcgcuuuuaguuuuuucccgcggauguauugucguuccaacugcagugcagggcguuccugaucugguggucccugaccgauuccaucucuuuggggcggcggcucagagcgcuacuugguuccuauaccauguuuacuggagaaguuuccaagagccccaucgccccucccgcgccccugcaccgcgugcccccucugcugucuuucgcggcuccccacaccuccaucucgaacuucgcguccggauuccccucggccccacccugcucuguaccaccagccucucccuuucuggcuccuagcggcgacuuuaacagcuccccuucaacugccccgcccuagucuugccccucuguguuuccagauccagaaaacucccuucuuucuccagggcgucggagccuggaaguuugcagcgugccucccugugggaugggugggagugggagggggggugggggacauaauuagggagauuccugcgcugggugggcggggagggggcugugcaaucgacacaguccccagaaccucccuugcuccuucuaggggcggugcuuucuccccaccccaccccacucccaaacucguccgggcgggauggcccccgccccagcgccuggcuggauuccagcagccugaggaauguagugguuggagccggugacuaauucaaaccagaauucgggggugggggugggggugaggggcaaagcggagggggaaagaggccguguguaggcggugggggccggagcgcagggcguaggugaaggacuucccugcucuccuuuggaacccuucacuuuugcagugcgcgccagcggagagggcggggggcaagauccuacugugggguuggaaaggcaacaugcuuagggugugugcagagagcuguguuauguaaggcuuucccaugcagggaggggaugugcagugugcgggagccugggccuccucuggcuggagccccuuucagugccgaggcagauuugggggacgcagaaccuugguggcguuggguugacaucagggcuagcuguacauggcgaugagcacugaagacucuuggggugacccggggauauccuacaagucaaauggaguggagccuugacaacguagugucccugguaugugugugugugugugugugugugugugugugugugugugugugcuugccugcucacucuauugucacuucugcacaaugugaccacagaagauugugcgcaugaugucuggguuggcacccugguuuggcaggguguggcccuaggcugucucugaggacacacguguccagggguacuugucucaaugucccuguucuguggaggggauuugcagaaaagcuucuggagguaguuggggggaugggggugggggauccuuggaaagugaccuggaauucccaggagaaaaaggacucccaacaaaugguuuugaaacaguuugcccuuaaacuuuagcaauggcaggaaccaucuuacuguaccuaacguauacuagaugggaugaauucacaagauccaaugauucauguccucauaucaaugauacuguccucauaggugacugggagaggggagggcacacaggaagaugcuaugggcaaugugggcaauguuuagggccucuccccacacugagaauggcuuaggugaguagaacuguuuugguccugcccuauuagggaagucucuggggguagggugggucucuuuuccuuuucccaagcugaaugaacuaguagcuuccuuuucuugaaaaacuaugggggugugggggagggcaggccuguaucuggucuguagagugugcagauugugcaguagaagggaaccccucauuuaagggccacuuccucggccugagcugaguuauggggcaaggggagugugggaaaggaacugggaacaagggagcugaucuaguaaaggacuggaggggggcguagggaugacaucuggaagaugucugaacuccuuucuaaagcucuugucccuaagagauuaugcaaagggacauugugaagagaaccaggacauucagagagacaggcacgugagucauccaagacuuagugcuaaugguuuggaagucagcagugauacccugagggucuuggccuagcacuccacagcuccaaguccagaaaaggacaagagagagaaagaguagaccggggagcucacuucaggccuagagaggcucugcuuagagguucagagcccuacaggccuuacgcuccacuuggaacugucugucggguucuggcagagcacaccacucugagccugaggagcugguuugagggguugggguaaagcugugggaguggaggauguguugggcacugggguguggucacuaccuuuuucagaacuugggaacugccuggagacagacaagagaagcaaacugggagagcuaguccgacuucugaagggaucuuugccuggacacccccaaguuucucuccuuggggcugggcugaccacgugcuuauauucacuuggguuagaggaagggagguggcugccaauuuagaaugugcaauacaccugggccccuucaggcuucagccagggcucccaggaacuugcaauuccuugaguugaccauuggaucaucuggccggcuuccaaagccuucuugaucauaguaucguccaugucugaguguguccaaaaaguguccgaacggggguuguuguggcaauguuucugcggaaaugucuguguacuuugacgaagcucccccuuucucuuuccuagccccaguuuccguuggugcuaaagcucaaauaauuggucuugggcccgucacuguuugcauuacaggagucauuguucacuuucagugaaguugguguuauugccugugagaggauguccuguucaugggguccucacacugugguaaaccuggauaugucaccucuguuauccucccgggacuuggagggcagaggcagugacugauugacuacucugggguacaaguuccaugucaguguauggagacugcacuuauggacucaagugagcuccuuuguccugcacagguccaggccaugaccuagaggcccucaaggaggauagggcagucuugggaguauaguccccacacauggagguugagcugggcaaagcauugcauacggccugucagggagcggcauccugccuggucccuggggccuggagcggagguucugggggaaggggaagugccuggagcugauccuggcuacguguccuggcuaggcugggagugggagggagcauugcagccaucauuugaagaccuggcucugagucuuuuugcuacauggcuugaccacuggggggcgaacaugcagcacuuacuagggagcuggguggggcacaggguauagucuaaacuguaaucuaccccacaaggcaacaacaaacuucucccucagguuccccaaccauaggacacugcccuuagaguugguguuuuaaucucagaaguucugucuaaggccaauuuuuccuugguguugugcccugauggggaaguuuccacuggguaauacaaugcugucuucagucucugucacuaggagagguggagggccccuuagcuaggggagggagagggacucucccuuccugcuggaagugagaauuuagagcuuuagggcuugccacuuguucuaaagaguuguggggaaacguguguggcccgagucgagagaaggaguuggaaaccaagaagcaguuaugguccugauuauggcuguccuagaagucaaugagcaaaacccagcaugcuggggagggggaugcuaaaggaggcuggugaaacguccuucugguaguugugguggcauggcugacgcucgaaggacagacacaguggaaggugcacacccugggaucugaguaccagguggacagguggcagauacccgcugugagccauaaagcuuaccaagaggacugccuacgcugggaaaggugggagauggaauugacaagggucucugugagcuucugcacguguguaguguguguguguguguguguguguuucccccuuaugucuuucucugaauaucccuccaauauccaggucaucugggucuuguugguuuaauuaauucucuuugaucuuucccucccauaaguggaaaguucccugucccauccucuacuuaaguagccucauuugccuaaaaguuuagauauucuugucuuagccuccugaggauucuaggugacaugagacaugagguuuacuccuauaacguuuuuuugauuguuucugacaggaucucauguagucaaggcuauccuugaacucacuauauagccuaggagggccuggaacuugcagugauccuccuggcucagccucuuaaguacuaggauuuuaagugugcaccauuaugucugucucugcuaaauguuuguuguuuuucuuguuuuguuauaaaugcuuugugugugugucugugugugugugcauguguguacgcaugugugugcauccucaugcuuuggcacauguauaaauguuuuuaggacaacuugcaggcaucaguucucuucuaccauguggguucuguugaucccacucagguugagugcuagagagaaaagcaucucuugucuuccacguuggcccaagagagauccagaguuaggcucuggagaguucaagcguuugaaaaucuuaggauuccugccucuuggagacacagucucaaagagacccagaauaaagguuccuuaaaugcugggcccgggguaccuacaacucugccuagguagggucgucaugaggcugguggaaugcaggagcaaggcuucuugcccucuucuggugggugcuucccucuggcucauucucuccugcuccagcacaggacuugcuucuggguguuuguuugccuuauggguguuucucugugguuucccaugugucucauccuauauguauauuugcgucuugaucucuuugcuuggaugaagacuguuagauuggggcuagucuccauaguccuaaaauaaugauguuaauucaccccugugggagugcuuguacacgagaugagacccuaagaaagggauaacaguggcacaguccuggcaggcacgguucugcagaauuccuucucucucucuucuuuuuuucuuggugagaauuuuuuuuaauuaucuuuaaucuuuuuuuacaauccaguuguuauccuccuccaggcccguccucguccucuaacaguuccucaucccauuccuccucuccagucuucaagaggauguccuccacccuuccccacuccccacccugucaggccuccccacucccuggggccuuaagucucuugaggguuaagugcaucuucucucacugaggccagaccaggcaguccucugcuguauaugugucagggaccugguacuggcuagugaacgcugcuugauuguuggcucagugucugagagaucuuagaacuccuucgcuuaacuacugauggcaggucaguguucagcucucucuuucccuuuggggaguguuuaugacagcauaucuaucguccuuccgggugugucucucugacuauccaaccccucaccugguuaggagugucagagcuuucccucugguggagaucucuaauccuagcuaugagucauuauguucuugggauggaaacuccgugucccuggccucguguguauggcagguuaguuagagcaugugggugcaggaggauggaagguucaguuacuaaggcccucccugacguaggcggaggacuuuuuucuucccugaguauuaugcagauccacuccuuguguccuucugguacaggccuauucagccauugagguucuagggcuuggcuuagcagacagagaagagagagagagauagagagagagagaggagagaaugagagauccugucaucuugacacauacagugguugucugucgcugcagcagcaauugcccugagcucucaccuguggggaagagagaacggcccaguucucggaggacagaggggagagaauggucuucuggaggccccuguugccgggacugucuguugccaggacugucuguugccaggacugucgucugcuuuuggaaguccucuggauccgcucacuacagccccuguuguagcaggcacauauguuuuugcugcauauauauauauauauauauuuugugauuuugaauuacagaaggggcauucuguuaugacauuugggcagaaucaugcucuaucucugaguccuuucugguuuuuuacuuagagcauucucacuaccucaguccuguguuccccaagcaacccucugccuuagggguucuccacggcaauccugccucuucucaucacaaaggauaacauguucaucucuauugggucauaggacuggagcuagcagaccugaauucucuaggucuaacccuuccuauucuagccucuguguaucuuccuuucccuguaugugagcagcggccaugcuguccucuaggaugcuacuggaggggagauuuugcauacccuugcugucuaaauauggcagugacuguuaggcaccuguaaugugacuguaaugguauuacauuuuuaacuuugagccaggcauagcagaauaccuuuguaaccucagaacugggaagguuggaggcaugaggaucaagaaguucucagcuacaaagcugaggucagcuuggacaauaugagucccugucucaaaaagcuaaagaccaaaacaaaagaccccacagggcuagagagauggcuuggugguuaagagugaguacuauucuuuuagaggacccaaguuugggacccauguugagccucuaacaaccaccucuaauuccagcgccaagggaacucaacauuccuggccucaggggaacuugcagucacguacacauaugcacauauauacaaacacacacaguuaaaaugaguuuacaugguaauuuauguauauacguguaagccugugagugugcgccacauauguagagggauacauggaagcuagagggcgugggauucccuggagcuggaguuguaggugguugugagucaacugacuuggcugcugggcgcugaacucagguucuggggaagagcagcaagcauucuuuaccacugaguuauuucucaucuucuuuuccccauguaguguguguguguaaccaugguaauuuaauuacuugccuaaaaugauuuuaguuuuggcuuuuggagacaggcgcucauguagcccaggcuggcacugaacuugugcuguaguucaggccacccuuaaacucuugaucuccuggcuuucccucuugagugaugagauuauagguguguacuaccaugcuaggcuaauccauuuaaauuuaaacagcuacauguggcuaccaugguagcagcucacauuugacucuuuucaagccccaaaggcuugugaugagugacugaauugugaagaauucucccaaccuucaaagaucuuuuugauuuaccuggaggcccgacuuaaccuuuaugggaggagagggaggaacaucugggcuggcuacaggcuccauuaguggaggacagaccaagagcugcugcccagaugcagaaaacaaaguuuguugccaccauggccucccaucucucguaugcgucaccauggcuuucaggaccaugcauguugagaagggaguccuucuuggccaguggcacaguagacaggugcuuggcagacccacuuggguagggccaaccuguggcaugaguccggugguuccuuuuugcugugguugagagcuuuucaaccucuuucaacuucgcucauuaaccuacugagugacacauacagcaaguccagguugguccucagugcuuucggcaucuaaggacccuuguuccagggcucaaucgggagaaggaaaacugugggaaguguacuugggugccuggccuaggagguauugcauugacuaggcucuaggcgugacccuaugcaugucuggagcuguugcugcagacugcagugacucacuguggaaggaggcaggguggggccaccaugugggugagagugagcuggcucucuuucuccucugcuggcucagcaccaggauguuuggcagagcaaggggcccugcacaaggaggaaggcggggacuaggaaacuugaaggguggguggcuucaguucuuagguguuugagcuugagacuuuuacuuuccuguuucugcugggauucugacuucuagucuggcuucucaguguugguccaggguagggcagacaagccagugccaguuucaaguugcaaagagucaguguggcuuuacucuuaaaguagccucuuuugccugcugggaagggaggggguguuucccuagcucaaaccugcaccagcaggcuucucucuuguuuucucuuacucucuagccagcaccuguguuguuaaguaggcccaugauaaacacuguguuuaugaguuugucaaguuugagaacagguguggugaucuagguuguuggauguuuguuuguuuguuuguuuugguuuugguuuguguguguuuaucuuuuguugguuucugccugagacuggaccugcugagugccauggguuucuaaaggcuacuguuccauccuggagguucgcuccagcaccuuggaagccucauuuauauuucauuccccgagaugccucuuaagacuucuggaacauuguggagcccaguuagccacacccagagucccuuguuuaucauuuguauggagaugggacucaaguguuuuaaauuuccauaucuggcauagggagugcguuuaauaaaggucuagaggaugcaugaguguugggagguaacgaccucaugcaguguacaauuaagugcugggcugggcugauuuccuuugcagcaucuaguauagacucggacaugcaggaggugaucgggauacauguauuuaugauugguugacuaauuucuggauguaaacaguuucaggguggggcuuugggcgaggcucaccacaauuuauagaguccuucacacaauuucacagguaugcuuuuagacgacugccagugguauuuuguguggguggcuguagcucauugccauauucaccauucugcugggugcuuucccagggcaccucugcagccgauagcucauccuauggcaaggaggaacaccuucaccuauagugucuaucuuaggguccacugugggcauccauauugccuugacuaacuaggggcccaagcaaggcuuuuggcuuugggaaccuaguggggaugggauugucuuugucuaggccacuaccaggagcauggcuauggaacuuccagcggguaagggguccuuuugguccugggggccuggcuacagauaguaagcugagucacugucacugggguggaugccaccauccaugcuuagagaacagucucacaugagugaagagguauagacugaaguuggcauagcggaaagacccguagaaauauaugugucaucacccucuuuaugugcacuccaggcaaaugggcuuuucagagucucagccucugcuugugacuguaggaccaguuauucuagagacugaugaacaugagcguuuuguggagccuucguggagcugcugcugucuuauauuucaucagucugcauggaacucuuacuauuuccauguucacagacaaagaaacauagguucagagagguuaaguguccuuggcaggaguccgauagcugggaggacgcagauguuagaaaccuauuccacuuuccuuuaaccucauuuucuguagcaaugggcuucagagucauguaguuacuaaguguaguggggaccagaguuuuggccugcccugggguucaguauucaucugucauuugggugguagcucacugaguuuugagaggaugggggugaauaucauggugaaauuuuuccuagguugugugaccaagauucgcaaagaaagagagagagagaccgauacagaaagagaagaaggaggggcgggcuccuggcaaggcguuugcuccugagcagaguccugcaaagguuaguaaguggaauggugcagaggaauggaggauaggaucgggcaugcuggacacuugguguaccauuuggaccugugccauggguggaucgaagggcagguuucccccuuucugucuuuauuguguauugugagagcuuccacaguggaaagacauggaagagaccacccucccccaaggaauccccaggugagccagggcugagggagcagcuugggcucuauucccuggaugugcacagcaccaaagauaucugguucucucauauaccauacuacucuccauguccccaugacuagagcucuguucuuucaucucaucccagauggagaaggaggaagagacaacccgggagcugcugcugcccaacuggcagggcagugguucccacgggcugaccauugcccagagggaugauggagucuuuguucaggaggugaugcagaacuccccugcggcccgcacugggguggucaaggagggugagucuccucaggauaaugacugggcccugcggggggggggggcaggaggcagggggacaggcagaaaugaccaaaugacuguggaaggccugggucuaacaacauaaggaaggucaguacccaagcccugucccuugcuacucugugucuugcuugugaaucucaggggagguaguccuguggagucuuggauaccgacuguaucuucagaucugauucugcgcuucucaccaauucugcagcuauguguaaaauaguuggccuuuccagcuaguuuccuccucugugcuugaaugggcaauacuaugucugugugguguucgugaagcuaaaggaaagucaguuuuaguggcuguuauguggugcuuucuugagaccugugggucuuuaccugauuguuguacucccuuacuuaggggaccagauugugggugccaccaucuacuuugacaaccugcagucuggugaggugacccaguugcugaauaccauggggcaucacacuguuggcuugaaguugcaccguaaaggggaccguuccccugagccuggacagaccuggacccaugaagucuucaguucccguagcucugaagugguucuggugaguaccuggugacccaccuuuguucagaacucccccacgauccugauggcuucuuggccuacuuccugagccuuccuucuuaucucuucuucugcauucucuugugacuucucucugcugguuucuuucuguuuauauguggcauguggcugguuccauuccuacaaguauaguguuccuucagucucuuaagacuaugccauggugagggaaacaacucaagcagugggggcuuaggugccaagaggaagguuggcugcuuuacucugaaaugaccucacugguguucaaccugccucccuacauuccaugagugagaagaugaacagcacaaugcuugugggaagcgcuucuuuacuccuaauggcuugcuuacugaauaaagcaugugcccucaaagugaaaguauuacccaaucacagucaagccaucagcugucacaaaugcuuuccagugugcaaaggcuccugggugacaccuuaaacaaucaagcuagugagcugagaauugaaagaugaagggccugauugggaugggucucuggaacagguuucuuugaacuaucacugggugguagagccucuuccugggcagccaagauuuuugcuuacaagaauuuucuuccaaauaguuucuauuuuccucuuaugauuugacugucaaccccuuucuucagugcccuguguucugccccaggaggcucucuagaccucuguuauggucugagcaccuuugggaaccaggcaacccuguuguuggcuggacugcagccgggcauuugcugauucaggcaggcuuugcugcaaccucugccgggcaugucuuucugcagagcggggaugaugaggacuaccagcgcaucuacaccacgaagaucaagccacgccugaggucggaggauggaguagaaggggaccuuggggagacccagagccgcaccaucacagugacuagaaggguuacagccuacacuguggaugugaccggucgggaaggagugaaggacauugacaucaccagcccugaguucaugaucaagauaccaaggcaugaagugacugaaaucuccaacacagauguggaaacccagccagggaaaacggugauccgacugccaucgggauccgggccagccucuccaaccacaggcucugcuguggauauccgggcaggugccauuucugcuucaggaccagagcuugaaggugcuggccacucaaaauuccaggucacugugccuggggcaaaggugggaagccuagaugucaaugucaaagcaaaaggcuuggacuuggguggcaaaggagggauccgaguuccaggaguagacguuucgucuucucuuggggcuggcucaguagagguacaggccccaucccuccagaguggugauauugggaaaauuaaaauuccuaccaugaaggugccaaaauuuggugucuccgcaggucuggauggccagauuccagagguagggcugaguguuucugcaccugaauccucugugggacacaagggugacaagccaggcuuggcuauugggggaaacauccaggcuccucaccuggaaguaaaucccuccucugucaauauugaggggcuugaggggaaacugaaggguccccagaucacugggccaucacuugaaggugacuuaggccugaaagguaccaagcugcaagggaacauaggaauggaugccugugcuuccaaaaucgagggcagcaucacugguccuaguguggaaaucggaaccccugauguugauguucaugggcuagggggcaaacugaauaugcccaagaugaaagucccuaaguucucugcaucagguucaaagggagaggggauuggccuugauguggcacugcccacaggugaagugacccuuccuggggucucuggggauguaagucugccugagauugcuacuggugggcucgaagggaagaugaagggugcuaaagucaagacuccugaaaugaucauccagaaaccuaaaaucuccaugcaggauguggaucugagccugggguccuguaaacugaaaggaaauaugaagacaucugcuccugaggugaaaggugauguuaaaggcccucagauggcaguuaaaggcuccagaguggacauagagacaccaaacuuagaggggaccuugacaggucccaagaucagcagcccuucuggaaaaauaggggccuguaggauuucuauggcagauguagacuuaaauguagcugcaccuaaagggaaaggggguguagaugucauucuccccaauguagaaggaaaagccaaaggucuugaaguugaugucaaaggccccaaaauggacaucagugcuccagauguagaaguccaugguccagaauggaauuugaagaugcccaaguucagugucccaggagucaaaggagaaggccuagauguaaauguuacucugcccgaaggagauauuaguauuucggggccuaaggucaauguagaagcuccaaacgucaacauggagggucuggguggcaaacuuaaaggcccugacauuaaucuuccugaaguaagugucaagacuccaaagauuucuaugccugauguggaucugcauaucaaagggccaaaggugaagggagaguaugaaguaacaccaccaaagcuugagggggaacugaaaggcuccaaaguggacauugacaccccacaaguggauguucauggcccagaccugaagauucccaagaugaaaaugcccaaauucagugugccaggguucaaagcagagggcccagaaguggaugugaaccugcccaaggcugaccuugacauuucugggacuaagguggaagucagugcuccagauguaagcauugaaggaucagaagggaaguugaaagggcauaaguuuaaaaugccugaaaugaauaucagagcuccaaagaucuccaugccagauguggacuuacacuuaaaaggccccaauguaaagggagaauaugaugucacagugccaagggcagaaggugagauuaaaguuccugauguugaacuuaaaagugcuaaacuggacauugauguuccaaauguggauguucaagguccugaauugcauaugaagaugcccaagauaaaaaugcccaaguuuggcaugccaggcuucaaggcagagagcccagaaauggaggugaaucucccaaagucugacauugaugucucaggacccaauguggaugucaaaguuccagaugugaacauugaaggaccugaaggaaagcugaaggguccuaagcugaagaugccugagaugaacaucaaggccccaaagauauccaugccugauguggauuugcauaugaaaggccccaaaguuaaaggagaauaugaugucacaaugccaaagcuggaaggagacuugaaaggccccaaaguagaugucaguguuccagauguugauguucauggucccgacuggaacuugaaaaugccaaagauuaaaaugcccaaauucagcaugccuagucucaaaggugaaggcccagaguuggaugugaacaugcccaaggcugauguggacauuucuguaccaaagcuagauauuagugcuccagaucugaaccuugagggaccagaagggaaguugaaaggccccaaauuuaagaugccugagaugcacuucaaggcuccaaaggugucucuaccagauguggaucuggaucucaaaggacccaaaaugaaaggaaaucuagacaugucugcaccaaaaauagagggagagaugaaagcuccagauguggacauuaaagguccaaauguagauauuaaagcaccagaaguggaugugcaaggcccagaauggagccugaagaugccaaagaugaaaaugcccaaguucaguaugccuacucucaaaggugaggguccagauguggaugugagcuugccuaaggcuacuauugaugucucaggaccuaaacuugacauugaaaccucagaugugagccuugagggaccagaaggaaagcugaagggccccaaguuuaagaugccugacaugcacuucaaggcacccaagaucuccaugccugauguggacuuaaacaugaagggccccaaagucaagggggacauggaugugacagugcccaagauagaaggugaaaugaaagugccagauguggauaucaaaggcccuaaaguggacaucagugccccagauguggauguacaaggcccagacuggcaccugaagaugcccaagaugaaaaugccuaaguucagcaugccuggcuucaaagcagagggcccagaagugagccugcccaaggcugaccuugaugucucaggacccaagguggacauugauguuccugaugugaauauugaagguccagaugcaaagcugaagggccccaaguucaagaugccugagaugaacaucaaggcuccaaagaucuccaugccagauuuacaucuuaagggucccaaagugaagggugauguagauguuucccugcccaaaguggaaggugaccucaaaggcccagacauugacaucaaaggucccaaaauggacaucaaugcuccagauauggacgugcagggcccagacuggcaccugaagaugcccaagaugaaaaugcccaaguucagcaugccuggcuucaaagcagagggcccagaaguggaugugaaucugcccaaggcugacauugaugucucagggcccaaaguugauauugaggccccagaugugagcaucgagggaccagaagggaagcugaagggccccaaguuuaagaugccugacaugcacuucaaggcccccaagaucuccaugccugauguggacuugaauauuaaggggcccaaaggaaaagcagauguggaugcaucauugccugagguagaagguggaguaaaagugccagauguggacauuaaaggacccaaaguuggcauugaugcuccagauguugagguucauggcccagacuggcaccuuaagaugcccaaggugaaaaugcccaaguucagcaugccuggcuucaaaggagaagguccagaaguagacauccccaaggccaacauugauguuucaggacccaagguagacaucgauguuccagauguaaauauugaagguccagauacaaaacuaaaagguccaaaauuuaagaugccagaaaugaacauaaagccucagaagauauccaugccagauguuagcuugaauuugaaaggcccuaagguaaaagcagauugugaugucucaguuccaaaagugggaggagaaauaaaagcuccugcuguugacaucaaagguccuaaaguagaggcaccagauguggaaguucauggcccagacuggcaccugaagaugcccaaggucaaaaugccuaaguucagcaugccuggcuucaaaggagagggugcagaaguagaugugaaucuucaaaaggccaauauugaugucucaggacccaagguggacauugauguuccagaugugaauauugaagggccagaagggaaacuaaagggucccaaguucaagaugccaagcaugaauauacagacacacaaaaucucuaugccugauguugggcuuaauuugaaaggaccuaaacugaaaagugguguagauguuucucuuccaaaaguagagggagaauugaaggguccugaaguugauguggauguuggugauauugauauugaauguccagaagggaagcugaagggucccaaguuuaagaugccugacaugcacuucaagacuccuaagaucuccaugccugauguagauuuacaucugaaaggccccaaagucaagggggauauggaugugacaaugcccaagauagaaggugaaaugaaaguuccagauguggacaucaaaggccccaaaguggacaucaaugccccagauguagaugugcguggcccagacuggcaccugaagaugcccaaggugaaaaugccuaaguucagcaugccugguuucaaagcagagggcccugaaguggaugugaaccugcccaaggcugacauugaugucucaggacccaaaguggacauugauguuccugacuuagauauugaggguccagaaggaaaacugaaaggcuccaaauuuaagaugccuaaguugaauaucaaggccgccaagaucucuaugcccgauguggacuugaauuuuaaggggcccaaacugaaaggagagauagaugcuucugugccagaaauggaagcugaucucagaggcccucaaguugacaucaaagggaccaauguggaugugaaaguaccugauguugaucuggaauguccugaugcaaaguugaaaggccccaaguucaagaugccugacaugcacuucaaggcuccuaagaucuccaugccugauguggacuugcaucugaaaggccccaaagucaagggggacauggaugugacagugccaaaauuagagggagaauuaaaaggcccaaguguggauguggaaguaccugauguugaucuggaauguccugaugcaaaguugaaaggccccaaguucaagaugccugacaugcacuucaaggcuccuaagaucuccaugccugauguggacuugcaucugaaaggccccaaagucaagggggacauggaugugacagugccaaaauuagagggagaauuaaaaggcccaaguguggauguggaaguaccugauguugaucuggaauguccugaugcaaaguugaaaggccccaaguucaagaugccugacaugcacuucaaggcuccuaagaucuccaugccugauguggacuugcaucugaaaggccccaaagucaagggugacguggaugugacagugccaaaauuagagggagaauuaaaaggcccaaguguggauguggaaguaccugauguugaucuggaauguccugaugcaaaguugaaaggccccaaguucaagaugccugacaugcacuucaaggcuccuaagaucuccaugccugauguggacuugcaucugaaaggccccaaagucaagggggacauggaugugacagugcccaagauagaaggugagaugaaagugccagauguggauaucaaaggcccuaaaguggacaucaaugccccagauguggaugugcguggcccagacuggcaccugaagaugcccaagaugaaaaugcccaaguucagcaugccuggcuucaaagcagagggcccagaaguggaugugaacuugcccaaggcugacauugaugucucaggacccaagguggacauugauguuccagaugugaauauugaagggccagaagggaagcugaagggccccaaauuuaagaugccugacaugcacuucaaggcccccaagaucuccaugccugauguugauuucaacuuaaaggguccuaaaaucaaaggagauauugacguuucagucccuaagauugaaggagaauuaaaggguccagaacuggaucucaagggccccaaauuggaugccaacauaccagaaguugcuguugaaggcccagaagguaaauggaaaagccccaaguucaagaugccagacaugcacuucaaaacucccaaaaucuccaugccagacauugaucuucacuuaaagaguccaaagauaaagggggagguggauguagauguucccaaauuggaaggagaccucaaagggccaaauguggacaugagcaggccagacauugagauugaaggaccagagggcaaauugaaaggcccgaaguucaaaaugccugagaugaacaucaaggcucccaagaucuccaugccugacuuugauuugcaucuuaaggguccuaaagugaagggugauguagauauuucucugcccaaaguagaaggugacaucaaaggcccagagguugacaucaaaggucccaaaguggauaucaaugcuccagauguggacgugcagggcccagacuggcaccugaagaugcccaaaaugaaaaugcccaaguucagcaugccuggcuucaaagcagagggcccagaaguggaugugaacuugcccaaggcugacauugaugucucaggacccaagguggacauugauguuccugaugugaacauugaagggccagaugcaaaacugaagggccccaaguucaagaugccugagaugaacaucaaggcccccaagaucuccaugccugacauugacuuaaaccugaaaggccccaaagugaagggugauguggaugugucucugcccaaaguggaaggugagauuaaaguuccugaaguugacaucaaaggccccaaaguggacauugauguuccagauguggauguccauggcccagacuggcaccugaagaugcccaaaauaaaaaugcccaaguucagcaugccuggcuucaagggagaaggcccugaaguagaugugagccugcccaaugcugaccuugaugucucaggacccaagguggacauugauguuccagaugugaauauugaagguccagaugcaaagcugaagggccccaaguucaagaugccugagaugaacaucaaggcuccaaagaucuccaugccagauuuacaucuuaagggucccaaagugaagggugauguagauguuucccugcccaaaguggaaggugaccucaaaggcccagauguugacaucaaaggucccaaaauggacaucaaugcuccagauauggacgugcagggcccagacuggcaccugaagaugcccaaaaugaaaaugcccaaguucagcaugccuggcuucaaagcagaggguccagaaguagaugugaaccugcccaaggcugaccuugaugucucaggacccaagguggacauugauguuccagaugugaacauugaagggccagaugcaaaacugaaaggccccaaguucaagaugccugagaugaacaucaaggcccccaagaucuccaugccugacauugacuuaaaccugaaaggccccaaagugaagggugauguggauaugucucugcccaaaguggaaggugagauuaaaguuccugaaguugacaucaaaggccccaaaguggacauugauguuccagauguggauguucauggcccagacuggcaccugaagaugcccaaggugaaaaugcccaaguucagcaugccuggcuucaagggagaaggcccugaaguagaugugaaccugcccaaggcugaccuugaugucucaggacccaagguggacauugauguuccugaugugaauauugaagggccagaugcaaaacugaagggucccaaguuuaagaugccagaggugaacauaaaggcuccuaagaucuccaugccagauuugaaucuuaaucuuaaaggccccaaugugaaaggagauguggauguuuccauuccaaauauagagggugauuugaaaggcccuucucuugacauaaagagcccaaaauuagauguaaaugcuccagauauugauguucaugguccugaaggaaaauuaaagggucccaaacugaaaaugccugacaugcauguaagcaugcccaagaucucuaugccagaaauugacuugaauuuaaagggcucaaaggucaagggagauguugauaucucuggacccaaacuggagggugacauuaaaguucccaggguggauuugaagggcccagaaguggacauuucugcucccaaggucaauauugaugggaaagcaaagaaaucucguuuuaagcuuccuaaauuuaauuuuucuggguccaaaguucaaacaccugaaguggaugucaaacuuaaaaagccagauguugauauaacagcuccaaaaguugauauuaaugcuccagaaguugaaguccaagguaaagugaaaggauccaaguuuaaaaugcccuuucugagcauuucaucucccaaagucuccaugcccgauguggagcuaaacuugaaggguccuaaagucaaaggagaccuagaugcagcaggcccaaauuuagaaggagacuucaaaggacccaaaguggacauuaaagcaccagauguucaacuuaaugcaccagauguggauguucauggaccagaauggaaucuaaaaaugcccaaaaugaaaaugcccaaguuuggugugucuggcauaaaagcagaagggccugauguggcuguggauuuaccaaaaggagacauuaauauagaaggucccaguaugaauauugagggcccagaacucaauguagaauguccagagggaagcuuaaaaggccccaaauuuaagaugccugagaugaacaucaaagccccuaagaucuccaugccugauauugacuuaaaccugaaaggucccaaagugaagggugauguggaugugucucuacccaaaguggaaggugagauuaaaguuccugaaguugacaucaaaggccccaaaguggacauugauguuccagauguggauguucauggcccagacuggcaccugaagaugcccaaggugaaaaugcccaaguucagcaugccuggcuucaaaggagagggcccagaaguggaugugagccugccuaaggcuaacauugaugucucaggacccaagguggacauugauguuccagaugugaacauugaagggccagaugcaaaacugaagggccccaaguucaagaugccugagaugaacaucaaggcuccaaagaucuccaugccugauauugacuuaaaccugaaaggccccaaagugaagggugauguggaugugucucugcccaaaguggaaggugagauuaaaguuccugaaguugacaucaaaggccccaaaguggacauugauguuccagauguggauguucauggcccagacuggcaccugaagaugcccaaaauaaaaaugcccaaguucagcaugccuggcuucaagggagaaggcccugaaguagaugugagccugccuaaggcugaccuugaugucucaggacccaagguggacauugauguuccagaugugaauauugaagggccagaugcaaaacugaaaggccccaaguucaagaugccugagaugaacaucaaggcccccaagaucuccaugccugacauugacuuaaaccugaaaggccccaaagugaagggugauguggaugugucucugcccaaaguggaaggugagauuaaaguuccugaaguugacaucaaagaccccaaaguggacauugauguuccagauguggauguccauggcccagacuggcaccugaagaugcccaaaauaaaaaugcccaaguucagcaugccuggcuucaaaggagaaggcccagaaguggauguaaaucugcccaaggcugaccuugaugucucaggacccaagguggacauugauguuccugaugugaauauugaagguccagaugcaaagcugaagggccccaaguucaagaugccugagaugaacaucaaggcuccaaagaucuccaugccagauuuacaucuuaagggucccaaagugaagggugauguagauguuucccugcccaaaguggaaggugaccucaaaggcccagauguugacaucaaaggucccaaaauggacaucaaugcuccagauauggacgugcagggcccagacuggcaccugaagaugcccaaaaugaaaaugcccaaguucagcaugccuggcuucaaagcagagggcccagaaguggaugugaaccugcccaagguugaccuugaugucucaggacccaagguggacauugauguuccugaugugaauauugaaggaccagaugcaaaacugaagggucccaaguucaagaugccugagaugaacaucaaggcccccaagaucuccaugccugacauugacuuaaaccugaaaggccccaaagugaagggugauguggauaugucucugcccaaaguggaaggugagauuaaagucccugaaguugacaucaaaggccccaaaguggacauugauguuccagauguggauguucauggcccagacuggcacuugaagaugcccaaggugaaaaugcccaaguucagcaugccuggcuucaagggagaaggcccugaaguagaugugaaccugcccaaggcugaccuugaugucucaggacccaagguggacauugauguuccugaugugaauauugaagguccagaugcaaagcugaaggguccuaaguucaagaugccugagaugaacaucaaggcuccaaagaucuccaugccagauuuacaucuuaagggucccaaagugaagggugauguagauguuucccugcccaaaguggaaggugaucucaaaggcccagagguugacaucaaaggucccaaaauggacaucagugcccccgauguugauguacaugguccugacuggcacuugaagaugccuaaggugaaaaugccuaaguucagcaugccuggcuucaaaggagaagguccagaaguggauguaaaucugcccaaggcugaccuugaugucucaggacccaagguggacauugaaggcccuaauguuaauauugaaggaccagaagggaaacugaagggcccuaaguuuaaaaugccugaucuccaccuuaaggcacccaagauuucaaugccagaaauugaccugaaccugaaaggaccaaaguugaagggugauguagauguuucuuuaccuaaaguggaaggagaccucaaaggcccugaaguugauaucaaaggucccaaaguggacaucagugccccagauauggauguucauggcccagauuggcaccugaagaugcccaagaugaaaaugccuaaguucagcaugccuggcuucaaagcagagggcccagaaguggauguaaaucugcccaaggcugacauugaugucucagggccuaaaguggacauugauguuccugaugugaacauugaaggaccagaugcaaagcugaagggucccaaguucaagaugccugagaugaacauaaaagcucccaagaucucuaugccugacuuugauuugcaucugaaaggucccaaagugaagggugauguggaugcuuccuugccuaaaauggaaggugaauuaaaggguccugguauugauauaaagugccccacuguggauauugacacuccugaugucaauauugaaguuccagaaggaaaauuaaaaggacccaaauuuaaaaugccagacaugcauaucaaagcucccaagaucuccaugccugacuuugauuuaaaucuaaaaggaccuaaaguuaagggagauguggaccuugcacucccuaauguugaaggugaucuuaaagggccagaaauagacauugaggguccugaaggaaaacucaaaggccccaaauuuaaggugccagauguccaauucaaaacuccacaaaucucaaugagugacauugauuugaaugugaaagggccuaagauaaaaggagauuuggacauuucuauuccuaaaccagaaggggacuugaaaggucccaaaguggauaucaaaggcccuaaacuggacauugacacuccugauauugacauucaugguccagaagggaaacugaagggcccuaaauuuaaaaugccugaucuacaccucaaggcacccaagauuucaaugccagaaguugaccugaaccugaaagggccaaaggugaagggugauguagauguuucucuaccaaaaguggaaggagaccucaaagguccugaaguugauaucaaaggucccaaaguggacaucagugccccagauguggauguucauggcccagacuggcaccugaagaugcccaaggugaaaaugcccaaguucagcaugccuggcuucaaaggagagggcccagaaguggaugugagccugccuaaggcuaacauugaugucucaggacccaagguggacauugauguuccugaugugaacauugaagggccagaugcaaaacugaagggccccaaguucaagaugccugagaugaacaucaaggcucccaagaucuccaugccugauauugacuuaaaccugaaaggccccaaagugaagggugauguggaugugucucugccuaaaguggaaggugagauuaaaguuccugaaguugacaucaaaggccccaaaguggacauugauguuccagauguggauguucauggcccagacuggcaccugaagaugcccaaggugaaaaugcccaaguucagcaugccuggcuucaaaggagagggcccagaaguggauguaaaucugcccaaggcugaccuugauguuucaggacccaagguggacauugauguuccagauguuaauguugaggguccagauaugaaaguaaaaggucccaaauucaggaugccugagauuaacaucaaggcucccaagaucucuaugccugauguugaucuggaguuaaaaggacccaaaguaaaaggagccuuugaugggucugucccuaagauugaagguacucucaaaggaccugaaauagauaugaaagguccaggucuggauuuugaaggcccugaugcuaaacuuagugggccuaacuugaagaugccaucgcuggagguaucuguuccuaaaauaacugggccugaugcuaaugugcaccuuaagacaccgaaaguuggaauuucugcgccuaaguuaggagguggugagguagaccucaaggggccuaaaguugauuuagaaacuccaagcuuagauguccacauggaaagcccugauauuaauauugaggggccggauguuaaaguuccgaaauuuaagaaacccaaguuuggauuuggugcaaaaagccccaaagcugacaucaagacacccacaguugaugugacugucccugaagcagagcugaauguugauucuccugaaauaaacauugguggcaagagcaagaaaagcaaguuuaaaaugccuaaaauucacaugagugguccuaaaguuaaagccaaaaaacagggauuugauuugaauauuccuggaggugagauugauaccagucucaaagcuccugauguagauguuaguguugcagggccugaugcugcacucaaagcugaaguaaaaucucccaaagucaagaaaacuauguuuggaaaaauguacuuuccagauguagaauuugacauuaagucaccuaaauuuaaagcagaggcuccccuaccuagccccaagcuggagggugaaaucaagguaccagauguggauauuucuucaccagggauuaauguggaagcuccugauauucauaugaaggcucccaaguucaaggugccaggcguggaagccucagggccaaagauagagggcaacuugaaaggucccaaggugcaggcaaacuuggacacaccugacaucaacaucgaaggcccugaagcuaaaaucaaagcacccucuuuuaguguuucugcuccucaagucuccauacccgaugugaauguuaauuugaaaggaccaaagauaaaaggugauguucccagugugggacuggaaggaccuaacauagaucuacaagguccagaagggaaaaucaaguucccuaaguuuuccuugcccaagaucagugccccaggugugaaaauggaaggugggagcacugagaucggcgcucagaugcccucucuugaaggaggguugagcacaucagauaugaagcuugaagggccucaucugucucuaaaaggcccaggaguagacuugccuucgguggaccucucuaugccaaaagugucugggccugaucuugacaugaacuugaaaggaccaaguuugaagggagaccugggugccuccagucccagcaugaagcugcacgccccaggucuugaccucaaagguguugguggaaaaguacauauaggagcagauggugugaaaaugucagggauugaugccacaacagcacucaguguuggggcaccagauguaacacugaagggaccaagucuacagggagaucuggcugugucuggagacaucaaauguccuaaagugucuguggcuacuccugauguuagcuuggaggcuucagaaggugcugucaaacuuccccacaugaaacugccucaguuuggcaucuccacuccgggauccgacuuggacauuaacaucaaggggccacaaguuuguggagaacuaaagggaucagggauggaugugaaucugaaagggccucagaucucagcaccaagcauggacuuuaacuuggaaggaccaaaagugaaggggagccucggggcugcgggugaauugaaaggcccagcgauugggggagcucuuccaggcaucagcauucaaggcccagaaggaaaccuccaaaugccuggaauuaaggcuucugggugugaugugaaacucucaucagggcagauuucuggucccgaaauuaaaggagaucugaaagguucaggacuaggucuccauggagcuguuccugauaucggugucaaggggccuuccuuuaauguggcaucuccugagucagauuuuggugucagcuugaagggccccaaagucaaaggagguguagauguuucagggggugucagugucccagauaucaaccugggugaagggcauaugagugucaaaggcucuggaguugaguggaagggaccccaagucuccucuucucuaaacuuggauacaucuaaacuugcugggaaccuucauuucucaggaccaaagauagaaggagacgugaaagggggccagaccggacuccagggucccgggcugagugugucugggccucaaggucacuuggaaagugaaucuggaaaaguaacauuccccaagaugaagaucccuaaguuuaccuucucuggccgcgagcucaucgguagagaaguaggaguggaugucaacuucccuaaaguggaggccaaugugcaggcuggugcuggagaaggcaagugggaagagucugaaguaaaacugaaaaaauccaaaaucaaaaugcccaagcauaucuuuucuaaaucuaaaggaaaagguggugucacuggcucaccugaagcauccauuucuggguccaaaggggaccugaagagcucaaaggccagcuugggcucccuggaaggagaaguggaagcggaagcaucuucacccaaaggcaaauucucccuauuuaaaaguaagaagccacgacaccgcuccaacuccuucagugaugagagggaguucucagcgccuuccaccccaacugggacuuuggaguuugcagguggagacgcuaaaggcaagcauggaaagcugaaguuugguaccuuugguggcuugggaucaaagagcaaaggucauuaugagguuacugggagugaugaugaggcaggcaaguuacaggggaguggcguguccuuggccucgaagaagucccgacugucuuccuccucuagcaacgacagugggaccaagguugguauccagcuuccugagguagaacugucaguuuccacaaagaaagaguagugggccuucaugcauguacauauauauauauauaaaacaucagccuuggguguguuuguauauaaacuccaaagagaaacaccccaauagccuaagcaauaaugcaaagaucuugccccugccaguggcaagugccgacaaaccaagugccuguaggcuccugggacucugcagcuagguaaagaguucuaaguucaucuggcccacgugcaaagucaacaguauugccuuaagauuucaguuuuuuuuuuuuuuuuugguuucuguuuucuuuucuuuuuccuuuuucuuucuuucuuuuuuuuuuugcauugaacgcugagagcucguguuuacuaagcaagcuuuuguguuuaucuuccuuauuuuuacugaacaucuucaguaccuggguaauggaaacccacucuuuuuucauuguaaugacuuugggggcuuuugugaguaagggagggugggauaaaagguggcagagggagcaaggucuuaauugcucugaagguuggacccgugaagcccuggcauagaccugaagagguggcagccagugggugguuguuucucaaucucuguagcaugacuuuuuaauccccagguguguuagucccagccuaguuuggugcucgaggugagaggggauuugaaucuguuugcaaauuguccaacccaccaggucaacgugaggggcuuacauucuggguuugauaagaaaaguguucauucaugacugcuauguccugagaaaaguuccgauuucuuuuaacaaaugucaucaugauuaaggaaaugucuggcacuuuaauggcaaauuaauugagaauguaugaaagucaugaauguacaagccaaauaaagcucuuuauuaacccugauguaucgugcucuuguauucuuuguugaagggaugaagccaagggaggcugcacacacagcccucaugggucagacuugauccaccugaugcuauugcuacuuuuguuagugacuuuaaggcauuaccucugcacagguaccagaaggaagucuuugcuucuugauuaugauaggagacuggcagcaucaugacugagcaauugagagugaacaguggucauaauucaccacagaacauuuaccuuagcgugagcaagacuuuaaaauggaguggggguuggggguggggcugagaauguaauucaguucauagagugcuuggcugguaugcaugagagccuggacuaaauucccagacacucguaagacccaguguggugguucacagcugcaaucccagcacauaggggcggaagcagaaggauccucuuuuuucuuuuuuuuuuuuuguauuuuugagacagauauuuuguauuuugagacacacuguaaccaaguguucaaggcuguccugcaacucccaguguagucugagcuggccuugaauuugagacaaucuuccuaagugauggggucacacguguaagucaucacauccaguaccauguacacuguugggaaguugacugcuaggauauugggaagauauccuagacagaaguguccaagcuguccaauuguacaucaacucauuuauguuuagcuugaggaaggagagguguagcuaguuagauugaaguguucacucauucaguaaauacuuauugagcaccauggcuagaugcuaaggcccggugucagaccaaaugacuguaauggauacugaaaucuggaaugcuuugaauccugaaaaagggugugggguugggcgaaaugacacauuuaguggagaugaugagacucccaagaccuucagguaauaacuuggcugggagaguugggagucuugaauagaaugggugggcaguaacuggccauuaaaccucaaggaaccuuucagguguucuuccaucaggcucaggcuggaggcagugacuauagaacagaaggucuccauccugcaggggcccucucagcaggaggagcagcauggaaggaggcaguaggggcuggaggauaaccucgaucguccuucuccuuccucugcugggauucuguaugcuaccucucugcuuuaguaaguguuggggauugaacccaguaagaaccucugguaugcuaggcagacacuacccaaugugcuaaaucuccagaagcaauauuuuuguucuuucucuguuguaguugccuacagaguuaaauauacauuaaaaaaugaucauuuggacucaugaaauggcucaguaggaaaaagugauugcugcgaagucugaugaccugaguuuaaucuccaaaauccaaauggcggaaggagauaacugacuccugcaguuuguuuucugaccuacagauagaccgccagccagccauccagacagacagaugcaugcaagacacauacagagggaagauaauuuccucagggaaacaaaguuuucucucaauuuugcagagagccagaagggacaaagacacugcagaguuccuggggccugcaaaagaguacuggccugggagucacugaguuaaucucccguguuggguccauuaggguccacugugaaccucuauuuacuuccugguaauguggauggagcauuuggagucucuaagguccuucccagacccaauaguccaugaugcccuuggaagcagacugaagagugguguggauggaccauuuugggugaaaagcaaggugugauuguaacacugaguaauuauuuuuccugugugacauugucugaaauguucugaggcaugucaguguugaaguguagcugagucuccagcuucccagaccaaaauggacagccuccaccgggacucacacauggcuaaugcacacauccuacuucaggguaccaucugagcugugaaguuaggaaauacaaccagagggcucagcuaagcaugcaacuaaagguguugguccuuuccuucauccuuccuuccuuuuaucuucucucuuucccuuaccuccaccccuaccccauccccagaucucacuuuguguccuugacuagccugaaacucauuauauagaccaggcugaccucaaacucucaaagaaccaccugcuucugccuccuggguucugggauuaaaggugugcacaccacuucugucuuuucucauucuuuuuaaacuaugcacacuuuaaauuaaaaucuucagagaaauugcaagaauaauauguugaugcacauauacauggcacuuguguucuccucccccucccuccuccacuccaaacccuccuccuccucuuccucuuuggaggacaggguuucucuguguagcccuggcuguccuggagcucacucuguagaccaggcuggccucaaacucagaucugccugcuuccugagugcugggaacaaagguguguaccaucuuuagggguguucuccaauucuuaacacuuuccucccuuacuuuaaucucucuccauauagauauuauaaucacuuaauuuuuguugaauuggucaagagcucacuacagaugucacagcacuuuaacccauaagugcuucacugugugcggacacuuucuuaugcaacucuaauauaaugauuacauuuaguaagucuuuuuuuuuuuuuuuaagauuuuauuuauuuauuauauguaaguacacuguagcuguuuucagacacaccagaagagggcgucagaucucguuacggaugguugugagccaccaugugguugcugggauuugaacucuggaccuuuggaagagcagucgggugcucuuacccacugagccaucucaccagcccccuacauuuaguaagucuuacuucgaucuaucauucauaucauccauucuuaaguuucuugcuuaucccuguaguuuccuuaacagagcugaccuuuugucccagcuaggcuucugagucccccuuggaauuguguucucuucuccaugauuucaaucuauuauuuugcuuuguuuuuaaugcugucucuagcacagagucuuauacuuguuaccuagguugcccugaaacucccuguguaugauuggcucacacuaaugcugauccucuugccucaggcucuccaauucugggauuacaggugugagccacuauuucuucaaccuagaaggucucacuauguaacucagguuggccagaagguccuucuguaguucaggcugaccucaaacucacaaugcuuuugccuuagccuuccaaagcuaugacuacaagugcauacaacgaccccagcagcugcaauaucuuuuccuuuuaaaaaauauuuaauguguguaugaguguaugaguaugagugagugacugugugucugagugugggagacauggcucaaguguggaagacagaggacaaaccuuggaacaugggaucuuuggucuugaggaucgaacucauguccuuaggcuuggcagcaaguacuuuuacuugcuccccucuugcuggccuggcauugauccuuuugaaggguauggagccaguuguuuuguagcaauaucccuuugugugaugugucugaugcuguuccuuaugaucacaucagguggcaccuuugcggguaggacacucauagaaguaaauguuaggugccuuuuagcucauccuucugaaggcaugugaguguacuagugccaauuaaguaggagcuugccagacuucuuccuuguaaucuugccauguuuucccuucagaauuaacaaguaaaucuaaguuuucaagcgagaaguccaaguuugggcaaguuuauuucgcaagugcacucuggaggcugguggcaugcuuggccuuggcgugaucucugguuggggauuuugaaaguggggcucuggccuagggcuuugcagcacacagcagcuuucugucuuugcucacgaggacaaagaauucugugcaugaaugcuugccacagagcugggaauaccaggagcuguuuaccagccucuggaucacccuguggcgucaggcagcuucaggggccuccugaggcugaaugcucccugcagaguagcagccuugugccacagcaaaugugugggggaacauucugcccaggagggcgguuucguuuccccauaaaugccucuguuuuuuuccacaacaaguuugaggucuggccagcacagaaagacuucccgguaggacgguugagguuggaaaggguuacagaugaagaacccuucuuuuuuuuuuuuuuuuuuuuuuuuuuuaaauuuuuggacagacuuuuagugcacaagugcuuuaucuucaggacauuucacacuguguucucagcuccacccaggaaaguaggcacuacccacuccaucucacaguccagagaggugaggcucuacucagagccuagaagggaugauccugccuagggaaaucaaagcuuucagauuuuagaaacuaaauuguuuuuccucccccuugauaguuuccugaaggaagggggaguuucggggggcgggggggggcauaaaaaaucucuugaaaucuguagaucuuagacauuuucuugucucagaaaguauuaagggaauaauaauaaaaacuagagccaagcauggcgacacaugccuuuaaucucagcacuggggaggcagaagcagguggauucucugugaaugcuaggucagccuggucuauauaguugaguguccagcuagccaagguugcauagugagaaccugucucaaaaaacaaacaaacaaacaaacaaacaaacaaacaacuaauaacuggggauggagagauggcucaguaguuaagaacacuuauugcucuuguagagguccuggauucaguuccagcacccacauggccaccuacaaccagcugcaguuccaguuccuggggaucugacacccucuucugaccuccagggccucauguaugcauauggcgcacauaugcacaugaaguuucacacucauacacauacauuaaaaaacgaaaucuugggacucagagguuaauauucuucuggaagaucucagcucaguucccacaaguuggcucacaaugacccaaaacucuaguuucucaucugauauacaucuuggccucuuagggcaccagggacacgugugcuaugcauacauauaauauugcaacauaaucauacacauuaaauaauuuaaaaaauagcuauuuuuuaaaaacuauuuuuaaguuauuuaaaaauagcuaucaaaugcuggguggugauggugcacaccuuuaauccuagcacucaggagacauaggcaggugaaucuuugaguuagaggccagccuggucuauagauugaguuucagguugaccagggcuacacagaaaaauccugacuugaaaaaccauuaagccgggcugugguggugcacaccuuuaaucccagcacuuguggggcagaggcaggcagauuucugaguucgaggccagccuggucuacaaagugaguuccaggauagccagggcuacacccugucuuaaaaaaacaaaacaaaacaacaacaaaaacuaaacuaaacaaacaaacaaacaaacaaaaaagaaguuagauggaagaugcuuucuuaauuuuaugaggccuuguggauauggagauagaucuagauuuuacuaauguuucccuucuccagaggagcagcuuagaggagccccagauggggcuauuauuggguuuuccagauucagugucugucugcuacugcagacaugaugucuuucucuguugucuccuuuguauucugccucguuccccaaugagaaaccauuaaaaaaaaaaaaaagguucuuuuuggggacuuuugggacccuugguaacucaucaaaaucugugacauaaggcuggagauaaaacuuaguugguagaguuuuuugcguggcguguucagguccgggguucguuccuuaggacucaggucaggagacagauauggaauuuccuuuucuguaagaugaaaagaaggagaugguauggaauucuucuuacagcauuaugagaauaauguaaaucaacaugcauaccuucuuccuaauaaacuccaacuucugcaucgugaauaguacagugugcucaauguauaguaaaaauuguauguaugaauuauuuccaugaacugcuugcuaacucuagguuaaguguucuauaagucacacacaacgccacaaggugggcccuaauuugcauuuaauaggcaaguucagacaggguuagugcugugugcaggggcacauaguccaacagcgucaacauucucacugcaaucuguucugagaaaccucaugucuuuaucagcaguuuguucuuucugcuaccaggaaggguggguuaguaaacuguguuuuaaggcuuggagaggagcugagggggguuuuccaagcagggaaacagcaggaguaaaagcugguagugaagugugggacagcagggugggacuagggcaggaaggguggacacugaggucccagaggaauacagguuucaggaucagcuuuggaaggcaaagccuggugaaugcgcccaauuuuuccccuccaaggggaggcagugggcucaagagcaaugagcaugggcagcugucagucucuuucuuggacuuccuaccucauacuauucccaguccuuugcccuauccagucuucacucuuccaugauacuaauaaaugagagaaacaacugaaguuaauguauuauaguuagucccgcccacuggucccuuggagaguggacagguugauggucugcaaacacuguucugcucaaucuggggcccuaggagguugaaccuugugucuaggggagggccugaaaaugagagguacuuccacacagggauugggagaagggaagggcugcuuccaaguguuuccccgucuaucucugcaccugccaugccugcucgacuccgguuugagaaucauccaacagccuauaguaugaucagagauuuccacacuccccaagugggauggggcaguucagcccacccaagcccaggguaagaacucaggacaccuagagcucuuuaaucacagauuagagccuagaaggaaacaagucaaaauccaagaagaagccugggcaaaguggauuagucagggccaggaugauuggaugagccugagaaauguaaaggguguggacgaggaagacuaggaaaaagaggaagaagggcuggggugugacucaauggucuaguaagugcaaaacguugucuuuauucguuacuacgcagacagccccaaaggguggcuguucauaggguuugagcccugccuuucugggugccccaaauaaauguacccuaagaaaacagaguacuguaacaucaaggcaaaauuuuugcucugaccccaaaucaaaugaucugacacccccgcccccuaccccaauucaccaauucagcuguuaguguccaggaaacaagggaucccagucucugggaguaauuguagccacuuucagccaaccagccaauccuggaacuaauccaaguucugccacaguuccuaggcagauuuuuaucuauuuagaccaggcuggugugaaguaaugagccaggcugauggccaaacaagacugggcauaugauacugggcaaucacagaaaaaagaccagcagagaccagcuggaagcugcuguacgugggucacauguugccucuggggccuaccccuuacccggugggaccuucauuucuaaaaugcggcaucagccccaacucucugcuuuauacagacuuugccuaaaagaugacuuuguauaugacggcaucuuagguuugcacuuuugaaugcugguauuuaaaagagggcuggggacaugguuugguacuuaagcucuugcucucguacgugaggacuugaguucugguguccagaauugaggcgaaaggugggcaugguauucuggucuguaacccuaucacugggagaugggguggggauagagagcucccagagcucucuggccugacagucuagcccauuggugagccagaucaaguaaaagaacagguggacaaugauagagaaagacaggugacuuuggccucuggccuucacaugcaugggcauagucuuguacacacauacacacacgugcacaugcauaaacaugcacacagauacaaguacacacaaguaauaauaaaaacaggacuugugugugugggcugggaauguagcaaguccuggacuugccauaucauaagccuggugugguggcacacaacugaaaccccagaacucaggagguggacccaggagaaucuaaacagaacucaggagguggacccaggagaauggaggagguggacccaggagaaucuaaaguucaaggucauccucccauugacggcuuuauuccaggacagccugggcuacacaagaagucacccuccuggugacuauuuaagguccauccauccauccaucuccuggaaucuggcagcccuuacugagcuguagucacaugggacugcaguguggggcacuugguacccuccccgaggaaggagcuucagcuuaaagcucacuacuccuguccacccaaaguggaaggcuuugauuuuuuuuuucagccaugcaguauagccugcucuguguguuuuuuccugugugugccgucucuuccaggauacacagcugccaggcagccggugcucuguccccuugcucaggcagccaggccguggggaggacuggaaugugaaaagccagggagaagaaugacagugcauuuucuauuugcaagccugcgagucuggcucgccacuugaauuucaagugggcccuucaggcagauagggaugucaggugagagaguggaggcagccaaucugaauugucuaaauuccuagaaaauaaauucuaggaauuuagcuguaggaguaaggugggucagguagggcaaauucacuguagggggugggggccugguguggguaggcuuccacuuuuuuuuuccuguuugcacaccauauuuuccuucaaacuauuuuccuauugaaucuaauagacaagcuuugaacuaagguuuuuauuuuuucuuuaacugagcugcagaucucuuuuagaggaaaaaaaaaaagccacucccuuuaaccacuguuuuugguuacugcucuuuguuuggaguaauuacuacccuuaaaagugggaaauuacagauuacagauuaucagaaggaaauaagugcuuuggauuagccagacucuugccccuggauggccauuccaggccuugccagucucccagguacaaagcccuguacuacauguucugcaaacacucccuuuccuuguuuccagagaggaaacgguuggauccugugugucacuugucagguucuuguuacauaaccauggaaaaccuuugauaggguuugcuggucacaggaaugaguacagggaacaacauggggucguggcuugucuuuuauccacugugcccugacagcggauugaacuuggaguguauuuucuagcacugauuuaauauucacuagaaagauuuauaaguuggaugggguggugucuuaggguuucuauuccugcacaaacaucaugaccaagaggcaaguuggcgaggaaaggguuuaucuggcuuacacuuccauacugcuguucaucaccaaggaagucaggacugggacucaagcaggucaggaagcaggagcugaugcagaggccauggagggauauuccuuacuggcuuguuuccccuggcuugcucagccugcucucuuauagaacccaagacuaccagcccagagauggucccacccacaaggggccuuucccccuugaucacuaauugagaaaaugccuuacaguuggaucucauggaggcauuuccccaacugaagcuccuuucucugugauaacuccagccugugucaaguugacacaaacuagccaguagagguaggguggcuggagagagaacuuaguggcuaagagugacuccggaucuuugggaggaccaaaguuugauucgcagcaccuacauuggguagcugacauucauuugcuacuccagcuccaggggaucugacuuucucuucuggccuccuuggguaucugaacucauguggcauauacucacagauacacauacccauuuaaaaacaaucuuugugggguaggguggcacauaccuuugauuccagcugauuaaucaggaagcagaggcagguggaucucugagagucugcgggcaaucagagcuacacagcgaguuccaggacagccagcgccacauagugauaccccgucucaaaaaccaaaacaaaaaauuuggaugagaaugcuguggugggacggccugacuguugguuuacgcagagagggaagccucguggagguaccucagcuugcccauaccucaucaagaccuggggaacccuugacccccaggcuccucucuacuguuuacugcaaugguugucaguuucugcgaggucaugauuggccuugccagucacucucagcagcccucuggcuuugaugcagccuucucuuuucucacccuuggguuuuagccuaaggggcauuuccuccuggaagccugccuggaauccucucucuuucccaacuauucuaugcucucauuacuuuaguuuucuggucucaaugcuacuuacauuuaguuaucagugagagacugcuugucagucucucuccggaauuagacugucaacccugugagggagggaugcuguauucuuauuuauuauuuuauuucaggcauaaugccaggcaccuggcauguggcacccagcacuuggcagaaauucuguaggucacaauggcccugucuuaucacugcauacaguucccaucagcaauagggacaccuguuuuccuucugucuuuugcuggguagucucagugcauuuuccaaaauucagggugagagcaaacauaaauaaacagaagaugaacaacaaacccagggcuguuuuuauucuuauuuuuauucuucuucucugagcuauuguugagguuucugcaggccagccgcuucccuugagcuguuagggugugaauucagcuguggucagggauggucugcagacuguugguggcauuccccaggucugcaccauuccagcuuccagaaugacauauggguagacaggaggucaggcagagcuuggagacacagaaagugaagaccuaaacucugagaauggugggcuacugguagcugcuguggggggaguggaagaguauuccgucaguaagguuccaaacaagaggcaggcaccuggcauguuagucauggcucagucagugaaguguggcugugauuauuauguugcccuucaguuguuuucauuuucauuaaauauauauuguauacuuauauauugcagagagagagaagagagagagaagagagagagaagagagagagaagagggagagagagggagagagagagagagaagagagagagagagagagagagagagagagagagagagagagagagagaggccgugguggugcaugccuuuaguuccagcacuauugaaguagaggcaggcggauucugaguuugaggucagccuuguauacaucaugcauucuaggauagcuagagccacacagugagaccuuaacucaacucccucccccugcccaaaaaagcuagaauggugguguggaucuguagcaccagcuacuaggaaggcugacaggaggauuacuugagcucaaggguuuaagaccagccugagcaaugaagcaaccuugucuccaaauacgauaggggcuggagagauagagaggacccagguucaguuuccagaacccacaugguggcucacagccaucuguaaugccaggcgaucugaugcccucuuuuggccucugagggcacuaggcaugcagacauacauacagauaaaauacccauauacauuaaacuaaauaacuauuuaaaacauaacaacccaucuguacaggcugguuuugugugucagcuugacacaaauaauagguagagacauaaucagagaggaaggagccucaguuaaggaaaugccuucaugagauccagcuccaggcauuuucuuaauuaguaaucaauuggaggagggcccagaccauuguaggggauaccaucccugggcugguggcccuggguucuauaagaaaguaagcugagcaagccaugagagaaagccaguaagcaaggcacuccauggccuugaaucugcuccugucuccagguuccugccuuguuuaagaaccugcccugacuuccuucaaugaugaacaaugauguguaaguaaaaaccaaauaaacccuuuccuccccagcuugcguuuuggucaugguguuucacugcagcaacagaaauccuaacuaagacacccuccaaaauaaagugugugugugugugucuguguguuuguguguuuguguuguaugugugugcaugugcacacgcacaaaugcuugcucacuugcacugggaugccuuuguaguccagaagagggcauuggauugauuucauggaaaugaaauuacaguacuugugaguuucuugaugugggugcuggaaaccaaauucagauucugugaaagaacauuaaguauuccuaaccauugagcuauuucuccacucccuaaauaaaugauagcugggcaugggagcaaaggcuuauaaguccacuacuugguagaucaagguaggaagaucaugaacuuaaggucauccuauucugcauagcaagaccuuguuucaacaugcaaauguauacacaugcaguuuucaaugagauguaauucugaguaggacuccaaauguauauuauaguauauuucuuuuuccacauguguguauaugcaugugugugugcauguguauguggugugugugugugaaguuuaugaaugugacauguauacagacauauauuggugagguguggcauguauggagaccagaagaggauaucuggauuccugcucuauuacucuuugcuguauaccguugagacagagccucucacugaaccuggagcuggacuggaggccaguaaagcccuagcuauccugucucugcuccugacagugcaggguuacaggugaggguuaauacccagcuuuuuacacaagugcuggggaguccaauucaguccucaugcuggugcagcgggcacugcugcccacugagccaucuucccaacaguuuuguuuuacuaaaauauuaaaacaccuuuguuugcccuucuucccuuccuccuuuccucccccgcccccaccugaguuuuuugacucccuagaaaucagccggaauguggagagucauguguuccucugauugucccaaucccccaugccugcccucccguucuguuugagccugccagacacaugacagaagcgagguugccagugcagaccacugcagaaugagacaaagcccugugccuuuugcuaggaggcauuuggcugugacauacuggcaugugaaugcagaaaaauaucuguggugucuggagggagcauauguuuuauguuucucagguugagacaaaguccuucuagaaagcaauuuugagugcugggauauagcuccauugguagagugauugcauaccaugcacaauaugcugggucugauugcuagcacugugcuaucuaaauugggcaugcuggcacauacaggccuguaaucuuagcaccugagggguagaggcaggagacucaguaauucaagccauccucagcuacacagagaauucagugccaaccagggauacaagagacggggucuuuaagaaaugacugguuaguggauuuguacgggguuagcaaucccugauccucgccagcuccguuagccucaucggauuucuucuguggguuccucuuccacagagaacaagcuucugcuggcuaaaacagauaaagagauuauucacuaggguaaugaaugggaagucaggaaucucaccacuugauucuuuugccucuaaggggaaacaaaauggcuuuaagguaauaauucuuuaauuugauuggccuuauggucaacuagguuuagcaguuuaaaacccaccuggguuuugcaaaucaugggagcaaucagauuggcagugucucaccucagggcuacauaaggacgggcacguaggaaugagaggaacagguuuaaaccugauucagauaauuaaugaaacugucuuucccuagcaaccacgaaaucuccaggccaaucagauuaccccagccuuucaguacccgugugaacccacacucaaggaagcuggcuaggccaggcuuggguggggcaaucaaguccugugaagugcaauuugagggccucaggauaggcugccuagccagaaauaucuccucuaccggcuugucaaggauagcugcaauuucaccagcacugagucauuuaucuuuuguuucugugguugucuuugccaucucucccugacuguaguggucugggauacaugauucccuuaaucuucucucuguaaaugaaacagguucaauuaaaccagcuuuaaucuuuuggguaagccacaaacucaguuccacuuuuuccuaucaggccccugugcagcccuuugccuaucccaguccaguucuguuuguuuagauaggagguaaaguuugaaguugacgagagauaggauggccagaagcaagggccuggagaccagcagguuuugccacauggauucucugcacugccaggacugggugggccuuggucugggacaggauggcauauggagggagaugcuuagcauuuguauggacuccucuucuugacuugccccacucaccuugccucugauaucuauucuuuguccucuugcccccuuggucauccucauuguaggugguguccugcaggaagggcauucucgugaggugucccuaaaccagacuagagguuugccacccacguucagucccucucaaaggcuggggaguggcaaaagaggaaagggcugaagauucuucagcuuguacaacugcuuggcgcagaccuggagacccauuagugagaagccagccugaugcuacuuguguguguuuaaaaccuuaagccccucccaucucuuccuauuuuuguggcuaccaagagaugaccagaaccuacuuuugcaugaucuugccuucaggcaugcuuuaucuccccagcuaacucuucuagacauuucccccuaccccaaaguaauggcgucauaaacuccccccaaaaggaaacuccacauuauuauuauuuuuucuuuuugaggcaagaccuuauguagcuaaagcuaguuuuaaacuccuaagcuuccugccuccaccuccugagugccaagauugcaaucacaugcuaccacaccccugacuggaaauccauucaguauuuuuuuuccuuuuuccaugugugugugugugugugugugugugugcaaacacauguguggccuguguaggccugauugguuuugauuguccuucuacuuuauuccuuaagucagggucucuccagcgagcccagugcuugcugacaugguuagucuagucagucagcuugcuuguagauucccugucacugcguucugagacuggagucacagacaggcugccaugccuaccugccauuuauguggguuucuaggggucugaaaucgguuccuaaugcuugcacagcaaccacugagcagucucucuaccucucugaacauuuacaaaguuacuuauuuuacguguauguggcuaaggguauguauaugcaccacaugcaugcaagagcuggaggaggucagaagaggcuguuggauccccuggucuggaauuacagaugguugugagcugccuuaugaucacaaagcuguaaggaguuaacgugugaaugaaaacuauguggccuuguuuggcacaugcucagugcuaauguguuugcccuuauuauuugaucauuguugccgacaagaaaaagcauuccuuucuucugugguuauuuggacuuauucugagguucauuuuauaacugaaagcaacgaauugaaagaaaagaaauagcuaugaaacacuuacucaaccaaacucuuucugggaaagcugugauuguuuuuugagaacuguauaauuucugacuaaucuaucugaaauuuuggaaaugcaugauaaugaagaaucagggaugggacuaaccuaugugcaguuguuugauuguuuuauucugagacaggguuucucuguguagcccuggcuguccuggucacucuguagaccaggcuggccucaaacucagagguccuccugccucucccuccugagggcugggauuaaagaccugugccacugcugccccgcccugugugcagcuuuuuagagccuuagaaguuuugugucauuuuaaaacaagauuuuaaaaaauuuuuuuuuaauuagguauuuagcucauuuacauuuccaaugcuauaccaaaaagucccccauacccacccacccuuaaaacaagauuuauuucuuucuauuuuuuuguuuuuguguagcgccuacacauauguauuugcaccauaugcgugaccggugcccaaggaagucagaaaagggcuggauccuccagaacugaaguuauggguguuguaaagcacuacguaugugcugcaaacaggaagagcaaguguucaaucuccagccccuacuuuuuuuucuugagacaugguuuaauauagccuaagcuggccuaaaacugaacguguagccaagaauggccuugaacuccugaucuuccugccucuacggaggcagccucagugcugagaugacuugagugcacuaccgggcccacaugagaaauuuccuaggauaaagaacuggagagaugccucaguggucaaaagugcuugcucuccaaucaugaggagcagagcuccaaucuuacguaacaaaccagguaucccuacaaauggccuguaaucccagcaguuuuguuuuuuuuuuuuuucucuuucuuuucuaauugguauaaacaaaaacaauggaagggcaacagaauaauccaaacuacacuucaugugguuuccaggagagcugagaaaaugcagguucaggaagagacccugccucccaaguagaaggcagagagagagauggagagguccaugguccauccaacaccaucuccaggccuccuugagugugcacacgcuuacacagaccagacacaacuaaauacaucucuaaaauaauuugcuagaaugcuagggaaagaguagccuguagaagcugcugccacuaacuaaguucuccaugagcugguuuccauguugcugucugguagacucuggcuauggccaggaaaucccaaggcaaugcuguuucuccuuuccgacaggauucuuccauccagaauggagaugacccuugauuggaggucuaccucauaagucuucaggaacuccuuguggaguacagccuacugguuguauguucugcucuaugacauuuaacuuagugcuggacggagagaaaagguguccuguggacaauaacugaccaguuuguugguccaauaaaaacuccucuuuccuuacaggauguucauaguguugaacauaguucuuuuuucucucucauuuguuccugcgaagccuuugaggacuggaucuaguuacugaugaaauuuaugugacuuucacagaaggauggcucugcugucuucucuauagccagaacuuccaguguaggguacgaaggggcugggagguuugcagguaauuugggaaagguggcuucucugguguuuuugugcauacccacaguauacauuugagaaauguuaauccacaagaugggguugagucacucuauaaucaucuuuauccuuaucauuagaacacgguacaaccuucaucccuggacugcaaugaccagaauaaacccaaggaagcuaucaacaaagcuggggcagcaucagacuccaccccagaugcaggugagugaagugguggggacugaaaacaugacagccuucauuagagaaggaguguaugcagagauaaggcucaggaaagcaccggcaggugugcugacuuccugcgcuguggauauggaaucccuggccugcuggacccagaaauucaaaaccuucucuccuaccucuuuuaaaaaauauuuuuauuauuuuuaauuaugugugugugugugucugaugucuguaugaguauguacauuugagcacaagugcugguggaggucauaggcgagaggcguaagugcccuggagcuggcaugauagguaguucuguccucagcaggagcugcaaauucuuuuaacugagccaucucuccagcccccauguuuuuguuuuuguuauuuuugauucaaggucuuccucuguacuuuagaccaccccuagacucacaguaacuugaaaucuuccugccuuauuuucccaagugcugggucuacagauuggggucacuaugucuuaguuacccuuccaucucauacgagcagagagagugguuuucaucuauugcugugaggggaauaugcugauagaccuucucuugugagggucucuucugugaauaacacaguggggucugagcaaggugcaacacacauuuaaucccaggauuugggggcagaggcagguagacucugagucgaaggccagucugaucuacaggaugaguucugggccaaccaagguuaaauagaaucuguucaaaaacaaaacaaaacaacaaccaaaacauaaaccgaaguggccauaucacauacugaggacagguuccacgguagccucucuuuccccauaagcucacaaauguaauaauuccuccacagauuuguggauuuaucuucagguucuuucccucccucauuaucuggguaaccuuggggggccugcugaaucccaagcccauacuccuccaagcacuucugaggugcccagcacuggacuccaucucuuccugcucugacccccacccuccugauuucugugcuaauuucugguaaccacacaggucgcccacauccuugacaucucugguggcugagguuuucuuugcugacugcagucaccuccugccuuccugucuuauuuuucuucacugcuagaguaguaggcucacagagcguugguuuaaaacaaacacacaugcucgaccaaaugguauuacuuuauuucuuuaaggucuccaguggcuggugacuuguaggguaaaguucauguucuuagcauacaagaugguuugugauccaguuucuaucucugugcccuuuguucccacagggcauccuucauuccaccugugcuggagucuuugcagguccccgagccaugaugccaggccacagaucuggucuucaugauccuuccaaugcccugccuuacuguuuauuauuauuauuauuauuauuauuauuauuauuauuauuauuauuauuauuauuauuuauuauuauuauuauuagcaggacuggggguugaauguagggucuuggagacaugaauaagcccucugcuacugauuugcaaccccaacccucuuuuuauuuauuuauuuuucuuuugagucagagucuaauuaaguuguucuggcugaccuggaacuuuuaauccuccugccucaaccucuucaguaguuaggauuuuaggcuuuccuaccagucuauccucugauugaguuuuugaugaucucucccuccauucaggcccacuugagucucaaagacccuguuucccaggauuccugggcauauuaacacuagcucccacacugcuggacuuccacuagacuacaugaggcagggggcugggggugggguggggcaaagaaugcucagcaaacaaaaugggcagaagauggcaagagcugcaggcuggcuacugggcuuucgugguagacagugcucuauugcucgugggaaaccguuugguuucuuguguauuugccaucccaacaaggugcuuguuucuuuuuucaauuuguuuuauuauuguuuaaaugucuugaaauuuaaaggggguuaggaucaaaucucuuucccaaauaacucaaauacugaacaagcgugagaugguucucucuuccuaccacguaggucucagggaucaaagucagguccuaagucagauauuagaggcaaucaccuuuacccucuggccuaucucaccagucccacgugccuuggacuaaaguacaggaaugucucucucccuugacugugaaugcuuccuuagaauguagggucuugugcacaugcaaccuagaaacuaaguugugcugggcauggugauuuaugauaagaaucccagugcugucaaacaucacuugacagacaaccagauugucugauuccaggcaccgggcuuaccuggcucugccauuugccugcagaucacaagaagguuuuggcauuucucugagaucuaaaaaaccaguuugaguacaacagagcuugcuguuggucagcaguggucagucauuuuaguaaaauagcagcaagucaguccauucagguggagcuaccugggagccuggucagucuguggcuucaaggcuaauggucauuuugaaggugagauguuggaguguggaaacucaaauuacagcugaggcagccauguuccugcagaccucgucgcccuguuucaagggcagcggagcagcccugaagcugccgggcucuaggccguuucagcgcuguaacaugugcaggcuauaauuuguuugcuuuuucuuucuguuuguuuauuuuuagacggaggugggggucuuccugaguagcucauguuggcuuggcgcuugugauccuccugccucccccccucccccaguacuaggauuacagacaggcaugugcuaccacacccaguucauuuuauauuuaagugccugagucaugcucacacgugaacuugguaaaagcuuuaaaauaaccuuuuaaaauaccauuuuaaccuuuuuauuuucuacuaagagcaauuuaacccagggcuuugaaauuucuaggcaagaguccuacuauugagcuauauaucucucaucuuuuuuucuuuuucuuccuacucuuucuucucucucuuuuuuuuguuuguuuuuuuguuuuguuuuuugagacaggguuucucuguguguguucuuggcuguccuggaacucacucuguauaccaggcuggccucaaacucacagagauccacuuaccucugcaucccaaguccuggugauuaaaggcacauaccaccacuaccugguuccuuucuuuauucuuuuucuucuuaccuuucuuuuucuuuuucuuuuucuuuuuuuuuuuuuugguuuuuucgagacaggguuucucuguguagcucuggcuguccuggaacucacucuguagaccaggcuggccucgaacucagaaauccaccugccuuugccucccaagugcugggauuaaaggcgugugccaccacgcccggcuucuuuuucuuucuuuuuuuuuuuuuucaaaaguucucuuggaauccaggcugaguugaucucaguauguagcagaggaugaccuugaggcuggccucaaacuugcugaauuugcaaggauggccuugaacucccgauccucugcuuccaccuuaugaaugcugggauuacaguaugaguugguugucacaccugguuuauucaucgugggcauugacuucaaggcucuaugcaugcugggcaaccacuuuaccacccuucucccaaguccuguuuuuaacuuuuuacuuugagauaagcuucaacuuauaugaacucauucuguagcccagcuuugaauccuucugccuuaaccucccagguagguagaagugcagaccaauuguaggucuaugauacuaggucugcuuuaacuguuuuucuuuuucuucuucuccuccuccuucuccuuuaagucuauuuauuuuauuugagagagaagaaagaggaagugagacagagggggggagagagagaacugugcuuaugugugcaccugcuucuacauguacuagauacaugccugguguccuuggaggccagaagaguuacacacagcugugagcugccuuuuggguucugaaaauuggacuugggugcucuggaagagcagcuagugcucuuaaccucugagccaucucuccagccccuggcuuuacccuuuugggauauucacuucagugauauuaaguaccugccugugcuugugggauccuuaccauaugcuaccuccagaacucuugccaucucccucagcucaaacucuauagucauuaaacaccaacucccuauucccauuacccagcuccuggaaaccaccuuccuuggugugacucugugaaucccaugauuccaaguaccucauaucaguggacucuaaaacaucuguuuuuuggggucuggcuuacuuguaguaguguucugaauguuacagcacaugucagaauaugaucucuguucuauauuaauaguaguuuauuucucguauaugccacauuuaccugcuuaucuguugauggauauuuaggaugccuuucuaccuuuugugaauaguucugcuaugagcacugaugagcaaauaucucuuucguucaaaaauuacauuuacugaugggcaugaucacgguugugcauaccuccaaucucaguacuuaggaggcaggagcacguagauuuaugugaguaagaggacagccugaucaacauagcaaguuccaggcuacccaggacuacauaaucugaguuacugucuuaaacauuuuuuuuuuuuugcaugugccacaaugugucaguggacauuggaggacaacuuuugggaguugguucucaccuuucacugugaagaucuggaggauggaguucagauugucaggcucagcugcaaccuucuuuauuagcugagucaucuuggcccugcacccacuucuuuucaguauauauccaguaauggaacuucuugauauggcccuuagcuuguaucaggugaacguuauacaucaggagaugugugaacacuugcugggaaaguucuccuaccucccuacccucuacugcgguggcucacagaguuuugucuucauaaaugucaucuuguccagaugaacaggugcugagcccaucuuuuacauuugauaugccauuagcaauuucccccauucugucuuuccaccucuauaauacagucacuuuucugugacuacccacaacgguccugauuugagcuccuaacucucacccacacuaugacaguugcuucugugucuuggacccucugguccuuuuuauaucauagcaacaagauugacuuuuucaaaacauuagucaauuaggccaacuuauucuaaauaucucaaaaaaaauuaugucauuuaccacuuauaccuuucugugacucuccaucucacugugaaacacagcucaagggcuagcaaugauuuaagacuucuacuucuacagcaucuggcuccugcucuccauuccugauccuuugcuguucuuugauuugacaaucaaauuccuugcuaugaacuaugccuggaaugcccuucugcuugggaaauucuucucuugguaaaugucaccucaccagagagaccucuaacauaccuuugauccuucuuuucaagcccccaccuucucuccaucccuuuccuuccuuucucacugugacucuccauauguaguacaggcugaccuugaacucacuucaguucuccugccucagccucuggaguucugggaauucaggcaugagccaccucaaugacuaccaccucuggcuuuuacuaauuccauauucuccaucuagucaguguuaauaccuacauuuguuagcuucuguccccuucacuagaauguaaccuuuaugauguuuuuacuuuuuauauuuccuguuguagcuuucuuaaucuauaaacaacaaaauggagacucuugauauucucuucuauguguuguuccauuugguaagcuauauuggaugcugaagcaguaguucauugugaguucauuugagaccaguggagggugaauaaugaauuccagaccagccuaaacuacaaugugagacacugucuaaaaaguggugaaugagcuuggcagugguggcagaugccuuuaaucuuagcacuugggaggcacagguagucagauuucugaguucaaggccagcccgggcuacagagugaguuccaggacagcaagagcuucacagaaaaacaaaauauuuuuaaaaaaaaaaagugugugaaaagugugugugguguaugccagcccauguuguacagugcaccuuuaaucgggaggcagaggcagguggaguaagaguaagagaccagucugguuuaaauaucaaguuucagggcagccagggauacacagugagugagaucuugcuucaaaaaaggaguggagguggcuagugagaugggucaguggguagaggugcuugcugcuaaguuugaugaccugaguucaauccccaggaccuacaugguggaaagagaaaauggacuccugcaaguuguccucugaccucugcauacaugcaugauauguauguacuaauccuguacacaaauaaauaaagguaauaacaucuuaaaaacccauuuggacacugagaaaauauucuguuacugccaaacccggagcacugccagugaguauuaggaaagaccacacucugcauacccugaagucuguacucaaggcucuuucggcugauggcuuucuggggaggcaaccuaagaaccacacuucaaaucccauuuacuugcuagauuauuuuuuccuucacauuuuucuuuuagguguauuugagaaaacauggcuuuuauuucauuuugauuacaccauucucucuguuuccuuugagaguaaacuccauaaagagacuuuggcuguuguugaaaacugugcuucuggcccuaugagaacagugccugucauuuagcggccauccagucgaccuuggggguggggagaugaucugagugcuuccuccguuucaggugcuagcuauggaaaguccguucaucaaaaaugaaugcaggagguguugucagccuuagguaauggcuaaacuauuggaggcuccacgugguggugcgacuugcccuuaagugucagagcugggaccugaacacagaggaguugaauaccucucuccauucaucccuggcuucgucaccaaccagccagauggggucuagugaugaguuuaccaugcuauauauagcuacacugcagcuuccuucuccucccacucucccuccuuugaugcuaaggguggagcccacaaacuagggaagaaacacuuagugaaccccacccaccaagugccucucccucucccucucccuugcccucucucucucucuccuuuccuuuccuuucuuucuuguuuuauuuauuuaaaaauuuuuauguguacuaauguuuugccugcacgcaagcauucagguaccuacuggagaccugaaaggaaguuggaucccuugaaacuauaguuagaaaugaucgugagcccuggcagcagguuuuaaaucccaucuuucugagcuguuuuuccuugaccugauguuguuucgaacauaccauguagaucucucugauggggacagaaauucagggcuggcugauuacuuaguugucuugguuacccguucccucuugauuugaaccaguaacagcggccugaugagguugaucaccccugacucuugggugguccugagcugugaauggauggauucaugagccuaaagcauucuuuuggcaaaucagaaguucugauggccucucacucuguugcucuugucaacuaguggcccugugguucugggcuuuggggggccuccuguauuugggugcagaucaguuuuagaaggagcagauguuaguccagcucugauaggccaucuccugcucuuuuuccucuucuuccucuuccuccuucuccuccuccuccuccucuucucauuguuucucuguguguuccugcauuccuggcuguccuggaacucacucagcagaccaggcuggccucaaacucagagaucuaccugccucugccucccgagugcuuggaucaaaggcauggaccaccauugcccagccaggcaguguuucuugguguggaaaucaugguauuucuaaaugucuuugagguguucaacuacacaggaggaugagucuuaggacauaguauaucuucauguucuggauaguuugucccuaucuuuccucuaagucucuuagggguuaaauguaaccaggaaggaacaggacgauucugcauauuccacacauucagaaugaggaauauuuucuguucacagggauuggggacaaucugcaugauggcccagagauaaaggcagacucgauaaggaaugaaaaagugaccucaccuugaaaagcacaugagcuggugagugguggggaagaugggugaggcaggagaguaaggacauagcacgaaagaucuugcuuuugggcauggugaugcacucuguaauccuagcacuugaaaggcugaagcaggaggacugcuguugguucaagacugcacucgucuguauagugaguuccaggacagcuagggcuauguagagagacucaaccuugaaaaaaaccaaucuuacucagugugguaacucacaucuguaaucccagcacuuaaaggauugaggcagaaggauugcugugaguuuguuaguuuggguuauugucuuuuuuguuuguuuguuuguuuuuuugagacaggguuucucuuuauagcucuggcuguccuggaacucacuuuguagaccaggcuggccucgaacucagaaauccgccugccucugccucccgagugcugggauuaaaggcgugcaccagcaugaccagcacuggguuauugucuuaugcugugaugaaacacuauguccaaaaaugcucauggaggaaaggguuuaucauugaaggaagucaggacaggaacucaaacaaggaaggaaccuggaggcagaagcugauggagaggugcugcuuacuggcuugcuccccauggugugcucagccugcuuucuaauagaccuuaggaucaccagcccagugauggcuccaaccacaauggacuaagcccugucccaucaaucucuaauuaagaauggcuuuacgggcuagagagaugguucaguggaaaagagcacuaacugcucuuccugaguucaaaucccagcaaccacauggugacucacaaccaucuguaaugagaucugaugcccucuuuuggugugucuaaagacagcuacaguguacuuagauauaauaaauaaacaaaucuuuuuuuuuuuuuuuaaaagaacugcuuuacaggcuugcuaacaucccaauccaauccaaggaagccucgcugaugaugcuagcuugugucaaguugacaauuguacagugagugccagaccaucuuggacuauacuguggaacucuauuucaagaagaaaaaccaaaccaggauuagcaagaugucucugugggugaaagcacuugacacacaggccugacaaccugaguuggauaccuaaaggcaaagguguggaaaaguggaaagagagaaaaaucucuccuucucucaauuaaaaaaaaaaaaaagcuuuaacauguaggcagaggguugguuugaugagguaggauauggucuuugaagggucuugaaagugaaucccuguagguuuggggcugcaguguaggucacaggguaggaagugugaggguaggaaggcagcgcucgggcuguugccgaaggaaggacaggagaagcucagucaccuuucuuccauuuaguuuagcgccagcugcuaguuuccuguguaguucgagucuccuccggcauggaagacaucuaaaaggcuucggggaagguggaggucuucagucacugguguuucucucagggggcugcguacaaggccaggcaaggagccuuucuuucuccacacuauguguucugaccugguugggccacaaagcaacagcuccaggaagaauuuuuguuuuuuacauugcaacagaauuccuugcauagcagagcucaggaaaaaaaaaaaaaaaaaagcccuauuugaggacaaaggucagggcuucagaguucaggcccauuuggagagaacccuucuuugcuaaucccaaauuugccugacaagccucugugcugauguauguggaaugaacucugucaagaccagugauuuaaucuaggcuucaaguuacauuuucuugcaccuugaagccaucacccacagacgggcuuugacggcaggagagguaagauuggcagaugcccgucccaggacugccggugcugggcuaagccugcuuuccccagcaagcccaggcagcacuggccuccuuggcggggaguggggucuggguuuccuugacuugccugcugcucuccugcucaggacugucaauggugggaggcuggaggagggagggcccuccuacaaaccugacacaaucaagccacaaggagcaccuggcuccuuaucugccucucccuacauuccagcuccuuggaaccagccaagcucuucucugaaguccaaaggagguugagauacccauauuccccaaagccacuuuggacuguuuccgagaauaacuuuguagcacaggaggcaaagggcaggguugcacccaagaacccaucacccaauuguccagucugauuuggaaaggcaguuuugauuuuguuccuuauccccaguggggauucacacacaguggaaggaggcaguggaaggcacuaggucacagaauagaggccugcucccuguccaggcaguucccaucugcauggugacaggcucuuagagaaauagcuuaauaaaagaguucuaagcagccuggcaaccuuccaaccuuccuuguaccagagacgaaaauguuguccagacaaaauguuuagggaauuucuuagcacauucaccacuuguagaccccaaacuauacaaguuguggaacucuugagaaagagaaaaaaaauaaagcccuuaaauauugugcaaugaucuugcuccagugaguguugaaguaggcauucugugaucuuuaauugugucaacgugagagagauaucugugggccaagagucccaggaggaaugauuuuaaugugauuuuuuuugucuuucuauuuuauuuuauuuuauuuuuuggugacaaaguccuauuacauaauucaggcuguccuugaacuccagauuguccugccucagucuccugagugcugggauuacagacacaagccaagaagcccagccuuacugugguuuuuguagcaauauaugccuuuuuuuaaaaaaauuuuuuugggagggggcauuguuuguuuuuguuuuuguuugagauaggguuucucuguguagccuuggcuauccucuaacaagcuuuguagaucaggcuggccucaaccucacagauccaccuaccucugccuuuugaguacuaggauuaaagaugugcgcugggccugcagaaauggcuuagugguuaaagaugugugccaccaugcucagugaaauaugugccccuuuucuaagcauugccaauuguugaagucaauuugagaaaauuaaaagaagaaaaaaacaaauuaaaaauauuaguuuuggugugaaggacaugaaaauuacuuauuuuuguguguguacacacgcacacaugcauguggcugggcacgugcauguggcuggaggcuacagucaaccuugggugugguuccuucggggccaucuacuuuguuuugagagaucguuucuaauuggccuggagcuggugguucagcuguucaugccuuccagcucugggauuaggaaaguaggccauugccaagguccccaugcuugcucagugucucagacacuguuugcugugaagagacaccaugaccaaggccacucuuaugaaagaaagcacuuagcugggacuugcuugcaguuucagagguuuaguucauuaucagcaugauggggagcauggcugcacacaggcaaacaugguacuggagcaguucuauauucacaucuguaggaggcaggaaaagagagacucugggccuggcuuggggcuuuuggaaccuuaaaguccagcccucugugacacacuuccuuuaacaaggcugcaccuccuaauccuucucaaguaguuccacucccugaugacacagcauucaaaucuauaaaccuaugggggccauucuuauucaaacaaccacacccagcaagcaguuuaccaguugaagaaagacuagggguguucaugccuagcaugcaugaggacuugaauucaauccccagugcuucaaaaaagaaaguacaaaaauuaauuuauaugacucaguuuuggggcugcagaguuagcccagcagcuaggaguguuugcuccuaccgagaacugggguucaggucucaguacccacaugggucuuaacaacuguuugcaacuccaguucugggaccuaacacccucuuuugaccuccacaggcaguucaagcaugugguacacacacacaacucauacacauaaacagacagacaaacaaauacauaaauauuaaacuaagccgggcagugguggugcaugcuuuuauuccuagcacuugggaggcagagacagguggauuucugaguucgaggccagccuggucuacagagugaguuccaggacagccagggcuacacagagaaacccugucucaaaaaacaaacaaacaaaaaaacuaaaaacaaaaaaacaaacaaaacaaaacaacaauaacaaaagaaaacaaaaauuaaauuaaaaagccauuuuccuuuuuuaaaucuuuuuuuguuuuacuuucccucucucuuccuuuucuuccuccuuuucccuucccuacuuuagacucucucucucuuagauguggaacuuaaguuuaaggccuugaccguauuaggccagcauuuuaccacuaaggaacgcucuagcccaagaugccguuuuccguguucccugaaguaugugggugagagagagaaccgauuagcacauguccugggucuuguuggggguggaucuggguugagcacugguagcuagcaggagagggucugcucuuacugugagcagaacacaggggcucagccuacccuugcaggccuccaggcucagcugacaagaagucacacagggagagaaggauggaugaggagauaaggagaccacagacgcucuucuuuuaagauaacagugucucuggggaggaauuccuucgagaaggggcaacugaguauaagauggcuucuugcauggcugcugacuaaugaaggccucauggauucagaacacacaccucccaccagcaaaacaacagguuuccugguguacauuucccaucaugcaccaaccuuggccuuuuuguuuucuuccucaaauauaucaaagucucugggcuuuuuguuguuguuguuguuguuguuguuaaucuugggucgggaauaccuagaagcuauucaggucucaguacagccauuguuggcucagauaaguccugacccuggguuugauagggcgcgccucaauuuuaaguuuucagagacucucuuuaccaggcucacacagcuuuucuguauuauguuugacaggguccccucacacccuuuaccagacuguaaccucagccucuaagaugaggaccuuccuuaccuguggccagguguucuaucuggcaggaacaggagaaaggacagccugcugucuaugagcaccgggcauauugggacaguuucugucugcucugacuucaauccccagagcucugacaaguauucaguaaguguucaugggcugaccaaaugacaagcucacuuuuuuuuuuuucaaaagaggcaucuuuuuaaaaaauuauuaauuauucagcuggauggugauaacacacaccuuuaaucccaguacucccaucuuggggaaacucucugaguuuaaggucaguuuaaggaccuauggaaugaguucuagaacagccaggccuacacagagaaaccaugucucaaaaagcaauacuuacuuacuaacuuacuuacuuacuuacuuucuuacuuacuuacugguguguguguguuugugugugugaagaauacauauguguauguguacagagcauguggcaucuguuaguaagggugcaggcauggcacagcaugcagguagagguacaaggggaacguguaggagucaguucccuuuaccuuagguucuagaaaucagacuuagaucaucagcacuuucuuuuguugagccauuucagccccucaaacucacuuuugucuucucuugagacaggccucucuauguagcccugacuggccuggaacucuguguagacaaggcuggacacaaacucauagagaucugccuaccucugccuccugaguacugggaguaaagucaucuuccuccaccccuggcuuuucagaucacuuuuucugaggacccuagcagucauguucuguaucugaugcaacccucagaagagcccagagacaacaggcgugguggcgcacaccuuuaaucccagcacuugggaggcaguggcaggcgaauuucugaguucaaggccagccuggucuacagagugaguuccaggacagccagggcuauacagagaaacccugucucgaaaaaccaaaaaaaaaaaaagaagaucccggagaaggcaguguuguguccaucuuacagaucaggagaguaaagucugggggauuuaguaacuggcugacauuaaacacuucauuuauuuuuguaaucagggucucaucuauuccagguugugcuagaccucacugugugacuaagucugggaauuacagguucuguucagaaaaugacacaagcaauaaagugguucuucuuuuuuuuuuagcugcuuuuuuuuuuuuuuuccuuuccccaagacaggguuucucuguguagcccuggcuguccuggaagucacucuguagaccaggcuggucuugaacucagaaauccgccugccacugccucccaagugcugggauuaaaggcgugugccaccacugccuggcgaauaagugguucuuacacauaugaugcauaaaaacuaccagggggcuugugaaaaauaugguguuguaccccaacucccaaggcucugauuuccucauagcuuuaaagaauugaaguagaauguacuuaacaaaaauuuccaguuuuaguaccgauuuucgagacauggucucuuguaguccccggcuggucucagcuugcuagguagccaguaugaccuugaacgucagaaucuccuguucacuucuacuuccuauggacuauugagguuauaagcaugugccaucauggcuguuuggcacuggggaaucaaagccagggccucaugcaugcuaaguaagcacucuaucagguaaguuacacacacacauacacacacacacacacacacacacacacacacacacacacacacaccacauguuuuaaccauuaagugugcagugcucuaguuuaaauaagcucacauucuguacugcuauccaucuuuagaaccuuucccccuuuuccugcuaaaacucagaccccuugaacaucccuguugaacaccaccuucccagccccccugccugagccccugcaaccaccauucugucccuacauagcuaacuauuugaguaaccucagaagguaaauucagaguuugccuuugugucugguuuauuucacuguccgaguauuuuaaacaagggcuucuggucauccucaugccagggucuggaucauucuuugagaaauuaugguagcgggugggaagagcgggagaggaagugugguccuggcauaggcaucaagggagggcugaauucaugcgguucuugagggcugguaugagucagagcaggcaggaggcaggccaacagccacagagaggcccuugacagggugggggaggagaggcggcugguggcugguaguuauuacuuagaagcagcgagguugaucuguuauuauuuagagggugguggaguucaaaguggagagauaugaaugguagcucacaagaugggguaauggagauccuagaggaggaugggguuugugguacccagggagggcaaccaaaguggaggugccuggagaacaggggccuuacggggcaguaggaggacagugugggaagcuggccuaggugagucgggucagaaugugaagugaaagccugcaggggaaguauuugaauagggcuguauccucacucuccucgcugcuguggcaaauuccuugcaaaggauacaaggaaggaagagcuuauuuugguucacaguucuaggcacagugauagagaagucaugguggcaggcuauugaggcagcuagccacaucgcauccacacacagauggcauggacucacaucuauaaucccagcaucugagagguugaaacgggccuugcaugagagccaggcuagccuggaguuauaggcucuaauaaacagacagacauagacaaggaggcauggaucuguaauaccagaauuuggggguuagaggcagaaggaucaagaauuugaagucaaaucuuuaacuaucagagaaauuuaaguuaaaaucccuuuuagaucucaucacguaccagucagaguggcugucaugaagcaaacaaaugacaagugggggugugaagaaagggaaaacucuguuuacugcaauugggggaugcaaaguugugcagcuauuguggagauagcacaauauucuaaaucaacgaacaaccuaaaaauaaaaccaccaaaugacccagcugcacuacucccuggcauuuauucaaaagacucuuagucaauauaucccaauaucuacaggcacaucgcuguucacugcugagcuauccacaauagccagaagauggaaggagacuagcugcuaauuaacauauuaguggauaaaagaaaugcaguuuuauguagccauaaugaaaaaaaugaaauugugacacuuguaggaaaaaacuggaacuugauagcacgauguuaagcuaaauaaaccaugcauagaacuaaaaaaaaaaaaaaagaaaagaaaagaaaaaaaagaauaaaaagaauuugaagucaucuuuggguacauggugaacuucagauuagccuagucuauaugagaccuugucucaaaauaagaauaagaaugaaaagacaaaaacaaaaccaaaaaaugugggagagguucagugugggugagugagcuccuggcacuugauuuuuguuuuuauuuuuugagacagggccccacuaugugagcccugucuaucuucaaaaaugugaucuuuguacuuugaccuccugaaugguggaauuauggguguauguguggaugcaugccuguguacguguaacaguauguaugcauacaugcacacaugcacuuguguuuauauagguacacacauaugcuuguguauguauacacauacaaaacacucauauauacacagagguuuacaaaugcauguuuguaugcauacacauguauguggacucacauccauguaaauguguguaugagaagugggcugugggaggcuaggauccuacugcagcugucaggggucagagccagcaucauggaaaucaugguuaaaaugaucucagccucagucuuagacuaaagugguucaggcaaauggaaguuacauaguuaauaguaaaaaugauauugauucugucgguuaaaaaugacaauuuucucuuugcuaagaaguuagauggaaggugcuuucuuaauuuuaugaggccuuguggauauggagauagaucuagauuuuacuaauguuucccuucuccagaggaggagcuuagaggagccucagauggggcuauuauaggguuuuccagauucagugucugucugcuacugcagacaugaugucuuucucugcugucuccucauuccccaacaugcgguucacaggaggguuucccccuuucacaaggggacuucuacugccaucuaguacgugguggcaggauugcugcuaaguacccuacagugcaagacucuugcaagacaucagaaagaauuguuccaucuacagugaugcaauugcuguugcuugggcuggcaagaugguuucaguggguaauggugcuaagucugaugaucagaguuuaacacuuggaauucacaugguugaaagacagaacugacucccacaugugaaaacacacacagacacacauacagacacacacacacacaagacacacacacacaggcacacacauacacacacacacacacacccucaacuguagcacuuucuguagcaugauuacacgaauuuaauuaaucuugauauaauuaacacaacuaauauaauugucucccaugcuucuuagagacaggaaccaugucuuugagacucaucuauaaguccuugucucugagaccucucaaguguuaaaggagcccgaugggagauaagucugcaggaaguguuuucggaacuaaacugaaguucaaagaagcaaaaugguaaacuugagucacugaacaccuucugaggagaaguaccgcagaggacuuguagcaggggguguuggcaacuguucgucuguccuuuccaagccaaucauggcuucuagugucauuuccucaguguugguagacucaaccacuucaagauacauguuuggagucugugguagaauauauucauguguguaaguguggauucugagacauugagaauauaaggugucuuagaguauaagugucaucugucuguuugugucuuccuuaucuuucucuggucucuuccuguauuuccuucccucuacuucuguccucuaccacauggucuggcccaaugauggagcuaagugaccaugggcugacuucucugaaaccuguagcucaaauacauacauuguguuuggccccaguggugaugaagguuuucuuggggagaagagaauggagguuugaggagaagcagagauucauugaggacagguaaaucugcugaggauagcuaaaaaaugagcuaguagaagaagagaaagcugaggcuagggaaauauuuaauuuauuuauuugcuuuuacuuuuauucauguguguauguguggaucuuugugucuauguguggguaccaguggagggcauaagaggaagagucagggcuucucugagucccugauguggguguuagaaccugaacucugguccucuggaagagcagcaagugauguuaaugacugagccaucucugcagucccaggauacauauauauuucccuaagauggcaaauauuaaaacuuguggccugcucgagugaugauucagcagagacagaaagauagaagaggcagaagucaggaugauaggauccuugucccuaguacugguaaagagacaagggaugggguaggaagucuuuuguacacaggagggugcaccuccccuuguauggaaagcaaagcuaauuaguuaccugcccagcuauagcauuaaaagucuaguuuugcugggcagugguggugcacgccuuuaaucucagcacuugggaagcagaggcaggcggaucucugaguucguucaaggccagccuggccuacagagugaguuccaggacagccaggacagcgagggcuauacagagaaacccugugucaaaaaaacaaaacaaaacaaacaaacaaacaaaagaaagucuaguuuuaagaugaagaauuccagaucucaggaacacccuuagccccagcaaagcagggcgguuggucauuccuuacaucaaagaaugggccugcugggagaguacccagauggaugaaggcagacagguggaggcuggauagaaggaagaugagauagccuuucaucuuggcuucuauuuucuugguggcuuaaucugugagauuguaaucugaaagcagagaucuggagggaggcaggcugugggaacagauggguguggguucaucgguaugcaaaaggagaaagggaauuugcugacaaagguagugcuagguggcgguuugagacagguagucaggaguuuaaagggauacuagucagccugagcaugggguguguacagagauguagugagccuauuauaauagacucauuggaaaguacagcuguuaaauuauaguugaaacagauacauuauuggcaacacauuguguagaacugggaaggaaccugcagaggcaagccucuagagaauaaauaacaacuucaucaucaucgugugugugugugugugugugugugugugugugugugugugugugugugagagagagagagagagagagagagagagagagagagagagagagagcgagagacugugugugacacaguauauguguggaguucagaggucaaauucugguguuguuccuuauuuucuaccuuguuugagacagucuccccccacaccccaacucuaccccuacuaugcacagcaggcuagcuaggcugagaacucccuggauucucuccugucuccacacuccauuucccuggaaaagcacuaggauugcaaaaccacacuacugggcuggagagauggcucagagauaaagaguacuggcugcucuugcagggacccagcuucuguuccuaccacccacaugauggcuaauaaccagcuguaacuucaguuccuggggaccuaauauccucuucuggccucuguggggucuguaugaauacacaugguacacagacauaauauggugcaggcaaaacaccccuuuaaaaaggcugaaaaaagucaacaaaggugucccacuguaccaggcucugugugggcucugggguuucauauuuugguccucacauuuggaccaagccccuuacccaugaaacugucuucccagacccucuugguggauuuugcauaauggaucuuuaagcagagugggugccucuagaauuugcaaagaaugcgguuuuggagccaaaaggguucauauuauacaccugccacuaacugaucaaguggcugugaagcucuguaacuguaaagcuuaguuuugucuuuuaaaaauguggccacaccccacaccucaccaggacagugcuggagacugagggagagcugaugggcugaccaacccagcuaccacccaggcccagauccagggcuuugaguuggcccacuccaccaucuaccccaucuaugaacugcuggccacucagagggccugguccugcagauccaaagcugcaggaucuccaugacacagggcaacagcaggauauccgagaggagauccaguauugguaguguagcagaagccagaggucucagaccagaccaaugacucauugcaaugcacauuugcaaauaaagcugugugggcaaaagccuacuccugugugacacacugugugacacacugugugugacacacugcagcuuccacagugaauuuuuuuuuuuuuaauuucuuguuuucucuugggguaguuggaagggaugaggacagauauggagggaugggggggaagagugggauugggcugcauaaugugaaauucacaaggaaucauuaaaaaguaaaaaaacaaaaaacaaaaaacaaaaguggccgcagugacuugugcuggccacuuaucagggugcagggacuucacaagcaugcacaacaauugucccaggucaaaagagugcugacugcgaggaugaguggagcaccugcagugugguucagggauuacucccagaaguuucuaguucuguaauauggaugaaggaaacugcuggcccguggguguggcagcugagugcugaguaacuguggcuguuggagaugggaugagaugagagccuggggugggacagaugggacgggagcaggguucccaggucuaguguguugccuucagagguugcugacuuaccgucucaugccuucugcuuuauuguauuuuuuucuugugggggccugggaucaaccucagggccuugaaauaaucugaguuaaugggccucuccuggucuucagcccaagcucacaucgaauaugcucugucuuguuuauauuauuguuguuguuguuguuguugcuguuugagacaggguagcucagacuggccucacacucacgucaaucccacugcuucagccuccuggcaccaggaucggaagcuuaugcuuccgugugucugucugacuuguggucugcuucagaaggcaggaacaagaggccguuucagaacgaguguacuuaaaaguugaaauggccuucauguaaagccuucaccuucaguuauccugccuuauaaagugacucauucauucccuggaggccucugcacagccgggccuuuacugagccaacuauagauacgucaauuguuggaugauugcucccauuuugucauggcuuauaacuugaaggugaccugcauuucuuuuuuuuaauuuuuaaaauuaaaauauugauuacaccauuugcuccccuucccguucuuccucccagucccucccaugucccucucaucuuguucagacucaaauucauggccucuuuuguuuucuuuuucaaaaguuacuuucagaaauaaaaaguuucaguuguagaaaacucaaaaugcuuuugaagaauuaguucuaaaacucuuaggcgaggccaggcaguggugguccacaucuuuaaucccagccccugauggacuauggcuugacuuuagagugcauucauuugcuugcuggauuugucccugcugauggaggacaaugaagcagcuauguucuuuggaggggagagaaagcaacgauggcucucacaacucccuucucuccaaggagcagccagcuggaggcagguauuugcuguucuugugaaggguggugaccguaguuuugggcagagggcaggcagcggaaguuggacccauuuccagagcuccugacucaguuccuuguggucuguuuucauuuuuuuuuuuucaucugaaauguugugaaaucccagacuucagccacacccacguaaauucugaguauauuugugguacauuccaacucugugagggcuguggagaagaguucucaccugcuggugccccuucuccugacccuuguguggggaauuuuagaugugcuggagugacuagcugcauaugucugugauauggauugucaucuugacaggaucuagaaucacugaagugacaagccuccucuaaacacaucuguaagggauuacugcaauuaguuuagcugaaguaggaagaccugcauugagagugaggagcaucauccguaggauaaggucccugacugcauacaaauguggagcaccagcauucacucuugcucugacuguggauccaauguggaccagcugucucaagcuccuguugccauggcuuccaccaugaugggcuguacccucaaacugugagccugaauaaaguuuucuuuccauagguggcuguugccacauuuuugucacagcaacugagcaaguaacucauacaccagccaucuuguuuuuuuuuguuuuguuuuuguuuuuguuuuuguuuuucgagacaggguuucucuguauagcccugguuguccuggaacucacuuuguagaccaggcuggccucaaacucagaaauccgcuugccucugccucccaagugcugggauuaaaggugugcgccaccgggcucggcagccaucuuguuuuauccuggauuguccaggguuuuaguacugcaagccaagugguacaggacaagcugucuuccuuucucagacaucaggguaugucugacuuccucagacagguaaauaaaggauccagcaggacacaggccucagaaucacccacaguguuucauaaauguacccuagugagucugaucaaguggaaccuggggagagccuugugcagaagguuaggcaccacacauugaguaacgcuacugcaaggggcuagaaagggaauagcguaagaugacuuacauauuaggcaugaggacugggcaaagaacaucaugaguaccagucaaguuuuucucggcucccacgcuccagaguaacugggugcugacaaagcuuggcuuuguugaguacaaaggaugacuugguguuuucuggcugggggcccauaagagggugugccaauggcaagaagugaguguccacuccagcuuucugccaggcuaccuuguugcagaacugauggcuguuuaccaugcccuccggucccuuuggugaagggaucaggagaggccaucucuagggccuguuguagcucugaucucugguauguggggaggcagaggccacauucuuacacuugguaggcagcugucaguucugcugcuuguggacaaagcccuuugcuuacugagccaauugacugccuuccucaaggacacugggagauggaggagcucuuuggugaccagugagcugauggcaaagggcuccacacccgcauuccuguuacaaagagcagaggugcuucucaaagagcggaugcuuugaugguuccaugaaccaugugcaccagcgcucucucccuccucccagaguuuaucacauuuacaauacuuuauccugauccggagcuaguauaagacuauucuguaggaauggcaguguggugcaagacaugagguuucugggcucuuggcaugacaugcccucacuguuccaagaggugauucaacuaagaguuacauccagcuagcaugagagcuuggguacagugugacuauuuuucuugaaauuucuuuauuuuuauuucauguguauugcgugcaugucugugugagggugucagauuagagacagugugaacugccauugaauacuggaaauugaaucuggguccucucaaagaacagccagugcucuuaaccucagagccaucuccgcagccccaagugugacuuucuacagacuagugccaugagugucccaguucagcacaauggccaggaggacaggcucuggauugagauguugucccuguuauuuaucugaugaauaaccuuggggggaaguaacuaaacucucugagccccacucuuccuaauugcauuuauuuaugauuuauauuuugacuuuuugagacagguuucuuugaauagcccuggcuguccugggacccauuuuguagaccaggcugacccccaacucaaggauccaccugccucugccuccugagagcugggauuaaaggugugugucaccaccaucaccaccaccaccaccaccaccaccaccaccaccaccaccaccacuacuuagcaguuuucccaacuuuaaaauggggauaauaauggccucuggguuaggagauucagugaagaaacuggaggguagcucagaguuguuaucaccagugacagagagcagcaggggcuagcgguguuaguggugcuggugggcuagggcuaccauaaugaaguaccacagaugggugggaaauucacagaaauguauuuuucauacagguauggaaucuggaaguucaagguccaaguaucagcagaucugguuucucuugaggccuuuuuccuggucaagucuucuuccucuucuacucucucccccuccuuccucucuucuuccuccuuccccuccuucccucagucccuccucuucuuccucuuucucuucaguauguguguguguuucuuagauaggguuucauguaauauuugcuggcuuaaaacccgauaugugguugaggcugcccuugaacuccuuccaagugcuggagauugcagcacuauguuugggucucccucuucuguuuccuuccccucuucuucugucugucugucucucugggucuuacuauguaaccuaggcccaguucucaaacucagacugaucccugcuauagccucccgacagccagcauuauggguaugagccacuacuccugguuaauuguuuguuuugagacagggucucacuuuguagcccuguaggucuucaauuuacagagaucuaucuagauguuucugccccgaguacugggguuaaacauuugugccaucaaacguggcaauuguuugguuguugaccaucuuuuuguucaugacuauucugagggagcugaauuugaagcugaagcuggaacucuuuucaguuuuuuuugggggguggguggguaggaggagugggaggugcaggucuugcucugacuggccucaaacucauagcucuucugucuugaccuccugacuagagaugggcauguacaccucucccaccucuuugggcuccuuggcagccccagaaguaggucagaauuucucauaguagacauacacaggcuucuaggaaggcagugauucugucuggguucaaguguuggucuugcuguugacucugagucuccugguuuauuuguuuauuuuuguuuguagaccaggcuggccccucgaacucagagauccaucugccucugccuccugaauacugggauuaaaggaguaaaccuccacuaccugccccugggguggguuuuaaguuucuuuuccuugaguucuuuuccugaguucucaugugcuugauaauaaugaguaaauuuuuuguuguuuuuauuugaaucaggggucuuauuauguagcuuuugccagccuaguacucaguauuuggcacuggcuggccuugaaguuccugccuuagcugcucaugcugggaugacaggugugccccaucaugcccagcuauggcuaguucuuauucuugcugucauuacugcucacuccaccuccaggcuucgagugauucugaauguaauauuuccccguagagugaggauggcgccacuguggucaaauagucaucagggaagcugaaccaggaccaucagucauuacacacacagacacacacacacacacagacacacacacacacaaggauacuaauuaaaagagcuuuguggguaaaggugcuugcugagcaagccugaugaccuaaguucaaucccuggaagucagcuaaagguguagagaacuggcuccacacaguugucuucugacuauguguccuccacccccaaagaauaaauaaaaagaaaacuucauuaauaguacaaaugcccccaucuuucuauaugucgaucauaacagagccccuucugcagacagaacaauggaauaaaucaauugcgcagcguaguagguggagcucuaggguucaggcuacccaguuccagcuuuucucccuggcuaggugucugaacuuagccucagccucccucaugcugaaagcagggcaacagagccaugagaaucauaaugucacauaaaggugacaugagauuacaaagggaaaguguccuggaugaaggaagcgcucagaaauucuuaacuauacuauuguucucuuuggguugggccugugacacauugagcauguuucaugggaauauguggcuaauuauccaucagaggccaccuauccuugagauuagguuucuuuuccuuuuuuguuacugguuuugcuacuauuacuacuacuacuacuacuacuacuaauuccaauaaaugauucuaagcaauuaccagcaauagucccaucacuuggcugacuggaaaaggugugaaacaacagaagauaagugucugggaaugaggaaguuucugggagggaacgaggcuagaacagccucccucugaccccauaucuugccuuaggcuuaugccauaaauaccuuaugcucuuagcuuccuuuaaacugcauucuuguuccaaggauugaccugaaguuuugguagaaaagagaugagacccagaccuguccuugauacaacuaaaacuccacuaaaaagugguucuaagacauuugcuuuucuuggaguuucuuccccagccuuuacugugaauuuauguguguguccauauucaugaggaggccagaggucaaugucuggugucuuccuugaucauccacaaugacuuuuguuugguuugguuugguuucuugaggcaggguuucuuuguguagcucuggcuguccugggacucacucuguagacucuggagcgggguggucaguaaagccugccaguaagaccaaagggcugggguuaugagcaaugccaccagcuuuuaugugagugcugggguuuuagacuuagcuucuuauacuuguuuguuuguuuguuuguuuuguuuuguuuuguuucgagacaggguuucucuguauagcccuggcuguccuggaacucacuuuguagaccaggcuggccucgaacucagaaauccgaaauccaccugccucugccucccaaaugcugggauuaaaggcaugcgccaccacgccuggcuguucuuuauacuuguauggcagucacuuuaucuucucagccccuaggcuggacagccuaccuuucuuccuuuugggaaagugaggauguucuaggcagggaggcagcaguagcaugcagagcaugucuagcaaguucuguguggcauagcacagcuggaguguuuuacagcaggcaggguauagugagaccuuccugugaggagcaggaagccacuggugguuuucauguaagaaagagacaugaguuugcuuuuguuuugaucgacauccuaaccaucaaucauaacagcaauuauagugaucaauagaaaccaugauuuuugugcuaggcauuagcuaaaaugcuucaacaugacucaucuuauuuaauccuaccuuagagcugagcuaggagaguccacagagcccauucacucagcagaagggcggagacaagccagcuguccaaacaggaaguuaaugcuguuaaccguuccucaaucucccuaaaccuuggugucuucaugucugaucuuaacuucauagauauuuuauucauguaaaacacuuggcacagugccuggaacacuauaacaacgcaguaaggguuagucauugugacuuuuguggcuguuucccacuuuagaguguccccugguaugccaggugcugggugguaccaguaaaaucgcauggguuggaaccaguaaacugggcucauaaagccguuccugucacuguagggugaagaagagggugugcucucugcaucugcuagugcacucuuugguugccuugguaaccagucuagacaccuggcucucccagcagcuggugcuucucuagcucaggccugggaaaaucuguguuguuccacagugguuucucugaguucaucccuuucuuuccgcucuguguuucugcugcagcuuaguguguaugcguguauguauguguuuggguauguggguauguguguguguauuuggguauguggguauguguucaucucacaaacgccauaguggaagaugagcugaagggagcagaggcagcaacugacucaaauucauuaguggagaacucaugagcacugggaggguuacagauggaaguagagagagauagauuuuaggaauguuuuggauuuagaguugauaggcugugacaauuuaacaccacaaggagaagugaagaaaaagcuuucucuccccuaaaaacucaaacacaucccuuuguuuucuuuucugccuuuguucagaggaacauauccaccugugugaugucuaaucucacuucuaggcuggucauuucuaguuaauuagcuucccuguuuuuaaauuaaaauucuuaaaaaauuuuuuuuuuuuguuuuggucuuauaugucugaguuuuuuuugccugaauuuuguuuuguuuggaaacaaaucucagcuuguagcucaggugggccugggucucucagcaguccuuuugccuuagucuccugagugcuggaguuacaggugugugcugcuacccucuuuucuuggcaggcaaauucagcauuuauacaauagaagucaaaaccggaauccagaaugauucccuuccccucucuggaagcugcuucuccuccugugagcgccacugugguccaggcagaaacaaaaccgugaugaacugugggugcucccaccuccccacccgcuccuccgugcuccucaucuccccacccgcuccuccugcccccugagggcaacaccauuacuacuuuggaaauccccacauggggcuucugugcagccaccuccgcuucucuucacaguuucucugccucucaugcagguucugcauuucaaccacaggggucuccagggcuacaaaucugccucuccaccuugacuuccagcugccuggcacuuucggcaugacuacucacuuucugugcugucuaaaguucuaucucagaucucagcuuccucaauagccccuauguaagucauuuucuuuaucuuggcacccuuguacuccccuagauguagcuagucuuuccucccaugcucuaccaggguucucacugucugucaggaugcucuuucuuggcuuugcuuggcccacgucuuuccaaucuuuaaaucccaguuaagucuucccugcuagaucacuacuuaccacccaagcagguuccacaaccccauuuacauggcuggcugcugagcccuagugaccugcauguuucugccuugcuggugcugggauugcacggguccuggggacugaauuuagcuauucucauuugcauggcaagcacuuuaccuccacuaagcuaucuccucagccugaggguaaaaguuuugaaccaagguaggauaguagaucuccaugcuuugaaggauccacagggacaaucagaugauugucacugagauggggcacuuuucugagaaaaggcagaugcauuuuacacggucuuaaccaacuguuucuuuucauucagccuguguccugaccucacguucggucucaccuaccccaggcuggccuggaauauacuugauuuguagcugaugaugauccugaacuucugaucuuuuugccuccaccuccuaugcuacuauuauggaugugagccacuauggcugauuuacguguugcuggugaucgaaccaaagacuuuggacaugccaggcaagcauugcccuaauggagcuacaugccuggucacacaauaugaagauuuuuauuuauugucuuuuuuauagugucuccccacugcaaugugaacucuagaagaggguaaccuggcagcccagaacagacaugucucuuuaguccuuuuuauugguggaacauuggugguagacauguuauuccuagagcuagcuaaucuuuuccugcagguaagaaaggcuucguaccugagcuucaaucagggacugucuaacccacugaaaucaaagaaucacuuuuccauuuguaacccaaaaggauucugcuacccaaggagaagcaauggcuuggggcuaagcacugaacacuguuuuccauacacacacagggcugacggauacagggagaucaggugggguggaugcugaggagcagccucugcauuugaugcuuaacagcccuuuagcucuugagaugacagcuuuuauagaguugcugggcuuuccuacugauguaagggcuuaggacuuacugacacucgggaggagaagguagacuaucaggaaguuggcugcugaaccuaagaggacagugggacagucacuguggagggacaguacaggagguggacaugggaggucuucuucauuugaggcugauuuugagagaagaggcaucaggagagagaaguuaaagguuuuuguugugguggauugugugagugcaugcgcacguuugugugugcacacauauguguacaggggcaauugcaugugugugugcauguagaggucugaacucaaccuugggugcuguuccucagguacuguccaccauguuguuguuuuuuguuuguuuguuuguuuguuuguuugagacagggucucucacuggccuggggcucacagacuaguuuaggcuggcuggcugcugagcccuagugaccugcauguuucugccuugcuggugcugggauugcacggguccuggggacugaauuuagcuauucucauuugcauggcaagcacuuuaccuccacuaagcuaucuccucagccugaggguaaaaguuuugaaccaagguaggauaguagaucuccaugcuuugaaggauccacagggacaaucagaugauugucacugagauggggcacuuuucugagaaaaggcagaugcauuuuacaacacuaggacaggacaugaagacgcccaacugccugcagaugcguuuuucuuuugugggaaaaugggcugacgcugauguuuugagauuguauuuuuauccuuggcuuuuucuuuaucuuuaacauucugacaagacagauucuucaaaaauaucccaucuguguggcuauacacugagacguccaagcauggauccauccuugaguuuucuuguugauggauggaguggccacauagacagccaugggugugacugccaugagauggaauccagagaguucaggucacuuaguguaaaacuccuaagcccugaagaguuaggugggcagauggcuuuugugugugugucccugaguuggccaaacaacucaguugggaucccggucuaaugcuuauaagcugggccuuguugacauccuccaagccugggaccucaucuauacagcgccagguaguggcaguuugucuccuuccucuccacuacagucaaaaugcacuggcuccucaccauauaucgccccaccccccacccccaggggagccugaccuuucagugugccccagcauaagauaggguuuuuuuuuuugucaccauuacuacugguuccuuccuucuggcauccguccuccucuguuuggggggaaugauggcaugaggccagcuaguaggacuaggagccaaaucguccuccucuguuuauucacaugguuucuauggauaugacaaaaaagcaaacagaaguuuggcuagauauacgugcuugauagccugcaacauuuaaaacuagugucuacuuacguaggaggcuaaagacauaacauuauguuaaaaugaauaacggcccauccaggagggaaaaaaggcauuuuagaagaaaaaguucucagcaagaaggaacaugcagacugcucugagaaaugugagcuccuguguccucacagugguuucucugugcuguguaggugugaguucagaagggacacuuccuucuaggccacccucuucaucuggcaccugggguagggcuuggaacgaaggagggcucuguguaugcauguggggcugcugggacagguugauguugaacagguuuguuaggacucaacagacugcucaagucaauagugucugacucuggcuugguccacccggacucucucugcuuuguggucucugacaugggaguuuauuuguucuuauuauuuuuaauagaauaccuuucacuuauucuuggaagaauuccuucauguaaacaauguaucuugcuugcauccauuccaacugcccccuaucaaucccccaggggucaagacguaccccuuucccgcuuugccucucucucuuuuuguggccuauagagugcaguuagugcugcugguuggaaugcgaacugaucuugugcaguuccugcacaggcagcuauagcugcagugaguccacgggugcagcggccaugucccaucuagaugccagugacuuacagcacuucucuccaacuucaaguucuuacguucuuucgucccccuuccaauauguucccugagccuuguggggagggguuagcagagaugaccuauuuagggcugaacacucaguacucacuuagucucagcucuuugacuguuaugcgucuuugccuuggcugcugcccacuguagagagaagcuucucuggccaggguugagggcagcacuaaucuauggguaaaaauguaaguauuuaguuagaaggcaguuuagcagcauguucauacugcaaaggccuaucacuaucaguaucaggcgcgauggcaggggccccugaaguggaauguuuaggaaugugccuagaccauugcucuuguaucaucacaucuguccacauggaaauagucaccaaacacggaguaacgggaacuuucuaauuaauggagaagaaguacuagaugcguuucugcccucagagagucagcaucuagcuggagaaaggaaagggaggcaguggagauaaaugagaacccuugaggugauuggggccagcccuucuugcugugcagacauccuggaaggcaaaaagugcuaggcggggugugcugacagcuagccaugcucagccucuuggcaaccagagcagggagaaaggagaaucugguauucauugugugguuguuucuaauuuccuucugcuuucaagauccucuucugaggcagaacaaugcccugaacagcuaggcuuggcuuuccuggcaccuacccagacaaagggagggccaggcacccgaaagcauacaauggagagugcuugcuguacagauggccucugacauccguugagagucacuggggacaacugagguggagaauagcugauggaacuagcccccacucccucucauguauaaauguuauuuuaaacuuucccuaaaccaccaggguuccuaugaugacucccggugucuggaggagauugcagaguuacuggacucccugcaggacuuggcccggaaacuaagggacacucuaugccaccauggcucuggaggcagggcagugguggcuccugagaacaggcauagauugcccggcggcuucagcucaaggaccagaccuggaaggguccuaggcugggucugucauuucuacagccagggucuuuaaggccaguuaggggcagaaggcccagggcuguguccaaggaaugggguggaguuuccuuuuuccuuguucucuuugcacuuagccuuuuaguuguagaguuuagaacauuuaucagccuuucuggguucacuuuucaucaccagauaauagauugguugcaaaaaaugauagggucauguguauaauaacaagaggggcuggagggugugugaugcugucugcagucugugggagucugucaagaaagaccguguaaggauggugaucaggaagacagagugaggagugauguaggccacgguggggcacaggauagucauuuuuaagauacaacaacauucagaggaggggaccuggacagauuucucagugguuaagaauucuggcugcucuuccaggggacccugagucucagcauccacaugagaugaaucacaacuacuuggaacucuagcuccaggggauccaguguacucuuuuuuuguuuuguuuuguuuuugcuuuguuuuuuugagaugggguuucucuguauagcccuggcugucugggaacucauucuguagaccaggcuggccuugaacucagaaaucugccugccucugccucccaagugcugggauuaaaggugugcgccaccacugccuggccaguguauucuucuagcuuacacacacacacacacacacauuuuuuuaaaguaaaagauaugacaaugugacaauauuuagauguauagcuuauguuauacaggaggcuuaagcagaaggcucauucaugaauucaauguuagauaguguuauauagugaauucuaaggauacuugaggcuacccaguaagaccaugucucuuauauuuuugguugugagccuagacuuuaauggcugagccauuucccuagcacaaggccaugucucaaaaaauuagauaaaauaguaaaagagggcuggugagauggcucagcgguuaagagcacugacaacucuuccagaggucaugaguucaaaucccagcaaucacaugguggcucacaaccauccauaaugagaaacaaacaaacaaacaaaacuuaugggcuagagugagcagggccagagcgagcagggggugggagggagaggcuggagcaagauggagaagggaagggggaaaauaauaauaauaauaauagacgugggaaggugagcaggauuuuugacauguauaucacugaagugugauauucuuaccauuuguuucauauuaucugguguuuauauugaagauuuauuuauuuauuuauuuauuuauuuauuuauuuauuuauuauuuauucuguuuauuuguucauguauacauguauguguguguucaugugucacugcccucauguggaaguuagaggaaaacuuuugggacucacuucucuccuacauuugucaguucugaagaucaaugacagguugucaagcuugguggcaagugcccuuaccugcugggccaucuugccagcccauuuguuuaguacgcaucccaggcugguacagaaccugugaccauccugcuuuggccucccaaguacuaugguuaccaguaugcccugccaugcccaacuuuccugauuaacuuuuaaaaccuuuaaguuuaauuaaaagugauuuuuagcuggagcuguaacucaggugguaucgugcuucccuggcaggcuuguaacccuuaguggagaaaaggccagugcaggcauugauuccaggcugccucccggaucucuuguucucuauugucuucaguggggacagguguggucagagggcauggcuauccuuuuagucaugauuacaggguugcacugagaugugaccacaguaugagucaucaugagauauucuggaugcgaucggcggucaucuuuguccacuaaaagaagcucaggcaccgagaugcaggcauggacauuggcacucuugggcugggggcuugucagaucuugcucgcucugguuucuggaaugggagaaaguuuuggagagagagagaagcuguggaaagcaaucccugccccccccccucccgcaagggccuggaaauccugcugcaaggccuggaauuucgucuuccuguuuagccuggcuguuguucacccacauuuuuggcccugacacauccucuuccucccccucccaggaugucuccucaucugcaaaaugaggggguuguauuagaucguaucucaggccccuuuacguuugaaaaagugaugauccugcuuccuagacacuuccucacuuuccccgcaggccuuuugauugacagaagaggagggagaauguauguacguucuaucuauagcucuagcucaaaacagagugaucuagcccaacagagagugauccagcccaggaacucaguggcauugagguugaaagacacuguuuagagaaggagagacagaggagguggaaggacuugaaagacggguguguaaaugcucuauagguaguggauaaauggcagugaaagaacaagaaugaaagaggaagaagauggauguguggccaguguuuaaaagggagagacuaggagcugcuggcacaggauggaugugucggcaaugugcuuacagcuugggugaauagauuuuaagcugcugaccucaguauaaaccagcgcugagaagugcuacaguuuggaugcugaaugcucccugagacaagguuuacguguuuaaggcuuguuccccagggugccauugggagguuauuaggggugugcccuuugaaaagaucgggggaccucagcuacuaccucuuucucugcuuccuggccacggggugaacuguucugcuucauucuccuguaguuguaacuggccuggcagaaaugaagcuguucuaagguaucacucaaucuaacucucaaacuacugaaauagugggcuccaaagaaaugggaauuuccuggaauucucuagaugggcagaggaaaagguuccaccagccagagccggagcuugucuuccagaaagagauuucacucaguccuaacagcuugucaggaagagacuaaaacccaaauaaagauggguucuuggugggcgggcucacaacuugacaggaacugcuuagcugugcuugucuuuggcccucuaucuaaacuuugaucucacuuuuagacucugaagauaggguuggaagcagagguggcuggaucucucuguccuucccaguguggccacauggaaugaucgccauucucugcuuuccacuuuuaauuugacucuuucaauuggcuuauuggggaucgguggcuguaccugacacagacaggcuaugaaucccaaguucuauaacagccaccuggcuucaucaaaggcccaauggaauggggugugucagaucuuggauuaucuucuccaaaacacaugguuucagauaaguguuucuccuuauaaaagaaucauccuguuauuucauuauaguaacagaaaucugaccacacaaagagauugauggcacacccucccccaaucuccugauucacuaugaaagagccacacccugugagggacccuuccucuggaauuuugaagggguggcuguuaaugucacaugacaguaugaggauaacacacugggugguccagugacucaggcaaucacuucccuaugagcucuaucaugaggcagucacgcuuucucuugcuuuucacuaaaaugacaauccaguuguuauugcuagagucagauaaaagaagaugaagagaaauaagaacuauauugugccuguaacuccagcuacucaggaggccugagagacgaggcuugaaauuggaggcuagcccaggcaacuuagugaaugagaccuuaucuacaaagggauggggagguagcucaaugguagagugcaugaguagugugugcaaugcccuggguucaguguccagugggugugagugccuguacaggccagaagaagguguuggagcucccuaaccuggagugacaggcaguugugaauggccugacuuggaugcuaggagcccaguucagauccucugaaagagcaagaagcagguuuagcuucugagcuggcucuccagcccugaaugugauuucuuaauggcuaaggcuagagguggcugcucucuuccuggcuccucaccuucaucugcuauuuggauguucucuagaacacauuguucucuucuggucuugggcuuguacagggcacccaaaggacacauacugacuucuuacagcuuccauucagucuuuacugaauggaaaccacacaaggagguacguccaaacccaaacaugacgaacaauaggaauuuccaaugcuuucuacuaggcgcagguuucuacuguuucaagguucugcugggcugggguggugaggaggccuuuuccagcucacguagacugaacaggauggaaagaugcgaauaguguuuggaauaauaauaauauaauaaaauaucucuguuguuguuuuacagggcuguagcaguggccaggaagaaaacugcccccacuggagguuguuuuugugauuguucuuuggagcauuguucuaaaaaugggaaaucacaucuugccaugccaaaggaaacaaacaccugcaguuaaagggaugccuucuuugagguggcuuuuuggagcaaacacaguuguagcuacagccgcuucuggauagaggcuguggcagaaguuugacgggcccuuucuuugcuugcaagggaugggaugugggcuuauuuucguaucuagggugggcuuuggcagcuguggguauaggcgacucucuucuuaccuacccaauaaacuuuugucaugcauuguuuguucugu

SEQ ID NO: 9162 - RNA, 1282 nt, Mus musculus
cuugaucuuuuuuuuuuuuuuuuugacuuuucaaauuguuaacuuuauuuaaauugaacaauauuucuuaaaacugcauuuagcgucaagaucauugauggaaaaucaccaguauuuguaaagcagaaacauucauguuaacaaaacuaguuuuuacuuuggagcuuauucuuuaagcaaauuauggagaauggagagaaaagaaaguagguuauuuacagaagauaucuacauauuuuauuuuaauauuuaagaauacucagguacaaacuuggugacagaaaagaccucaggacacgcuggcaucucaggagcaaucuucaaagguuuaguuuucucaauuucuagcaaugccuaagaugcuuccucaucuucaaucuugggagccaaauaauacuuuaagugucccaugucagcaauuuuauacucuacaacaagggguacaucugcagacauacugaguguuacuguaggagacaguggaguggcuuuugugaaaaaguucagguaccucagagcaaaaguuaggugaacaggcucauucaucucuauggcuaccgccuccucuucuuuauccacauuacuuguuugugacaacuuaauguucccauugccaagcucuccacuugcagaaaacuucaccccauucuuugcacaggauaucacaacagcaucuccaauguggcuaaggucucggcauauacgugcaaauucacucgacggcaucuuuauuacacagcuguacuccuguucugggauuccaaguugcuccacaucuaaguccauuaacuucauuucauagucugaaacuuucucuugauuuggugcuucgaauacuagugcuaaggugucugcauuaucuucagcccuuaauguaaugaugucuucauuaccagcacauuuuagaauuuuggacaugcuggugagguucacgcccauggcuagguugcggucgcagcgguaggugucgaagccuucggagcgcagaguaagcugcaccaaggagacgugagacgaguccaugcucugcagguucacgccgcccgagcugacgucccagcaggccucauugaugaggucuuugagagccuccagcaccuucuucaggauggagcccuggaucaggcgugccucaaacaugguggcggaguuguggcgacuagaugagagcuacuguaagaggaacgaggucuggcugccaaggucccccgauucacgaugcagaagcggcagcgaaggcccacagcgacaacuaccaacccucugcgcccgcaaccgucuu

SEQ ID NO: 9163 - RNA, 16349 nt, Mus musculus
gaugugggcacaacaaauugguggucugcacggggacccgaggaucucguggauucagaacucuucagcugaggaaccgguaagucucccaaauugaucccccguuaaaaggggggauauguuuuucuugcccguagaccaaguguggguagcucuuagcguuuuuguuucguuuuuuguaauuucuggccucugcuuuuguuugauagaggcaguuaaggcaggucagaaaauucucacggaagaaaguaugucagaggaagauaggaaacacauaagcaaaagaaagaaaaggggcgaaaaagagagagaaaaggaaaagggagaaaaggcaaauucaaaaggaaaaggaaauagcgagaaagaaaaagcaaaagaaaagggaggaaaaauaaaaguaauuagugauaaagaaaaggaaauagugaagauauaucccucucuaaaggauuuaaauuuaucaagcuccgcuuccagugacucagagcuuaguaaagaugaugaagcugaccuagaagaggcagcucaauaugagagggauagguaugauccggauuggccauauagagccaacccgaugaaaaagggaguaucggucaacaaaaggccgaaaagaaaagaaaagaaaaggaaaggaaaggaaaggaaaggaaagaaaagaaaagaaaagaaaagaaaagaaaagaaaagaaaagaaaagaaaauuagaaaagaaacgauuguuuguagcaccugacaaaguucagaugggaaauuuaggagaguuuuuggguacccgaguuacuucacauuauguagcaccucaaaagauagaauuguguaaagaucauuuaaaaacauuaaaugauuuccagaaauugcuaggugauauaaauuggauucgcccauauaugaggcuaucaaauucugaauuacuuccacucuuugagauacugaagggugaucaaguguuaucaccucauguccuuacuccugaggcccaaguggcuuuggaaaaaaauagaaaggugcauagaaaaggccaggcugcauagauggaaagaaaaagaggauauauaccuauguauuuugaaaaccuuucgucaaccgacugggguacuauggcagucagguccucuguuguggauuuauccucaugugucucccaauaaaacccuugaauauuaucccauugcuguuguucaauuaacgauuuugggcauuaaaucauguacucaacauuuuggagcacccccucagaaaaucauuacaccuuauaaugcuaaucaaauacagauccuaaguucuuugauagaugauugggcccuauugcgcuguaguuuugauggggaauuagauaaucauuaucccaaagauccuuugcuacaauuuuuuagugaacauccagugauuuuccccaaagucacagcaucuaaacccauauugggugcauuggauauuuauacagaugguucuaaaacagguguuggugccuauguaguuaauucucaaaaaccuguucuuuuucaauacaauccuggcaccccacaacuuacugaauguaaaauuguguuggaaguauucaaagcuuuuaaggaaucuuuuaaucuagucucugauucggcuuauguaguaaaugcagugcgugcauuagaaauugcaggacccauuagacccaccagcccugugugcaccaucuuauuagaguuacaaaaauugauuuggaaaggaacacauaaauucuuuauucaacauauucgagcucacucuaguuugccaggcccuauggcugaaagaaaugccuuaguggaugcuagcacuugcauggaauuuauuuuucacgccaccccacuggagcuugcaaaagauuuucaucaauuguaucauguuccugcugccacacuucagcagaaauuugauaucucucaagccacagcacgagaugugguguuacaaugcccacaguguguacaauuucaccacccucucauguugguauuaacccucguggauugcuuccucuaaaacuguggcaagauauuuuauggauauauuggugucuuuaucacuccaaugagguuccugccuugcuacaggagguggacucuucuaauucaaauuccccaccgcugugugucucaaauacaaucucccacuaauucaugaaaaucuccccugucccaaguuucuggcauaucuucaagaugucccccaccuucuccauuacugucagcugcagauuuacauucauuuuccugcccaucugucccuuucuccugucuauauccacaccugauucugauccaccccauuccccucuccauccuguuucucacucuuucccucugcuuccuaugacuauuuucuuuucccuucuaagugaguuuuaagcauccucauugggucuucuuucuuguuuaguuucuuuugaaauguggaauucuauguguguauucuguacuuuuuggcuaauauccacuuauaacugaguacaugccaugcauguccuguugaaucuggauuaccucacucaggacaauauucucaaguucccuccauuugccuacaauauucacaaugucuuugcuuuugauagaugaagaguauuacauuguguaccacauuuauuuuauccauucuucaguagagggacauugagguuguuucugguuucugguuauuaugaauaaagcugcuaugaacauagcugagcaaguauuccugugaugugguggagcaucauuuagauaucuguccaggagugguauagcugggccuuaaggcagaacuauucaaaauuuucugauaaauagacaaauuuauuuccaaagugguugugcaaguuugcacuccaacuagcaaugagaaaguguaccccuuacuccauauuugcacaagcaugugcuaucacuugagguuuugaucuuauccagcagggcagcaauaaggcaaguagcaauguuuacucucuauuuuucucuuuuauucugccuaggaccucaguuuaaaagaaggugcugcugacauuuaaggccagucuucuacaacuuguucuaaucacucauuuaaugguuggauuguucauuguucuugcaaagagagaaacucaacaagaaaaaagaccugaaguaacuuguuuauacaacagaauguauagggcacagcucaugaaaaguaaauuaucauguauucaacuuuucuugacaaauagcuagauauauaggcgguugagaacuuugccugaacaucacagcuucuucuagauuauuuucugcuuggccauaugauauaugcuuugaccacuauugcaccagugguguugguacugugguuccuagggcucacagcucugcccuuccuucaaaugaucaucuugguuuuucagggagcaguucccugaauuucaguuuacuuuugagcuuucugugauuauuaucuacauuaucugucucacugcacaaccacauguggauucugaaaacaaaagaacauauccuuuauacuaaaauggauggaagcacuucacuuaugugugaccagguacaauaccaagcauuuaaggauaaauguugugccauguaaagauccauauggaugggguagguagagauacuuaccacuaggccucacaacaugaguuuugucucugagaccuauaugguugaagaagauaauugacucccaggagucauccuguggccuccacaauguccugugguacacaugcaaacacuccagauaaauaaacauaauugaagaacaagaaagggaaagaguaaauucauauggucacauuggggaaaggaaacuccaagaguacuucuauguaccuccaguacauagauagggccucaaguggagggaauggauacuaacccacagucaaaauucuugacucagaauuguuccuaucuauaagaauuacagggacaaaaauggagaagaaacugaaggaaaugcaauccaaugaccagccuaacuaggggauccaucucauagggggacaccaaggccugacauugcuaugcuguaauguguauacagacaggacucuggcaugucuguccucugggaaccccuaccagcaucugcuaagacagaagcagauacuuacacccaacuauuggacugaagucauggacccccaugcuugaauuaggggaaugauugaagaagcugaaagggagagcaaccccauaggaagaugaacagucucaacuaaacuggaccucagggagcucacagagacugagccaccaaccaggaacauccaugagcuggucaaaggccccuggcacauuuguagcagaggucugucuggucagugugagaagaugcaauuauuccuccagacuugaggucccaaggaagggggaggucugguggaguggggaacaaccuuugaaggcaagaggguagaggaugaggaacuguaggggggaacaaagugugguguaaugacuggaauguaaauaaaauuauuuuuuuaaaaaaagauucauauggucuaucccagguaaacaugaaaaguggccuucugucuaucauacaucuauucuucaauaagcgaguaacuaagagcgucuucucaagcaugaauccaguuuauugcugaauguauuucuagaaauauucucccuugugacacuuuguuuuguuuuguuuuuauuuuauuugauugguuuuguuuugauuuguuuuauuuugagacaggauaacccuguuuagcccuaauuauacuggaacucacucuguacaccagauugggccuuuaaacucagagauccaccugccucuacguccugggugcugggauuaaacgcaugcaccaccagcacccagccaagcacaaccuuuuaaugaagaguaagacaacagaaagauaaaaugugaaauaucaacaugugguguucacuccaaaaagcuacaaaauaucagaaaauuuggagaaugaaauaagagaccaccuaugauugucccucuaucacaauauggaaggcuguaauuuguucuuuugcuuguuuugcuuuauagggccucacaguugagcuccucuuaacucuuaaaggacuuuuuagacuugaacuuaaaaauuauuacagagguagugaacacagcugacauugugaaaaagacauggucccuugaggacuagaguggaaggcuacccacaaauuucuguaguuaaaggauuauuccaagagcagugauaauguguaaucuuuguggagccuaaagaggugagguccaguaaaaaguucauagguaacuguguguugccauugaaggcaauuauguaacccccagcuugaaauccagucccucaguuuugaaaauugaguuauucaugucuccugagccacuaacacaugccuucuucuguaaucuucaucauaagagaaaugagauaaccucucaguuuuggacacuuaacuuccuaaacuauaagauaauuaaagcucucuuuucauaauaauaacgcugggcaaguauuuuguuauaguauaugguauguuucaaagaaagcauuuaauuuggcacuugcuuacuguuucagaggguuaguccauguccauaauggcagggagcauggcagcaggcaggcaagcauggcacuagaggaguaacugagacauauauauuaucuucaaguuggagguagauagauagcaagacugagcuuuuaaaaucucaaagcuuucccuaugacauacuucuuccaacaaggcuacaucuacuaauucuuccucaacuguccaccaauugguaaccaaacauucaaauauaugagccuauggagugauucuuacacuacuagacaucaguuccuucuguggaacaugucucaaauccaacccaaaaagugaauaguuaccaucacaauagucaugccacugcuaagucaaugggugcauguugcugacugauugauuguuauuauaguucauagggcuaaccacuuggcaagacugcuaagguuugagcaguauugguacuagaucuuccuaggaacuuggggaaaauucagcagugaauauguuugacccuagauuuuucuuuguaggcagacuuuuaauuguuaauucauuuccauauaaaugucauauuuucaaucuucuuuauagccauuaaacgccuauuacacacgcauaaacauuauauauacacauuuuauuaguacaaucauauguugauauagucaucuaaguuggcuuuacaaccuagcuauugugaauaaugcaacaaacacagauaugcaagugccucugcaguagucuuacucagauuccaucagguguauaucccaaagauugagcugaaucuuaaguagcucaggcuuugagaaaucuucauauaaauuuucauaauggcuacuccagaaacuacacuuaaauuucaaguacuuguacauuuuauuuuauauguauaagugugugacugaugaccugcacauauguauaccacaugcaugcgggaacccagagagguuacaaaauggcauuagguccccuagaacuagaguuacugugagauacuauaugggugcagggaacugaauucaguuccuuugcaagaagaguaaguacucuuaacugcugagccaucucuccagccacagaaacuaucauuuaauaauguuugauacugugcaauaugauauuuuuuuacauacaguauauguuauccugauaaaaccucacugugucauucacaucccaauuuuaccaaugucuaaaagaaaucuuagagagaaaagcauuauaauucucccaaagacaggaccuugggagcagauuuuagauuccagaccuuuucaauaaugagucaaaauugguaagcguccucccaaagugaaaaggauuuacaaaaaagauuaacaaaaggaaaguuugccuugcagagcaagugugccauaauguacucacccaaccacugaaaucaacagaugacagacaagguuuguaagggaggaaagggggacaggaaagaaggugaaggaggaaaaaaaugagggaugauauuaacaaggcaaauaaggagagaaaagaaugaggagaaggcaagaagagaaggggagaaaugagaccaccuuaaaaucagaacagcagaugauaaaaucaucccacagugcuguaaucugcacuggacauuaggagcacuugccaacacuuugcuguugccauuugucguuacaguggucccuagagucucaaaaaucuguuuccuugcuuucuucaaugaaaucgguguucuuuggcucuucuucauccucuuauguuuccuguuacagugccauauuaaacauaugacuuuauucuuauuuaugggacuauauuaaauugguugccugagcaauaaauagaggggcacugaggucucaacuccagagaguuuccugauuuuugucuuggacaacagaaaaaaaaaaaccccacaggaacugucgaaacaugaaguuggugguucuuauuggucaccauucccauuugcugcuaugccaguggaaauuuugguagaagggaagagugcauuuggaccacccauuuuuacugugucuuccaggaagaagucauuguaccugagcaguaaagugucuuauguaauaacuccauggaucaacauuaguucagauaguaaagaggguaucucuguuguggauuuuauuccuauguuggcgcuacaugucaugugucaaaaugaccauacaaaaugucccauuaugaaaacuucucuuuuaaaauccauggcaaggcucagguuugauuaugagauaugccagcagaaaaagaugauuauauaaaugugcucccauaacacugggcuccucuggguuuccuagaggauguauucaugugucucuaacuauggaaggaaaugggaaacuucccagugaugcugauucccaacuguagcauguaaugccagaguaagaagcuugggaauuaugugacagacauaugagagauuguucugaauucuuuaagugguccuuuaucuccauguccuuuguguucaugcuaauagggaggacagcuugcauuuucuggggguuucuuccaguaaugaauaauguaaaacacucccaccaaaaacugaucaaaguacaaagaauaagugacucaucccuaacugagauaucuaucucauauccuuuucuccaugacucgugaaacacuguggaaauggggggaugaaagauuguaagagccagaggucagggagaacugcugcaaaaugcugucuuuggacaagucugggcuauuguacugaugagcugaugggggcaguguuuguuugcccaggacuuucacaagaucaagcuggucaacacucuaaaugugggcagagguggggccgugaggccauaucccuaacugagaagcuuuuggaaagugauuggcugcugagggaggaagcaucaauuuuauucauguuguagcucaugguagguuucccaugguccagcagauggccuucuaucagugaaaaaugagcaacucuaauuguacucagcauauuauuuuuaaaacaaagaaggauaagacaugaaguugugaggaggauauaagggagaucuuggaggaacuaaaagggagcagagaggaauggauauaauugaaauacauaauuuauaugugaaauguugaaggcuguauaauaaaagcuuuuagcuuuuauuugggcagccauauguugagguaucauaguuaaaacuucccuguaaucauauucauacaaguaacacaaaauaaauagauaggugauacauagauagauagauagauagauagauagauagauagauagauaguuaaggcugugacauggagggguuggaaagaggaaagcuaaaggggaagauuacauaauuauacuuuaauuuacuuuuuugauuuaaguuuuauugcaguauuaugagaaaagauacauaauuucaauuuaucugaauuuguuaauauuuaaaaacauauuuugaguaaauagauuuacaucacauucuucuuugccuuuuuuaccccaacuccucccagagaccccaucuucaaaaccugcaauaccuuuuguuuuuaucauauucuuuaaaauuuauauaauauuguaacaauaaaauuaguauuauagaaguugacauaagauuucaucauucucuuuguuucuuggcugccucgugguaaggaacuccuggagggagacucaugccuaguauuugcugaaccugaaaacuuccuuaagcugcaguuguuguguuggccuccuaggauauucagcagcugguccugucaccuuccagauauucauaugcucagccaaaucugcauaacuguaaaucaacacuaagagcaguggaagguuaaagguaaaggagagucucacaaaggauccagaaccugggagaaguucaacaaaaagaaugagugugucucugcuaaacaugcuacagggucuguuaaccuucaaggacguggcuuuggacuucucacuggaggaaugggaaucucucaguuuugcucagaggacauuguacauggaugugauguuggagaauuacaauaaucuguuguuuguggaaaaucauugcaaauguggaauguaugggaaggucauggaucaagacagccaguacauuguucuugaacacaugaauauucaagagaagucuucuaaauggaacaagcuuagcaaugugauuccugaauccccccauuaugcaccucacaaauguacugaaugugacaaaugcuuuucccagaaaucccaucuuaauauucaucagaaaauucaugcaggagagaaaccuuacaaaugcagugaaugugacaaaugcuuuacugaaaaaggccaucugagaauucaucagagaauucauauaggagagaaaccuuacaaauguagugaaugugacaaaugcuuuacccuacaauccaaucuuaguauucaucagaaaauucauacaggaaagaaaccuuacaaauguagugaaugugacaaaugcuuuacccaacaauccaaucuuaguauucaucagaaaauucauacaggaaagaaaccuuacaaauguagugaaugugagaaaugcuuuacuaagaaacgcaaucugagaauucaucagagaauucauacaggagagaaaccuuacaaaugcagugaauguuacaaaugcuuuacccaaaaauguaauuugagaucucaucagagaauucauacaggagagaaaccuuacaaaugcagugaaugugacaauugcuuuacugaaaaaggccaucugagaauccaucagagaauucauacaggagagaaaccuuacaaauguaguaaaugugacaaaugcuuuaaccaaaaaucccaucuuaauauucaucagagaauucauacaggaaagaaaccuuacaaaugcagugaaugugacaaaugcuuuacccuacaauccagucuuaguauucaucagagaauccauacaggagagaaaccuuacaaauacagugaaugcgacaaaugcuuuacccaacaauccacuuuuaguauucaucagaaaauucauacaggagagaagccuuacaaaugcagugaauaugagaaaugcuuuacuaauaaagacagucugagaauucaucagagaauucauacuggagagaagccuuacaaacgucaugaaugugacaaguguuuuuaccaaaaauaccaucuuaguauucaucagagaauucauacaggagagaaaccuuacaaauguagucaaugugacaaaugcuuuacugacaaaggcugucugagaauucaucauagaauucauacaguagagaaaccuuacaaauagauuguaugugauaaauacaauacucacaaugucagucuuagaaaucaucaguuauuucauacaguagagaaucuuuauaaaugaaguaaaugagacaauccuuuaccaagauauaucaucuuaaaauucauuagagaauacuuacagaagaaaaacuuuucaaauacauugaagguaugaauccuuuucuuuuggccuauuuccuagaauaacaguuaauacuuacaggcuagaaacuuaaugcaugcauuauaugaagaaauauucuugacuucauuucaguuagacaaaacaucuaagaacuuuuuaagggaaaguauuucuguuggggaaaauguggcauauguuuuauucacgguguccuggcaacacacaaggcuucacacuagagaauuaguaugauuaugaaaauccugugaaaauuuucaugcaauguucaaaucuuagguaaugucaacuauuuaugcugugagaaacucugaaaaugugaaauguagaaagcuuuucaugauacccuuuuacuuguucacccucaaauauuacaagaugaagacaaguugggaagucagaagagaguauuguguaacacuuucauugagacagaaaaaauccauuucaaaagggaacuauuuaagguauuuaauacaacccucaaaauaucuaauaaaacugguaacacucuguauauuuaauucaaaugagccaauucagaaaaauuguacuuaaaagauuaucuggcaaacugagccacccggacagcauauucuuuauccuauaaguaugcuuacagaugugaaaauugcuucgaguauccaguaaucauaauucuucucaaaugcuuguuucacauuauaagauagcaacugacuaugagucucuugugaucuggucaacaaguacucuccuauuauccuguaacuaacuccaauaaagcugaaagauucuacaaaaaaaaaaaaaaaaaaaaaagaggccuaugauccauccauuagcugacugugagcauccacuucuguguuugcuaggccccggcauagucucacaagagacagcuacaucuggauccuuucaauaaaaucuugcuaguguaugcaauggugucagcguuuggaugcugauuaugcgguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguagccaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcuaacuuuauaugccccaguacaggggaacaccagggccaaaaagggggagugggugggcaggggaguggggguggguggauaugggggacuuuugguauagcauuggaaauguaaaugaacuaaauaccuaauaaaaaauggaaaaaaaaagaaguugacauaaaacaacaaucaauuaaacagucuuauguagaugcuuguguucagcaauacugaaaauacauacauuuuucucaauauaaauuuuaaauaaugccaaauauauuaacuguaugguauuuuuaauuaauauaucacuauuaguuuuuuuaaugaacauagucuguuuguuuguuuguuuguuuuuaguagagcuuaaaaucuuggcucuuacugugguacaaacacaaaauaggaacaauggacaccggaguucauaucaauaaggcuguacuugaaaugucccucccaucaccaaaggauuuuaccucaauaguagauaagcuaaaaguugacaguugugcugggccacggagugaaauguaagcaugauuuugggauacagauuuccugccauggucaaagcuauuugacuugagugacugucuucauucucagcccgcagggaacagguuacauucauuuaacaaauaguguguguauuaagauggucuuccaaugaagucauucaucaacuguuucaaugaagaaugggucugcuuggaggguggcauagacauuaggugacgguaagauucugguacauuagcugugaugauuuugaaaaacauuuaucucagaauaagaguaacucguaaaaauccucgucuucaaaauugauacaauaauuauaaauaucaagcaaagcauucagucucacucuuggcuguucucuuacaagccaccucccaaauuaauugucuauguuucuuuuggcuguauaaauaauuuugaaauauguaaguaguucugaaaaacacaguauaguguaaaaacaucaaauaaacaauccuacuaauagagaggcugagauaggagaagcaugauuucaaaaccauuauguggcacacagcaagacccugucauguacaaacaagcagaaagaguauauggguuguacaguauuggaccuauuucuuccauuaccaaauaagagagaccacuggaugacaggcgacaaauuucuaauucuucauauuuuuuaauuguaauuaauuuggauauguuauaauauuaauuugcauauuaaaagaaauuaaggaaaagugauuguuauuuccugauaauuuucuuguuagaaguggaaucauguuugugugaguuuguugaaagauuacuuucuugcuucuucuaugguauacuuucacucuuuguguuguuguuuuccaucuauuaugcuuuguagggcuggauuuguggaaagauauuuuauauauuugguuuucucaugaaauaucuuguuuucucugucuaugguuauugagagcugugcugagcugggauuaguguucucuuagggucuguaagacaucugcuagcuuucauagucucuggugagaagucugguauaauucuuagaggccuggcuuuauauguuacuugacccuuuucccuuauugcuuugcaaauucuuuuuuuagugcauuugguguuuugauuauuauaugacaagaggaauuucuuuucuggucgagucuauuuggaauucuguaggcuucuuguauguucaugggcaucuguuucuuuagauuagggaaguuuucuuuuauaauuuuguugaagauauuuacugacccuuuaaguugaaaaucuuuacucacuucuauagcuauuauccuuugguuuggucuucucauuuuguccugcauuuccuggaugcuuuggguuaggaguuuuuugcuuuuugcauuuucuuucacuauugugucaauguuuucuaugauaucuucugcaccugaaauucucucuucucucucuuguauucucuuggugaggcuugcaucuaugacuccugaucucuuuccuagguuuucuaacgacaggguugucucccuuugugcuuuuuuguuguuucuaguuccauuuuuagaugcuggaugguuuuguucauuuccuuuaccuguuugauugugcuuucuuguaacucuuuaagggauuuuauguuccucuuuaagggcuucuagcuauucuguauuucuuuaagcaaguuauuuauguccuucuuaauguccucuaucaucaucaugagaaguuauuuuagaucugaauccugcuuuuccaguguguugggguauccaggacuugcuauagugggagaacuggugaugccaaguaaccuugauuuuuguuacuucuguucuuacacuugccucccaccauaugguuaucucuugugcuaccuguccuggcuaugccugacuggaaccuguccuucuugugcuccugauugugucagaacaccucagagucaagcugucucuguguuccugugauucugugauucugugauucugugaucuugagguccuggauguguccgagcuccugggaguuaagcugccuuugggacccugagauccugguguaaccaagcuccugggauccugggcuuguuagaguaccugggaguggagcugccucuggguguugugggacuggcagcagaguuuuugcccaaggucugcacaaggcacuggccauauaaagcagaaggaaccugugccacuggucuggaggagauccugcauacauaggucccacuaguccgaguuacucaugguguugggauagaugauguguccucaccucugauccucugagcuauacuuuaauuuaaaaacccaaauuuaaaaaucaauuuagucaucugggcagugguaaugcacaucuuuaauuucccccauacagaggcagaagcagaagcaggcagaucuuugaguucaaggcuagacuugucuacagaguguguuccaggacagccaaggcuacacagagaaacuuugucucuaaaaaaaacaaaaaauaaugugaucauuauaaauggcccucaugcagugugguguguagaguguacauuguuuuuauugccuauuuugcuugguacagauugaaaaaugugaagggcucaaugaauuuuaaguacaauuaaagacucaugacuagaacuaguucaagugaaucaaagcccugagcuccuucccuccccacuccuagucuggcugcagaggccacuucaaguacuagggcuucugcuuguugcuuugugaugcagaugcuagaguuaacagagcaauguggauaauauuuuaaaugugauauguauaguauguuugaacauauuucaugauguccucaagauaguaaugaaggauguuuaccaugccuagcaaaacagccugccgucucuucaguuuccuuguuagugaagauugugugagguguggccuaguugagguaggauuuuagggucauaguuugcuauuucuaaguagaaucucacauccugcaucuucugucccucauuuggcagugccccaucaccauuacuaaucuguguuuccacuuguacucaagaaaaugacugucaugauagguaagugcuaaugaguucaaaccuccaucaaugaauguaaugucucuccagguucuggcugcauuauucuagauaauguuuucaaaaguacaauugacuccucugugucuaagaaugacuaucugaaauugguuaguccagaugaacauggaccuuuuauuaaaaaugcuaugaaacaauucaagcaaugucuucuagaccaguccaaggagacucuggccaauguucaagagaugaugguaacuuuuaauuuguuuucuuuuguaagcuguaaaaucauuaauguagaggcagaaggacagaacuggcuuccaacaguuuuucccugacuuccacacauguguggguauacauaagcaccacacacaaauacacauacuaguuauuauacagucuaaaugcaucuaaaagaaaacugaacaaaaauacuagcaagaaaaauugauuuuuuagccugugacuuuuaaggcacaacacuaaauuuaagacaucuccuuguuuugcuucuccaggaugcaauauuuaacagcgacaguugucagcagacaucauaaa

SEQ ID NO: 9164 - RNA, 4074 nt, Mus musculus
uggacaaauuacucaagcuuuauuuucugccagacagggcaauuucccuagagugagguuugagaaaaauaguguugaacacaaaagaugagguuuauauuagccccaaaacugcaaggccggaggaguuucaaggguuggaggauuuccagaggaauucuaguuauguagaaacuugaacauuucaaaaucauuuuacagaacauuuuaucagaguaguggucaggguauagaguguagagcauggaaaauaucauaaaaugaagggaguccuggucaaacccaaguuuuacagaaaauaggaauuaauuuauuuugaccuuguaauaagaugacuacuaaucuuaagauaaucacccuggcccaacacagccuuaucaccccacauagaaaaacucuacuuaaacuauauguacguauacacguacauuuauguauguauuuuaaagaaacaauguuucccugugccuuguucaauuauccuugguagcuuuuuuuuuaauuccucuuuccucccucuuacucuauauugccccccacuaauuaauuaaaaguuucccugcccuguuuuucccauuuccccuucaaagcaccuguauuaggguucuaaaaagaaacagaacugaaugcacacacacacacucacacucacucacuugcagagacaaauuuauuggaaugucuacccaggcuguagucugacuauuccaaaaaugacugacuccuaacuggggaaucuaauaacuguucagucugugaggcuggaugucucagcuggucuucaguacaugccagaaccaaagaaacaggcucugauuccagugaagaagugaacuucccagugagaggacaaguaggcaaagaacaagcucuuccuucuauggccucuauuuaggcugccaccagaaccuguagcacagauuuaaagguguggccuccuaccucaaaugauccaaucaagaaaaaucucucgggcuggugagauggcucagcggguaagagcacccgacugcucuuccgaagguccgaaguucaaaucccagcaaccacaugguggcucacaaccauccguaaugagaucugacgcccucuucuggagggucugaagacagcuacaguguacuuacauguaauaaauaaauaaauaaaucuuaaaaaaaaaagaaaaaaaaacaagaaaaaucucucgcaguuauacauacucagcagcuuggguuuuagcuaauuccagauguaugccaucaagcugacaaccaagaauagccaucacaacauccaacaucuuacuaucccugucucccuugcccuacauggucccuuuucacuucccugguuucuguagcuacuccagguuauaugcucacaucugcagauucaaagcuaaaauccacaaauaagaaagugauucacuuuuugggucugaguucccucacuaaauauaacauuuucuaguuccauccauuuaacaauauaauuccaaacagcauuagugggguauugcaaauauuaggauaaauucccagauucuuuguggaaugccaucacauugaaguucaaucuuuauaaguagguucauuuuaagaaacacuacucauagccaggugugguggcgcacgccuuuaaucccagcacuugggaggcagaggcaggcggauuucugaguucgaggccagccuggucuacaaagugaguucaggacaaccaggacuauacagagaaacccugucucgaaaaaaccaaaaaaauaaauaaauaaacaucaugaauuuuguaggcaaauggaugaaacuagaaaauauccugagugagguaacuagacccaaaagaacaugcaugguauguauucacugauaaguggauauuagccaaaaaguacagaaugcccaacuguaagaagugugacaagcagaaauguccaagugagguggcuucaauccuacucagaagggagaagaaaauaaucacagguggcugaaggagggagagaccugagugggagagagggaggggagaagggguauuagaucagauaugggggugaagggacaggagagaagcccagagggccaagagaaugaaaggagacaagcagccuuggaggaugggaaguggaggaaccucuaggaaguaccagagacccaggaggugagagacuuucagaacccaaugagggggugaucuuagcuaaaauguccaacacuggggaaagggaacucaaagaacccaccuccaguacauagauaaacagggauuuaaguggagggacugggcuaauaacccacaaucaaaauuccugacccaguuauuccugucuaaaagaacugcagagacaaaaauggagaagagacugaaaggcgguccaaugaccagcccaacuagagacccaugucauguggagacaccaaggccugacauuacuaugcuaugauguguuuaugacaggagcuuggcauggcuguccucugagagucccuaccagcagcucacugagacagaagcagguacuuacacccgaccacuggacugaagucagggaccucuaugcuugaauuaggggaaggauugaggaagcugaaagggagaucgaccccauaggaagaccagcagucucaacuaacccagaucccagggagcucucagauacggagccaccaaccaggagcauccacagguugguccaaggccccuggcacauauguaccagaggacugccuggucuggccucagugggagaagauacacuuaaucaucaaaagauuugaggccucgaggaaggggggauggcugguuggggggguccucucugaggcaaggggaggaagaaugaugagaaacuguggggagggguacagagggguauaaugacuggaaugcaaauaaaacaauucuaaaaaauaaaauaaaauaaccaccacgcucugagagaaaguaacagggucaugcuggucuuacaagacuuccagacagcucaagggcucuuuuguucugacagcuacuaaaaauucacugacagcaaaugcaaacucuuaaaaaaaaaugcauuuaaaaauuauuccucuuagacaacacuauauaucucauuaaacacaaaagucaaucuggugccuacuuaaagacaucaccccuacugacucaugguacuggaagaggcucuguaugcuagcaacaaaagauaagcauaacccugcuacaaacccuuuggucuacaaugaugaagugccugcauaacaugcuagugcaguaguggcacaaauuuuguuagaguaaccauuaugaguagauuaaggcccacuccaagauggaaccugucuccaacaugcuuggcuggucaaaaaucugaggcuagauggaccuaggaaaaaacugaauacuguuguguugcuaaagcaacauaaaauaacucuugaugacauucugcuauacccacagaucaguuuaaaccagcuaucaucaaauaagucucccucugcaguagaugggaaguaauggggacagccacaguuggacaaugugcagaaugagaggcccugggacauuuaguccugaaugguauuucuucaucaaagaccuccccucaggauucagggagcuauacagaagaggagguagaaagguaagaggaagagaggaugaaaaucaccaagaaaacagugucuuccaaucacaaccggacugccacacaaaugaacucagagauaguagcaguaugaauugggccuucaaagauccaaaccagguaggggucccagcacuaauaggagaggggcguagacaugagcucccauccucaagaagcuguauccaauuaucagcaacucacaaagcaaaaauuaguuuccccaagucuuacuggguacaauuuagggcagacuccauguccagguacggccaacauaaaaaaggaacucaaagguauuugacgggauaccuuuucauuuuuuuuaaucucacauugcuuuguuugagcuuuuuaaaaaauaaaauaaaauaaaacaaaauaaaauaaaauaaaauaaaaaauaaaauaaagcccuauggucuuuuacuuguauagaaugcuuuacaauuuuugag

SEQ ID NO: 9165 - RNA, 4074 nt, Mus musculus
cucaaaaauuguaaagcauucuauacaaguaaaagaccauagggcuuuauuuuauuuuuuauuuuauuuuauuuuauuuuguuuuauuuuauuuuauuuuuuaaaaagcucaaacaaagcaaugugagauuaaaaaaaaugaaaagguaucccgucaaauaccuuugaguuccuuuuuuauguuggccguaccuggacauggagucugcccuaaauuguacccaguaagacuuggggaaacuaauuuuugcuuugugaguugcugauaauuggauacagcuucuugaggaugggagcucaugucuacgccccucuccuauuagugcugggaccccuaccugguuuggaucuuugaaggcccaauucauacugcuacuaucucugaguucauuuguguggcaguccgguugugauuggaagacacuguuuucuuggugauuuucauccucucuuccucuuaccuuucuaccuccucuucuguauagcucccugaauccugaggggaggucuuugaugaagaaauaccauucaggacuaaaugucccagggccucucauucugcacauuguccaacuguggcuguccccauuacuucccaucuacugcagagggagacuuauuugaugauagcugguuuaaacugaucuguggguauagcagaaugucaucaagaguuauuuuauguugcuuuagcaacacaacaguauucaguuuuuuccuagguccaucuagccucagauuuuugaccagccaagcauguuggagacagguuccaucuuggagugggccuuaaucuacucauaaugguuacucuaacaaaauuugugccacuacugcacuagcauguuaugcaggcacuucaucauuguagaccaaaggguuuguagcaggguuaugcuuaucuuuuguugcuagcauacagagccucuuccaguaccaugagucaguaggggugaugucuuuaaguaggcaccagauugacuuuuguguuuaaugagauauauaguguugucuaagaggaauaauuuuuaaaugcauuuuuuuuuaagaguuugcauuugcugucagugaauuuuuaguagcugucagaacaaaagagcccuugagcugucuggaagucuuguaagaccagcaugacccuguuacuuucucucagagcguggugguuauuuuauuuuauuuuuuagaauuguuuuauuugcauuccagucauuauaccccucuguaccccuccccacaguuucucaucauucuuccuccccuugccucagagaggacccccccaaccagccauccccccuuccucgaggccucaaaucuuuugaugauuaaguguaucuucucccacugaggccagaccaggcaguccucugguacauaugugccaggggccuuggaccaaccuguggaugcuccugguugguggcuccguaucugagagcucccugggaucuggguuaguugagacugcuggucuuccuauggggucgaucucccuuucagcuuccucaauccuuccccuaauucaagcauagaggucccugacuucaguccaguggucggguguaaguaccugcuucugucucagugagcugcugguagggacucucagaggacagccaugccaagcuccugucauaaacacaucauagcauaguaaugucaggccuuggugucuccacaugacaugggucucuaguugggcuggucauuggaccgccuuucagucucuucuccauuuuugucucugcaguucuuuuagacaggaauaacugggucaggaauuuugauuguggguuauuagcccagucccuccacuuaaaucccuguuuaucuauguacuggagguggguucuuugaguucccuuuccccaguguuggacauuuuagcuaagaucacccccucauuggguucugaaagucucucaccuccugggucucugguacuuccuagagguuccuccacuucccauccuccaaggcugcuugucuccuuucauucucuuggcccucugggcuucucuccugucccuucacccccauaucugaucuaauaccccuucuccccucccucucucccacucaggucucucccuccuucagccaccugugauuauuuucuucucccuucugaguaggauugaagccaccucacuuggacauuucugcuugucacacuucuuacaguugggcauucuguacuuuuuggcuaauauccacuuaucagugaauacauaccaugcauguucuuuugggucuaguuaccucacucaggauauuuucuaguuucauccauuugccuacaaaauucaugauguuuauuuauuuauuuuuuugguuuuuucgagacaggguuucucuguauaguccugguuguccugaacucacuuuguagaccaggcuggccucgaacucagaaauccgccugccucugccucccaagugcugggauuaaaggcgugcgccaccacaccuggcuaugaguaguguuucuuaaaaugaaccuacuuauaaagauugaacuucaaugugauggcauuccacaaagaaucugggaauuuauccuaauauuugcaauaccccacuaaugcuguuuggaauuauauuguuaaauggauggaacuagaaaauguuauauuuagugagggaacucagacccaaaaagugaaucacuuucuuauuuguggauuuuagcuuugaaucugcagaugugagcauauaaccuggaguagcuacagaaaccagggaagugaaaagggaccauguagggcaagggagacagggauaguaagauguuggauguugugauggcuauucuugguugucagcuugauggcauacaucuggaauuagcuaaaacccaagcugcugaguauguauaacugcgagagauuuuucuuguuuuuuuuucuuuuuuuuuuaagauuuauuuauuuauuuauuacauguaaguacacuguagcugucuucagacccuccagaagagggcgucagaucucauuacggaugguugugagccaccaugugguugcugggauuugaacuucggaccuucggaagagcagucgggugcucuuacccgcugagccaucucaccagcccgagagauuuuucuugauuggaucauuugagguaggaggccacaccuuuaaaucugugcuacagguucugguggcagccuaaauagaggccauagaaggaagagcuuguucuuugccuacuuguccucucacugggaaguucacuucuucacuggaaucagagccuguuucuuugguucuggcauguacugaagaccagcugagacauccagccucacagacugaacaguuauuagauuccccaguuaggagucagucauuuuuggaauagucagacuacagccuggguagacauuccaauaaauuugucucugcaagugagugagugugagugugugugugugcauucaguucuguuucuuuuuagaacccuaauacaggugcuuugaaggggaaaugggaaaaacagggcagggaaacuuuuaauuaauuaguggggggcaauauagaguaagagggaggaaagaggaauuaaaaaaaaagcuaccaaggauaauugaacaaggcacagggaaacauuguuucuuuaaaauacauacauaaauguacguguauacguacauauaguuuaaguagaguuuuucuauguggggugauaaggcuguguugggccagggugauuaucuuaagauuaguagucaucuuauuacaaggucaaaauaaauuaauuccuauuuucuguaaaacuuggguuugaccaggacucccuucauuuuaugauauuuuccaugcucuacacucuauacccugaccacuacucugauaaaauguucuguaaaaugauuuugaaauguucaaguuucuacauaacuagaauuccucuggaaauccuccaacccuugaaacuccuccggccuugcaguuuuggggcuaauauaaaccucaucuuuuguguucaacacuauuuuucucaaaccucacucuagggaaauugcccugucuggcagaaaauaaagcuugaguaauuugucca

SEQ ID NO: 9166 - RNA, 27258 nt, Mus musculus
ccaauauuccaaugaagccucuagucuucacaauauccacagcagacuuugggcuauacacuuuauuaaacuaccucacaaacccuagaaacuaaaagucauucaacugaacuguaacaaucuauuuauuuacagaguacugccuacagagccaucagugcucaaccugguucuuccccaggcaugaagcccauccucccaacaggucugggaauaccugacaaacagaggacacugauagccaccugaacaauggcauaucaggcagaagugcaccagcccaacaucaaaacagacagagaaacaaacagaaagacacacaugggcccugugcuccaaaaugacugagggccugccucauggacucuucaggcuagauagucuaguccccacugcuggggaccaugguggcuuucagggguggugaguuccaaacagcagagcuagugcgcuugugguagcgagucuuccucuucuuaaagauguccuccaaguccagugggagaauagauccgaagagcucuagaauguuuggagggugguaguacugguggacaauggccuggcugaguugggugccugaagaaaacagaggccuggaucacuguccggugcucucugggagcuucccugaccccugcaccuacccacagagcccagucauccuuuucaugacagcaugccuugcuccuauccuaucugcuccucuagcaaccuccugcucgccuccacccaacaauuauccuuuuaucuccaucuucuagcagcugagcccaaaggcccccaggaguugucuuaggcaauacuuuauucucccuauuuuguagaaagagacuugucucacggcacaugguaggugaauggcagagcuaagugugaagacaagccugucuccagaucuuaagccuccuugccuggcuacucccaccaaccucaaagacucuacagaagagcacacagcuaaaggagcagagcugugugggauucacagccccaccaaccaggcugaggagggcccuagaggaucaggagugaacacacauccagggcuugcuuccuaaauuccuucacucauaaucaucucaguuggguccuaguaccacuggcucccucuucacagauacagaaacuaaguaaucuaucuaaggucaguuaccaugaggcaacucugcuggccacacuggccccugcuugcuguuguucuaaagugacuugacauaagauucugguuauggugggguuuaaacaaagucugucacaaaaguugucuuucugucaagugcugacccacugugggaucugaggacccuucugagguaagcaccuugugcuaaccucuaguucagcaaauccuaagaaacacccuagcaggcccucaugcccaggccagagacagcaucaaacccauccacacccuguauaaaucggaaaccccaagacucaaggcaaaucuugcucaagaaccaauccccuugcucgugaucuuuccuaccucuaacauuccaaccaaaccuugcuauccucuuaguucuaugcccacccauggguggcuuacuugggucuaagccucuugagcccugcugggccagacucugacgagaggacuuucgaguccaugucagaauacuuagcagcacguuugcuugagccagacauagcuacauucaacaagagcaaaggaacucaacacccuuuauccuauauccucagaugcgucuucagaccagaguaagccuccuaccucuaggugcaugugcaaagcccgauguuccuaaguccucaggucaaugccauaagucacugggccuagccugucagcacaucagccuguauaccugcagcagcuaaacuaccacguccacaucccacagaggggaagaaaggaggcagcccaagccucuucagaaacucugggccccacucaccuuuggcccaggaagggauggguuuccgggggugggacucaucaucuguggagucaucacuauuuagguccaucccauaaucgucuacgcugaucuuggggauggauuuggguccuuguggagucauuugauaugagguacaaacaggagacuagaagaaaaucagcauggucauuagcuccuccccugccuuccuggaggacacugacacucuggccaucucccuucacuucuuaagaagaaaagaaagauauagggccacuuuuucauuuuaauaagucagggaauauaaaccacuuuguaucauguaaacuuucuuucauauuggcauuucccucccucaaagacacaccaugaucuucaacuagcuuucuacuauggaugguccuuuaaucccugcaacuguggguaagguaaaaggauuacaaauuugaggcuagccuagguuauacaaccagacccugucaccaaaaagagaaaaaagaaauaaacacaaguuacuugcucucuuucuucuggcucuaacacacagccugagcuuguaagcaaaugaagggugguguaagagccccucccaacaggggcgcaggccucaccugcacauccacagucauguucaggacuuuccuggcugcugccaccuccuuagcuuucuuugccugcuccuccugcaguugcugcucagccaggcgcuguugcucuuccugggacccaaccagcaacaagauuagguguguccuuccucuccucuugccacacugcuaccccauguggcaaggcagggcugccugaagaguauauagcccaggcuucccagugcucucagcucucagcucagcacagaacccacauggagcccauuuucccaacacuccuaccuuccucuucuucuccuccaguuccuucugaagucguuccuuuuggagucgcagggcuuucucucucuccugcaucucccugaggacaaccaagaaucugucaagccaguaguagggccccaguccucuucccaccccgcaagagaaucuaggcuugguggacaugccuuuagggacugggacaaguagaacuggacaucagcuuaaagccaacagcuggacucuccaaaagcaagcuucaaagccuaacuuuggaaucaaauagcauacaaccccucuuccaugcaagugagguccacgagccucgcccuuuucuuuuucacaauaggaagagugauagcucuccuccggccuugcuaugaccacuacaugagagagacaacacagaaccggguggugguggcgcaagccuuuaaucccagcucuugggaggcagaggcaggcggauuucugaguucgaggcuagccuggucuacagagugagugccaggacagccagggcuacacagagaaacccugucucuguguaaaaaaaacccugucucugaaaaaaaaaaaagaaacaaaaaaagaaaaagaaacacagagcacucagcuccacccagugagcaggggucgccucuacagucaggagcuugaccuuaaacaagucauuuagccucacucucaaaccagauuccuuuguaaagcucauugucucuaugccacaagagcuuuaaggauuaaguuuuuuaaaaaccuacagagcagguaguucagaggaacccucagaccccaucgcucuucagggcuaauacaaaucuaaccacccgacucugaagccacaauagcagccaccacccacucccucccagacucuuaucucugacuuuaccuagaaagaccaggggcacuuuugugucaaucuauaugcacccaauacugccuugagaugcaggcccucuaugugaaguccucaauucuccaucaaacauguacccaagucaggaguugggaaggaagaggaaauaguugcugggccuguuggucugcacacauaugugggcacaguucuaauaaaugucagugaagggaaaaccucaccggguuaucaucaccaccaaggguagcauaggggccagggcuaacaugugcucaaugcccuauacugcaauauaaaugucccucaugcccaggaugccuggggcaggcccauggaggaguacuaugugucuaagaccccucaccuuacuuauccacugagacaaaggcaccaaaggagucagcacauucugcugaagcagaagaaaacgugcagugacccugagcuggaaccccugagucucccacagcuaacauauauccuauuuggugguccacuagcuguaggcaucaggacaagggaaagccugacaaccuucaagugaauagaagccaagaaaaagaagcaguggccaugcugccugucacuccccacacaggacaguaguaaauggucaguggguggccucaccucuuggcccgaagacgcuccugcuccugcucccgccgcuccugcuccuuccguuccuguucccuccgcuccuguucccuccgcuccugcucccgccgcuccugcucccuucgccucucuugcucccgcuguucugccaggcgccuggccucagcugcuuugcggcgcuccuguucuuccuccuucuuccguuguagcauuucuugaugccgccgcuccucuuccuccugaguuggcaaugcaaggaagugcgggacacucaagccagguuugcgcccacagagagaaagcaagccaaggagcugcuccugcccacagcccuagcuccuaaggcacugacuaccaccaugacaucagguaggacggagccgccagacuccuugacaauagguuuugaaagucaugggcagacagaaaaggcaucuggcaacagcugcagcagagcugacaagcaagaggggaccuuggagagcuagcuaugugcaauaggcaagccaucuaacccgauggucauuucucaucugaaaagcaggagacagcagcacgugcaccucgaggagcugcugaguuaacacacauuaaacuuaagugucugucagagcguaaguacaccacacugauuaauucuagagcaccccaacgacagacauuguucccuccagugcuaagacugcaguuccagagcgagagaugggguccuacucuugcaagcauaaggcucaaggguggaguguguuacaaucacccacugggcauucagcacauaccaggcacgacaugccucucgugcauuagugaaucuugcucucaacuagaacccuuucaaaagcaagaucacucugccauuugaguaaccugaucacgggcacaccgcuaagaaacagcagaugugaggugaagccgggcuccaaaagcacauccaaucuccaaacucuggcuucuagcaaaguccccaugacgcaacccucaagucagcaacaaguucaagaggaccuacucuacagaaugggcaugcccagccaguccucagggcaaggaggcagugccugucccacccuacugcuucccuguccccaccuagucgcaccuguuggagccaccugagccugcgugccuccuccuccugcuuccuucgugccucuaccucuuccaucuucuuggcaguugccuucuucuuugccuucucugccagacgcuccuccuuagccugcagaauccacucacauguguccucuggagcaaccucuaccuuagcaugcagcauggagccuagagcucugugagagguacccaugccccuacaaacccugcccagaacucagggaaaaggcacaauaagccauaccaccucaggacugcucacacgaaaaggguugcuggggggagaaaaggcuuaaagcuagacuuccagcauucaaguugccucagaaaagaucaaagcccauaugacagaaagcagggguacacgggccguccagccaaugacuaaugcaagaguccaguggccccgcccacugggcccauuagcccagacucaccuuuucugucuucucaucaaucugagcaaacuucugcucaaucugcuucuucuuuuccuccuucaucuguuccacccucucacgggccugcaacaccuugcggaggcgcucuucacgcuuccugugggcacagcagucaaggagagccuacccaagcuggggcaggccgggcugggagcugggacacuuacagcuucaccuccuccagucgccgccgcuugucuuccucuaccuucugucugcgccgcugcucggccuccuccuuccgucgcaggcucucuaggcgcuggcgcuccuucuccugaagagggcaggauggccacugggauguaaauaaggauacccaccaaccccaaaggcugccugcaccauucucaagcagccagagaagcagaugccucacaggcagacauccaagcaucccgugaccacccuaggcaagacuaagcauccuguuucuccuucaggcggacagagugcauccacgaaccugacuuguaggcaacacaaaagcagccucaaauuagauguaugcugauuauaguuauauaaacaacuugaaaagugacuaaaugugggacuguguucagcccccacugugcugcugggcacagcugcuggagaagggaaacacaggagcuugacugcacuuaucccaacacgcugccgcccacccauagggugcagggcuuuagggaagcaccaagacacugcuccaaggaugggaaaaagcagucugagauguggacuccugggcaucuagucaucacuagaaaaccacacagagaagucaaaaaugaaguguugggguccacaggcccucaaggaggcaaggccaggaccauugggauccucgggcuaaggacagcaucugcccggggcuugggcugggagcuccagcuuagcucaucaguaaaaguagcagugguugucuagaauuacagagaggccuucuaugggagacuuaggcagaggcucuaugggcgaaggccuccuccaugcuccccauagcagugguagaugaaagagacaguccuugguuucauugguuguucaucuugaaaaacggaugcauaccaacuucucacggugguccagagauuaaauaccuuuugcagagaggaaugucugggaaggggagcuuauugacuagacccucagggccucuagguaccuuauuagcauggagaauucuuguaugugggaaguguggcacacauuccaggccaggaaacuggcagaaagcacggaucgcggagccccuaccaucucagauguguaccugaguuuccaaggacucugacccacuaccuuaccagguuccugauaagucgccugucccacaacuaaagacuaagacugcaaagaaaauggcaggcagcucaaagugucagcuaauguucuauuuggaagaacaagauaaaggagcagccauuuaucacugucaacacaugcuaggagugugaacaugcaccacucuuuuaugcacaucaacucuuuuagaacaguagaaaaaaagguaccaucaaauguuaacacaggcuagugagcuagaucagggaugguauguccuguccuuuaguuuucaaauaucuugugauauacugaaagauccugaaagaauguaaaaggucacagaagcccugaaauuggcaaaauagaugucacuguuagcagaacuagcuucacugauuuagauaaauagaggugcacaaugcucuggccgcuccuugaacccgugugucugccaauguucugaccguuccuugaacccagguguguguccacugcugcaccucacugccagguguuugugauauugguugcuaagauagagucagaaaaucuccccagcaaccacagcagggccaaucuggaguugcuacaccugcaccagacucuuuccuuguaccccucccauacccauuucuugagaauagacauuguuuagaucuggaaauccccuaaucucucccuucuccuuuuccuccugagggccuauaaaaacugggaccucuuuccccucgaggucgacuccucuaccccugugugggauaugagucguccccagagcucuggcuuuccccgaauaaagccacgugguuugcaucaagcuuggucucucuugaguucuugggggucugcuacuguccugaggccugagcgaggggcuccucucggaggucuuucaauauuuguguuaauuucuaaaacaccauuaaaagacagcugauuguacagcagaucgguacuagcaucacuucccaugcaaacccagaaagccccauagggacaugguuauagcuacaaugcaacagcagagauggggagacgcuccaaacugugccuggccaaggguuagacuaaugcuuuccagcacccacugcccggcaauaaauuuuuuaaaaacauuuaaauuauauauauacauacauacaugcauauauauacauauauauguacauaaaauaugugugcauguguaaaauaaaagacugccagaaauuuuuaaaagccaauuaugugcuauuuacaaguaauaauuuagauggguucaaagaccuuagcuagaagcacaguggcuaaccaaagguagcguacaacucaacacaauucccaagacguucuccaaagauauuccuacugacuaauggucuauggcugcugagcuuagugggugaggacaguguggacauggucugugucccagcuaugguaauggccacauaagucacguuacaauucauagaaacacacaucccccaaauucaccauacuguguaacuuuaucuaucuaaacaaaaaacauugaagagagaaauggaaaaaaagagggacaucaggagcuauuaaaaccaaguuggguacagaagagccuaaaaaagcacuggucuuugagaaauccacauggaaugggugaccuucaguaggcucuccaaccacccagacucaggaagaaaagaugggaaccagacauauagguacacaccuauaaucccaggacuugggaaguagaugcaagaggguuaggaggugaaguccagccugggcuacuugagaccacaucuuacacaaacacacagacacaaguagggaggaucacacuccaacuuucucuccaacacuacaguacacaagugcucucccaaagcaaaggcuggauggcacucagugcucgccaucucuucuucccauagacagucaaacucuagccuucagcaaggcagagaucagccuuuucuccuuaagcuucaauauuaaacuuucccacaccagccauagcaucgauuguacuacucggguauaaaaagaaacauuuacuaugcccagaaccuuucaaccuuguuaggcucugguaucccagcuauaagcaccagaaguccugugcagggacuuggguucccuaaagcaggcaggacaacuugcagugccuaucagccauguccauaccugcaaggcccugggcaauauaaaggagaggcagugaauggccaauugaagaaggaacaaguucagccuucuucacaggcaaguaagggagacaugcugucacccugaccaaucaaagaggacaaacaaguugaggaccuaucuggccagcugcugagaccuuuccaccugccauggccaucagcugaaggcaaaagccuuucagaugccuucguaacucuucucagaacuauaacaagaggcugcaucaagguaugaagcaggaagguguauucaggauauccuacaugaccugagcuauacaacaccccuucccaacaaaguauugaccagcuguucuggcuggagccacauacaacucuuucccgagaaagcaguguccuucuccucccuagcaauucccuguuuggagucuguggucaaaugaacaauaaccuauguucucaguaugaacuuuuuuggggggaguugggaguggggaggaggagaccuuauuuauuaucucaugccuguaugggauuuauaauccacaccuacacagguugaaguuuccaacugucaaucaaaaguugaccagagcagaaaaccaucuguacccugucccuagaaaccaauuccacuuucuccuugacccacugcuccuuccuugcagagcaucuaccuuugacuuucacuuucaaauaaaauccuggaccuuaugccucagcaggcauaagcgccuaccaccaacacugauaaccuuaguuugauccccugaauccauaugaugaaagaagaauagacuccaaaaauuguccuuuaacuuucuuccaaauauauccuauagcaugugcuucacacacacacacacacacacacacacacacacaaauaaaacaacuuuaaagaaaaaucccacauuauuuguaugugugugcauuuucaaaucauuaaacagaugacaaaaagcugagccauagcuggucaagacagcaaccaacuaggagcaggaaacaggacugugggcuccucucaggucccaguuguccaaagcucuugcucacagcaagugacccagcccagcucagcucugaggugccugggaagagaacagcuucuuuggucuuguuuccagaugccacuugccaacagcuacauugaaauuugcacaaugaacccagccgaaguuuacaguuaccaguccuaccccaucaaacaucauaucagggcuacugcuuagguccaugacccaauaacucucaguggcucuguggaccagagacaugucuguucuuuucacagacccucaagcuccagugcugggaaugaggaaguagauggcugugggaagcacuucuagcuguaggccagaaaaacacugcaggucacaccugccuguguccucccaauagcaggggaugggcagagggcaaucucuacagugggagguugcaaagcuccaaaacuauugauucucaccaguuacccuggugacuccagugacucccacgugcacaucugccuuccuaacacucccacuugcaauguuagugcuuccaugucagcuacaccuagcaugacaugguuaagaacuaggcgcagcucuguuaagggacagggaaaagcuuuacuuacaacaaagcugcacuguggagaggaaacagaagaacagaagaguuaaugccaagugauguccuacagggcgggcuacgcaccuaucuacgguagugggucuacucagggccuuuuuuuuuuuuuuuuaaccaacaacacacugcugcuucaucucgcccauccucccucccaacaguaaaggugucgucaccuguuccucucaagucacacccagcacuggucuguggacacaguagccaguguuaggucugcuaagccaauccucccacuuuccagccuagggcucacaccaagcagcugagcuucucagucauaguccaggauccauaaagucagagcaguaccacagaauugaggcaacccuugccacagaggcuugaacucgaucgcccaucagugucugaccuccauaugcccaagcccacacuacccucaguaacuuaggagagcuuucaaccacagugcccuaguuccagcaaggcacagccaggggacaggcucccuuaccuuaggguccacacgaagcggaguguugcguuuaauaaaggacuucaugacacugcugcgggaggccagugugggggucaugagcaucugguucuucugcacugugugcaggaaaguccggaggggccguaccaccuacagaccagggccggggucaggauggaacaggcaaggcagacaccaagcaagggcaggaaccuacucaccuuguuggcuggacaggguggggaaggggucuuauucuggcagggcugcaguucuucaucuuccaguugcuccucauccgguucacuuauugccuguuuguaacugcguuuccuccuacccaggacagguggccacaugucauaaagaggugucauagccccacuacaucccauuuaaaaaaaaaaaaaaaaaaaaucacccuugcaaacacgucugggcuuaagccucagaacucuagacuugaagagacugcagaccagcccuuugcugcccacacaggaaaagguagguggccaaugaaaggucacagagccaaggcugcagagggacaugaucauucccaagacagcaucuacagcaucaaggugcuucuucuguuaagucaaaaaauuaaacagugacaccagucaagaagcagaaugccuggccacaccccgacauagccucucuaugcaaggccccagcuugauucaagcccccucucggauccucagaccacagcugccuacacauccuuuuuccagaugcaaaccugacacucuggggugguucucuguguccaucuguuuggucaagcucagcuucugugaagacagaaauuucagugaaguuguuugagugauggcggugggguauacaugcugguuuuagggaagggguccagcagcaauagcuacagcaagagcaaaccccacuccugacaaccucaggguggucaauggcaaaaacaccaaacuaagcaguaacuggccuugagcccaggauacuggcccccaaaucagauccuccaacccuaauccuuggcaaaugugacacaaauggcaugacaguaucacugaagucuuaaucuacaugccacuccacuaccacaaaaacuaugugcaaaaaccuuacaggacaagcugccaacucuacuauaacuaaagucaccucuccuggccuucaauugguaccacaugacagaagaugaagguucuuuucauggggucaucacacagggcacaguacauuuuauuucacaccaagaggaagcacucuuuacuccaagagucuuugcagcaguccuggcagcuuucaagcuggcacaacuaucccugaccccuucauaaaggguaugcuuugcucgaaaccuuacagugccauuucuucacaccauggaaauuacccuccagagagagacaugagccagacuccaagagccuaaguagccugggaagccaggcaagggcucccgaccaacucccaaaacccacaggaacccugcccuuuuugaacuagagaagucagaaacaagcaaagggaaagaggccagguagacacucagaccccagccuguaggucuucaugaauccuuuggagugggcuuuaagaccuucacaugacagucucauaccguuacuuccuucagguccuucccuguuuccuaaucuagccagcuagacuuacucaugugacacucagcagcaaccucuagccaagaucauggacucuucagguuuaucuuuggccuaucaggucaucagaaaauggagugccauaucccaagacacaggaccaagcagcucaccuugcucuucaacaguuguugucugaccagcggccgcaggcuucgaggugggcguacuaaucgcaaucuugguggcacugcgggguuuggagggacacccacuguucuuggagaccuacaggaagaaccaagacuugaagaagcccacauagauccugaggcucaggauggcguggcacagagcuucagaccuggagggcucagguccuacccaucucuggccugugaccuuaccucuugcuccucuucugccuccucagguucggccaccucgacaggcuccugcuccaggcugaaagcaaagcaggagcacugugagaacucuuaagucuaaguuuccucugauauuaggcggccagaacuggaugacaaaccaacagccuaggcuggaucagaagacagcagcuaacaccgauggcuuccugaguagaaacguuaugcgacuuucuuauuagaggucacaugcuuauuaggagugugcccaugaaggcaauaauaacgggcacaguccuuucuuuucuuucuccuuucaagucccagccaugagaugaacagcuuuguggaccaaacucccauagucaugauguacugcuccccaaagcagcagagccaacaggucauagguggcuuagcucuacaacugugagcuaugacaaaccauuuuucucaguaagcugaauaacuuuuaggcauugcuccagugauacagagaagacaaauauuuuauccaacucugucccagucuuuagggcccagcaaagccucaucucuuuugaugcuugcucacuacucacccaggggccagccagccccauuuccucaucccaagcacugacccucugccucaaaguaaagaaggacuagaugugauagcacagcaugaccucugagaagucagugcccuaggcccaagcaaugauagggcuaaucuggaaacagagagcagucgagccccagacuaccacucuacuacaccucauuuuaaaugguuguucuacauucuuuacaagcauggaguucacacacucaggcuaacaagugaugcugauggaauguugccuggggacuugacagucauguugcuugcugccugguuacauggggaccaagcuaagggagcaugguugucagcagugccauggagagauggguccugcaaugugcccugagcaccccuguaaaagcucuagcauggaacuuacccaacauucugaggcacuucaacauucaggagccucuccagguaacugugaccugaaggacaaacaaaaacaaaagaugccaucagaaaccagucaggagccaggccagaggugcaggaaguuuguggcaggagcacgaucacugcuccuuucacagacacacagcccucacugcgcccuggcucucuuccucauucacccucagaaccucaaugaagcuauuagcuuuauguagcuugcguaacaggcacagcuccaccucuucacuaggcuaggaaucaauaccuuggaaagagaaaugucugacauuacacgggccccgacacaagcagccuauucacucaacaaacauucaucugcuacuauguacugggcuccgggccaggugccgcagccucagugguaaggaaaaccaacaaagccacugucuggucuuuuuaccuuccagcaucaaauaaucuuacacaguaaacaaggacaugugcgacaaccaaguuaaagaggcuaaagccuggauggagacugaacugaugugaaagacucaaugugaugagacaaccaaaggggaacuaggaggugguagugcacgccuuuaauucuugcacucaggaggcagaagcaggagguucucuugaguucaaaaccagccuggucuauagagaguuccagaacagccugggcuacguacagaaauccugucuuuaaaaaaaagggggggggggggugagggaggacagaggacgggaggaaggaagaagggaggauaugaagcuucuggagauacugagacccuuucaggcaauccacacgucugaacuacuuucgccacugcacugaagagugacuucuuacuauauuaacauuagcccaaacagcacaaaaaaacaaggaaagcaugcuaaacaugcuuacauccaucaagaauucugcaccauagcugggcgugguggcgcacgccuuugaucccagcacucgggaggcagaggcagguggauuucugaguucgaggccagccuggucuacagagugaguuccaggacagccagggcuacacagagaaacccugucucgaaaaagaaaaacaaaacaaaacaaaacaaaacaaccagaauucugcaccacacucuaucauccuaucacacacaguaaagcaaugcccaguuucaauuaagacuguccuugaggaaguauuaauuacaggcacaaugauuaccaccuuuagccccagcauucaggaugcugagacagagggauugccacaaguucaaagucagccugagcuugucuaaauaaguuacugaacauguaucauagccaagcacuaaggaugaguucuuuaacuaccaucaaggcaaugucauuaccauuucagacagaagacugaaguuaagagaagaggugcacccaaggucacccaccugggggcuguuacuacauauucuguucccugccucuucaucuuuccuuauuucaaggagauaacugaugggcuuggaauuagacagaucugcuuacacccaacccagaaucguauccagcagcagcaaaggcugugggggagggaaaaagcaaugcuuaaaagcuacaaguuugcuaucauaaaaacaagcccugccgggcgugguggugcacgccuuuaaucccagcacuugggaggcagaggcaggcagauuucugaguucgaggccagccuagucuacccagugaguuccaggacagccagggcuacacagggaaacccugccucgaaaaaccagaaaaaaaaaaaaaaaaaagaaaagaagcccuaguuugaagcaaaaauuggaaagaaaaagacaccaauacuauaaucauuucacauguaaauucaggaaagucuaccacuacuggucaucuacaaauguggaauugacaaaccacuaaaaaguuugaaaaggaagcugcugagauaggaaauagcucuuuuaaguaugccuuggucuuggagaaacaaaagcugagugggagcauaguaucacuauugacauaucccugugaagaguugagaccaguacucauuaugugacuaucacccaggugugucaggaugaccgugccauccagacugucugccaaugcugaugagucucuaagaaugggcagaccugugagcaugcccuucugacuuuucacacucagugugaaagagcuaacuauuggugccaacaaaacauauuccauaaagccauccuacagcaagaagacauaaggaaauuaagggagucaguacauccauaaagaauauuggcuauaacccugacacaauaccauuuauacaaauuucugguuggaauguugacaacaagcuagagccaaguguuaauaugucuuauuucaagggauguaaagucacccauaaagauggcagugcccuuggaaccacacugcugggagcuuuagauuguaucccaccaccaacucauccaacugacaagccuuuccaacagucccuccaugaugucuauaaaauugguagauugauauacauauacgguauagaauauuauuccaccguaaaaaaaugaaaucugcaaguaaauggauggaacuagaaaagauuauguugagugagauaacccacauccagaaagacaaaccucuuauguucucuuaucuguagcuccuaacuccaaaucuucaaaucuggguauguuaccuggaguaacuguagaaacuagggagguaaaaagguacuggaggggagugagauacagagaagagacuagcaggcuaaacaugauuacaugggaagaugggggaaaugugaguaggggcuuaauuuagagagggagcugggcuugguggcacacaccuuuaauuccagcacucaggaggaagaccuauguucaaggccagccucaucuacaauuugaguuccaagacaaccugggcuauaccaaaaaacccugucuugaaaagaaaagaaaaauuuaaggaggaggaaggaaaucaauauauagagacaaaggaggauaaaacaauaaaaaggaugucugaaaaagucauaaaagauuccuauuacuauguauuuaccuaaauuacauguaauacauauaaaucuauguauaaugcauacauauauauaauuugaauaaaauuuucccacucgcacugccagacucccugcaaaagccauaaaccaucuaauaaaaaacucaauaccaggcaugagaagcccucuuuugaauuauuggucaagguuauccaagacucauauugcuauugcccuugguugucucccagagcuucaaaguuaagucccuacugcuaaagacaugcacuuaaaaaacuagucuuggaggauccaaguugaaucugacuugaaagcuuacucucuaagaacuaacuagcuuucauauuaccagaaaguaccauguaaguagucaagagguaaguaaccaagaaauccuacccauuaguguaaucuaugaacuauaacaaugaccacuguggcaccauaauccuaaaguauaacaggagcauccauaucuugaaaguaaccaacagcucucuaguuggaccuaaggcccucucaacaagagggaaaugguaccuggggcuagaaaccuagccaacuucccagaguugaugaggucauagaucuuagaggagaaccuacaacugcuacuuuaccaaaccaauauaauuccuaacugcaaucuaaauauuuauucuuauacucauagacaaguauagcucucaacaucauuaaagaaacuucucuuugcaacagauggaagccauuacagaaaagcacaacagaucaaaaugcaaagaacaagugaucucauauggugcccagcuacaauauauacauauacauauacacauacacauauacauauacauacacaaauauauauauaugauauagcuacaguacaucuucugccccugaggcucaggaacacuaggagagaaaacagucaaaagagccugagaacaggaacuaucaggugagacuacaucuccuagaaaugucaaagaagcuaccgagaccauuaagucuuaacagcauggcugccuaaaccaaaagugaaugaggacaacagaaaggcaugccaaccucuaagaggaaagcucacuggaccacaacccucaacaaagaacuacagcaacgaaguaaugcugagacugggaaaaaauggucuuucucccccaccaaggggaagagggccccaccacaauugguuauccaauacaagggguccccuuuuacaccguguacagucgagcaacauuauacaaacugagcaggcuguauuuauauauuugucuguguguauacaugcauguguguguguagcaacaaguuaaaaaaaagaggucaugaauuuaagaaagaauucgguuagagagagaaaggggaaagggaaaaugauguaauuauauuuugacuucaaauuuuuuaagaaugucuucaugcaaaaaaaaaaaaaaaaaaaaaaaacaaacaaccaaaccacaacaacaaaaagaauaaaaagaaccacaugucugaugucuaacaccaaaucaugaaaggguuuaugagauucaccccaguuccuccuuccccucccauagcuccuggcucaccuaaccaggaccagcuucagaccugaaaaaaaacucaaaaggagcugugacacucaccccaucccaggcaccugacaaucaaagacacaguuugccagaccucgugcugcacaaggccuacacugucucuccaggcuauacguauagcccaaagcuaggccaaagagaaccuuccaagguauggugucuucaugugcccgacaaacccagcccuugggcgccucaccagccccucagcaccugccuuccuggaugaaaugcaaguggacucaaauccaaacuucuggacucuacagcuugucuaccucaguuuccucuucuguuaaaaggcauaaacucugaggagaaaauacacagaccaauuucuuccguaaaucugacaagagccagauaguagauuuacuuccuauuuacuaugaaacuuaaccuguccucugacccugaaauuguagaaaccugauauagcagucuccuucuucacuuuugcaggaugccuaagaacuuccaacagccaucauuguacuacauuugcuuuaauggcaagaagcuccaggcaguccaucgcuuacugaauggagucuccaagucuuugugaaauccuuuccuuugguuaggauugcuagugcuauacauucucuccauguagguuggauacaaccauccuccaaaaaucuuacuagcacccggguccucaggcagccaaccccaacucucaggauugccucugaggcucauaaguccuagcagcuacuggguaccagccuacaugcucuauauggcacaucuccacaguaguuucaccacuaggaguuaaauacagggauaguguguuuaagucggucacuccagcaaagagggaccaagggauauacuaacucugggaaaaagaccuuaggaacacugggaccaacauucuaggcuuauuuacaaaaccauguugacccaagcaguggugaaacaugccuuuaaauuccagcacucaggaagcagagauagguggaucugauuucuaauacagccuggucuacagagugaguuccaagacauccaggcuauacagagaaaccccaucucuaagaaaaggaaaggaaaggggaaaggggaaagggaaaaggaaagaaaagaaacaaacaacaacaaaaaccaauguugaacuagaucucagucaccaaguaguggcagccauugaagucuaaauuggucaaugaaacuuaaaacagugagaggacucgaguaaaaguaccuacugacuggaguucaaucuucaggacccacacaguggaaggagagaacugacucuuacaaguuguccucugguaucuaucucucccuuucucccuuucucucucucucucucacgcacacacauacacacacauacacacaccauagcaaguguguacauauacauacacauacuauuaaaaagaaaaacaaggggcuggagagaugguuaagagcacugucugcucuuccagagguccugaguucaauuccuagcaaucacaugguggcucacauccaucuauaaugggaucugaugcccucuucuaguacgcagauguacaugcagauaaagcacucauacauaauauaaauuaaucuaaaaaaaaacaccuuaaaauucagcuccuuuguaguacacacuuguaauccuaauauuagagguacagagacaggaggacuuugaguccaaagccaaccugagcuauacaagggagaagcccaucucaaaaacauaagagcuaggggauauugcucaguagucaagacuggggggauuugcuuugcuggggggaugggguggcaggaggaaucagcuucuccaucagacuauauauauuuucaauagccaggcacggcuaguggcuaguggcuccauucaguagauucacaugagaaacauuuauaucacugaaaugucaauggaagcaucccagcugagcagacaccagggaccaccuaccauaucaucaccccacaacugccccacacucacaaaugauucgagcagaggccucuggcucuuugccagccuucuuggcaauccuucugcuugaucugcgacugccauuuucuuguuuggccaccaaauuauacuucgaggcuaguggcacuugggaauccugggaaaucaggcuucgccgcacugaccgaauauucccaagagggcucuuggcuguugugggcaagauguuauucagcaggauaggagaaagcacccgcucuugccauggugagucuguagagccaggagaguccugcagcccccaggaggcccgagcaaucuugagcuuggaaacagaacguccuuccccaaccccucgguucuuggggcucugagggguagccuugagggaguucacugugacagaguccagcuuuccagccucugauuucuuggguguuaguuccuccucugaugucagggugccuugggaaacuggagauggaggaaggcuaccuuugagcuuagugaguuguaguucugcacucagucguucacuagugcuuaucuccaccacugcuuucuuggucagcacugugggagacccagcaguggaagaggaagaagcugaugccacagacgcugccgcugcugcugccgcugcugcagcuguggcccggguuauccgcugcaacacagggaagccauucuccucaacaauaguaacgggcuugcugcggaggugccggguacccaccugacugcuccgagacuuucugcgggauaaccuguuagggcaacaggacagagacugagacaacccaaagcaagaggcgcccuaaaauaauucuagaguacaucagucuccuuaguagccuccagcuccaacgaugaacgagcagaagguccagagcagccuaccacuucuagccaugagaccccaguuguuccucucugagccugucuccccaacuaucuguggacaguugagaguuaagugaacucugcaagugacagugaguuccuuuacucacagaacugcugggaagacuaaauucacaccaccuucuuaacuguuguuacacugugcuaagcacuuucugcaaacuucacucaugcucagucuacaggacugagauaauggcccugggaggcaggcaccauucacucagcuuggaagaugagaaaauggagaugcggauuucaucccaaggacacacagcuguugagccagcugugguugauguuauguaccagggcugccugauuagaaugacuagcaucuuuaucugagugcugcagucaccaccauuccugcagagaauaauaacaaauccaauaacagagguaagaaccagcaaccugggccacaacucuggugccucuccccucuuccaaaccccuaacucccugccuccacccgcagcaccaaugcacagaaaucuacaccuguacucucaucuggguuaacaguucauuuuacccauggcaucucaacugucagagucagcgugggccacaaaucacuauugccuccagcugcugcuccuaucagcacauugaggagcuuccaaggcuccagacauccuccagcacagccucccaguccuuuccuaccuuuuccucacgggaucucuguuuucauccugaauguuagacacccgccucuucuuccgacgguuuuucugagaaggaguuuugggcaucagcucuggcucauugcugaauucucuguaaguacaaggagggugaacaugaggcucccugggaacuacugggcugccccuucucuuauuagacuacauuccaccccauucucggcaaugacaagucaggcuagagaaaagcucuccaaagcucugugaaaucagcagcugggcccucagagaacuuccucgugaacuuaaagcagggaaguaaguuccaagacaagacaccacaggccauacacucagacacagcuuaccacagugagccaggaaaaagacucagucuccucuucuucuggucacugcaccagguuggccccagcacaugaggcacuuaggaaggaacccugaccuauggagacacccaccccagcaugccccugccuuuaccugauaaacaugcgcucagccuccuccucaaucuccuugagccacaugaaguccuuguuguccacauugcagacaaaguccaggaguuucuggucacauagauccagaaggcaaauaggcccuggggcugugguccccaugguggcacugucuggugaaggcagagacaaaaagcauaagaacucagggcugguaaccaggaccuucuccaaggaaagucugccagauccacaaucacacagaauacccuguaccuaaauccaugcaucucuuaggacagagccacuuguacagcuccaaacgccaacccaauggucucaccuucacaaaaagaaaugacguuacaguaaucccgaucucuugacacccucucaacccaauacaaacacagaguaugacuguccuuacaggcccacccuuccuaaacaauucugauauaaacuuuacaaaccuucuuucaaggacuucauaugaccaugcacuaccucccugaaucaaggagaaacaccaugccgucauccucucucucuuuacccaaguacagacccguuuaccuucuugugggcucuccucccacuccucauagaugggaacuaagacauagccauccuguguugaccccagacacuaggucaucaagacaccaaguccaacugccucuuuaagaugacaguggaugacgagcaggacaacucagcagauuuacggcacuugccaccacaccuaaucaccggaguucaaucugagacccacaugguagggaagaaaugacuccuucaaguuguccucagaccucuacacaacccaugccacacuacccauuuguauaacacuuuccucccagaaugaaccauuucaucuacagggaagcuccuuaaacaggaaagucaacaacucaaaaaagcuucaggaagucccugaaguucacuaggccccucccagccagagucagcaaauaaaaacugagaguccgggguggggcggaaaaaaaaaaaaaaaaaaaaacugagagucccucgcagacaagcagagcugagcugcaaagacgacucucaagcccaguugcaaagaagauucucaaacaagcugagcugcaagaagcagaaaccaaccaagcuuuuggacgagguuuagacugacuaugucaaugucacuuagaaaggacacucuagccuguuaaagcuagcugcaggcugugcauuaugcugcaaguuucccaguuuuuaugagcuguuaccaaugcuggggugggccuuagugaugcagcugucuuugagucaguucugcuccuacaaguuaguucugcuccugaaacuuaaugcccuuauacacguagccucuagggucuucccugacguucuucagccugauuuguggggcauacuaccuuugcccuucauccuguaaccccucacugauacuacuguaaguaacaaaaaacauuucacugguucacaaaguuggacuuuggugguggguauccauacuuuggucuacuguggguuccuaucuagggguaaacggaguguguguugcaucuccccagguaaagcuuugucacacaacauguucauauauauauauauauacacacacacacacuauacaaguaaacaaguaaauagacacuagagcugagcauaguucguucuauggucccaaacauuugagaaauucaggaggaucauuucaagguuaugccuagcuacauagcaaguuuaaggccaaccuagacuacaugagacccugucuuuaauuugggggcgggggggggggagucaguagauggaaaugugcuauacauuccacaggaaugcauaagaaaugagggguccagaaccauguucuccaaagagaccucugaaacccucccuaaagccaaaauguccuaugaauggaugagggagagcgaagugagugcgcaugcaaugugcugcuuucaggaagaccuggcugucaauaccaggcaaaagacaaugcagugccaguuuacccacugccuuaaaaagcugggagcuuggauaucugccguacgaccugacuauauaauccuaacaaagguccuacacuaagugggaggauucugauacugucauaucagggcccccgauaagcaguaccccaagugguaaacacaugaaagaucaagaguggguggcagcuaugagcacuaauauaucggaucccaccuuauauaaggacaggaaguucccaccaugacuuacacuuucaaaagcaagaagcaugcauacacacuucagccucucagcuacagaaaaaggucagggaagaaagggcuauauuacugauccucuuggaacauaaugccaucauauacuguggccucuagguucuuccuugaaguucuucagccugauguaugaggcacacuacccuuuugcccuucaaacaaguucuggccucuaggaacucugucuccuguuuuguacagcuucuucacuuagcuuucagcuccuuaaggaggaucagaccuccaauccaagccaagaucucacacacagauuccagcuaugugcacagcaaaugagugauuguuuauguuugccuacugcuggccucuacccacuaaccugcucucugaggguaagccuugugccuuccucagcaacaaaagagucuggcacuuguggaaugaauucauucauccaucaacuaauccuaaagguugucucaccaucacacacugggacacucagugagcaacucaguaggcacauguuagaacaggccaaaacacacccugaccuaacggccaaaggcagcacuaacuggggcaaaaccgaauggauaggggcacugagccuuuaggaaaaagcauuaacugugcagccagcuacucaucagcauggccucuccacugagucucccuaucccccugcaccagaaaacagcccuagccaaguccaaggccucaucaguucaaggccagcaaagagaagagaaaacugcacaaggacuccaaagacuugcagaggagcuauaagaaaguaacaaaugggaaauuuuacaaaaugucugcucaugcuacaaucggagugagcgcuucuuucaccaaguccaauaccacacuucuucuuccauggggaaaugugcuuucuagcaagcccucgcugaaaaguuagaaaaggugacucugaggaaaggaggagguguaacaagaaucagacuccuggguaacuucaccuucaguccacgaaauaaacaaacccuaccaugggagaaggaaggucacuuccucuccacaaauacuauuucugugccauucagcagauuagcaauugccaucuccucugggggugcaggaaaugaacuaagcauuucuccccacacacaccccuccaagcaggaagaucgaucgcuaaaacugcucuuccacucaagaguccuacuccaugccaagaaaccucucaauuccuuuuugccacauacuccaagauacccaugcacauacaaaucuaggucaaagucaccaagaaaaucggagggcggagccuggauuuaaaauguuuuuuaaccacuagccacaggccuccaggacaauaguuucaagcucagaaugacacaaucccaacgcuuggcagcaggaagcuggagggaacugcgccgcugacaagagccuacgcuugcggggaugacaaaauaaguagcagggcggucuccggagcugggucaguuuuuaaaugcugcucagcugggacgaagcugagcagccguugccauaaaaagacucaaguccggguuuacagagcagcccaggcucugcacagguguuaggcccggcgugcggggaagaggacugaccauucucggaucccaggacucaagugcagggccucgaaguucaucuccaagccuagaaccauuggaagugauccccacacccauaagcaacccauaggcgaaagugacuccccuggcccauccugggaagcgaagaggccgggaccaguggccgaacaccgcgacccugcgacucccgacgcccguucucacucacccggcggcgccgcgucuucccggaccacuccuuuuccaguccgcggcuuccgcagauuaagcuucccgccacgccggaccggcuggacucccaguaccgcgagcucgccgcaggcgaggaccuaccgggcgaagagcgcgggcgaaucuacgauuuucaaaauuguggcucaaccaauuccccuuaaguuugucugggcgguuacaaaacucca

SEQ ID NO: 9167 - RNA, 4516 nt, Mus musculus
ucaaucacaaagaaaagaagcuggguaccaaaauucuuuauuugaagaaaugguacaaauuaaagaacuuaagcagauguuuuggugcaacuuauagaaaagaugaaggcagccugacaugcaugcacugccucagugaccaguaaagucacguggcuuuggggaagucagcuuagcucucaucaccgugucccagggugugcuugucaaagagauauucugccaugccagcuucaggggcacccaucuugcguaaguuggucacguggucacccaguucuuuaauggauuucaccuguucacucagauaauacgucucaaugaagucacauaacuaggaaagagaacaugggacaaaguuacuggucagcucucccaaguccugcggcaaaucaucuccuccacucaucccacguuuccgauacucacguggggaucauucuugucaguagccaguuugugcaguuccaguagugacugauucacacucuuuuccaagugcagugcacacuccauugcauucagcccgcucucccagucaucacggucugguuucugaaugaaacaucgggucaagucaucuaccaaucaacccaagccaggaaacaccucacacugagccaucaugcucugggcaaaggauugcccucaauuuccucuaagcuuucaccgcaggaugcucgacaacugccauuugccaacaacacaaggacagaagccucagugcaccaucauuuccugaauaaagucuaaccgcucauuuagggcaccccuaggaucuacuuaccuuuauauccugcaggaagauucggccaccucgcugguucugcagcuucaucaguuucucggcaugcucccucuccucaugagauugguggagaaaguauuuggcaaaguucuucagagccacaucaucucggucaaaauaacaagacugaaaguggaaaggguacauguuacugaucuccacugcaaggcaccgcaauggcuguaugcaaaggcugugagccauccuacucggccuuuuaaaaguucaguaaggaugggaaggcaaaccuugggacuuggcuuuaucaaguguucuacggcucgguauuagugcagagaaaaaaauuuaagccaagcccaaaucuacuugucuaagagguagggugcuagaguauccugcauugggaggccauuuuucuccuccuucaccaaucauguaaaaaguagcuaacacaaggucacaaggcuuccagcucuacaaacaaccacugauuuauaaaauuaaugcaucaugcccuguuaacaauugagggcauugcauuuuagcacaaauauauuaggagaagcuuugauuuucaguuuuaagcacucaguguauucauauuccaggaaugacagccacagaaguuggaccuguuucaaaguccaggccuuccccaaaccuguuuuucagaaacuauuacauggaaaacuuccuuguccagcaauugauagcaggcuuuucccaacaaguauguaccuaccacuuguuaguaagccacacucaugcaaaauaagaaaaauacaguaacaugaugccuuguaaaugcaaggucggggugacacugauaacuacagaaggggagauuccuagcgauaaguuucaaugcaagugaggcucugugauaagcagagagguggaggcggcugcuuugaaggggacaagaguaagcucacaagagauaagccucuuuacaccaggccccaaggcugccacucgacaccaugaccaagcagacccgccauacuccaggaggaacuggagcaggaugcauaaccaaacagagaagcuuguaggccacgugaucggaggggacgagcgugcagaaaaugcaccuaacugcaggguugauuggccaggcugacagucguacugcccuaaggcuucaaaaaaaagugguguaaugacaugccugaucuaugcaggagccacaaggugcuaugugcucagacuugccacggcagggcugccugccuuaggaaagaaccccgaacaaacuccauuuuccagaagggcgcuggaaggcggggaagcccgcagcaggccacgccccgacccacccuccgccggcuccccaaguggcccugaggaggccgcacucaccauagacagauagacguaggaggcauacaacuccagguugaucuggcgguugauggcagccuccgcguccuggugguaguucuggcgcacuugcgagggagacgcgguggucaugguggcggcggggcgaggcgcgguggcgacgcuggagcggcggaacgacgaaguugcaaagggcucaggcucgaagcggccggcgggggucggaggggucgagcaccggguuccguucaagcacuguugaagcaggaaaccgcggcgacucugggcgagaacgucuggcgcaggaggggacagcgggccgcacuuauagcgggauccugcgucaggcgagcgcuggccaaucagcgcagcgggccgcgccgccccgccucuuccugugggcguguugcccaaacccgcagggcgcgggcggggaggagccugugugagugugaggcgacgcaaggggcucugagcuucugcaagagcggugccuggcaacaagcgcgcuguuucuguggcccggggcgggcguaguuggaucuagccguacugcagaggcaucugggucccagaugggcacagaggguaccgaugaggaugauuuucaauucucacaggauaucccuaaacucuaggcaaagugcguguuguuagucgugacauacaccagacagcgacuucgucuuacaaauaggaaaauggaagcguggcgcuguaaauggcgaacgacauauaaguuggacugggaaagagcggcuuucccuccuucagaaucuguggagagaagcucagaggaggaguaggggaacuauuggcgaggagguuagggucuacccuguucuucugacucaagcaaccccggcuuuuugcuaaggcaaacauggcucugagaacaguugaaaaaacaaaggcuaagaaggcgcauuucuccuuagagcaggacaacagccgucugucuauagggcaauccuggggccaaaccauuuagguuucugagaaagccccuggugaugcuugaaauuaagagacgucucuggauuagaaaaguaaagaagugaccuacgugugucuguuucaaaauggucuccuuuaucuuucucaguaaccuuuggguuuguccuuggagugaaguugaugcuugcagaauggcaggugacaggugcaggaaacugcagagggacaagccaacugugucuaucuuguagcuguggcccagcuucaaaaugggugcgaauucuuggauagcaagcagaacuagagauuagccacugcgucuugcuaggcccugccauccacauccacuugugcucagccuugucuagucuuuaacacagguggagaaccagcagaugcuguucauauucucaaaacuggaaguuggacuucgauuuuguuguuauuguuuugaagcaagauugacaaaguuacuggaucaguaacccagacuggccagggacucucuguguaagccaggcugguucgucagagagcugggauuauaacccucuuccccccuuuuaagguacgucuacugaaauacauuacuaguacuuagucuuuuaaaacuacacguuauauauguucuuuucaggaaagauuucagugguaaucuagcugcaggaugcuucuggauaaauauccuggagucagacuucaggacgauggcccuaggagacugaugcugagcuaaaguugaugaacaaauucccuuuggaaaguggaggagggagguggggaaaggaguucuaaguagagggaauagcaaaugggcaggcaugggaaugcuucccuuguucaaggaaccuuaaggaaaguguguuuguuggcccgaaaaacgaagugcauguuggggagagcuggaaagaacauagucagacuggcgagccauaaaaagucauuaaacuuuacccuguagguaauauggauauaucauauccauuugauuuuaggaacauuacuguaaaucaauacaaaacugguaggaguccagccuagucauugucacauguagaaugcaugcaauuuuuuucuaaggguaaccaccaucagaaaaauaugauggaagaccagcaagagggugaugguagugagcaaauauuuucacuuaccuuagcagcagagacucaaguagcaaguaauaagaucaccaauaccacgaaacaaagccaagcaaguauuggggaaaggaggugcuaucuuccugaagggucggucaucuuccauacuacaaaugucagcucuaacccuguaacucaacagagucagagaugugaaaauacagugucucuuuggcaggucgugauucugagguucauauggagccaguggacuagcuuguaaacccugaagaaaacaaaggucgggagggaagguuggcuggagauagcuaucauaucauca

SEQ ID NO: 9168 - RNA, 630 nt, Mus musculus
ugugaggcgacgcaaggggcucugagcuucugcaagagcggugccuggcaacaagcgcgcuguuucuguggcccggggcgggcguaguuggaucuagccguacugcagaggcaucugggucccagaugggcacagaggguaccgaugaggaugauuuucaauucucacaggauaucccuaaacucuaggcaaagugcguguuguuagucgugacauacaccagacagcgacuucgucuuacaaauaggaaaauggaagcguggcgcuguaaauggcgaacgacauauaaguuggacugggaaagagcggcuuucccuccuucagaaucuguggagagaagcucagaggaggaguaggggaacuauuggcgaggagguuagggucuacccuguucuucugacucaagcaaccccggcuuuuugcuaaggcaaacauggcucugagaacaguugaaaaaacaaaggcuaagaaggcgcauuucuccuuagagcaggacaacagccgucugucuauagggcaauccuggggccaaaccauuuagguuucugagaaagccccuggugaugcuugaaauuaagagacgucucuggauuagaaaaguaaagaagugaccuacgugugucuguuuca

SEQ ID NO: 9169 - RNA, 16464 nt, Mus musculus
aggcuguaauguucuggguccagaaccuucacccaucagcccuaugugcucugcuugcucccugacaugacucucuaccagagggcuagagagcaugggcucugcuaccaucaaagucuucucugcacacccuucauuccucagaccucccuucaaacccuacagaaacccuaacagguaagccucaggccccagguaacccuccuccagggcagaggucaugguucgugguagaaagggcccaggacccaaacuuagaagacuuuaggucccggguccuaguccugguucauugguagugauguggccuuggccaaaaggucugccuugagcaccagugucaccugaguguuuuacacucaacagucccucggcaaugccucagugacuugccgugggcuguucuuaugugcuuacaucuucucggcucagugagcuucuacuccugcuucaaacaccaacuccagagcucccacucuguaggcuucccuggccucucagacacucucacucccauucucugcuggagguuuuaaauauuuuuuuuuagagucucucaacucuugucuucuuagaggcaggaguuagaacagauucuacccugguaucagagauguuuuguugaauaacuucuugugggauggaaagggagaguggucuuggcugcgcugggcacucuccuuguaggagguuauucugggguccuguauccagguaugucuugggcuuuacuguauaccugaggccugucugguugacuggagacacauuuguguuugaggcccgugggacaccaugucuuauguuugaaugugcuuagaguugugugggucuaggagcagauuguucacagugucucuggagacaucuugagacuggaagaagcagagagcagcacuagcaagugaagaacugguuaacggugaagaacugggcuucacagaaaaccaaagaaguucuccagcacuucccagcucuucuaaaauacuauguagcuacugguaauggucaaggagauaacggcgacuuccaaagacaacuuugaugaucacugacaccugaacaacuggacuaggcuucccuggcaagaacuaagucaauggugaccucuagugaccaacauaagggaugcaggaguccauuaaggcaguguuuaaggcaguguuuacagguguuuuguuuugaacuacucugcuagaaacauauucaacuuuaauuaaauauauauuuauuggacugggauuuaucucagugggaggaguucuugccuggugugcaugaaacccugcacuggauccccagcacuuaucuguuggauaugguggcucacaucuguaaucucagcucucaggaaguacagagagaaguguuagaauuucaugguccugggcuacauagaaaguucaaagcuauccugagcuacaugagaacacaccucaauguagacucugugugugugugugugugugugugugugugugugugugugagagagagagagagagagagagagagagagagagagagagaacaccuauuagauagcaagcucucuugugaaggucaguauguauugaagaaaagaggagaaacagguaggagcccacagagauucucgguccagcuguacauuacaauggaaaacccgcaccugggcaaguugggucugccccugcccaguggggcgcaggcagcacugggucugccccugcccaguggggcgcaggcagcacugggucugccccugcccaguggggcgcaggcagcauuggguuugacuuugcagauccuccccaggccugccgugucuaucacucucacucucaucuugcaguaagugagccagcacuuauucucacccucuuuucagaugaaaagacauucacaacuguccugucccuucucuguccaauuaaggacagggacagaguggcagggagggguggguacuuuucauccuccaagauugcccccaaucucagcagacucucaggauaacaccagcuuuauuguucacuaugauuagaaacguagucaaggucauggugaaacaauccccccucccuucugaacagaguuaaacaggcaaaaaccugugugucagaaucaccugcaagcucaguuuccuuagggagugucugaaggggugugggagcgggagaggaaguagagaguaggaggguggauucacuuuaaggcucaggaucauaauguaaauugggacucccagaagcgugguucccaagaccacccaaaccacagacgccuacagcacuugauaaaaacgcaacguuuccaaggacacagcaucaggcuccuaaggucuggagaagcugcguauuugguaacugucuuggcaacugucucagucagugaagacuugcuguccaugcucuucauguacaguggcuuguuggcaaacucucaucuuagccuggugcucagaagaaccuacagaaaggacuggcacacuaagguugccugagcugcugagaugccacccagcucccucuggaugcuugggcaugugucuuuguuuuucucaggcugucugggauuaggccguuuaaauagcaucaagccccguugccuuccugcuccccuuuucuuuuucugacuuugaaguaccuacuaguaggcccugccaacuaaacaagccaccacaaccuaugaugucaccagcggccaaucagagcuucucaccaauauaugcauugauguuacuuuuaacugugcugacauuccagagcaacacauccuuuucagacgaggacgcuguggcucagucacagcuagcacacaggucgcuagaagccaguggcaugugucaauuguuccagagcgguccccagagaccuggacaaagucuccuucuuccccugagcucuugauaccuuagauggagcucaaucuugccccagaucuucucugaaagacuucaagggucaggacgcaguggcggcgacacagauuuauuuauuuauuuauuuauuuauuuauuuauuuauuuauuuauuuauuuaucgagacaggguuucucuguguagcccuggcuguccuggaacucacuuuguagaccaggcuggccuugaacucagaaauucaccugccucugccucccaagcgcuaggauuaaggacgugcggcaccaccaccuggcacagauuucuugaucuaaacuuagagccauggaagaggggcuauggcaccuaauuccagccuaauaagucaacacuccccaggaaagaauuagaggaacgcuggccaggcugugcuggcugcugauuuugagcagaugacaggaggggcugagacaauggcuucuuuguagaaccuuuugcuuagaaagucaggugauaacucagcacuaucuaggugggcagugccagccuccaaguaugggcaaggguaccugccccagggucucagaaagucccaucaacauaguggccagagcuuuuaugggguuaccugaacugcuggaacccugugugagcaggggcugccccagguggacagggccggggcuuugggggcuuuuaggaguggucaccugugcuuauguaugcaguugugaugggcacacaucgggagcacaugugggagaugugggcucuguaugucugugcaaagaccccgagguaggaaugaacuuugugugcaggcacagagacaacagcugguuugugguggcacuggaauggugggaauggguuaguugaucacugguuuaauccguuuuuauugagcaacuaugcugagaacacacuaagagcuuuuggggggagaagagaacaaaggguaagcaggagugcccgguggcacacggauucaaguagaaacaaugcaccauguagaaggaucaagcacacggggaagaugcugcuggugacaacugaggcaugacuuccaguaggauggcuggggaccuuuuuccuaggagaugaccuaauguggaggggggccauggacugaccucaggaaaagcauccaucaccccccacccgcccccagguggguggauagccuuggaggucaccauucaguaacuaucagaagggcauucccucuugccaggcugggcgggggaggggaugggcacauggcggugagcacagcuugccuaaaucacggagcuacucacuccaguacgauugaggaaaccgagaaaauggguugggagcucaugcugccuggcucugaagcccugagcucugugugacuguugcuacugcccuugcagcugccuuuugccaucacacaaaaucaagaauguguggcaauucacagaccugccuucugugucucaggcuagaaaauagaggcccaggguaggguaggacuaaacucaugcaaguccaagaucagaaccuagucuuugacuccuauccauucccacaucacucugccugcucaccaggacccaagcccaccuacugcugcccagugccaagccaugacuaucaccuacacaaacaaaguagccaaugcccgccucgguucguucucgucccuccuccugugcuggcgaggcagcaucuacaagcugcuguauggagaauuccuugucuucauauuccucuacuauuccauccguggacucuacagguaagagggucgggagcucaugggggaggggccuccaagcauguaaguggaguggagauaagagugagggaggagcacggagcugagcaggagagggucugauguuccagcucccuuauaagacugagcugaacuccuggccaggccuggucauuggagaggaggcuagggagaaaaacaaaagaccuggagcuugucuugcagcucagagaaauagcauuugccuggcaugugugucauccccaggucaauccccaauacacacacaccauacacacacacaccacacaaacacacacacacacauacacaccacauacaccacacacacacaccacacacacacacacacacacaccccacacacacacaaacacacacacaccacacacacacacacauacaccacacacacacacauacacacacaccacacacacacaccaccacauacaccacacacacacacacacacaccacauacaccacacacacacacaccacacacacacacacacaccacauacaccacacacacacacaccacauacaccacacacacacacacacacacaccacacacacacacacacacacacaccacacacacacaccacacacacacaccacauacaccacacacacacucacaccauacacacacacacacacacaccacauacaccacacacacacacacacacacacacacacacacacacaaaucagacugggaagauacuuuaauccaggccagaggagacucuggaacucuuucucuguaacccagggagggauguggaccucuggccugagcaaguccaacugggcugaucucguuuuauuuaggcacucagacacccacaaugcaguuucauauguuuauuucaguaaaaauguauuuauaaagaauaaaaugucagauggguaugaucguggacuaucugauaacauuuuaagugaaaaucacuggcugaaaaaaaagaaaucacggagcugggcgugguggcgcacgccuuuaaucccagcacuggggaggcagaggaaggcggauuuaugaguuugaggccagccugaucuacaaagugaguuccaggauagccagggcuauacagagaaacccgucucgaaaaaacaaacaaacaaacaaacaaaaacacaaaaaaaaacccacgggcuucugagaugguucaguucuguggaggcaccugcaugugggcuggacaaucugaguuuaaucuccaggaucuacaaauuacaagagaacaucaauucccacaaguuguccucuuaucuccacacaugugccauguauuugcacacccauguuuuuuucucucugucucugucucucugucucucucuuucugucuuugucucucucucucucucucucacucacucacucacacacacacacacacacacacacacacacgcauacucaagaaauagauacauaaauaaaaguuuacaaaacaaucauaccuacuaugcauuaaaaauauuaaauaucuacaauucuggaguauguucuaauaauagcacacugguaucuggcacuuuaaaaauuagaauuuaugccgggcagcaguggcgcaggccuuuaaucccugcacuugggaggcagaggcagguggauuucugaguuccaggacagccaggacuacacagagaaacccuaucucgaaaaacauaaacaaacaaacaaaaaaacccacaaaaaauuuagaacuuaauuaauuacauugucuguuuuuagauuuuuaauuuuuauuuuacauguaugaguguuuucccugcguuuaugucuguguacccuguaugugccuggugccugugaaggucagaaggaggcacuggguccucuagaacuggaguuauacacggccugugaugucacauggguucugggaacugaacucuuugccagagugacaaguacucuuaaccagggagccauuuccccagccccaauuaaguaauucuuggggacaagucuugguaaguagcccugccuguccuagaacucccuaugcagacaaagcuggccucaaacuugcagugaggugcucuucuugucuucugccucccaagugcuaggaucacaggcaggagccacuaugccaagucaggacuuuauuuuauuuuuaagacaagaucuuucuauguagucuugccuguccuggaacucucuguauagaucagucuuaccucaaacucacagagaacugccugccucugucccucugucccucugucccucugucccucugccccucugucccucugucccucugccccuuugccccucuguuucagccucugugauuaaugccuggcuagagguuauuuuuuaagaacauguuugcauaaaaauuaaacagcugauuaaacacuugagagauuucucaucugugcccauuccagccucugcuuuaagugaagcacaaaugcacgcuggcauguuuguugcugcagucagugagcuugccuugucacaccacugucacuagaacgucauaguugccaccaggguucauucaugguguccuacacccuguggguuuguacagaugcaucuuacaugauauguaguacuauuaaaauaccaucaagagccacuccauggcccuaaaacucgaugcucagccuagccaucccucucggugugugugugugugugugugugugugugugugugugugugugugugugagagagagagagagagagagagagagagagagagagacugugccuggguucauucccacaugugguguagagacugaaccuaugaacuuacaugugauaggcaagcacuauuccacuaagcuacaaagcccucuaccauauaaauaaauaaauuuauauacaaauaaauauauaacaaauuauacauaugugugcauauauauauauauauauauauagagagagagagagagagagagagagagagagaaccaagcacuuguuugguggagcaccccuuuaguccuaggacucaggaggcagagguaggcagaucucucugaguuuacaaagugaauuccaggauagccagggcuguuauacagaaaaauccugucucaagaaacuaaaucaaaucaccaaaacacucuuuguuucuaccugcuuuuauuuauuuguuaagauuuauuuuuauguguaugagugcuuugccuguauguauguauguauguauguauguacguauguguacuuguguguauugcucaaggaggccagaaggggauaucagacacacacgguccagaacugaacuuaauuugguucuaagugccaugugggugcuaggaaacucaaucugggucuuccacaagaacaacaagugcuccaaaccacugucccuuggcuuguuuaaaagugaagaacuggguauguaucuuaguggugaaguguuuuuccaacaugagcaacagcuggguuccauucccaguguggcaguggcaacaauagaccgauaaacacacacacacacacacacacacacacacacacacacacacgcuagaagugacccguuccaagaaccuaucucagucagagagugacccugggccagaccagugaaaggguaaacacccagaugcccaguucauccuaccuccacccuccccagucggaaguagggacacauucuuagccauuuccucucaaugccucacccacgccagaaugguucucucgagugaucagcagcuguuguuugagaagcuggcucuguacugcgacagcuacauucagcucaucccuauauccuucguucugggugagcgcccccuugcggcuguucgggguccgguggccucucccuagcuccuguuacacaaugggcggaccuccaccaggggcggagaguggggugaggggggccaguggccuuaagggcuggcccacacacaucaggaagacggagaaagcaaggguucaccgggcgcuagucucuggccacagccuggccccuccccgcuuguaccuccuccuuccuccuccccagguuucuauguuacauugguggugagccgcugguggagccaguacgagaacuugccguggcccgaccgccucaugauccaggugucuagcuucguggagggcaaggaugaggaaggccguuugcugcggcgcacgcucauccgcuacgccauccugggccaagugcucauccugcgcagcaucagcaccucggucuacaagcgcuuucccacucuucaccaccuggugcuagcagguuggcaguaucuggagugggugggcccgcagggccaagccuaaccggagacggggccugagacuugacaaggugcuggguggagccagaguccccugggcuugaagagggugaaguggggcagggcccguggggucagacuggggacagaauugggcaggucagaaucaggugcucagaguagggcaaggccagaguaaaccaaaaagggagggauuugagaaagggucaagcacccuucagggauaagggaagauguguggguuugggaacugaugggucugaucuccguuuuccuggcuggauggcuugacacgcgucccuagcuuccccuugauuuggccagggccugacucuggcuaauaacaaagccccccucuccucccaccuccugccccaugggauccagaagagcacccaacugggacucaauaauuuugugcguugaagcaaacaugguaaaagagcccuaggggacugggcuggcuggguuuccuggugcagcccacuucuucuuuagaguuaccuguugccuuguccacucugcccggcagguuuuaugacccauggggaacauaagcaguugcagaaguugggccuaccacacaacacauucugggugcccugggugugguuugccaacuugucaaugaaggccuaucuuggaggucgaauccgggacaccguccugcuccagagccugaugaaugugagcccacacaugggaugcagugggaaggguuguggcuuccuuuaaagagaaggcuggagggucuucccacacugcccguccugguaguauaugauauuucaaacaagauucuacagcccacgguggcuccucuccaaaacucccuacugccuccucucugagugagccuaugauguccuggcuccuuuuuguuagaugaagccacugagacacaggucuagggagcugcauauggccacacagccaaagcugcuccauuagugccauugcauuguaucuggggaagagcagugggaggguucugcggucggcaccucaucccccuuucccgcccaucaggagguguguacuuugcguacucaguguggacagcuguaugccuacgacuggauaaguaucccauugguguacacacagguaagaacugugggaaacugcagcuguaaagaugcagaaagcacucuucccuagagacugaauacaaucucacaggccuggacuuggaagauucugugcuccugccugguccagccagcagggggagugcuaucgucuuggucuuaaaggggagcuggcgauggagggguagagcucauuggguggugcuugccaugcaugcaugauucccuggguuugaucuucgccauugcaugaaacuggucauggugccacacaccuuuacuucuaccccccuggaucuaguggccugaguguuguguuuuagaaaaagauaaggagagaaggaauauguucuauggauguguagucaggugugggggaagggggugccuccaugggcccaugcugaggcaucccuuccccaugagggaccagccacacaacgaugguauaguauagaauagaguuauucagggcauggggaggggaguuaagaggguaggagagagagagagagagagagagagagagagagagagagagaggaagaagaggaggagggaggaaggccagcuaugaguacucagagagagaggggaaagggggauggggagagaggggaaggggcaauaggacagagugggagcaagaagacaagagaacaauagagagaggagggggcaagcagccccuuuuauagugagucagguacaacuggcuguugccagguaacuuugggguagagcuuagacaaaaugcuaacacagacaaaggaucagagguucacugucauccuugguuauauagugaguuucauaccagccugggcuacaugagaccuugucucaaaaaguaaaaguaaacaaacaaaauacacacacacacacacacacacacacacacaaagaaggguaaacagagacccagucacaaaaguguggaggucagaacaaggcuguagacacaaaagcuuucgaccauggucccugcuuagcccuuucugcuacacgugccuuuucuccuuccagguggugacaguggcaguauacagcuuuuuccuugcaugcuugaucgggaggcaguuucugaacccaaacaaggacuacccaggccaugagauggaucugguugugccugucuucacaauccugcaauucuuauucuacaugggcuggcugaaggugagacucacugcauacuacccucccccauagcgugggcauggccaaggggucauggccagcagccacuugggagagagacaggcagcugcaaaguaucugguugcguauaucacacaugcaugagcauacauacagaaacuauucuguccccccacacaccacaccacacacacacacacacacacacacacacacacacacgagagagagagagagagagagagacacucuaguuucaauauacccucucccaguucccuuugcuuucuaaagacuccacuaaauuauacuuugaugacugaaauuaucugaggguaccucacuaacuaucaggauguugccuggacccacaaaacagauaucaccucuguggagcuuugcuugaguauuuuagauaucaguguccaggaaacuccccuccuggccacucuaguucagcccagccucagcauuuaucucuaaccucacaaaacaacagauacaugcauauuggaagauagauaggugaacaaaaauuuacaugggugagaucaagguaaugacucugcugugugacauaggaggggacaguuuggucuucagggacaggcgggcucaugagggagaggcagaagaguaguaugugggcaccccauugggaguggcuagggcccaauaccguggccaugaaaacaauuguuaaggaggaagggcaucaugaggggggccaaaaugggaggacccaaggcuuggggcugcaaagcagaguaacaaaguucucagagcgucacuccucuccccaccucuagguggcagaacagcucaucaaccccuucggggaggacgaugaugauuuugagacuaacuggaucauugacagaaaccugcagguauaagggggugugcagagacugugucguauacccuucucaaagagggguccaaagaggggacccagcaguuucucagggagaccacacagugaagugucuuccccuccucuaacgucagcaccuuucucagccagucauucacucacaggauucucaccucgacuuuggagacugcaucaagcaucagugucuuuagugacacgggaggggaaacuggggugcagagggaauuaacggacaguuccugaggcauccaucgggcaggcucaugguccugccugagcuguccagucuauuggcuaccacuucgguccuuggcaaccaggugucccuguuguccguggaugggaugcaccagaacuugccucccauggaacgugacauguacuggaacgaggcagcgccucagccgcccuacacagcugcuucugccaggucucgccggcauuccuucaugggcuccaccuucaacaucagguagacagugccaggggacugggugggaaguuuuuuaaguguaagcaauuuggaacagcucuuauuacuacacugggugcccaguaagggcuagccaguggacugugcucuucacagacauuaauuuuuuccccucccaauaaccuuuguuugcugugucuacucuucagacaauuaaguacagguucauagggacuaauaaaguugcccagcccaaaggcacauaagugacaaaggacacaucugagccagcuaucugguucuagccccacaugcuuccuacuuauuuuugauugguuuucuugagucucacauaguccgggauggcuucaaacucacuaugcuggggagugagaggcaggcacuguugcuuuggcuuugguguuuugcuuuguuugagacaaguccauuacuauguaguucgggcugccuuggaaucccugacuagcccaggcuggccuuaaauucacauccagugcuaggaauacaggugggaaccaucacuaugugcgauacuuuuuuuuuuuuuuaaagacaggcuucuccacauaguccugaauguccuggagcucacuagguagaccaggcuggccuugaacucacagaaauccuccugccucuaccucccuuaaauccugagauuaaaaacaggcuguguuccaccacacccagcuaccuccauacucuccacuacgcuguuagacccuccaguccaaucucuccuguguacagaccagagagacuuuuccagggguagucagcgauugaugaugccaugagaugccaaggcuggcuuucuagcucugaccagagaaaguaaccuuugcguggacauggaauucuaggaagccuggggugcaggaggaacaguauuuguaagggagucccaauaggagagagggccuccugaauagauuguccuacaaagaccuccuuacacccacagcagccgaaauuuccucuguacaaucccauuucauccaaauucccccuagauacaguaggccggaugggccuucccacacaguccucuggcugacagagguaagcaggcucuggagugucuaauguauuuguacacuguacuagaccgcucgcuuucugcucuuuuaugagccaaagaguucauuaagcugaaacaagaaauaggaacauuuuggaagauguuuuugaaccuguuucaucugaacaucacacacacacacacacacacacacacacacacacacacacacacacugaaccuaguguggcacugggugcagguccugcauucagggaaugugcaagcuaguaguggaguaggcuguaacucauggccaaagacugggcagacacagaacagaaguugccuuuggccaagaggugacccccuccuuggccugcaaguagaucuuagagccaggggaguuuuggaugugggcaaggggcccacccugaggaaacuuuuucuuacagauuaaagguccuggggccucaggaagucugcugccaggaagccaaaggccuuuuaguguauguuacuccccaguggguaacauaaguucuuuguuccugcucggccuuauccgaacaggcuucaccaggaguagaaauucccauugcccggagggagauguucaggaagguugccugauaaagauuagacuguggauucagggauuuaguguggguuaaagcaggagugccugagcuugcccuccagaacagauggugucauuugacaccauacacuuguaaccgcagugcuaaagcagacucagagaguugccuggagauggccggccagauaaucuagccuaauuugugagcuucaggccaguaggagacccugccugucccaaagaaaguggaugacuuucugaggacacaaauggagauuguccucuggccuucacacaggcauacacaggugcaucacacaccuacgaacaccaacucuguaauccuagacuggaaaguugaauguuaucagugagcgagaaucuaagguaaauugggccuugauggacucccugggaaguguaggauccaucagaagagguaaagccuugguccugggcagacauuugcuuccuucuuuucuuuguccacuuacucaaucuuacacaucucuuuuccuuccagccuaaagaaagaagacuuagagcuuuggucaaaagaggaggcugacacggauaagaaagagaguggcuauagcagcaccauaggcugcuucuuaggacugcaacccaaaaacuaccaucuucccuugaaagacuuaaagaccaaacuauuguguucuaagaacccccuccucgaaggccaguguaaggaugccaaccagaaaaaccagaaagaugucuggaaauuuaagggucuggacuucuugaaauguguuccaagguuuaagaggagaggcucccauuguggcccacaggcacccagcagccacccuacugagcagucagcacccuccaguucagacacagguauggacacuuaaacacaaaagccuaacacccaugacuucugagaccaagaagaacacuuuguuuucaaggcuuauuuuuauuauuauuuuuuuuauguaugugugacuuugugaguauaugcugcauauacugguacccuguaguuauaaacacuugugagcugccugaugugggugcuggaaaucaaacucaagcccucuggaagagcaggaaguacucuuugacuguuggcacaucucuacagcccuaccaagaacacuguuaaauuguuccuaggugaugggccuuccacagauuaccaagaaaucugucacaugaaaaagaaaacuguggaguuuaacuugaacauuccagagagccccacagaacaucuucaacagcgccguuuggaccagaugucaaccaauauacaggcucuaaugaaggagcaugcagaguccuaucccuacaggucuguccacccaaagagcugcauucccugugccugccauuucaguucugagucuacccaacaaauccccaguucauuacuacugaccugugggggaaacuuguguuccuacacuagcugaggguuaaugccaacuaccuaggaaagaacccugugauagaggccuuuuguucacuccaccuaagggcuugauaugagcaacaaacuucuagcaagugcaauacuaacagaaugcugaaaugaugucucuugggaaguaaugaggugguucuugcagggaugguuggcuagccucuugcagguagccuugagacagaacugagacucuagcuaguguagcucaagggccagccucacuauuuguuagauggcaaaugaacacuugucuuuaccugagcucuucccaccucacuucaggcauuggccacggucuucugggauaccuucuugggucugaggccuugcuuaauacuuccaaaaagcauaacccacaagccuaaugucauuucucuuuuacauuucuugggacaccuuugcccaauuaacaaacauuccacaccucucaccuugaucacacauccugaguguuaacuucccacuuccauauucccaguuucaucuguguccagaacaucuuuuucguaaguggaagggcaacaauuuccagcuugcuucuaguacuagacauuaacauuuacagaccaucccaguguguuuuaaaccugcuuccaccuuuguccucagucaacucaugcuaugaauacucucccacagggaugaagcuggcaccaaaccuguucucuaugagugaugccucacagccuggcccugacuugcaaggaugcccagcagggcacugacccagucaaaggcacacaagcagcgacacccaggaguguguucccacgacagucuagcauguaacucagaaccaagaguacuuaauaguccugccugaaaacaccuguauuuuacgaucuuucccaaacuaaggaguuuaauaaacgugaauauucuuuuaggugu

SEQ ID NO: 9170 - RNA, 19258 nt, Mus musculus
gugacaccaugaauggggagaacugggagguggugacaagcaagccacccauugcagacuggaccauucuuucaucuccugaacggcagaccuccacgcagcaguguccucugcuccuccuccaguggccaaccugggcauccccaauccugcguacagccaggaggagaggccaucugcuccugcagauugcuuuagauggcuuccucgcguggauauugaggguuuacugggggaugagguccauuguuugguggcuguugacagucaccccaagguaguguccucauuucuagcuaccugggaugccugguuaaagaccggugacgucccuaacuacauuucucagccuuucagggcucagacuugggcucauuucgggccccugcgggugugccugggcgcagcggccugcaggacucccgugcgcgcuggguccccaucccccgccuucucaguugagccgagaguccgagaaacugggggggggggggggcagugccccgggggcagugccgggcgugguggccccaggcccucgaggguggggcaagccccuucgcgacaccgcccuccccgggcagccaauagauguggaggcgccgcgccuggauuggagcgagagcgggacuggccagcgcgggggccgggacgaggggcgggcgaggcgagcgcugucagcgcgguuauaagggagggaaaaguucccugcgcggagagccgggcaggcgcacgcucuuacggcggccgcagcggcagggcggggccgguggggcgggcggaggaagaccccugauugccaccucgccucccucagugucucucuuagaccuuggucacguaccgggguccggaggacuuguguacagcggcaaugggcggugucggggagcccggagggggacccgggccgcgggaggggcccgcaccgcugggggcgccccuacccaucuuccgcugggagcagauccgccagcaugaccuaccaggcgacaaguggcuggucaucgagcgccgugucuacgacaucagccgcugggcacagcggcacccaggggguagccgccucaucggccaccacggugcggaggacgccacgguaagcuaacccacagccggcgggguggagccuggcacuagcgguggagagggagacguuguucauaggcuuggcgucucauuccaccugcggaccuuagcauccuuuuugcucuuucugaccuuugaccccuucccuggcuccagaguugagauggagccugagggaaggaggucucuuucuuucacggaggaugggcuguuugggucagucuguggaauaaauagaucucagggaagaaugggcccccagaggugggugugccgugaggggcagauucugccccagguaaguacccucacuguuguacugaggguuucuuuucugcucugagugucacagacuauuuucuggugcuuccaagagccuggggcagggcugggucccuagcgauagggacgugccaucagaaacugggggcugggcagcagagcuugggcagggccuggaggucuguggcuuauccagcacuuguguagacuguucugagggccagugacucaccucugcugggcuggcagcuacacgugggaagacuuugccaggcugggugggccuccacgggaagcacagucaccccagucaccgacuagccccuggggacucuggcuucccauucucaguccgugucuagacaagaagggauggaacuggccugaaggacuaucuggcuagagcccaguggugaagcaauuucccagacccuuccuccuucagucccacuccauggacaaagguugaggccauggugcucugcccucgacuauccaaaauuguagguuagucacauuggguacccggaaggucuuuaagacuggagggaaugauucucuaguggaagaacuugguggcagcagaggagguucucugugucccaggacugucauugucccucuccucccggauucacuccaggcaacugagagggauaagaaugagacaauuccugaaaaucaucaaccugugggccagugugugugugugugugugugugugugugugugugugugagccuuccuucuuucuaccagagcaugaugggcaugaggugccacagccccucccacugagcccuggcaguccugugaggaucguguuguagcguaggacagaaugcugggcaggagaggaggacaacagagagcacugacugcuuuuucuugcucagggccagccaggaggccccuccuacaugggauuucuaacuuuauauuuagcucagugccccgagaccuccaucuaaugguuuugcuccagccaccauuuugauucacagccaguaaggucuguaaagaaaacaucacucuacaucuuguaguaggguucuagcucugccauugaaggcacucagagguaauuccucugaaccuuagcuuugucauuggacggguggggagagcuaggcuauauagcaagccagccaagggcaagaccacaccuucuccaccaugcugcuguguuguagauguuuguucaguagcugcucuuuagacuauauguaugcagacuggagagugcagugggacagucauagcacucccaagccuuuucugggagagcuugucucugacccugccaguaauaggaaaagauugcuauaggccccagacguugggguagaguugcuaaaaauaccugguguacucaggucucagggccgggaggggucuagguucagaaggcccuagccuuugucagugauggacccacaaggaauacuaggaguugaaccaauccagugccccauguggucaagucuagaugccagguaucccaucccagaaucugaagcucagguuaggggugagauguggcugcccacuugcaucagcccagccacccaucagcuguucucauguccaggcaacagaagcuuuccugccaggaaauucccagaguucuugugccaugaagucagcuuguggccauccugggauacagagccugugcccuagggagaguacucugggcccugggccagguuugucuaagagucacaggcaacccugagaugagaagaggcagccagagaggucuagccccugcuggucauaaauaugugagagucacauaccaaccaccuacuaugugcuagauucuaaaucaaugcuugcuauugauacuguuucuuaauccucaggauaccaaccagcgaggcaguuuacuacuguuaucccacuuuacagaugagaaaagagauucaaagaaacagugaaacuugaaacaguggcaggugugggauuugaaugcacagccacacucugccccacguugguuccucaguaaugggacucccugaacccacccaugaauaucuccugugugcuccucacccccugccucugcagaugcagcugugaacaaaacauuuucagggaaggagugugcaacagaugcaucagcuagagccaaggcucggaggugggaccaugccacccauaccuaaggaacagagcauggcugugcuagagagcagccacagggaggggaagucagaaagcagacaugccaagcucaccagauauuuuuguuuuuaggacuuugguuuauucuaaagaaggaggagaucccgggagggcagagcagggaaaccaaaggggucugauguauguuuaaaaggaucucaaaagggcggguuggaacuuaguugguagacugcuugccuaguguucaugaugcccuagguuccaucucuaaugcugcauaaaugugguugugguggcauccacuuguaaccccugcaauuaugagguagacacagaggauggcgagcucaagguugagcccagccugggacacauaggacuuugucuucaaauaaaaggaucguuggggcuagagaaauggcucagagguugggagguuaggugcugcucuuacagaguaucugaguuccguucccagcaccuauggaacuggugggugggucacaaccccuuguaacucaggcuucaggaaagccaccaucucugaccucugugugcacugucauuuaugcggacguauuccccccaacacacacauauucacaugcaaauaaaaucaccuuuuagaagugcaaaggcuuuaagguaagguaaacaaguuaagguaagcaagauggggaccugcccucuccuuggggagaaaguucagaacaaguaacaguguaacuuggcucuaguuacgcuugaauguagucaggguguaaggucugagauaugugaauacuaauagggacacuaguaggggacauuagaauuagcuccguaagcugaggauauggcuaaguaguagaguagcuggcucaaggcccuggguucaaguuuuaacaaaggagcaaaacaacccauugagcccggcauuauggcgcaguaccugggaaguggaagcaggaucaugcagaguugcauagcguccucaguuacacauggauuugaagccauccuggacuaugugagaucccuuaucaaaagcucaaaaugcugcgguuuucucuguguuaccaagggaaggagcuaacuugucuuacacacacacacacacacacaccagugugacagggguaagaaugcuuucauuuggguucacuguaggaaacggugaugggcaccuggguggcugguuaccaugaguaaugaaacccuguucucaacuggugugcuuaugcagaaagggagaaauuucccagaaguccauggugccgauuagguugaagcacugucagcccuaaaagaauccaaaacccagcagauuugagcccccuggcauucaccuucuguggccccuugggaaugaccugagcuagaaguagggguggcuagcaccaccaucagaggcuaugccauaguaauuucagccaacaguuuuuaauuaggcuguguucugagaauuuucgauauacuaauuuacuuaauucuucuaacaaccuugugagguugaguccugucuguuguguagauaaagaguuuggugcagaagauaagcagugucacagcacccuaaaaaaaggccuucagcuccgggcuuaggagggagggugugugucuggaugggaacugagagggaccagaauuaugaaccaagcucugagacuugggaggcaggauggccucaaccacccagaaccaaugcucacacccuguccuugccaaccacacuggcugcuuugaaaguccgacuucagcgaguagucauuuucuggagucugagugggcauuuguuuuguuuuguuuucuucugagacagaaucucauuacgugucucuggcuggccuagaacucaguauauacacugcucuggcuuugaagucauuauauacaccaagcuggucuuaaacgcagaguuuaauugccaucucccuccugaguacugagaugacagguacaagccaccacaccugacucgggucguauuguuuuacaggugucuucugcaggccaaagugcccacucucucccuguggguaggagucaggacugggaccggcaggaauguagugugcagaggugggaaugagggugaccucagaguaucaggcagccucccagcuccuuuccugcaagggaaggcuucccuggcugccuuuggguuucugauaaaagagccagugggaaagccagaguucagugguaaagagaggaccaugugccagaaggccgggucauuuucaggucuuugcugagccagcaacaucucugaggccacggguucuggcuggcagaucaaacauauuccuucccuucaccaggacagcagggaugccaaggggucugggacaggcagcuuccuuugggcuggguuuugcuacauggacuagagccauggguccugguuacagagcuguguccuuucuuccuugucuuugccucgguuuuuccaucuguaaggaggguuacagauaauguuuccucacugggccucuugaaggcaaugcuggggagaggguggcaaggagcaauugacugcagagccuuggcucuuccugucuguccucuaucuggagagcgacagaggcagagauauuuuagaggcguccuuggagacccuaugcccaccucuaguaaagguguggaugggcagcaaguguaagccuagaucaucagggcuccaccaccccucccugcucccccaccuuccuggcuggucuggaauagucucgauucuuuggccagaaaccagaacuuccugccuccucucucgugccugggguagaaggaggcugucucccccaaaccucacccuuccuguuccuuagccugagauuuggcuaugucuugaccaaacacaucgcaguuucacuucuccacucauaccugccagcagcagcagcagcagcagcagcagcaggugcauagcagggcccuggggcacaagggaaagcuggucaguggggcucauguuagcuguuaggcuccuuccaagugccuuccuggccaaaucaguucucccagcagcuauccugugagaccuagguuaacauuuuccaucuuauuaagaagauguggagggaagaggggagcaagccugucuggggcuccuaaauggaaucacaguuucaucucugcaggagggcuggcuccagacuguaccccaccuccccagaccccagucagcugcuacauggagcucauaguaaggcuggggucaggccacaggcgccgguggucuggacuuugagguuuccauauucugaggguguauggguaccacagagagcagauucaaguucaaacuccagcucugucacugcaaacucuuccacuggggacaggugucucaagcaggcucacccaugcucaccugaaaauuaguucacagcccugcccugggagguggggagggcuggcucuugucuacuuacuaucaucugcaccugaaaacuugcuccaagccagguauauguggaaacagagucugcaggggccacugggaacuugggguugcuaugccuuuuugcuuguuuuguuuuauuuuuuucuuagauuaaaaaauuauguguacagguauuuugccugcguauauauguacaucacauguaugccugguacuuacaugugcacaugugugcaggggucagaagaagguguugaauucuuuggaacuguaguuacugauacuugugagccaccacauguaggugcuggaaacucaaccuggauccucugcaaaacaagccauuguucuuaaucacugagucaucucucuagccguauggccugccuuuugacuccagcacuuucuacccacucuuaucugagacuuaaugauuuucaauuucauucauuuugacucuucuaaaauguguguguugggcgcgaucacaaaguuugacacacauaccccuuaaccuuucugagucuucccuucccucacuuuuaguccuugaucuuagaaaggacuaguccagagguucucaacuugugggucgugauccuuuugggggagaaaaauaacccuuucacagggguuacauaaaccaggaaaacagauauuuacauuaugauucauaacagcagcaaaauuacaguuaugaaguagcagugaaaauaauuuuaugguuggggcucaccacaacauaaagguugucccuugcugguacucugaguccagggaccaccuugugggugcuuucugauaacauagucucugugcccacccagucccaaggcccuagccuucuguccaagggccuagggccaccuucuuguccccugaucacccacuauggaaauuucagaccuggucccaagggacucauaccugcccuaucauuuuaguggguugagcugacuggaacacccuugggagagccuggcucugcuuacuucccuacugugcacaccugugcgcaccuguacaggagacuguaucuuucacaugguguucauaugggccaugacccuaggcacauuucuaagagucugaaucuuucuuguuuauguagugggugguucugugugugugagagguuggggagaggagggagggagggagagagagagaaucugucugucugucugucuuuccaugccccaggcuccuugcccagauggggaaguuucaaaucgccaccagcuuuagggaauucuggcacuugauacagcaaggaagaaccuugagaguauuaugcuaugugaaauaggcuaaucacuaagggacagaugcugucugacuccauuuaaguaagguuccuggaacaaggcuagagccagguggaaggagaagaaggaguuuaauggguauagcauuucaccuggggaagaggagacaauucugaagauagauggacacgcaucagcaggaaggucuuguaauguucaguacaccaccuaagagugguaaacugaggugugcuuuacagaugaugaugaugacgacgacgacaccaacaauaauaauaaaaaaaaggcugaggauguagcucaguagcugccucgcacgcacagcuuccuuggcuucaaaccgauagugaugguguacaccuauaaucccagcccucagagacggaugaaucaggagcucagauucauccccugcuacguuauuuauuucaaggccacccuggcuaucugugacccugucuuagaaacaaagauagcaauaaaguuugugcugagcaguccuguuucagaaggguccugaagucaggaaguagaggccacugcaggaggaugaaauaacucaaggucacauggaaaugggcucagcagaaccccaagaccaauccccagugagccugggcccaggcagcuuccugugaaaccccauuuucccaucucucugcccucuuccugugucccugccccuccuucaucuccagaggaaaugagggcuaugcuuuuauaacucucauugcuuggugagccccagggaaccaggcagccugaguuauuuuggaagccacacccuccuagaaccccagcccuugccuugggacagugacccuagaguagacuagauuuagccucuaaauaguauucucccuccaaggacuccucagaaaugucccggcaguaacuauggggguuacagucauuuucagcuucauguuauuuuuaaauuauuuuuauuacuuucuucccccucuguguguguguguguguguguguguguguguguguguuguaugcguguggguauaugagcacccacguguguagaggccagaggaggacauugaacauccuguucuuucaucugucucguugagccauccuccuguuucuguccucccccaacuucugccccagggcugaguuacacacuuacacaguuaugcucagauuucuaucugggugauaaggauuugaacucagguuacaugcuuucccagcaaguguucuuccaauugagccaucuuuucagccuuuuauuuuuaaucgacacuuaauaagagcucuguuccuggggccagugguuucaacacccgucuccaguguacaauggucaggguaacuauuaguuuggugacuacaguggggugacuguaguuagcaaggucauuucuguuucaacuuacacaagcuggcacaagacaauaggaggcugcuguucuuugucagacuucugcaaagguauuuccuuuuagcaucuuggaaggacccuugaucuccuuucccagggccauggggacaaugccauccagucaccugcucagcuuuugaaaucgcaacaguaaaagucagaagagcagcugugaccaauaaaugggcaaggugugauaucauauacaaacaauaaaugguguaaguaagguacaggaacaagccugaaacaggaaggacagggagccuggccaccuucuccuauucagccguucucucucucucucucucucucucucucucucucucucucucucucucucucucugucucucucucucucugucucucucugucugucucucucucucucucucucucuugccugauuccuguauuucuccuuaccccugaccaauuauuauagaaaguuucaggcuucucuguauuuagaggaaaucaugcuaucugcugagaauguaucucagcugguagagugcuuagcuaucacucauggagguucuguguucucuugaguacucaugugaacugggugggugugguggugcaugcuuguaguuccagcacuggggagauugagacaggaggaucaguucaaagucauucucucuugagcuacuuaguggcuuagaggccauccaggacuacaggagaccccguuuccaaagauaaaugucaaaucaaguaagugugacugcuuaaauaccuuccuugcauaaacccaagaccucaauguguacagaccaccacugacccaccccaaguggcucugaggucuccaauggcaagucugcacacacacacacacacacacacacacacacacacacauucugcccacuguuauggugacgagaacugaauaaaguuaacaucugugagccaaaucuuguuuuauauguuguaaaaaggcuauggcacacagaaagcucuucagaagggcuaagccuguucauggauggacccagucuuucuggaguucuuucaggcauauugagaggagaaaccaguauuugaugaagcagacagggcaugguaaaugagugggugguguuaaacaggguccuugggccagggaggacuagagagggcucguagguaaggcucacucuccuggucuuguaucuaugacuagagagggcucguagguaaggcucacucuccuggucuuguaucuaugacuagagagggcucguagguaaggcucacucuccuggucuuguaucuaugacuagagagggcucguagguaaggcucacucuccuugucuuguaucuaugacuagagagggcucguagguaaggcucacucuccuugucuuguaucuaugacugcccaacaucucauugacguucuaucuguucugucuauugacaguccccuccgaccucccguuuuucuuuuuuuaguuuuaaaauuuagauuuauccaacguuuguguguguguguaacacaugcaugcuuagugcccacagaggugagaagagggcauuggauccccugaaacaggaguuacuagugguuacuagugguuacauauggaugcuggggauuuaaccuaggucuucugcaagagcaacagaugcucucugauccacugugucgucucuccagccccuccguggcuucuucacucuguuccuauugguucucccugggugcuacauacgcuguccgcugacugucuguuccccuucaggaugccuuccacgccuuccaccaagaucuccauuuugugcgcaaguuccugaaaccccuguugauuggagagcuagccccagaggaacccagccaggauggagcucagaaugugaggggacaacuggagggcuuggggacauugccuguugacaguagcaucuuguucuguauuacuauuggggggugcaggguggggcugggucuguaucccccuuugaggccacaucaaaagugaauucauagcaauguucuguuuaaguaaggauucuaaaucugacuuagcuaggagaacuugcugugggucuccagugaggucucuuucugcuccagaugcaguggaaacuuccuccugccuccaguucuacaaugaggauauuuuugagucuuaaaaguuuccucuauuggcucugauuuucucugcuuauuacccaccccacaucuuuggggccagggagagacuuagcuacaagcuaguuccccaggccauacauagcauacccugucugguguuauuguuucuccaucuaucacccagcagugggaagugggaugacuuaaggaugcaaugguaaacuucuggggacuacagcagucccugcuuccucaucugcuggacugcuucccugccacaggcccagcugaucgaggacuuccgagccuugcgccaggcagcugaagacaugaagcuguuugaagcugauaccacuuucuuugcacuccugcugggccacauccuggcuauggaguuguuggccuggcuuaucaucuaccucuugggcccuggcuggguguccaguauccuugcugcccugauccuggccaucucucagguaacuaugcagcagaugcggggguccagaacauguggaaacucagggcaguuuucuuaaggaugaaagaauggauugguaaauggaugaaugagaaaaugaaaugccagaggcccuuaagaaacaccagaucuagaacaccacagcccagcccuaugugugacacaacuuguguaggugaagaaaaggaugacccugccuaucaugaaggucaugguuaacacugcuaugacaaaagacagauuagcaagagaaaaacugaaaaauuuaucugaucauagucucgugugacacagaagccuucagauuaaagaacaaaaggucagagugagucaucuauuauuauuucuuuagcauguaugcucuuauaaagcaggaacaaucuguaggaaugggagcagacacagaaggucugugagauggaaacagaaugaaagggucugagccaguggaaacagacuggcucagaauccuggcaaggcugacugcucagagucuuccugaccucuuucugaggccuucuuccuucccaggugugggauggaacacuuuuugaaaugggucugauaagcucuuaucagaugagauagcccuucuucacggucagcgccaagguaaaagggaaaauuagagcagugauuuuaggccuugaggaagaagagcccuugugucuauggccugcuucagguaggguagagaauucuagguucugucauuugccuugggggauccaggggagcaggagacaggacacuaugagaagaacagaaaguuugcuucugaagccauuauucagcgguaugauguuucagagcucugacaucgguaugcaggcacaccgccaaacucaauugcguugguccaguuaaagaggcagcugguuucaguaaagcaucaguaguagguggaucacuaguaguggguugaccucuggugccagaagugacuggcuucugccuccacucuuaaccuaccccucuccccaggcccagugcuggugucugcaacaugaucuaggucaugcuuccaucuucacuaaguccagguggaaccauguggcccagcaguucgugauggggcaguugaaagugaguguggagcggggcgggcaucugugcugggucuguucaagugugcggguaccaaguuggagcccagccuaacucugccccugagcuuccuucuccccacagggcuuuuccgcccacugguggaauuuccgccacuuccagcaccaugccaaacccaacaucuuccacaaagacccagaugugacugucgcaccugucuuccuccugggggagucaucuguggagguaggugggaugggacaugaguuuucucaagagaggccugcagcuaaggggucuuggcagggacuaagaccucaugcuugccccccagcuuaccguaccuucuagcuccaguuccaguccuucccccaccuccuagccaccuggggaugaguggcucaggggcuagaaucuagaguugccuuugaccuuggccucagccagcccccugaucuuggccuggagagcuguucuccccagccgacgccugucuccacaguauggcaagaagaaacgcagauaccugcccuacaaccaccagcaucuauacuucuuccugagugaguaccuacuggcccuuuggggugggaacguggcagggcuuacaccucagccuaugcugccuaccugaaggcucucagccaccugcugcucugguuguccucuuucccacccucccuagagucccucugcccucaagucaggguuguccggaguccuagaguauuuuguaauugccucugcaaacagggacaggguaggcucaagggcaggaauguguaaggcugguuccuuaccuacacaagggacaagggaggugggagauggccaagagccaggcagcaagggacugaauaugaauagggccuugugggagcugugagcucagcucagugugaggugagcacuuauaaccuauggguguuccuccucuucuccacccacaccacuuggguaacccaucccuguucccccaugcccuuguguucccuucuugcaguuggcccuccgcugcucaccuuggugaacuuugaaguugaaaaucuggcguacaugcuggugugcaugcaguggacggugaguagguacugcucaggaccccaggcauguagcuuucugggagagugcuucaggcgagagcacucuccaucccugagggugaaugaguguaugugugugcauugaugugauuuguaugcacuguggaagagcccuccuggcccccccuggguagaaucacuggauugacugacaagcaucugugucccaggcacaggcuacccuaaugcacccuucaaggucacugccacggucaguccuaccuggugauaagguguggaccccuguucuuuuacucagccauaguagcagaagcccauugaggggcagaacccugaagcaaaugaguugaaugagcccagcccuuccuccugccucccagguccccagcccauggaggcuacucaacacugccucuauccuccucgcaggacuugcugugggcugccaguuucuacucccgcuuuuucuuguccuacucucccuucuauggugccacugggacacugcuccucuuuguugcugucagguaugcccagacucagagugacggggaguugggaggucucacacagguggcaggggaccucgaccacagcccuccuuguucagucuguugucccucugcaggauggguggcagcaccaccucuucaggugccugcuguacauaaucaaacacuagcagagcggccagacccuggggcuggcaggucugaggaaacaagcucggcuuggccgcggcucugugggugacccucuugagaaagguuggcaugggcuuagccuaacuaaggacgcuguaguacugaagccuuccucacagggugcuggagagccacugguucguguggaucacgcagaugaaccacauccccaaggagauuggccaugaaaagcaucgggacugggcaagcucucagguaggaacuggagagccuggugggaggauaugcuagccggggagggaccaggcccugcugaggcugccaggugguggggucaagguucuaagccagcgucucucccuugcaccucuccugacccugcagcuggcagccaccugcaauguggaaccuucgcucuucauugacugguucagcgggcaccucaauuuccagauugagcaccagugaguguggccuggagggcuugcugggugagaccaaagccagggcucaggacuccccucugagggaucccuggaagaugaggugaggcaugguucagcucccuacucagaucugccugccuuuccagccucuuccccacgaugccaaggcacaacuaccggaggguggccccccuggucaaggcguucugcgccaagcacggccuacacuacgaggugaagccuuuccucaccgcucugguggauaucaucggguaaggcuguaccugggccccucaggcugcauguacuagucucuucgaaggcuccaugcuuacuccuguacugaucuucuguacgccugcccucagagggggcccuuccuaagaacugacuuccuagagcuuuccugauuagccagugcucuccuuuccccacagcauggaggacuuacucaugcaguuuuacaaauauggcagugagucagacagucugagauguuccuguguccugggagcuggagccuauguucuaguugaaacagaaagcaagcacuguagggcuggggagaggggucaguggguaaagugcuuuccuuguaauugaugaggaccugaguucgaauccccagcacccauguaaaaauccaggaaugguggcaugugccaguacugucaucccaggaccggaaggcagaaauagggauuccugggacuuacuggccagugagcuuuagguugagugagagacaaacacacauaaacacacauugagugggacgagaaggaauguuagugguuagccaaggagcacaugacagagcgugagaaccuuuuuaauaacacaaugagaaugaaaaccuagucuggaggcaggagaggggaugcagagggcagguagagugugguauuguuuauggcauagcagguguaaaguauggcaaaggugauguguaagcagaggcgagaagcagggagacaacuggccacuggguagagggcaccuagcugaagaguauuccagauagaggcccugggacaggagugugcugauuugugggagggccacuaaguggaggagagaccaccuggcuuucaaauguggcaaagaugcccuaaauggacaugcauucugagcaagggugaaagcagaaaugguaaagcuaaagugccuguacuuguccgggcucaguucccagaaguagccuuggaagugggaacagagguuggauacucgaccugcagacaccuauauaguguucuuuuccuggccucaguacuugucuuuggcauccugauggagcagcuucugugucccacauuuuuggguugcagaguccaacagggagaggcaacagggugaacgauggccaggcccacugaggcucacaacuggacuuggccaccugccacucaccuccuuguugcaguccagauuccacucugguuaaugaguaccuggccucacacagcugccugucccgagcagggaggggggcgcgcggggcgggggacucacaagaaugucuucacucuaacacuccuuaugggacacagggggauacuaauaccucccaguugagucucugauccccauccccaccucucaggucccugaagaagucuggcgacaucuggcuggaugcauaccuccaucaaugaaggcagcacccuuauggguggugaagggguaaggguccagacuccagcagucaccgagucacugggcaagauugacagucauccucacccccugcuggggcagccugucugcccgccugguccugcuggcuuuccucaguccucagcauuuucuggucagcaauccuauggccauggcacauguccaacaggaccaggguggagggaacauacuuaaaaugacacggugagcauagcauguuuuccuagagcaagaacuggaaggaaaacuuguuauuuuuauauaaaaagcaacccagacacauggagccaaguguuggacuuucaugaauuuuggagccaaaucugcuucagacuugguggaagggccaucauuguggagcugggauggaauguaaggaguuccucuccacccugggugcucugggucauggaggcaacagcuacucuaccccaugguuuguuccuacacugagcagcaucccggggggaguuauguacucaagagccuaugguuaaggaucacaucugcaggagccucuggauuaugggaugggaaagccuauauaucuauacuggcuuucuacagcccucuaugcaggagagcccaguagugggagcucugcuacacuggguauugcauaacaguugugcugaauaugcagugacucaaguguggccauucugucccuaaguccuuuaaauauaaggacuauuucuugagcaggaacuaaccucucacuuggccucaggaucuucaucuggacaauggguacaguugacaguugacugcacuaucaaccuuugaacagcucaaggcagaaguuuugcuuuaucuugauucucuccccaaaguguuaaggaugcucccuucaagcuaagcacugcaaucugggaaggcaccccuucccuagugcuuuacauccaacucagugcuguaggcaugcuaggcaaguacucuacuacuguccuaaacccaaguuuggugagagaggagaggggacaguggacucugucagccccagcaccgacaccccauggcuccaagcugggcuacagaucuuuaaagaggucucagaagcuuuaggcuguagcaaucccagcagaaaugcuaaacugggcaucuccuguaggagcugaggccucaucaccagcuguggggacuaccccacccucucuccacucccuguggccuccuugccuaggggaguaccagugaagccuccuggauaaagcgagggaaggagaggucccaucgcgucuggguaccucccuugcucuguuccauucagcucucccuucccugggauuagguggauggggcuaagucacgugucugcuaggacuuaaggcugcuugaccucaaggaaggaauucaagcucuuaaauccaaaguaaauccaaagugucgcuuucaacgcgaugagaaauaaaaaggaugcccuagaaaggcuugcgccaaaaggcagaaauguauuuaaaagcuuuaugcguaugaccccaugccucugggcuaaacuguuuuguucucugagacaagcccuuugcuuucucuggacuuuauuuucuuccucagguaagggcugaagaucccuugaaagcuacuucuaagcccuguuauauauacuuguaguccaagguacuuaacagaaggaucacaaguucaaaggcagccaaggcgacuuauuaaaauccuguuugagaugauaauaaauauuuuaagggucuggggauguaacucaguaggaagucuucuagcauguguucgccgagucaagcucuaacacacacacaccacuacuucuugccucaaaagcaaauuucuuauacccagaguguaucacaccaucuuucuguacuuccguucccugcagaaguccccuuuccuauccaaacuuugaugauccuagucccacauagauauggcauucccucagcauacugucugaaagcacuuggucuccacucuggcaaagucagauuucuguuggugucucugacgugcuuagagaugugucuugcucagaggaaaucacccagccugcagcaccauccacggguauccacaugacugacugcagcuuggacuguguuucaugcugccccuagugguagccauggggaaugugcucuuucccuccaaauccagaguuauccaauaaaauacccugcagagacc

SEQ ID NO: 9171 - RNA, 19258 nt, Mus musculus
ggucucugcaggguauuuuauuggauaacucuggauuuggagggaaagagcacauuccccauggcuaccacuaggggcagcaugaaacacaguccaagcugcagucagucauguggauacccguggauggugcugcaggcugggugauuuccucugagcaagacacaucucuaagcacgucagagacaccaacagaaaucugacuuugccagaguggagaccaagugcuuucagacaguaugcugagggaaugccauaucuaugugggacuaggaucaucaaaguuuggauaggaaaggggacuucugcagggaacggaaguacagaaagauggugugauacacucuggguauaagaaauuugcuuuugaggcaagaaguagugguguguguguguuagagcuugacucggcgaacacaugcuagaagacuuccuacugaguuacauccccagacccuuaaaauauuuauuaucaucucaaacaggauuuuaauaagucgccuuggcugccuuugaacuugugauccuucuguuaaguaccuuggacuacaaguauauauaacagggcuuagaaguagcuuucaagggaucuucagcccuuaccugaggaagaaaauaaaguccagagaaagcaaagggcuugucucagagaacaaaacaguuuagcccagaggcauggggucauacgcauaaagcuuuuaaauacauuucugccuuuuggcgcaagccuuucuagggcauccuuuuuauuucucaucgcguugaaagcgacacuuuggauuuacuuuggauuuaagagcuugaauuccuuccuugaggucaagcagccuuaaguccuagcagacacgugacuuagccccauccaccuaaucccagggaagggagagcugaauggaacagagcaagggagguacccagacgcgaugggaccucuccuucccucgcuuuauccaggaggcuucacugguacuccccuaggcaaggaggccacagggaguggagagagggugggguaguccccacagcuggugaugaggccucagcuccuacaggagaugcccaguuuagcauuucugcugggauugcuacagccuaaagcuucugagaccucuuuaaagaucuguagcccagcuuggagccauggggugucggugcuggggcugacagaguccacuguccccucuccucucucaccaaacuuggguuuaggacaguaguagaguacuugccuagcaugccuacagcacugaguuggauguaaagcacuagggaaggggugccuucccagauugcagugcuuagcuugaagggagcauccuuaacacuuuggggagagaaucaagauaaagcaaaacuucugccuugagcuguucaaagguugauagugcagucaacugucaacuguacccauuguccagaugaagauccugaggccaagugagagguuaguuccugcucaagaaauaguccuuauauuuaaaggacuuagggacagaauggccacacuugagucacugcauauucagcacaacuguuaugcaauacccaguguagcagagcucccacuacugggcucuccugcauagagggcuguagaaagccaguauagauauauaggcuuucccaucccauaauccagaggcuccugcagaugugauccuuaaccauaggcucuugaguacauaacuccccccgggaugcugcucaguguaggaacaaaccaugggguagaguagcuguugccuccaugacccagagcacccaggguggagaggaacuccuuacauuccaucccagcuccacaaugauggcccuuccaccaagucugaagcagauuuggcuccaaaauucaugaaaguccaacacuuggcuccaugugucuggguugcuuuuuauauaaaaauaacaaguuuuccuuccaguucuugcucuaggaaaacaugcuaugcucaccgugucauuuuaaguauguucccuccacccugguccuguuggacaugugccauggccauaggauugcugaccagaaaaugcugaggacugaggaaagccagcaggaccaggcgggcagacaggcugccccagcagggggugaggaugacugucaaucuugcccagugacucggugacugcuggagucuggacccuuaccccuucaccacccauaagggugcugccuucauugauggagguaugcauccagccagaugucgccagacuucuucagggaccugagagguggggauggggaucagagacucaacugggagguauuaguaucccccugugucccauaaggaguguuagagugaagacauucuugugagucccccgccccgcgcgccccccucccugcucgggacaggcagcugugugaggccagguacucauuaaccagaguggaaucuggacugcaacaaggaggugaguggcagguggccaaguccaguugugagccucagugggccuggccaucguucacccuguugccucucccuguuggacucugcaacccaaaaaugugggacacagaagcugcuccaucaggaugccaaagacaaguacugaggccaggaaaagaacacuauauaggugucugcaggucgaguauccaaccucuguucccacuuccaaggcuacuucugggaacugagcccggacaaguacaggcacuuuagcuuuaccauuucugcuuucacccuugcucagaaugcauguccauuuagggcaucuuugccacauuugaaagccagguggucucuccuccacuuaguggcccucccacaaaucagcacacuccugucccagggccucuaucuggaauacucuucagcuaggugcccucuacccaguggccaguugucucccugcuucucgccucugcuuacacaucaccuuugccauacuuuacaccugcuaugccauaaacaauaccacacucuaccugcccucugcauccccucuccugccuccagacuagguuuucauucucauuguguuauuaaaaagguucucacgcucugucaugugcuccuuggcuaaccacuaacauuccuucucgucccacucaauguguguuuauguguguuugucucucacucaaccuaaagcucacuggccaguaagucccaggaaucccuauuucugccuuccgguccugggaugacaguacuggcacaugccaccauuccuggauuuuuacaugggugcuggggauucgaacucagguccucaucaauuacaaggaaagcacuuuacccacugaccccucuccccagcccuacagugcuugcuuucuguuucaacuagaacauaggcuccagcucccaggacacaggaacaucucagacugucugacucacugccauauuuguaaaacugcaugaguaaguccuccaugcuguggggaaaggagagcacuggcuaaucaggaaagcucuaggaagucaguucuuaggaagggcccccucugagggcaggcguacagaagaucaguacaggaguaagcauggagccuucgaagagacuaguacaugcagccugaggggcccagguacagccuuacccgaugauauccaccagagcggugaggaaaggcuucaccucguaguguaggccgugcuuggcgcagaacgccuugaccaggggggccacccuccgguaguugugccuuggcaucguggggaagaggcuggaaaggcaggcagaucugaguagggagcugaaccaugccucaccucaucuuccagggaucccucagaggggaguccugagcccuggcuuuggucucacccagcaagcccuccaggccacacucacuggugcucaaucuggaaauugaggugcccgcugaaccagucaaugaagagcgaagguuccacauugcagguggcugccagcugcagggucaggagaggugcaagggagagacgcuggcuuagaaccuugaccccaccaccuggcagccucagcagggccuggucccuccccggcuagcauauccucccaccaggcucuccaguuccuaccugagagcuugcccagucccgaugcuuuucauggccaaucuccuuggggaugugguucaucugcgugauccacacgaaccaguggcucuccagcacccugugaggaaggcuucaguacuacagcguccuuaguuaggcuaagcccaugccaaccuuucucaagagggucacccacagagccgcggccaagccgagcuuguuuccucagaccugccagccccagggucuggccgcucugcuaguguuugauuauguacagcaggcaccugaagagguggugcugccacccauccugcagagggacaacagacugaacaaggagggcuguggucgagguccccugccaccugugugagaccucccaacuccccgucacucugagucugggcauaccugacagcaacaaagaggagcagugucccaguggcaccauagaagggagaguaggacaagaaaaagcgggaguagaaacuggcagcccacagcaaguccugcgaggaggauagaggcaguguugaguagccuccaugggcuggggaccugggaggcaggaggaagggcugggcucauucaacucauuugcuucaggguucugccccucaaugggcuucugcuacuauggcugaguaaaagaacagggguccacaccuuaucaccagguaggacugaccguggcagugaccuugaagggugcauuaggguagccugugccugggacacagaugcuugucagucaauccagugauucuacccagggggggccaggagggcucuuccacagugcauacaaaucacaucaaugcacacacauacacucauucacccucagggauggagagugcucucgccugaagcacucucccagaaagcuacaugccugggguccugagcaguaccuacucaccguccacugcaugcacaccagcauguacgccagauuuucaacuucaaaguucaccaaggugagcagcggagggccaacugcaagaagggaacacaagggcaugggggaacagggauggguuacccaagugguguggguggagaagaggaggaacacccauagguuauaagugcucaccucacacugagcugagcucacagcucccacaaggcccuauucauauucagucccuugcugccuggcucuuggccaucucccaccucccuugucccuuguguagguaaggaaccagccuuacacauuccugcccuugagccuacccugucccuguuugcagaggcaauuacaaaauacucuaggacuccggacaacccugacuugagggcagagggacucuagggagggugggaaagaggacaaccagagcagcagguggcugagagccuucagguaggcagcauaggcugagguguaagcccugccacguucccaccccaaagggccaguagguacucacucaggaagaaguauagaugcuggugguuguagggcagguaucugcguuucuucuugccauacuguggagacaggcgucggcuggggagaacagcucuccaggccaagaucagggggcuggcugaggccaaggucaaaggcaacucuagauucuagccccugagccacucauccccagguggcuaggaggugggggaaggacuggaacuggagcuagaagguacgguaagcuggggggcaagcaugaggucuuagucccugccaagaccccuuagcugcaggccucucuugagaaaacucaugucccaucccaccuaccuccacagaugacucccccaggaggaagacaggugcgacagucacaucugggucuuuguggaagauguuggguuuggcauggugcuggaaguggcggaaauuccaccagugggcggaaaagcccuguggggagaaggaagcucaggggcagaguuaggcugggcuccaacuugguacccgcacacuugaacagacccagcacagaugcccgccccgcuccacacucacuuucaacugccccaucacgaacugcugggccacaugguuccaccuggacuuagugaagauggaagcaugaccuagaucauguugcagacaccagcacugggccuggggagagggguagguuaagaguggaggcagaagccagucacuucuggcaccagaggucaacccacuacuagugauccaccuacuacugaugcuuuacugaaaccagcugccucuuuaacuggaccaacgcaauugaguuuggcggugugccugcauaccgaugucagagcucugaaacaucauaccgcugaauaauggcuucagaagcaaacuuucuguucuucucauaguguccugucuccugcuccccuggaucccccaaggcaaaugacagaaccuagaauucucuacccuaccugaagcaggccauagacacaagggcucuucuuccucaaggccuaaaaucacugcucuaauuuucccuuuuaccuuggcgcugaccgugaagaagggcuaucucaucugauaagagcuuaucagacccauuucaaaaaguguuccaucccacaccugggaaggaagaaggccucagaaagaggucaggaagacucugagcagucagccuugccaggauucugagccagucuguuuccacuggcucagacccuuucauucuguuuccaucucacagaccuucugugucugcucccauuccuacagauuguuccugcuuuauaagagcauacaugcuaaagaaauaauaauagaugacucacucugaccuuuuguucuuuaaucugaaggcuucugugucacacgagacuaugaucagauaaauuuuucaguuuuucucuugcuaaucugucuuuugucauagcaguguuaaccaugaccuucaugauaggcagggucauccuuuucuucaccuacacaaguugugucacacauagggcugggcugugguguucuagaucugguguuucuuaagggccucuggcauuucauuuucucauucauccauuuaccaauccauucuuucauccuuaagaaaacugcccugaguuuccacauguucuggacccccgcaucugcugcauaguuaccugagagauggccaggaucagggcagcaaggauacuggacacccagccagggcccaagagguagaugauaagccaggccaacaacuccauagccaggauguggcccagcaggagugcaaagaaagugguaucagcuucaaacagcuucaugucuucagcugccuggcgcaaggcucggaaguccucgaucagcugggccuguggcagggaagcaguccagcagaugaggaagcagggacugcuguaguccccagaaguuuaccauugcauccuuaagucaucccacuucccacugcugggugauagauggagaaacaauaacaccagacaggguaugcuauguauggccuggggaacuagcuuguagcuaagucucucccuggccccaaagaugugggguggguaauaagcagagaaaaucagagccaauagaggaaacuuuuaagacucaaaaauauccucauuguagaacuggaggcaggaggaaguuuccacugcaucuggagcagaaagagaccucacuggagacccacagcaaguucuccuagcuaagucagauuuagaauccuuacuuaaacagaacauugcuaugaauucacuuuugauguggccucaaagggggauacagacccagccccacccugcaccccccaauaguaauacagaacaagaugcuacugucaacaggcaauguccccaagcccuccaguuguccccucacauucugagcuccauccuggcuggguuccucuggggcuagcucuccaaucaacagggguuucaggaacuugcgcacaaaauggagaucuugguggaaggcguggaaggcauccugaaggggaacagacagucagcggacagcguauguagcacccagggagaaccaauaggaacagagugaagaagccacggaggggcuggagagacgacacaguggaucagagagcaucuguugcucuugcagaagaccuagguuaaauccccagcauccauauguaaccacuaguaaccacuaguaacuccuguuucaggggauccaaugcccucuucucaccucugugggcacuaagcaugcauguguuacacacacacacaaacguuggauaaaucuaaauuuuaaaacuaaaaaaagaaaaacgggaggucggaggggacugucaauagacagaacagauagaacgucaaugagauguugggcagucauagauacaagacaaggagagugagccuuaccuacgagcccucucuagucauagauacaagacaaggagagugagccuuaccuacgagcccucucuagucauagauacaagaccaggagagugagccuuaccuacgagcccucucuagucauagauacaagaccaggagagugagccuuaccuacgagcccucucuagucauagauacaagaccaggagagugagccuuaccuacgagcccucucuaguccucccuggcccaaggacccuguuuaacaccacccacucauuuaccaugcccugucugcuucaucaaauacugguuucuccucucaauaugccugaaagaacuccagaaagacuggguccauccaugaacaggcuuagcccuucugaagagcuuucugugugccauagccuuuuuacaacauauaaaacaagauuuggcucacagauguuaacuuuauucaguucucgucaccauaacagugggcagaaugugugugugugugugugugugugugugugugugugugcagacuugccauuggagaccucagagccacuuggggugggucagugguggucuguacacauugaggucuuggguuuaugcaaggaagguauuuaagcagucacacuuacuugauuugacauuuaucuuuggaaacggggucuccuguaguccuggauggccucuaagccacuaaguagcucaagagagaaugacuuugaacugauccuccugucucaaucuccccagugcuggaacuacaagcaugcaccaccacacccacccaguucacaugaguacucaagagaacacagaaccuccaugagugauagcuaagcacucuaccagcugagauacauucucagcagauagcaugauuuccucuaaauacagagaagccugaaacuuucuauaauaauuggucagggguaaggagaaauacaggaaucaggcaagagagagagagagagagagagacagacagagagagacagagagagagagagacagagagagagagagagagagagagagagagagagagagagagagagagagagagaacggcugaauaggagaagguggccaggcucccuguccuuccuguuucaggcuuguuccuguaccuuacuuacaccauuuauuguuuguauaugauaucacaccuugcccauuuauuggucacagcugcucuucugacuuuuacuguugcgauuucaaaagcugagcaggugacuggauggcauuguccccauggcccugggaaaggagaucaaggguccuuccaagaugcuaaaaggaaauaccuuugcagaagucugacaaagaacagcagccuccuauugucuugugccagcuuguguaaguugaaacagaaaugaccuugcuaacuacagucaccccacuguagucaccaaacuaauaguuacccugaccauuguacacuggagacggguguugaaaccacuggccccaggaacagagcucuuauuaagugucgauuaaaaauaaaaggcugaaaagauggcucaauuggaagaacacuugcugggaaagcauguaaccugaguucaaauccuuaucacccagauagaaaucugagcauaacuguguaaguguguaacucagcccuggggcagaaguugggggaggacagaaacaggaggauggcucaacgagacagaugaaagaacaggauguucaauguccuccucuggccucuacacacgugggugcucauauacccacacgcauacaacacacacacacacacacacacacacacacacacacagagggggaagaaaguaauaaaaauaauuuaaaaauaacaugaagcugaaaaugacuguaacccccauaguuacugccgggacauuucugaggaguccuuggagggagaauacuauuuagaggcuaaaucuagucuacucuagggucacugucccaaggcaagggcugggguucuaggaggguguggcuuccaaaauaacucaggcugccugguucccuggggcucaccaagcaaugagaguuauaaaagcauagcccucauuuccucuggagaugaaggaggggcagggacacaggaagagggcagagagaugggaaaaugggguuucacaggaagcugccugggcccaggcucacuggggauuggucuugggguucugcugagcccauuuccaugugaccuugaguuauuucauccuccugcaguggccucuacuuccugacuucaggacccuucugaaacaggacugcucagcacaaacuuuauugcuaucuuuguuucuaagacagggucacagauagccaggguggccuugaaauaaauaacguagcaggggaugaaucugagcuccugauucauccgucucugagggcugggauuauagguguacaccaucacuaucgguuugaagccaaggaagcugugcgugcgaggcagcuacugagcuacauccucagccuuuuuuuuauuauuauuguuggugucgucgucgucaucaucaucaucuguaaagcacaccucaguuuaccacucuuaggugguguacugaacauuacaagaccuuccugcugaugcguguccaucuaucuucagaauugucuccucuuccccaggugaaaugcuauacccauuaaacuccuucuucuccuuccaccuggcucuagccuuguuccaggaaccuuacuuaaauggagucagacagcaucugucccuuagugauuagccuauuucacauagcauaauacucucaagguucuuccuugcuguaucaagugccagaauucccuaaagcugguggcgauuugaaacuuccccaucugggcaaggagccuggggcauggaaagacagacagacagacagauucucucucucucccucccucccuccucuccccaaccucucacacacacagaaccacccacuacauaaacaagaaagauucagacucuuagaaaugugccuagggucauggcccauaugaacaccaugugaaagauacagucuccuguacaggugcgcacaggugugcacaguagggaaguaagcagagccaggcucucccaaggguguuccagucagcucaacccacuaaaaugauagggcagguaugagucccuugggaccaggucugaaauuuccauagugggugaucaggggacaagaagguggcccuaggcccuuggacagaaggcuagggccuugggacugggugggcacagagacuauguuaucagaaagcacccacaagguggucccuggacucagaguaccagcaagggacaaccuuuauguuguggugagccccaaccauaaaauuauuuucacugcuacuucauaacuguaauuuugcugcuguuaugaaucauaauguaaauaucuguuuuccugguuuauguaaccccugugaaaggguuauuuuucucccccaaaaggaucacgacccacaaguugagaaccucuggacuaguccuuucuaagaucaaggacuaaaagugagggaagggaagacucagaaagguuaagggguaugugugucaaacuuugugaucgcgcccaacacacacauuuuagaagagucaaaaugaaugaaauugaaaaucauuaagucucagauaagaguggguagaaagugcuggagucaaaaggcaggccauacggcuagagagaugacucagugauuaagaacaauggcuuguuuugcagaggauccagguugaguuuccagcaccuacaugugguggcucacaaguaucaguaacuacaguuccaaagaauucaacaccuucuucugaccccugcacacaugugcacauguaaguaccaggcauacaugugauguacauauauacgcaggcaaaauaccuguacacauaauuuuuuaaucuaagaaaaaaauaaaacaaaacaagcaaaaaggcauagcaaccccaaguucccaguggccccugcagacucuguuuccacauauaccuggcuuggagcaaguuuucaggugcagaugauaguaaguagacaagagccagcccuccccaccucccagggcagggcugugaacuaauuuucaggugagcaugggugagccugcuugagacaccuguccccaguggaagaguuugcagugacagagcuggaguuugaacuugaaucugcucucugugguacccauacacccucagaauauggaaaccucaaaguccagaccaccggcgccuguggccugaccccagccuuacuaugagcuccauguagcagcugacuggggucuggggaggugggguacagucuggagccagcccuccugcagagaugaaacugugauuccauuuaggagccccagacaggcuugcuccccucuucccuccacaucuucuuaauaagauggaaaauguuaaccuaggucucacaggauagcugcugggagaacugauuuggccaggaaggcacuuggaaggagccuaacagcuaacaugagccccacugaccagcuuucccuugugccccagggcccugcuaugcaccugcugcugcugcugcugcugcugcugcuggcagguaugaguggagaagugaaacugcgauguguuuggucaagacauagccaaaucucaggcuaaggaacaggaagggugagguuugggggagacagccuccuucuaccccaggcacgagagaggaggcaggaaguucugguuucuggccaaagaaucgagacuauuccagaccagccaggaaggugggggagcagggaggggugguggagcccugaugaucuaggcuuacacuugcugcccauccacaccuuuacuagaggugggcauagggucuccaaggacgccucuaaaauaucucugccucugucgcucuccagauagaggacagacaggaagagccaaggcucugcagucaauugcuccuugccacccucuccccagcauugccuucaagaggcccagugaggaaacauuaucuguaacccuccuuacagauggaaaaaccgaggcaaagacaaggaagaaaggacacagcucuguaaccaggacccauggcucuaguccauguagcaaaacccagcccaaaggaagcugccugucccagaccccuuggcaucccugcuguccuggugaagggaaggaauauguuugaucugccagccagaacccguggccucagagauguugcuggcucagcaaagaccugaaaaugacccggccuucuggcacaugguccucucuuuaccacugaacucuggcuuucccacuggcucuuuuaucagaaacccaaaggcagccagggaagccuucccuugcaggaaaggagcugggaggcugccugauacucugaggucacccucauucccaccucugcacacuacauuccugccggucccaguccugacuccuacccacagggagagagugggcacuuuggccugcagaagacaccuguaaaacaauacgacccgagucaggugugguggcuuguaccugucaucucaguacucaggagggagauggcaauuaaacucugcguuuaagaccagcuugguguauauaaugacuucaaagccagagcaguguauauacugaguucuaggccagccagagacacguaaugagauucugucucagaagaaaacaaaacaaaacaaaugcccacucagacuccagaaaaugacuacucgcugaagucggacuuucaaagcagccagugugguuggcaaggacagggugugagcauugguucugggugguugaggccauccugccucccaagucucagagcuugguucauaauucuggucccucucaguucccauccagacacacacccucccuccuaagcccggagcugaaggccuuuuuuuagggugcugugacacugcuuaucuucugcaccaaacucuuuaucuacacaacagacaggacucaaccucacaagguuguuagaagaauuaaguaaauuaguauaucgaaaauucucagaacacagccuaauuaaaaacuguuggcugaaauuacuauggcauagccucugaugguggugcuagccaccccuacuucuagcucaggucauucccaaggggccacagaaggugaaugccagggggcucaaaucugcuggguuuuggauucuuuuagggcugacagugcuucaaccuaaucggcaccauggacuucugggaaauuucucccuuucugcauaagcacaccaguugagaacaggguuucauuacucaugguaaccagccacccaggugcccaucaccguuuccuacagugaacccaaaugaaagcauucuuaccccugucacacugguguguguguguguguguguguaagacaaguuagcuccuucccuugguaacacagagaaaaccgcagcauuuugagcuuuugauaagggaucucacauaguccaggauggcuucaaauccauguguaacugaggacgcuaugcaacucugcaugauccugcuuccacuucccagguacugcgccauaaugccgggcucaauggguuguuuugcuccuuuguuaaaacuugaacccagggccuugagccagcuacucuacuacuuagccauauccucagcuuacggagcuaauucuaauguccccuacuagugucccuauuaguauucacauaucucagaccuuacacccugacuacauucaagcguaacuagagccaaguuacacuguuacuuguucugaacuuucuccccaaggagagggcagguccccaucuugcuuaccuuaacuuguuuaccuuaccuuaaagccuuugcacuucuaaaaggugauuuuauuugcaugugaauauguguguguuggggggaauacguccgcauaaaugacagugcacacagaggucagagaugguggcuuuccugaagccugaguuacaagggguugugacccacccaccaguuccauaggugcugggaacggaacucagauacucuguaagagcagcaccuaaccucccaaccucugagccauuucucuagccccaacgauccuuuuauuugaagacaaaguccuaugugucccaggcugggcucaaccuugagcucgccauccucugugucuaccucauaauugcagggguuacaaguggaugccaccacaaccacauuuaugcagcauuagagauggaaccuagggcaucaugaacacuaggcaagcagucuaccaacuaaguuccaacccgcccuuuugagauccuuuuaaacauacaucagaccccuuugguuucccugcucugcccucccgggaucuccuccuucuuuagaauaaaccaaaguccuaaaaacaaaaauaucuggugagcuuggcaugucugcuuucugacuuccccucccuguggcugcucucuagcacagccaugcucuguuccuuagguauggguggcauggucccaccuccgagccuuggcucuagcugaugcaucuguugcacacuccuucccugaaaauguuuuguucacagcugcaucugcagaggcagggggugaggagcacacaggagauauucauggguggguucagggagucccauuacugaggaaccaacguggggcagaguguggcugugcauucaaaucccacaccugccacuguuucaaguuucacuguuucuuugaaucucuuuucucaucuguaaagugggauaacaguaguaaacugccucgcugguugguauccugaggauuaagaaacaguaucaauagcaagcauugauuuagaaucuagcacauaguaggugguugguaugugacucucacauauuuaugaccagcaggggcuagaccucucuggcugccucuucucaucucaggguugccugugacucuuagacaaaccuggcccagggcccagaguacucucccuagggcacaggcucuguaucccaggauggccacaagcugacuucauggcacaagaacucugggaauuuccuggcaggaaagcuucuguugccuggacaugagaacagcugauggguggcugggcugaugcaagugggcagccacaucucaccccuaaccugagcuucagauucugggaugggauaccuggcaucuagacuugaccacauggggcacuggauugguucaacuccuaguauuccuuguggguccaucacugacaaaggcuagggccuucugaaccuagaccccucccggcccugagaccugaguacaccagguauuuuuagcaacucuaccccaacgucuggggccuauagcaaucuuuuccuauuacuggcagggucagagacaagcucucccagaaaaggcuugggagugcuaugacugucccacugcacucuccagucugcauacauauagucuaaagagcagcuacugaacaaacaucuacaacacagcagcaugguggagaagguguggucuugcccuuggcuggcuugcuauauagccuagcucuccccacccguccaaugacaaagcuaagguucagaggaauuaccucugagugccuucaauggcagagcuagaacccuacuacaagauguagagugauguuuucuuuacagaccuuacuggcugugaaucaaaaugguggcuggagcaaaaccauuagauggaggucucggggcacugagcuaaauauaaaguuagaaaucccauguaggaggggccuccuggcuggcccugagcaagaaaaagcagucagugcucucuguuguccuccucuccugcccagcauucuguccuacgcuacaacacgauccucacaggacugccagggcucagugggaggggcuguggcaccucaugcccaucaugcucugguagaaagaaggaaggcucacacacacacacacacacacacacacacacacacacacuggcccacagguugaugauuuucaggaauugucucauucuuaucccucucaguugccuggagugaauccgggaggagagggacaaugacaguccugggacacagagaaccuccucugcugccaccaaguucuuccacuagagaaucauucccuccagucuuaaagaccuuccggguacccaaugugacuaaccuacaauuuuggauagucgagggcagagcaccauggccucaaccuuuguccauggagugggacugaaggaggaagggucugggaaauugcuucaccacugggcucuagccagauaguccuucaggccaguuccaucccuucuugucuagacacggacugagaaugggaagccagaguccccaggggcuagucggugacuggggugacugugcuucccguggaggcccacccagccuggcaaagucuucccacguguagcugccagcccagcagaggugagucacuggcccucagaacagucuacacaagugcuggauaagccacagaccuccaggcccugcccaagcucugcugcccagcccccaguuucugauggcacgucccuaucgcuagggacccagcccugccccaggcucuuggaagcaccagaaaauagucugugacacucagagcagaaaagaaacccucaguacaacagugaggguacuuaccuggggcagaaucugccccucacggcacacccaccucugggggcccauucuucccugagaucuauuuauuccacagacugacccaaacagcccauccuccgugaaagaaagagaccuccuucccucaggcuccaucucaacucuggagccagggaaggggucaaaggucagaaagagcaaaaaggaugcuaagguccgcagguggaaugagacgccaagccuaugaacaacgucucccucuccaccgcuagugccaggcuccaccccgccggcuguggguuagcuuaccguggcguccuccgcaccgugguggccgaugaggcggcuacccccugggugccgcugugcccagcggcugaugucguagacacggcgcucgaugaccagccacuugucgccugguaggucaugcuggcggaucugcucccagcggaagauggguaggggcgcccccagcggugcgggccccucccgcggcccgggucccccuccgggcuccccgacaccgcccauugccgcuguacacaaguccuccggaccccgguacgugaccaaggucuaagagagacacugagggaggcgagguggcaaucaggggucuuccuccgcccgccccaccggccccgcccugccgcugcggccgccguaagagcgugcgccugcccggcucuccgcgcagggaacuuuucccucccuuauaaccgcgcugacagcgcucgccucgcccgccccucgucccggcccccgcgcuggccagucccgcucucgcuccaauccaggcgcggcgccuccacaucuauuggcugcccggggagggcggugucgcgaaggggcuugccccacccucgagggccuggggccaccacgcccggcacugcccccggggcacugcccccccccccccccaguuucucggacucucggcucaacugagaaggcgggggauggggacccagcgcgcacgggaguccugcaggccgcugcgcccaggcacacccgcaggggcccgaaaugagcccaagucugagcccugaaaggcugagaaauguaguuagggacgucaccggucuuuaaccaggcaucccagguagcuagaaaugaggacacuaccuuggggugacugucaacagccaccaaacaauggaccucaucccccaguaaacccucaauauccacgcgaggaagccaucuaaagcaaucugcaggagcagauggccucuccuccuggcuguacgcaggauuggggaugcccagguuggccacuggaggaggagcagaggacacugcugcguggaggucugccguucaggagaugaaagaaugguccagucugcaauggguggcuugcuugucaccaccucccaguucuccccauucauggugucac

SEQ ID NO: 9172 - RNA, 39053 nt, Mus musculus
ggaacucgggaggaugcggagccgggaacggggggagccagagggguggggggaggaggcagcgaggcccugagcuauccuggaguuuucaccggaggcaaaaguccacagcaggcgggccuagggugggcggaggaaggggaccgcuugggggcacugggaagccagggguacuccugagggaaggcagggguacuggcuagcuagugaaggcgaggaggagcgaaagcgaggggaggaggcacggugggaggaggaguagaagacaaaagccgaaagcgaggagggcgccgaccgcacacugcggccaggagagggaccgucgguguugcgagccgcgggcgcccggaggccguagcgcacggggcauccggguagacuggcagcauggggaagggagguaaccagggagaggggagcaccgagcgccaggcuccgaugcccaccuuccguugggaggagauucagaagcacaaccugcgcaccgaccgguggcucgucaucgaccgcaaggucuacaacguuaccaaauggucccagcggcacccggggggccaccgugucaucggacacuauucgggagaagaugcuacgguaagagucugggggugccagccacucuugucugcugcaggcuggugucaggagcccggggucccugggcgccaaacagauccccgguucuuaaaggagcgcaggacguucagcagggaaagaaaguguaccaacugcccucaccucccuccuggaaucguucuccucugggucaacugggcagacuuuggccgagccuuuuggacgccaggccuuagcaccucuguggaagucccaucagugguaaacugugcccggugcauguucacagcgcauacugcgcgcuguuccagccggagccugggacucuccaaagggggcgcuccagccuucguguucggcgcuccccaaguggaagauggccacccuugggcgccggggagaggagccugagagcgggcagccauaugugggacucuccugccagaccagggggcggagaaggaaagcugguuccuggccaggacucgcuccugcuuggacuccugucuaagaagguccacaauggcugcccgacagagacuuccuaguaguucagauucccacgcucccgaggauuaucccgacucacuccaagugccagccuucugggaaauccugguggggaauugguggaaggcgaacgggcuggauuuugcaaaauucagguccgcaggggaucuagaaggugaaucuaagacuggcuuggcaacagguccaucugccucugggguuacuaucggacauucaacucaauggcccucuguuuuuagauccugccaggaucacccuuccccucuugcacucauggagguuguugaagucucugagaccucuguggaacggaggcuauccuauauugcacaguaccccauaccgugccuggccccacccccaaccauaaagugauuguguagucagguggguaagaggagaaacaaagucaaagaggaaagccagaccuuucuuggcaccuuucuuggugggcugaaagcagaggaaaagauguagcuggagagagcuugggaaagacgagugggaggaggcugagaagagggauaaacuuaucagaccgcacuccacaucaaaguccaggaugcugacuugagugugggcuuuucuugugcaaguuugauaguuucaauucuuaccuuccaugucuuuucuuuuugagaucagccuagguagccauacccuaaucaauggacuggaggcuuuggugaacaggaugcaaucuuacuccagauugaggagagaacuggccacauucauacugccuaaagacuauuuuccuugcuuguggagccugcuuaauuaugcccauggggcuggcgaugcuaaccagaccuuaggagaguguaagcuuuucacauuccuugaguguccuagcucucuuggaccgccucacaaccagagaagaccuugguuucccagggagaaaacuucccagccccuaucugggggaucuuuccacuguuucgggugcuggugugugcaugaaucuguaggugaauugcagacgacuccuccccuuuccaggcucuuaccaaaaaguuuccuaaaaaguaaaacaacaaaugugauugguuugauccgauuauuccauauugugugauaaguggguuuucuuguguggaagcucagcccaacaacagccuugaacuuuauaguuuauuuaagaagccagacguauuucauccuuguuuuggaaauucuuaggguuucccugacucaguuuucuccaaaugucuauguucagaucuaacccagcagauaccuggauggcuugcucuuauguucugaaagccuuauguccucuuccacauuuccugugucauuuucauugguucugagucuggugucugggauguuaauugucccaugauaagaaagguaaggugggagucaggguaggccgcagaugugaucccugggcuuguugcagagaaucacuuaguggacacacacacacacacacacacacacacacacacacacacacacaccgccacccccaaucccucaucuauuccaauaagaugaguguggcaaagcuugcuguaaacagugagccccagacagacaugagaggaacaaaacagcuagcauguaaaguacucgcagagaaacggagcaagcucauuugaugacacgacaugaaagcuuacugucuucccaaauaagacacaaaacacacuugauggagacagaguuggagaucaguguagaaagagccgugagguuuucuuuggcaucccccuguuucuucuuaaacugagaucagauuggcagaaggccuuggacaacuaggagaucuucaaagggagcuccacgagauguggggaccccuccccaggcuguuucucagggaacuuugccgcuuaggggucuugccuucuugagaagggugaugagaauggacugucagguuuggggacggacuguucagcagauagaggcuggaucccuagagcccuuucauuuguuaccacucaaaggauaucugugauaugcugacaagaggcuggaaggugaggccagaagccaaggaggcccauuuugaggucaaucuaggauaucagucaagaauuuucuguuccugaaggaagaaaaaaaaaaaaaaccucagaagugcucacuucuucucuagaaggauggagcuguuguuacuugauccuucuguagucagacccuggccucacuuguacuaaaagccaccuaaguggcaugugcucagagucccagauacgcagaagacuggagcaagaggauuauuugaauccuaaguuuugaggccagccugguacccuagugagauuccauugcugaaaauaaacagugugaguuuugcaguucacaaacccaugagauugguauauacuaucucauuuaauucccagguuagccuugccgcuguccuguccugaggcucagaaauccuggucaggugguguucagucauagucgggaucugcuggcagcacucgcugcagccuuaccuuccucucuccaucucccucuucuuauuuuucuauaucuuuagucauuuccugcugguccccccagagcuuuuucugucuuagauuugcuguaggcacaaagaacugucacccaugccccaagccaguguuugcacuuuucucgggagucuaggcaguacaaaaugagcccacuugugacuuuucaucuucagcaagagcucaugaaacauucauugagcgucuccauggcucugagcugggcucgcaucagggccucaacacaaagaugaauaauucacagacaguggccuccucuacuggacuguuccuccuuaguuuuccuugcuucaaccuggauucuccaccuccagacucccgccuguucuccagccuauccgguuuugucuaugcuuuuuggcccaucugccuuucuuucuuaccucuuagaaucaaaaaaaauaaaaaagacaaaggggaccagagguggguuccaucuuugagcugcuccuauaauguuuccgugaauaagcagcaauugaagaaauggaauuguuggaauugugucccuguagacagagcaggagcaucgguauuuucuaggccugaagggcagcgccccccccccccccugccgagugagagccaucugauuccugcccaucauaguuuggugagagacaaccuccauacccagccccagcaucuccuguaacggcucuaauaaaaugcaaauggcguuggauuguggagauggcuuagggcuuaguaguuaugcuuguuagugagagugaaacucagaucccauaacauaccggaugggguaguagcugacuugcaauucuagccccugagugcagagggguaggauccccagaacaagcuggcuagcaagacuaagcaugccggugaacucugaguuugacugugaagccugccuugauggauaaaguggagaagcaaucgaagaugauucucaacaucaauucugugggccuccgcacgcaugcacaaguaugcacaugcacacgugcaaaaacauuuacgcacauguccaugaaaacggaaaggggagaaauggcaucaugcucucaggcccagucugccucuguggggauuuacuuccugugcagccagggaaguccacacaucccgugcuagccaaggaguucacgggccacagaguacuccucagccucuucuccuuggagggggcaggaccaguggacuuucugcucugucuguaccuaugugcugcuaaaaguaacucagaagucaguaucuuccguggcugccaucuuuuuaaucucuaccuauaaauccccaggucccuccugauucucuuccugcuuugagcaaucgucaaagaaucguggauugcugcauggaucaucaugcauccuuauuuauugagccuggauuucuuaaauccugggcuaaauucccagauguggaaaguuaacuuauggcuuugcugugcaagagagccugggcacagucagaaacagguuuugguacccuagggucugugcaagggcagaacagugaguucugcccagagguggcaggggcagggaagcugugccuagagaagucaccaccaugacagcugagaacaaacagugcuuacgggucugggccugaccccacuggguaccugcucagguccccugcaccuguuugccaccucuuuccccaugucuuggcuugcuuccuagaaagacuuuggcuucucucccugucagagaaagagagccugcuucuaacucuuguuccaaaaucaucauuuggguuggcccagucuugccuuguacuaaggccuacucugcaaccugacaucccuguagccagacagcacuucggaguuaauaguguucaggugcagcuaugaccccuugaagcagugacaagugaagugaacaauuccccaagaagagaaaguucauuucaagggaggucuucgucuuaacagcagaaaaauugauggucagccaucuagcccaggcucugcccacucaguuccuggggugugaccauggacaagugagguuaccaaccuaggucucuucuuaucaaugaagcaggaccugaaaagcuagggugguauagugcuuguuagcuugugaaagcucaggguuccauuccuaguacugcgcaaaagaaaggcaacaacaaaacgacucaccucccagagcugggaaaacaggcugaugacacaggccacccgccuggcuugcugucucaccugugcagugugacagcugccagaaaaccagccagaagugugagugccuauagugaugaagagcuccauguuccagaaguauugaucggguuguauaaaaugacagacagcagagucuauacuggacggcaggauggaaacauauccuggauuagaggguucacagccacugggcccuggguuucucugagccuugucuugugaagcagguguggucaccacaggcuagaugcgauccuuucaucucuaggugucaggugauaggauuuacgaugaauaugccacccaauuugugcaguuuuguguguuuguuuuuugagacuggauuucauguuugaggcuggccucaaacucaccuuguagcugagaacagcuuaaauuucugacccuucuguuucuacccccacaccugucuuaugccaugcuggggauuaacccacacacagcaucaggcacaccaggcaauuucugucccaaaguuugugauaugcgcguguguauguucaaaugugcuauguucacauguauguaugacugcaugugugugcauguacuuguagaggccagaaguugguauccaauaccucccacuaucucuguguacuuuauuuacugaggcaggaugucugucgcucuuaaccgggaucuugaugaaucaaucggcuagucuaacucgccagauugcuauagggauccaccuuggugcugguuuuacagacagguugaauuuuaugugcauguuggggguuccaaugccagcccuuauauuugcauggcaagcacuuaguccacggagccgucucccugaccuccugguuugugauccugacaugaguaugaagaggagcgaucagcagugucccugagaagccuaaggcuagaaagggcuguuuucagacccguggcugagaaaaaaaauuccuugaagguaacauugaagcaggcgccacaucucuagcacaggugugggaagaaacuugauguauuaaagagcccguucuggaagcuaauaagucagccaggacaguaagcugguuccaaggagcagcugauaagaggcacaaaggaaagccacucccugaggcaguuggacuggauggcagucuggcugcacucccuagccuucagaaccucacugccuggggacuuugaagagaugaagggcuuugccuggccugugacugugugccucaccugauuucagggagcugagguugucccagagaccugugcaaauggcugaggagugacagggcucucauuuugccauuagcugggggcauccaggacgggugugugcgugagagugaucugaaagagcuaaggugaauaaggcacuugcuagccuccaccaaacaaguggagaggaaauuuauagggagcuucuugucuguggggaggggacccugccauuggcagcucuugcuggacuuucuucugaguuuugcuuugugugugugugguguugguguuguuguguaaagaagccugagccuggggcucacagaacugauccuuccuccucacagucuuccugagccuccuuggacaacaggcuucucucuaugaaaagacccuugguuuugaucugacccugugauuuaaucucaccuuuuccauucagccaggggagauucuguuuguacuaaacucugcccauuguucucuuguacaaaauguuacuuugcagguucauauacaauggccuugcugggguuaucagagaugugaaccucuuuccaaauguaaagguugaaagauaaagaaauacugucucuucugaaccaggagucacuaauaguaauguuuaaucucauuugcuuucucuguaugugaagacaguuuucuuuugaaauuaaguuguuugauagugcaugccaucaaucccagcacucagaaggucgaggcaagaggaucagcguuuccaggccaaccuuggcuacaucaguuugaggccaguaugagugacaugaugcacugucucaaaagagcaaaccaggguaggcaagacgaaucaucaguugagccacuugaugccaagccugaugaccugacuucagucccugggacccauguggcaguaggagagaaugcacaacucacacauuguccucugacuuccacaucugcuggguaugcaugcacacacacauacacgcacacaaacacaauacauacauacauacauacauacauacauacauacaaaaaaaguuuuaaaguaaaacaggcugagagagaggguucaguaguuaagagcacugucgggucuuccagaggaccugaguucaauucccagcacccauuugguggccaagaaccaucuguaacugcaguuucaaggaaucugaugcucucuucugaccuucuuugccccaggcacacacaugguguacauacguacaugcaggcaaaaugcucauacacauaaaagaaaugaaucuauuuuuaaaguaaaacagcgaaaaguugcagcaucuucucccaggaauaagagugcucugugauaaccguaauaccucuaucacauuagaggccagagcugaaguucguccugcaaaccguuugccuagcaugcuccucaauuuaguccccagcagugcauaaaccagacauggugaugcaugccugcgauccaagcacuugggauguugaagcagggggauuaaaguucaacucuuugaccacauauguuugaugacauaugaaccuacgggucagucugauugauaagaggcccugcucuuaaaaaauuaauaaucccaguuggaucaaaagcccaaugcccauuuugauuuugacaucuaccucucaaaacucguguguaccuuuucuauuuccuccaaacaggaaccuuuccagugaaagggugugguuuauaugucugcauucagaggcguguccccacacucacaccucucucugccucguuauguugauuucucuggugguuuuuccugguaccauauggcuuguucagcucaaucuuucagugcuucauuuuggaugagguggugggaggcggaauaaugugaagcuuccaauuauacauccuggggaccuggugcagaccaccucggagagaugcuugaauuuguagagacaauuuuuguuauauauguacuguguagaaaagcugguagaaauacuauaauauuagcauugacggucuucccaugugaugauugucuuuaaaaaaaaacauuuauuuauuacuauauguaaauacacuguagcugucuucaggcacaccagaggagcgacagaucucauuacggaugguugugagccacuaugugagugcugagauuugaacucaggaccucuggaagagcagucggugcuuuuaaccacugagccaucucuccagccccuauuugucuuuuuuuauucuucggugcauuucuaauguugccagaauuaaguauguuuccacuucaucuccggaaugagagcgauuaaaaugcaaaacaucauaguaauguuacggaagguuugcaaacuagugaaaauaaaguaaggugcaacccgugucuucaguaagaguuuuaauccaugacacccugugccagauuuuccaggaauucuuuuacauaauuccaugcuauuuuuuuccucuuguuguuucaugucaucuaagcauauuuuccaugcugcggucauuuucuagguguuagggaccaagcugggugccucacacaugccgggcaaguguuuuuuuuaucacugaguuaaaccccuucacugagucuuuaucucuucccugauaauuguggccuuguggaagaggacaucucuggggugguagguaguguaguuugugcgcuaugaaagacacucagcucaggagcaggacagggcugucuucucugaguccugugccuaucugcucucccuggagaccccucuguccacaaacccuugaccagcucaguaggccuggcgccaguacagaggcucagggugguuaccguuugcugcuggaguccugcacuaggaauauguccugggguggagucuggaguaagcauuugccacuggguggugggaagccccacuugcugucugagcagagacuagagcugcugcuaaaugcccucuccccuagaaugggagaaaccagcagagguuugagguucagccuuacaaacugcuucucuguuucccaggaugccuuccgugccuuccaucuggaccuggacuucgugggcaaguucuugaagccccugcugauuggugagcuggccccagaggagcccagccuggaccguggcaaaagcgugagugggacuuguaacauugaugaggugggaugaggcgggaugguaggggucagggcuguggcaggagaguccuugagccaguccaggaggaagcccuaaggaacuaggucagggaggaccucagagcauccccugagagccaccagcugggugacaguagcacccccucucucccaacugguccuuuugcuccucuuauuuucacaaaguugucaaaugucagugugcuaccaucuaagaaagggcagaaacagcaaggcaguaucaacuguugauaaguguggcugcuuuggaacgaaucgcuuugagaaagaguggccauuugucacugagucaggcaccccacuaagugcugcgcuucaaaggucugcaaagagaacuuccaggcugaguggugaagcagccuguguaccagaccuggcuugcaugauggaguuguguagaacagcuugcuuuagaguuucucugaccuuggagagcccuucccuuccccuucacccaaugcuuaccuuucccuaccagagucacccuucuaguggagccuaggcaucuccuggcccuaagcaaggcugagaguacccauccuggcauccugagcccguuggcaucuuggaggguggagugguuaaguccuaggagacacacuaugguaucagagcugagguauuuuccccuuuaacaggcauacuaugugugccagcaagagacggugggccgccaucacccuugccuguccuagaaagauggcacuucugccugccauccagagcagagaagcuuccugggggaaaccagaccaggccagucccucuugcucccugucugagcuggaguaauacuuuauuagcuucuaccucaggaccucaacaaagcuaggcaggacagaggcauuuuccuggccuggauucuuggcugguccuccaucgaggacagucugccucccuggcugcugugcucggcacucagaggccucugaguuggacccugucugcgccugcacagucaggugggaaaagacgaaagggcucucucccgaggugugguguucaguggaacgcacagcacucgcacuguugccaaaccaucccuaccacccaguucuagaacguugacaucaucuccaacugacguucugugcccuucccaccaucuccucacucccuucggccccugccaacuaccguucuacugacucuaagcauuuaacuccgccaggcaccucauaagaaaucauacugcauuuauuauccuuuacaaaauuuuauuagagaauauuuuuaccguuuugguuuucuuuguuguuuugauauagggucucauguagcucaggcuagccuuuaacucccaauccugcuuucacccucucaagugugggacugcaggugugcacugccucaucuggcagcuuguauauacugauuauacagaauaauggguuucauuccaacagcuucaugcaagcuuuuguccuuuuauaacuggccuauuucauuuagcauaaaccuuacccauuuuagaacacacaguguacugacaugccaaacuuuccuuuguuuuuaaggcugaacagucugucauauauguagaccacaaucaggcauagucaaccugcagccuaacacaaaauuguaaacuuacuaaaacauuagugugugugugagagagagaggcggggaggagagagagggagagagagagagagagaacauguacauguggguguccauggagacccaaagagggcaucaggccccggagcuagaauuauaggcagcugugaguggcccuacaugggugccgggaacagcaccagcccccuauaagagcugcacucacucuuaaccacggagccauuucucugguuccgaguccuuuguaaauaaugccccugagaacauugauggagaagguacaugcuacuuauuauuaauuauagcaauuaucacuacaguuauaggaggccauuuccacacauacauacuuguauauacacaguguacuuaggucuuaucccauaucccuccacucucuuccuaagcccuccuuuagucccuuacauuuuuuaagcuuuauuuuuauuuucuguguuugaauguaaugccugcauguaugucuuugcaucacaugcauccagugcccuuggaagcacagaaaaggguguuguaugccccugugacuagaguuauagacaguugagagccaccaucgggaugcugggaaucaaacccugguccuauggaagagcagccagugcucuuaacugcugagucaucucucuagcccuguuaguucuguuugucgccauacagcuucacuucuacguuagcgucaccuguacauaaaagaugucauaugugcaugaagucucgaauccacaagggaacugagagaaagcacaagcuaguugccuuucugagacugacuuaauucacucagugugauucagguccgacucuucugccacucacccugaugcauuauggcugugguaaugguaaccacugcaggaccuaguagcugggcucacacagaguucaaggugcuugccacagcuguaguguguaccgugcucgaucacauguccccuuggaaggucucggggcucauugucuucugugcccuugcucaacagucucagaucaccgaggacuucagggcccugaagaagacugcugaggacaugaaccucuucaaaaccaaccaccuguucuucuuucuccuccugucccacaucaucgucauggaaagccuugccugguucauccucucguacuucggcacuggcuggauuccuacccucgucacagccuuuguccucgcuaccucucaggugaggccugacaucccugagcaucauuugaacauccccaccucucagaucccuccuggcuguuugcugaugcugcagugacauucacagcccucuuucccuaggcccaagcuggauggcugcaacaugacuauggccaccuuucugucuauaagaaauccauauggaaccacguuguccacaaguuugucauuggccacuuaaagguagguguuggggcuaagggggauggcuugggcaguaaaucucuugggagaaccugaguuugauacccacagcauguguaccaaugcuggccaugcuuggaaccccagcacuggggaggcacucacagggggagccgugggguucaauggccaugcaguuuggacuacuugcugagcuccgagcccugucucaaaguagguggauaguguuccugaggaugcuaccuaagauuguccagucuccgugugcaugugcauacacucaagccuccccucaaacauguagccacaugugcacacauguggacuugggagaggacuuggggcuggagagauagcucaguggucacgaacaauaaaagaaggaaagaaaaggaaggaaagggaagggaaggaaaggagagucugagggaugguguguguguguguguguguguguguguguguguaucagcagcagccugagugaccaucccauuagaaugucucucuguaaauagaaaauaucccauguuuaaaauguauguaacuucauacaccaaaccucacggcuuagcaacagaagacaguauagggugacaguugguuaauggcuguggcuugcugcuucagaauccaaggccauuauaaaucaggaauggcaaaucaccucuacugucauuuuaguagugacaucacauuagguaauacuuaauuaaaccaaagggcaaguugauuaaaaugcucacgaggccaugacccauggagagaaguguuaaaguuaggcgaguccguaaagccaaccuugccggugaccuugagcugagcugacuggugccccucuacuuggaaaagcaacauaggagaaggaagacuucuuucaguagcuugugguuucaaaagugucacuccauaguccccagcucuguuaauucugggcccaugguaacccugcugguagaagcauguggcagaagccacuuagcucaaggcaagcaggaaggagccagggaggaagaaaggguccagggugcagaccgaacuuuccaagguaucccuccuugcacugaauacuucuucccaccaucugcugaagcagugucguccgugugggacugcggauucaacccgcaaguucguggugaugugccauauuccaaccguaacauacucucucaagcaaacccuagugcuucccacagucagugcuauugcuuccucagaaacgcugggucccuaauauuacccaccugcccucagcuggggaaggguccuguuuccagguuaaaaaucuccacucugugccccccccccccacugcacccuuggcuggccagcuguggguuggauuaugggugagccagcgaugaguucccagcuaacaguuuaccuggaccugagccucgaaggcugggaaccuggacucuucccagaaccucaagaggggaaacacacagugcauuguuucauucugcacugcacucuguggcuuaaaauccuccucuccguaggaaagaaacauuuuacucacuaccccugugcuccccaggccauagacaaagauagacuguguucuguuuccagguccuggcaggguccugagggccuuuucugcucaaggucuuguguccuugauggacagcuugaaacauggcucuuauaucagacaaacaagggcaggacagagggcuggcuuccuuauagaaaccuuugcugguaaaauuggaacgcugggaacuggggauguagcucaguugguagaaugcuuguugaguaucuugaagcccuggguucauucccagcaccauauaaacuggguguggugcacacagaugaucccagcacccaggaucuggggaaggaaggucagaagcuggaagccauacuaugcuacauaacaaguuuagggccagccugggcuaaaugagacccucucucaaaaaacaaacaugcacuccuauaucuauaauauguggugguguucucucucucucucucucucucucucuaaccuccccaacaccaccacauaggucagauuggccucaaauucauggaggcccaccugccugccucuguuucccgaguucugggauucacugcacacauugccaugcccagccuugacauaucauuucuuaaaugagcaauccuuuuaacuccaggacaccaaaauauaaaauguucaaaaauugaagucuguuaaaaguauuuuauuuauaucaaaacaaaaaaaauuaugccuuuccuuuauuaagaaaaaaaaaacuuggugaugcugaggauugaaggaagccagggccuugcucaugcuggguaggugcucuaccaccaagcuaugacuccaauccuuuggccagaccuccauuuagauauaagauaaaguaauugaaaauaucuaagugucucacuugaaaacaagaugaacgccagcguggauguugaaaggaucauaggugcaucugcuggagugcaugauguuucucaugccccaggccaugcuaugacugcccagcucugcuggcugcagcucugcuaaggagacuucuugccaggugugcugcugcugcacuccgugacccagugcuaggauaugagaggccaaggcagccuggcccagauagucacauccucucucggcucaccaccgucuccccugggcccagcccagcaggcuuggagcagauaccauucauucagucuucauucugagaacacggaaggcugaucguugcuccuccgguagaugaggcaccguugugccauggaggaggaauugcugauugguagggcuuugccuagugacgaagacagcauaaaccaccaaaauauccuggugccuaguccaaaguuugugucccaucuccaugacuuucacuccucaucucacaaauaucucuagguuggugggcuguccgcuggcuuguuaacauccucguuccucagugucgcugucggggacuuuuccuucugaugcuuuucuuggcaauuguguuccuucuggcuuucggauguaaacacaucauuugacuccguaagccugggaccuuucccacacucugacaugcugcucuuugcugugagggauuuugaagccugcugcacacaggggccagaggucgcugcagagaccacagcuguuccuaacuaucuccauccaugcucuccaaaacacuccacaagugagaagcuuguuuugagcaaauagaccugcucacagauggucagagccggccaugggccaccguuucaccugcugaaggggaagaaaagaccugagucuugcuuggaccacuuagcaacuuuguugagugacacaccucuggggaaggcuuugagaacaagugauagaguaguagccuguggcauuccaauuaauacaaagauccccuuuuccuguaucgugggaccacagugucaucuaaauauuggcuuuucccuggcuaucagaccacauuuauuggaaggggcucagggcaggcaagaacuauaucaacugagauacacuccccccaacucccccaacacuuaggauccccuccacacucaacuauucucucucucuucuuucuuuuucuuuucuucccuccuuucuuuguaggcuuauguuaacuuuucagcauugugacuuguaggaaauacuagauuuuaucgggcauuuucucccauguguaggagacgccauucauacucacccucuaccaccuccuaguguuggcuucucuucuccuuccggucucacuccuucccagauggucucacuuuaccuuaauaucuuuauuuuaaaaucuggaguccaugucugagagaaaaauguguggcuuauuucacuuacaugaucucuguuuuuguuccuuuuccugaaaaugacauaauuucauucuucaggacugaaucauacucuguugaguauauaucauauuuuccuuuauccauucacccacugaaaggugcccgggcagacuccguaacucauacuuauuuauuugaacccccgaucuuccugucucucccuuucaaguucuggguuuacagggguucuuggcuguuccuaguagcgcuucaaugaacacgaguaucaugugcugauauuuaucucaggaaugguagcguuggaucauguaguacuuuuuauuuuaguuuuuuuuuuucgaaucuuuaugcucuuuucucuacuggcuagacuaaccuacauucccacccccacccuaacacacaccuucaugagaauuuguuguuuguuuucuuuuucucauuaguuuauuuauucacuuuacauccaaguaugcaucccuccuccgccuacucccuccccccacugcuccuucccccauucccuccuccccuuuuccucugagaagccagaggcuccccugguaucacuucacccuggcacaucaagucacugcagggcuaggucuguccucucccaccgaagccagacaaggcggccugguuaggggaaggggauucacagaccugcaacagauucagggacagcccacacaccaguuguuggggacccacaugaagaccaaguggcacaccugccauaucugugcaagaggcuguuguuugucuccuugauggugacuauuuuggcagggaugagauggagucucagaauaguggugacuugcguuuccucuguugcugaggauggugaguguuuuuuccauagaugggccguuuauacuugcuucucugacaacagacucauaaauucaucugucuaccuauugaauggauuauucucuugaugucucauauuguagccuuuuuaugcauucuggcuguaacuucugucugaugaauagccaacaaagguugucucccauucugucucguucuugccaagccccuucagaaaaauagacuuugaaguguuucccuguauuuuccucuggcaguuucaggugauacacaaaggccuuugauccuugggaaacauuuggauaaaauagugguguugauauauauauaagauacacggagggccauuugcccauuucaagcuugcagaagauuccauuaacaccucuggccuacaauuuuagagcaucguuaucacccacagcuuaaacccccacaaaucauagccacuuagccgcguaccccaguccugucuccucuucacugcucacugaccagggauaccugggccaccaacugugucuuccaccgggcuucacaucacugagaucaugaggaguagaauuuugugguuuuuuuugcuuuuucuuuucucagcuucuuuugcuuugugugguguuucuaggaucaucugugcuuauaucguguguuaggggccuauugucuucugacagaaaagcuuuuuuacauuuauuuauguauuuauuauuuaggggaaggggcaccauagcauguauguagagguccaaggacaacuuucagggguccguucucucuuuuuaccaugagucagucccagggauugaacccagggugucaggcuuuguggcaggcaccuuuacucacugagcccucuuacugacccaguccauuccuuuuuauaguuugccuaaaccauucuguuguaaggauaucacauuguauuuuugguucguggacauuugaguuguuccuguccugacuauuuuugagaauucuucuuugaguguguguguaugugucuguguguguguguguguguguguguguguguguguguguguguaaauacccuaguuuccuuggcccacaagucaggaaggaaauugcuggccccugguagagauuacuucacucuuucugaagugcuuucuccuuggucaguccugggaaaacugaggcuggagaagugacuggacuucuuucagaacugaacaguacucugggcucagaaguguguggcagaguuauagucugaguuccagggacuccaggcacaaaccccaugugugauggggaagcuggcuauuggugguguggguaccaggaccugguucccaucagggcccaucacugggucacuggucucuguggcucuccuaacuccucuccccuuacagggugccucagccaacugguggaaccaccgacauuuccaacaccaugccaagcccaacaucuuccacaaggacccggacauaaagagccugcauguguuuguccuuggcgaguggcagccccuugagguaugaaucguguugauuaggaggugucaugggaggagggaaggaguccuguaggcucagcaugccacugggaugucagcaccuucugccacccagaagaauccuuuccuagucgucucaaguuaucccagcugcaaucuacauagagugccuuuccuccagaguacuggacacagccucugagccucucagcaugucccuccggcccacaggaaagugggucaaauguuucaggaaggcaaaauucuaggccuccaggauaggucuaaugggccagcucauguggaggaagcauuaucuggagagcagcagccuguuuaagcagaugagaaagcaaggcucgaacagacaggaagugauaguaugaaggucuggucauuuaccaguuaggccaggacaagccuucagaucuuuggcugcuaggacacuuccuucuauuuacccacacuuucucuaguaucauuuuacuuuuuauuauaaauauaggaccuacuugguacaaacauugacgcaguauagaaauauauacuuagugucuuaaccucucaacaucaggguuuauggacccaagaguaaguaaccacuguuaaugagacgccagauagcuuuguaagugccugccgccaagccuugacuucagcccucaaaaccuucuguuugcaagugaacaugcauauaucauguuuuuaaaaaacuauacaaaacaaaaacacuagaaaugaagcacaccuucuauucugcagcucucugcuucucuuaaugcagaccuuguuccacaaguccaggaagacugagucaucuucuuggggacuguacaguauucuaccuguuuguaucuuacagcaugacauuauuucauuugacagugcuacugauuuuaauuucccucuuugggggaaauggguucagacucagugccugucacgugguaagcacauguucuaccacugaguccugucacucucccccucugaugcuccauaccaucacuuaguaaaaguacacgcagccaggcaugguaauaggacauagaggcaggaggauuucaaauucuagcuuaacuugggucuagauaaugagacucuuuucaaagucaaaugucaaaaacaaaauaaaggaccaagcaggguggcugccagggcugauaaucugaguuucaucccuaggacccacaugaugauggaaggaaagaagcaaacccccuaaauuauccuccaaccucugcacaugcacuaugcacugugacacacacacacacacacacacacacacacacacaaaugagggguuaaaaauauuaauuuuaaaaaauacuaauuuuaaaaauauauaguauggcuggagaggcggcucagaacuuaagaauacuggccucucuuuuagagggucccgguuugauucucagugccugcacaaagcagcucacaaccauuggcagcucuagucccagaggguccuacacccuuucugggcucuccaggcauucgaguagugcacaggcacacacacaggcaaaaaaauaucuaaacacauuagauuaaucaaucaaucaaucaauaagcaaacaaacaacucuauaagcaaguuaaauaaagcacccucauugcauuuaaagaauguguucaguccaggcaugguuguauaugucucuaaucucagacaucaggacacugggaagaauuacugugaauuugaugccagccuggucugcauaacaagauauugucuuuuaaagaggcuacaggggaauuuuuaaaaauuagagccuuuauauuaggguuuaauuuauaaaaaguaagagaaaaaagcuacccgugugugugugugugugucugugucugugucugugucugugugugucugugucugugugucugugucugugugugcgcgcaugcguguuggauggagauaauaugcugaggaugaacacaagacaagcuguagauguagcucaguggcaaaguccuugcgcagcaugcucaaggccuuggguucaaugccaguauugugaaggaaaauuacagcgcugggcagagcagagcccucaacaagcagauaugagagaauacaaacuuacucucaaucaacagggucauagaaagaguacccuagcuguguuggcauccaagacuuaugacauagacaaaagagagucugucccccucgauucugguuugcagcccugucugauccaaggugcacaggaccucagccucaguucugaacuuuggcuaggcagggauuuuauuuucugcccaacaccugucucuguuucucuucugggaaauggcuuguuagcuuugguuagaaguguuuggauaguagcauugauuacuuagaagucuuuugauagcaaggacaaagacuuccuuaaugccuguaguaaagcuguugguucucaccacacagcccugaguuucuaacaaguaaaggaaagccaggcuucccagcucuguagaccagcugcacaguaccugaugaauucugucccaucccacuucuccaaugcugggauguuggcuuuuggagggagauugugggagguugcugauccaaauggcaguggcauuugaagauggcggcuagcaucaccauagaaagucucucucgggcauucagacgaucacaagagaaaccccauguuuccuggguuucugguuuaacuuugugcaagugcccaagagaccaugcuggcugaaaggagcccuggucucuacuugaagugacaguccagcccaucucaagagagccccaaucaucccaacaggaauugauuccugacaaggccuuuaucucaguguagaugaccagagcagaccagccacaagggcauuugacucacagaaauguuaagagcagacuuccaccaucuggucauauuuaugauuucugggagggcguucugaguuuguuuuauguggcaguaugcauucaguuucuuuucgguuuagcaaaguucuccauacagaguauuuucaguguuuuauggcuucacaccucagcuuuuaaccugggguggggguggggcaguuuuuacacggaugcauuuaauuggcaugugguccauguguucgggugugggccccagcaugaggucagaggacuacuuguaggagucuguucuguucucugcguugguucuggggauguaaugaaguuaucaguccucgcagcaacuuccuuuagccucugagccaucucaguggcccucaguuuguaauuuuuccccaguaggauuugggugugaaacagucugcuuuuacauucucuggagucggucagugcccucagccacuaaggggcuucauugcccuucccaaacaguagcuugagcucucuuguaccccagugucugcucuagacuguugauccucucucaggaggcaggcugugcggccuggacagagcuuucugcugugcuuaguacuucaugcaugcuccucuuucaaugugcauguugccuuucaauauccaagcuucuccaguauucaggaugcaguugauggcuggcucauugugccuacguggaagacaaucaaucaaccauacucguuuacagauaaggaggccaaugucucucuacugguaccacugugucguuucugcuuggggucucagcccuaggugugaacucucagccuaguuaaacuguggugugugcaacaaucuuguucgcuuccccagcccuuugcuaugucacuauccucagagucuagccagugugcuccuagaagugcuagcagcuuaccugccugagggcuuccuucuccacucaccuaggaaacacauugcuuucuccuuaucucccugugucuagcagaccuucagucccuacugcaguuccuaggacauacguggcucucuucguggagacuuggaugagcaucuagcauccugccagugccugcucaggccauguggcucacugcucuguauaugccuuugucaguucccaguggcagcaaccgaccuuguggcaacuccugccaaacugccccucggcccuagacagacaaaggaggcccuugucacuccucagacacuucauuucagaccugaaacacgaccuugccugggucugauguaucauuuauuuuucuucuugcugccacaaaaugccugauuuaaagaaggaaggguuauuaggacuuagaguuaaaggcgauacccuccauggcaguaagaggaggcguggcgguagggaaggcguggcgguagggagcuggcccuucacugcaucugcagucgggcacagaggaggaugcucagcucagcuuugcucugcuugcuuucuccauuuuauccagcuuaggaccccagcaugaggaauaacacugccuacaguuaguguaggucaguccaccucaguccaccucaucaagauaaucccucaccauguuucuuggugagucuagggagccugucaaguuaauaaucaguaguaacugucgcagugccaucucuuaaugcccaaacacaccccuuuuuauguugcaacccccgcccccugcuuguucuuguugucucauggcaucucacaggcaaaauguguucaguccaacuucaacaguuuccauugucuuaacaguuucaauacuguucauaaguauaagugcaggagcugguuaaaauggacuguugcucuucuagaagaccuaguuccuagcugaguucagauccuagccagccauguugggcagcucacagcugucuguaacuccagcuccagaggaucugacacccucuucuggccuccauggguaucuucacuuacacaugugcacauauacacauacauaaauaugaaaaaugcauccuuuucuaaaguguaagugcacucgucucaucugagacucgggccgccucuucacugugaacaccuguaacaucaaagcccaaguuccaugcuccuaacauaaaccggcacagagcaaauacccacauccccagaggaugggcacagcaacagggcagaacugugauacccagcauggcaaacaccaaaaucuaaagcuccguugguagcaucuggggauugugacagaaucgucugggcuuggaggacuuagguagccuugccacugcagcaauguugccuggaaaccucccagccucucucuugagcuggcucgccuuguacauucaguuucccucugaggguaucacagcuacagucucagccccugucacuaucacaaccccuguuacagucacagccccugucauagccacaggcacaaccccugugaacagucacaaccacagucacagucccugucauaaucacagccacagucacagcccaugucacagucacagucagucacagucacagccccggucacagucacagccccugucauagucacagccacagucacagccccuguuauagucacagucccugucauaaucacagccacagucacagcccaugucacagucacagucagucacagucacagccccggucacagucacagccccugucauagucacagccacagucacagccccugucauagccacaggcacaaccccucugaacagucacaaccacagucacagccacugucacagucacagccccugucauagucacagccacugucacagcccaugucacagucacagccccugucacagccaaagucucugguuacagucucagccucuguauuagguugagagucagcuacaaccuuuucuuuguuugagaugcacauuucuaauacccccucccccaucacucuuuuugcucuagaucuggauaagaacaguaagaaccaugccacagacagucaccagagacuuccuccaccaaacacauuaauuaacccauuuuuuuuuuaaugcagcgucacacaaguucucagaacacgggcagaaugugcucagguucuucgccagaagaucacacgagcagacuauaacccaguuacuuuaggaguccuugcuuguucugaaaccucgugagccaucccucccacuccucacuccuuucagccucccgaucuucccagcagaacagccuaguaagcccagccuacagcaguucagggcuucuuaagcuuacagauccaaacuccacauuccucccaaaagccagucccaagcaucaccagccaccuggucaggauuaugacacaacggcuauacuucuugguacuaauuuuauauauuaagaacuuuucucagugcuacaaaagcaaaaaccuaacaugaagccaucgaaggaagaaaggauuucuucuggcuuagaguuccaggggagucauuucacuauuguagagaaggcauggcagaggaaacgggagacuggcgguccucauugcuuacauagucaugagguggaaauggacgcuaugcucagcuugcuuucuguuuuauauucagcauaaggguuggugccacccacauguaaguggggucuucaccucaauuaaccuaaucuaaauaaucucucacaggcauacagagaaagugguuccagaucuugucaaguucacacucauuacuaacuaccacacauggccugcggcuggugaagaagcuagucacacuggcuaccagggcuggcaacacuuccugcccacugcucuugccuguuccccagccgugggcuucagcuguccccguucaauagcaauucugugugugccaccaucucccucuugggcucuggcuacaagccacacuugacuaguuggugaagguaccauuuguccuucuggcccccuccccucuaauugugcugucucccaaacuuacuuccuggguuagacaggaaaggggaugagcagaggccucuguuccccacauuuuggccuggcagcccccagcgagaaggaagaguaacuuguugagugagucuguggaccugcaccccaaggaguaucaggcauucaccucacuuacuccuuauuuaaccugagaggcagaagcugccaucaacauuuuguaacuagaaccacuagggcagaaaggaaaugacauacucaaagucaugguagaacuaccauccaggccaccagcuugccagcccuuggaaauaucucuguugguuaaguccagcuuucugaaaagaagccaagugugcacccuccuagcucugcauucuaaaacacuucucuccauccuuucuucaaucucaugacuuaacaagcuauuggccaaguaaaacaagcuucagagucaucagagggcaaggccuggugucccuaagaccagguugugcuuugugggccauaucuguuucuuuucucauugcuuugacugaaaagaagcaacuugguggagggagaguuucuuuggcuuacaguucaaggggagccagucaggaaucagagggagggauaaaaguugguguucacauugcuuucuucuucuucuuuuuuuuucauuuuaagacccuaagccaugucauggugccaccugcauuuaaggugaaucuuccaaccucaaugaacucaaccuagaaucacccaggaaguugacaaucaguauuaaccaugcaaaugaguuuuagauaagagaguugguucagccauacccuaacacaccucucuguagcuguccuucagaggacauugaguggccacacaugcagugcuaugucagcgcgucauuuugugcaugaagaugaaacuggaauugacauucucucaccauccauccagugggcucuuagaaucccuaugaaguacacaucauaccuccacuuugcagcaaggaacucaaaggucagggagguuaagcaguuugguuuaauggagaauuguuuccagugcugaguuccuguaacccuaagguugagcauccauaggggcuggcacugagaccugccacugccugggguggccuggccauguaggugggucagucugggaugcugaaaagcacaugugggaaccaacaaugcuuaccaacuggaggcagcccuacagucucagccauccuccacagugaucaucaaccaguggaaacaauacuugcuacagaaacacagccuucaaauggucuccccugacaacucccuccagugguccuuuaagggggccuucugacgucugcuggucugaagauucuucuugaugcucagacucugucuuaguuaggguuacuauugcugugaugaagcaccaugaccaugaagcaccauugaccaugaagcaccaugaccaugaagcaccaugaccaugaagcaccaugaccaugaagcaccaugaccaugaagcaccaugaccaugaagcaccaugaccaugaagcaccaugaccaugaagcaccaugaccaugaagcaccaugaccaagucggggaggaaaggauuuauuugacuuaacuuccacaucauaguucaucacugaaagaagucaggacaggaauucgagcagcacaagaaccuggggcaggagcugaggcccagaggccaugaagcagugcugcuuaccggcuugcccuucguggcuugcucggucugcuuucuuacagaacccaggaccaccugcccaggcauggcaccacccacaacaggcuggggcccccgacauccaucaccaauuaagaaaauacccugcuggccuguugauaggccaauauuacugaggcaucuucucaaugagacccccuccuuugcagugauucuggcucgugucaaguugacauaaaacuagcuagcacagucuuaagcaggaacagauaaacugugagcuugaauuugaugggaaagggaggcuacgaggacuaggaauccuguauuccaaggcuaggccugcaugccaguuccuuggcuucugggagguggucagagcaggacccagggccugucuacacauuugccuaggcugcugcucuccccacucauugggcacuuuaggcgugugugucuaucuuuccucugugccagcauuucacaucuccucucuuuacuguaaaaccaucaaaggccccucugaggcuucccuggcucugaccucuccaaggcuaaccucaggucugacccuaaugacagacuuaguguacaugacauacuuucugggaaaucaugagauccuugccaaggcacaggaggccucaaagaacaaaggaaucauuucugguuguucuucagcaggcgugugagcauagccacuggcaccaagaugcacauucuggggacaggcuggacuuuguuccugcccacacuccuugcuuugugggaacccauggaccucugugauucugacauacacgucccacuccauguucucacuuggaggucagaagugucagccuaggagacauccaaauuuucuuccuucugucacuaauuuugcucugcugacccuagagaguacgaaggaacagcgaugacauaaaucuuugggucuggagagggaaggguagcauugucccggagucagcuugucauuauguccaaguucccauuggcaacacuuaacuacuaaaugacuugcaagcugagcaugcucagaaaggccugggaaccugcaugggcucuguguuggcaagaagcagcguuuaagaaguuuggaucuguugacuccaaacaugggcuuauuguagcuggucugugcugcuuuguggguucuucuuucuuccaccuuuuucuccaaaccccuaagccuagauaggagaauuaaaaaggauagagacaaaagaaaagagcucucugacuaaagucagggauuggaaagcaggcaaugguauugcucggcuacuuccugcugguugggugcauugaguuccuuggggcaagucugaucuuugccaucaggauaucuaacuucuuguuguuucuucuuugcauacgauuacuuaaugaaugguggccaccaaugaccaccaccaaccaaccaacaaucuacccuacaucucagggcccuagcauuuauacauacccucugaaaagucuccagaauuccaaaugucccacaauugcagaaacuaucugcagcuggcaaaaaucacacccuugcuagagcacgaggcaaaucauagucagcugcuguguacagucugaagcagcccaauaucucacaccuggaauuaaaaugaaaaccuaaucuuauaauauuucggggggcgguuguuuuuuuguuguuguuguuuuuguuuuagauuuagauuuauuuuauuuuuauuuuguguauaugaguacacuguagcuaucuccagacacaccagaagagggcaucggaucccauuacagaugguugugagccaccaugugguuguugagaauugauuucaggacgucuggaagagcaaucagugcucucaacugcugagccaucucuccagcccuauugcugugcuguugguuuaaacaaaacaaaauuccaaaauugucacuacagcuuacccuccccgccccacccccacccagcacugcaaggagcagagcaggugcuuccugagccacagcugguggcugcgcugcuugcucccuggggauugggcccugggaugaaaaggugucugcugcugcugcugcuuucauucauuucaugcaaauuaucuaaauaacuguuuugccugcucgugugucugugcacuggaugagugcagcgugcccacagaggucagaagaggucaucagagcccuuggaacuagaguuauaguugcuuaugagucaccauguuggugcuggaaaccaagccuggguccucuggaagaauaagugcucuaaacagaugaucugucucuccagcccuguauggccucuucuguccauuuggcuuccucaugugucaagaaccacuggggaaaggugauuagcccauagaaaugacacaagaucucacagacuagauguucccaggacggugacuguuaaggauuccugguccuuguuuggguucucuuaacuguuaacagucuccagggagcaccuccauggagaccugggagccucuguuauucccaaaaggaauaaagauggcgccagaagcuccccauggggugccuaggcuuguguaagcauuuuuauuguuuaugcccccaagggcuaggucuaguguggcucagugguagaggacuugcuuaccauggguuaggcccuggaguccauccgcaguacucccaauaaaaccacagcagaagaaaacaacacaaagcaggcauacuucucacggccuuggguagugauuaacugugaaccugaacuucagccaccaaccugaaggcuggccaagguuuuggccucacagagcuggcaggaacgaacuuauuuugaauagaagcuucugccugaucccuuuggcuugcggacuauugaacaauaguccccugagaaauuggaaauuccccaggaauugcaugcugggagaaggaaaagcugacgccuagugccagccagaggcacagcuugucucccagaaagagaucucccacaauucugagaacuugucagaauaccuuacacgaaagacuggaacaaagacagaugggucggugaugagcagagccacacgugaccaggucugcuuaguccuauauaccucuugcuuuugauuuaaaccaaaaccucauuuuaggaccccccccccccagaaaaaaugggugagggugugguggugacaggguuuacuuaaucccuauuuuuucuucacaaugugaccacauugacuaaauaucuuuucucuguuuuuuuguuuuguuuuguuuucuguuaggcauuuauuaauugguccacugagggcagguagcugagcauaggucacugggcugccaaggccaggggucugauccaaacucuaauaaaaaugcuagcaugagcagccaagcccaaggaaauuggcagcugcuagccuuguuggacccaguuacagguagauuggaaagagacaaggucucugcugagaaggucgaugcauaaagugggcuggagguaggggaccagauucugguguucacugucucucuuuuuccucaguauggcaagaagaagcugaaauaccugcccuacaaccaccagcaugaauacuucuuccugagugaguaugguugccugagggccccaacccugcucucaccacagcaugcccaucuggcucacuuccucucauacccuuuucaaacugagaaaaugauugcaaaccuauucaagagaggggagccagcagucagcuuguggaaacaccucugggcccaguuaagcaucgucuaggcucccaggcuccucucugacaggcacauguucucucuucagucggaccgccgcugcucaucccuauguacuuccaguaccagaucaucaugacaaugaucagccgcagggacugggugguaagucaggaagugacggcugguggugggguagcgugacuagggcacuuugccccugccuguggauccccagacagcuccccuaaaguguagcugcuuugucacucuugggaagaaacggucucugaggccaccagagccaagaaggccauagcaugucaggucuaaagacaccuggcaaccauugcccuugcagaguuccuuagaaaguuccugaaggcagugugacaagaggcuaaccuagcccaccaguaguggauaaccuuagcaauagaaacauauuuucuuucucacucucacaaagucuaaaaucaguugccaucgggcugggggguaagguggagggguccaggucccuguccuugacugguaggugaccagguucucuuugucucucuuuacaucaucuucccucugggccuguccacaucuguguucagaugucccccuguuuuucuaauguguaugugugugugucuaugguugcauguaaauuuguaggugugcuuacaugugugugcauguggaggccagaugacugucuuaguuacucuucuauugcugugaagagacaccaugaccaaggugacuuguaaaagaaggaguuuauugagggauuacaguuucagagagugagaguccacgaccaccauggcagggaagauggcugcaggaaggcaagcuggagcugaagcucagagcucacaucuugagacacaacugugaagcagggugcuaauugggaaugauaugaaccuuugaaagcucaaagcccacccacagugacacagccccuccaaaaacaccacaucuccugauccuucccaaacaguuacacaagcuagggaccaagcauuccacuagaggggccuaugugagagcauccucauucaaaccacaagaaugucaggugucaccucuuuugagauacggucucucacuagccuggaguuuagagauuagguuagacuauccagcaaggcccaggaucugccugacugucccuccccaacaccaagaucacaagugugugccauugugccuagcuuuuguauggagguuuuggguauuaaaguugcaagcacuuuaucaauugagcugaaccccuaguuugucccuuucuuauaggaugacacuaguccugcugcauuaggaccuauccgaaugagcugucuuaaugaguucuauuagcaaggacugugcuuucaaagauguugucauuugcuggagguuagaugucacuguaugaguugggaagguaugucagaguuuuaaaagagcagaaaugauaaaacgaacacacacacacacacacacacacacacacacacacgauuacuagaguagcuuacagacaguggucagaauagcacaauggcugucucugacagaaaagccagagaucugcaugucucagaagucccaauuugaugcuagagucccagaggauuccuagagaguaggcucuaacaccgaugaaggaaugccacagcaacaagguggaugaacuugccagcaagagugagggcacgcaucgaaaagcaaaagcuucauucuucugugauucuuuuaguuuauuccagauguagucaaguugacaaccaagauuagccaucacagagggcaugcuucuacccaaaacagcaggcuuagagguaccuccauggagggaggcaggcuguguauagguuugagaagguaaacuuggguuuacauagaaguacaguugugguuuuuguacaccucaugguagaguaagcucuaaggaauacucaccaugagcaaagaguugucuaugaugaaaacauggucccugcccucagaagagaacggacaagugcauaggcccuuaguggauguucuuagccuuuuaaagccccaucaaaggcuaggugugauagcacacaccuuuaauccuucaccucuugggcucuccauacuuuuauuuacuuaauuuugaggugggcucucauuauguugcccaggcuacccuugaacucagucuuccugccucuauuucccaagccguguguguguguguguguguguguguaccacauccuaugcauauccacacaauauacacacauacauacuuaugcaauagauuaaagugggacugggcauguggcuuaguggcagagugcuugccagcaugcaugagaccuugaguucaaacucagcaccaaaauaaaaaauaaaaaagaaggaaaaaggagagaaaguaaggaugaucaaaggacaaguagaacugcugugccugcuucacuuguccccgacagccaccuaaaucugaguacgucguauucagccacuccuggcuguuguaacugcuccuacacuggcccucccaaggugcccacccccuuucuuacuuagcuggcagcacucugacaaccuggaaugacgccaaggaccugcuucaauuucuugcauccaagcaagcacugaacaagggccacccuuguccccuaaaucguucuggaauuugccaugucuucacuaaugugaucuugguuuuguucuucauuuucuaucugaacuaagacaccggugugcccgauucuguugucauuuuaagaucuuuuguuuuguuuuuaaguucauguguauguguuuugucuacaugugcacugucuggugcccacagaggccagcauauggcacuaggucaccuggaaguaaaauuacagauggccaugagccuccguguggguucugggaaucgaaccuguguccucuggaagaguagccagugcucuuaaccacugaaccaucucaccagcaccucuguguggggucucccuugccucaaagagguggguccuugaugaaauaagcuucugcauaagcauggcugcuuaugagcacuccugacugcagaaaguuuguguaaaggucuagagagaggagcagagagcuuaggcaagaggaccuguggggccuguagccuguggccuauggccacuuggcuuauaggggaggggguuguagcaaagaguugggaucugcuacaggucaucaguugcccuggaugcaugaggaccaucagguggagagcaaagggaggcucuugcuguggcccagccaagacacacagcuugaguagcagaggaaauggaggcauguggauuucucagcagaaugacugcuugugaggcugugacagagggcagaggcuuccuaggggagucauucaagcuugggaccuugcuaccaaagagaagcagacaaagugaugagaggagaggggccaagaagagaaucuaaccugagaagagaccuagucugggucgcugacagggcugggguauguccagaaaggaaggaaguccaggugcccgaauaggggcaaggcaaggaugaccagugaccuggccacauguuagaggcucacaucagaauccucuggaccuacuggcuaccugcuagucaagaucccauuucuuuccugaaacucacauccaaacucgaugcaaagaggugguugaggcaacuguaugacugggcacaguguccaacuuccuagcagucugcugugguuucuuaugaacaccugugacaagcagugucagcuguguauauacaugccccuguggucagcugcaccaugccaaggaggguggggcagguuaagucuaaucuuauuuacccuacaggacuuggcuugggccaucagcuacuauaugcguuucuucuacaccuacaucccuuucuacggcaucuugggagcccugguuuuccucaacuuuaucagguaccccaacuuugcugguucacccugugcuuuugagagcacuggcuuugccggggcugugaugugaacccugaaccagccauggggguaggguagguacaguggcuuuuuguggcugccuaucucccacccugaggcuucggcacugagcucugcugucuucuagguuccuggagagccacugguuugugugggucacacagaugaaccaccuugucauggagauugaucuugaucacuaccgggacugguucagcagccaggugaggggaggcagagguagucacgggggcccuggaaagcugucccauguccuugccugcacccugccucuguggacccagggcuauacaaaccuucccuagggcuacuuggugccuguuggcagccucagagcaagaaaggaugguaggaagauuggggacgcagcucaguugguguggcagccucaguuaagcaagaaaggaggguagaagguuggggacgcagcucaguugguguuugccuagcaugcauaaaauccugggucuuaucucuggcacccaauauacucaauguggcgacccauaauauaaucuuaguacuugggagguggagacaggaagaucaggaguccaaggccaggauaaguuaaaaacaacacagaaggaaauauggaaggagugauaagaaucuaccagaggaaacuuggggagucugggagggugaggcuagaaugguaugaccuagagagaggcccuaaaacccugguuaaggugaccuuuaugggguaaguccagguccuuugguuuuguucuuacacaccagccacugaugcccuguccccucugcagcuggcagccaccugcaauguggagcaguccuucuucaaugacugguucagcgggcaccucaauuuccagauugagcaccagugaguacagcccagcaauguuggggguguggggggaagaggggagacaaggagcgggagggcaguggccacuaacccacaggccaagggugccaugagguuuaucuucucuucuuggcaaaaccaccaccaccccacccuagagcacagcugggcaggagaggggcucugggaucagcgugcccuggaggcauugcuguccaggcucugugccacaugggccauccuggggacugcacuccuucacguguggccucuuugcagauauagaaagcuuacaagacuauccugcagaccuauaaggggccugguuauuggcugggaaacugaggaccagcuagauagcauaucugguacacaggggcccaaagggucccugcugccugcugccucuuccuguaucucucaucuuuucuuauucuucucaucuuccauccguuucuuucauuuccuuuuuuuuuuuuuuuuggcuuaguguugaacuuacauaggucuucugccuuggccucccacaugaugaggccaggggcgugagcccugauacccuuuuucuuuuuguuuuuuaacauaagacucuuguguuuggcuguucaauucggcuuucugcagugccccuguucauaaauugccccucuacacaccaccaguaacaucuucaggcaguuggcaggagccacagucuaguccugguuuaagauaggaccucagcccugccugccucccuggguuggagaggagguggagaacaugggucuuggguugcacucacucugcccaccugcucccccagccucuuccccacuaugccacgucacaaccugcacaagauugccccacuggugaagucucucugcgccaagcauggcauugaauaccaggagaagccguugcugagggcccugaucgacauugugaggugaggggugagcuccacaagggcugaagcucuggagcacuggaaggggccagagaugagguggggcugaggaggugagaggcacauggcuggccuuacucacaguagggacucuagcucacaguggggauuccugucuacccagggcuagaagaggaccuccccucucuccuuucccagggguuucucugggguguauuagucaguagcccacagcuccugugguauccugugguaaguggugagcccuagucaguagcugagaggaagcaccugccgccccaacaugacuucccacaagucucacugccuggaggccgagguuccuuccaucugguuccugagcccugccccccucucucuauuugcaguucacugaagaagucuggggagcuguggcuggaugcuuaccuccauaaaugaagcugccguccuccgggcacccucgggaaaggggcacuguugggugacagccagagggaggggagggcuuuuguucugaaggguucucaugagacugaagugucugcugccucacauuccccgggcuugcauccuuucuuguuauuccucuucccucaccccuaccuacuccauucucauggaguucccccuuugucagcccugaccccauccccucugccucccagucccuucucccagagagccggagaggugguugucucaggugguuacgcgucugccuuuaacuucugcaccuaaagauuccugguaugagauucugcuccuggcagccuaguccccacccccuucugucccacagacacucugggggccuguggaacaggaguccaggacuuggcucuacacucccugucagcauuaugguguagucauuugggugaagacaugcuucguucugagugucuuucccauggcugggauugguacuugaggcuucuuuccagcugccaaggaccaccuuagacuuugaggaccaaggaaaaguucucucaugcccaccaucacaacuccagaccauaggguuuguacagguucuauuucaucaucuacccaacuccagaaaccaaagggaguguuccuugugcgggcucaggagaggcaguagccagguugaaggagggacugaccagccuggaacuuuaaccucucccacuacagucaggugcuucugaguuaaaaggcccaagauucuagaaggaucagaucuuuuuccagauccucuggccaguuccagaugcuuggucuagagaauguggaccuugcaggagagccccugagcagcucuccccaggauagagcugccaaucuagccagcacuuggcuucuuuuuggcucaucccugucuuuacagauguuuguuugcuuguuuguuuuagcuguuguguuaacauuuccuacagaauucuucuuaauaggagaguagcagagggcuggcugggucuuaggacaauccaucuuuacuagaugucccuugcccuucagguagagcuaggcuucgccuucaaggccacaguauacgcuguggcuugagguugcugcuaucagaaaggcaggaaaaacaggguagggugugaggucucaggagggcuguuggggguacccagugaggcucaagcaggaguguagagggaagaggaggcugagggcaugagggaaaugugagggcaggugggaggggggacgucggcuauagcaggaggggacccacgcuaugucauucugaggucuaacuggacuaaccaaccaauauguaaacuggaggaaaaggcugggccugcacagggcaagcccucuaggacuccaugagccaagagagaccaguugguauuguuccacagaggcagagaacccauaggagauggcagucauuuguaucaucuuguuccccgccucuacuuuuuugggaaauaaaaaaaaaaaaguaauuuuauucucac

SEQ ID NO: 9173 - RNA, 13989 nt, Mus musculus
cgguccgcgccaagggugcugaaaacccugcgcgcgaacggcggucuccgggcgcgcgcucgaggcagcccgacgcuccccuaguucgcgagccuggcgugcgcugccccgcggcccggagcgcgcaccucucagacuccagcuucccccgccaagcuugcuauggcucccgacccggugccgaccccuggcccggccuccgcccagcuccgccaaacgcgcuacuuuacuugggaggagguggcgcagcgcuccgggcgggagaaggagcgauggcucgugaucgaccggaagguguacaacaucagcgacuucagccgccgccacccggggggcucccgggucaucagccacuacgcgggucaggaugccacggugagagcggacaauaggcgcaucugcaccucggggagggacauuggcggggagagaggccuuugaacccgggaugcaagcgccugagagaccggagcgguagacgguggccggagacacgcacacucaaacaaagggcugguugcacauccgugcuuugccucuggagucucaagcauggguuggauaggagggaaugagcuuuccaggcacccguucaacgguacuugcaaccuccgguggugggaggaggagucugagcagagagugggagucgcguccugucugccaggcuaggagggugaacacagccuugucugaccuagagaacuggcccuaaguugggauucggagcggaaaggaagugggaaaggacugcuugcgcuagggaugacacugaggacccggugcuugggcaucaccuguacauugugaagcccggaggguaggguaaugaaccugagccgguccaagacagcuugcaguuggagucguaaaacuguacucggauucuuagugcgaggucacuugggccagggaggucgacuauugagggaauagggcucccgcgcgauuagacacuucgcggggucgcgucccuuuuccguuguagcuuacugaaggaagagucaguacgaaccccagcuucugucuaguggcccuguuuucucuuuuuagaccauauccucccucagaggcgagggccggacuaggaaugacuuaggacagagcauucuuugacaggauugucaucuguugggucucuacauuuggguccaucucccuuuuaacuaccuaaugccaucccuccgaccucuuacuccuugucugccagucuaacgugcucccgggguccucaggguuccuauuaaguugcccaugaaguuagagguggagggccuuagcgaccaggcuagaaggagccgguuucuagaaguaaccacccagaauccaaacagcagugcauuccuauaccgguucaugaaaggauggagcagacccgcuccgucuaggcuucccauucuguguggcuugggggccuaggauuucauggcaaggacagcgauuggucuggauguguggugccacugaccacggacuccaccuccgcuuacagcuuuuuuucccuaaggcccucccacccaccuuguauaacccauauuaacuauuccggagcgggaauggucagaauguugagggaaauagggaacccugcccaaaggaggaagaaaugugaagaguuccccagcgcuggcauagguagggagucuuccucacaacagaagcuggcuaagaaagaaagggacauguugaaaguacuguaggaacaaaaaccucauagccccaccuauucccgcaagcugcuucucuccugugcuaaauuccuacaccaagugucuguagacaugaaggcuagcuucgucagguccguguuuguggcauucagcggagucuuuccagucuuugguguagugcccuuucaguggaaacccaaaugccaggugaucugggacugacaucuggaagaacaguagggaggagggaggaggccuugcaucagcauugaugcaaaccuuguugaccuggaggauggucuuugaugugaggcccuugggagccugggagacagggguccucacugucuucucucuguauuuuuaggauccuuuuguggcauuccacaucaacaagggucuugugagaaaguauaugaacucucuucugauuggagagcuggcuccggagcaacccagcuuugaacccaccaagaaugugagaggccauguuugcuguuuggagacuuaguuguggagggagagggggcaaaugccugcauaggaucacaggugacgguucuugggagucuugaguagucaugggguaauaagcccacuggagcuuguuccagugcuacuaccaccgaugcucccaucaccaguccucccaccaguagugcucucaucaucagugcucccaccaguaaugcucccaucacuaguacucccaucaccagugcuuccaucagcagagcucccaucacucguauuccuaucaccauugcucccaucaccaaugcucccaucaccagugcucccaucaccagugcucccaucagcagugcucccaucacugacagcagaccuauuuacugagcaucauguaccaauguaaacucauaaaauacucuucauauaugcacacauaagaaaacacgcucagagaguuuaagcugcagagacccaaaguaagucuguuuagcugccggacaugaugccauuuauaggagcuuuuccuauccuccuuccccaucaggguaucuuugccuaagacuguggacuucccacagcuaccugcacgggagguucucuucaaggguuaggggugccacugagaagaauuauagcccccgucucccacagaaagcgcuaacugaugaauuccgggagcugcgggccacaguagagcgaaugggccucaugaaggccaaccaccucuucuuccuggucuaccugcuucacauccugcugcuggauguggcugccuggcucacccuuuggaucuuuggaacuuccuuggugcccuucauccucugugcaguacugcucaguacaguucaggugagaguggcuuugccugguuauucucagaauuccuagcgaaaacaucaaggccaagaauccuuccuggggucuguagauucacaggagacucggcacagggagagaacacacauucucugaaauuucagguucagguucuaccacagucccaaggaugccaagaaccaaugguuggcucccuucccaccauugaugcuacccaguauagugccagccaaucaugguccggcaccaggauuuguacuaacagucuguuuucugaaugccagucuguccuaagucauggcacuucagaggaaagaagggaguauggucugccucagcucacaugugacucaggggccaagagggaauuggaaccuggguuccauggcuuauccuaaugugcucccuuaagguacugcagcaauccagaauggaggagcugccaaggucugugagaaggccuuagccaggccggggcugcccugagcacuaaccuuucuccuuuaggcucaggcagguuggcuacagcaugacuuugggcaccugucagucuuuggcaccucgacauggaaucaccugcuacaucauuuugugauuggccaccugaaggucagugagauuaucggguucccccaagccccagucauucgugguugucagaguaugggagaugugcucaugacccuggcuuuuguuucuuuuaaaaaauuauuuauuuaucuuaugugccuggguacccugcuugcaggguauaucuguaugccacgagcaagggcgucagauccccugggacuagagucauagacaaguugugagcugucgugugggugcuaagaacugaagcaggguacucaggcuggguuuucauucgcaauucucuguagggggcccccgccagcugguggaaccacaugcauuuccagcaccaugccaagccuaacugcuuccgcaaggaccccgauaucaacaugcacccccucuucuucgcccuggggaagguccuuccuguggagguaagcugggugugagugcagaggggaauggaguggccuguucugcaagcugaagggaaagugcuuguuugcuguuaucagagaugguaggacaucaggggcuaagcugcagggcucuugcuuucuggaaauuguggagggcagauaaacggggacuguucaagaccaaucgguuagcaguuacugcacaaaacugucccacucuguagaggauucaguggguuauaggggagucugugcaagccccugcucaucuuugacgaugacugagauaccucuuuggggugcuguuugacgcccugcuccuggaaggccuguccuugcacuuggcguuucugucucuuacgucggguaccugcuguggcacagccugccuugccuaggacuuaacugucucacaugucucauauccguguccagaacacucgcucugaguacagcuggcuucuguaucucuagauuccgcaucaguggauuuaaacagauacucagaaaaaaaaaaaaaucacacccauccugaacauguacaugcuguuuuuaauuuauuauuacugugugugggcacaugugccauggcacacguguggaggucagaggacaacuuuuguggggucacuucucuccucccaccucuaugugggucuuggggauggaacucaacuuaccaggcuugcauggcaaauaccuucacccaccgagccaucucaccaagccuauugggauuuucaacuuuauuuuauuuuugguugugagcugagcugucucuccagcccaucuuuauugauuauuaugagagcaggugucagaggacaacuuaguggggucaguuuuuaccuuuucuuaggcucuggguuugagcucaggucgucagcucccucaaaagugcuuuuuacccucugaauucucucagggaggcgucucacccccuggaucuagacucuuccuaaauagcacauuaugauaacuauuuucugcauaguguuuacacuguaucagguauaggcaaucuggagaggguuuauuacaugcugggaggaggcuggauagagcucagugguagagcauuugccuggcuugagugaagccccggguucuauacacagcgccaaaaagaaagaaggauagagaaagaaaaaucgggagggagggaaggaacgaaaccaagcaugguggcacguacccguaaucccggcacacaggaaguggaaguaggaggauugagaguuugaggcuaaccuggguuacauagcaagaccuaacuaaagcgagguggggaggaccaaagccuaucucccagccugcggggcuaggagggcauaugucaguuauugcaaguaggaugccacuucacgcaggggacuugaacaucuguggacaccuggaaccaauugugaauaccgcuguacuuuucccucccauuugaggccagcccgucuuucagcgugaucagcauuggcuuugaguagucagcugaggcugagagcugaugggagaaugcccagggguggagagcuggugaacucgccuggcauaagcaauagaagguuccgaaugcccagcagaguuccuugaaaaguuaauuaaaaacccuccccggagcucugccagcuccccuccccccaccuaauggcagcuguuugaauuaagcuguugagcacaguucauuuucaggcaucaguucaagguagucuggcugcucuguccucucuggcugaaaccuacuguggaagagccuuggcaguucuggcucugcuggcacagggcacucagagcuugagucuugggcuccaucugucccuaaagcucccauuuucacaguuuccaagcacuggccucagcuggucuguucuguguguucccuuuugcuccgucagcaaugcacgguagggaacuggcccgugucauucugaaacagggcagacugcucgucaggaagagcacugggcacuaagcacuucucuuguccccacagacgauuuugcugguucuugauacuguggcuuucaaggaacugugguccacaaacaucagaaagagagaguaggggcuagggagauggaccgguggacaaagugcuugccacauaagcgggaagaccugggauugaaucuuaagcaccugagcacccaguagagacccccagagcugaccucuggucuucacaugugugggcaaguacagcugcacacaugcguaccccucucucccucacccccacagacacagaaaacgagaacgaauggauguaggaggcaggguuuggucucucugaggacaucuuaccuuacugccaucugcccagugccuccuaacacucuuggagaacaaagugguacagggaagacuuugcccucaacucuuggaacucugagagucuaagcacugcgggcagaccauaauguucuugaucacugucuaacgggguagcaguggacaggguucuuucccauagcaguccccacucaccccagcaaccaagagcggugcuuugcuucuauggaaucuccuugguuaaugcugugaggcuucuuuagcugucuccagaucguaugccaauuccaucaaauuauccagcuccagugcccccauuaucugguaacuguccaauuugcguugcuauaauaaaauacccgaggcuggguaauuuauaaagaaaauaugucugcuuaguuuauuggucucagggacugaaaguugaagauggaauagccccagcaguuugcaguuugccucuaggacgagcccugugaaggaugccagacaucggugggaguggccgugaaagcaaauggggugagauagaagcuagauuagucucuaaaacaauccacucucaagcaggaacucacuggggucccacuggaaucauaggaauccccucagagggugauuucaucgacucucggggagcugugccucuugacaucacugccuuggugaccaagcaugcggcauguggacccuugggaaacaaaccacauugcacagcacccgcaugguagcacucagccugacccaucuucugcuucauuugccccuggaacuauaugugcugcucacuucugcaccucuggacaaagccagaacacacaaaaccacagagcagaccguauauaagugagcccaaggccugccugcaggacggaguagucggagacgcagcuuccugagggccugaguaaccuggccuucccuagcuuucugguguggugggccucgagggcucugguucuggcuacgcccuguacuuugaccgcuuuucuuuggauuugugcacaccugccauuccucauuauuuaguuaucagggcccaagggaggccaggccugagugucuuugccaagcugcugccuuucugucugcccugcccacugucuguccugcucucccccaucuguagucuguagaugaucuugaacuacaaguuuauuacccacuucaucgccucagauuauaagaucuauggagaugagaaugcccuacuguuuaccucugugcucuuggcaccucaaacagugaauagugguauacccucacuccagggcuuguugagugacuccgugaguguagaaagauugucucaucuagccaaacuggcuugcaaagaacacaguuuugaugaacaauuuauaggccuggcuguggauaugugugaagguaacucagaaugugcucugaguugaagucaccaaaacuaauuggggcaagaagugcaauggagugagacagcagaacacauaugaacccaugugaguggcucugggccagaugaauggucuggugagccccaguccgucuguucaguagcuuggcuuaaaauaauaauaauaauaacaacaacaacccacucagggggcaaaucuuugccaaaacccuucgaucgcugaguuguucuugguaaucuuucuacauauauuacuaaacuuucaaggggguuuaugaaacucauguugaagaguccauaagagaggcuggggauggcucacugguuaaaggcaugggcuuugcuuccagaagaccuggauuugauucucuggacccaguugggaacucacaaccaucuguaacuccgguuggucugcugcucucugcuggccuccacaaguauugcaugcacuuggcacauucaugcaggcagacacccauacacauuagacuuaaaaaaaaaaaagagucuaaaagauugugauggaaagacucaggccaccgauucaggggcaaaaauaguuuucuguuaagacucugagguccaaagaguaccagaagcaggaggggguugggccuggaaaccaugugacagagacuuagauagccaucaggaauccuguagacugacuaguguacacucuuguguguuccuugucauggcagagucauaggucacaagccagggccggccacuugcuccaggaacaugucagagacuuucaaagguagcaaaaagcuaaagguucuggaaguaggccuagagucaggacagggaaaguugguggcucagugggagaaacgggugucugucuggucucugcugcugacuugcguuuguuuccucacagcucgggagggaaaagaagaagcacaugccauacaaccaucagcacaaguacuucuuccucagugagugucagccugggggcgggggaggggcggacaccacuagaagaggccuagggggaaguacugucugcggaugccccuccccccacaaucucaauccuccacucuuccuuccaggaagaaacugagugguccacaggagccuugucuuaaaccuagucccacaaagguggggucaguuaggaugacuccuuggccagugggguccgagaagaaauuuguuuagcaacugugcagaagacgguuugcuauauccucccuacuuccagaaccugcugcauacugcccaaauuuaggccuuaaaauuccuuuaagaccucaaguuuuagggaccaguuuguggguacuuuugaugaguuuugagggcuuuuuguuuguuuuuguuuuugagagagagguuugcgcagcucaggcugacuucaaacuuggcaccuguaucuauuucaaguuuuuaaaggaagcuuggggaggcauuggaauuuaucuaacugcuuauugccaacugucccuucuagaaaaggcuggacaugguggaaggguugagucaagacuucuauaacaaauaguuuuaggucuggggagacggcuccguuaguaaagggcuggcuaugcaugugugacccgauuuuagauuucuaagcuccacccccuacccacacacaaaaauccagagguggugacacgcaugccuguagucccagugcuggggaugggaaggguccaugagauggcuuagcggguaaaagccugacaaccggaguuuagucccuggaacucacgguggaaggagaggaagcaacguguguaaaguuguccucugaccucaacauaugcacuugugcacuacagcccacacucacacauacacauugcacaucgggaggggggagggagggggggagggaggaaagaguuuuagaaucuguggcauauccagaugaagaagcuaugaguggagacugucaugccgagguugguauagcaucaggugugccucagacugugacaagucagcagaguccuuccccugcccuuugaccuauauaguggaacagugagaaugugacaggacugcggaggcagagcugugguccaggcacugagggaguauuaaugugcccuuuuaaaggccugagaguagaguauguuccaugcuugaggcuuaagcucccgcacgcccuccacgaagaagggauacugcucgcagccucggcuucuguggcauccguuugcagaguuggccuucucuaggcuuguguuccuggccaagugcucauagcuuguaguugauggaggagcgguggggcagcuaaggggugacaggaggcaguccugugcugggggccaucuuaccauaacagcccuuucuaaccccugcuugcucacuccuccaucuccuuuuccuccccagucggacccccagccuugcugccucuauacuuccagugguauauuuucuauuuugugguucagcggaaaaaauggguggugaguaucccuagcccgagagccucgugcaccagcuucuccagaacugcauagggaaaggugugcucuguggagcaugaagacuccaagguugacagagcaaaacagagccagggaaagaggcucuucucuagaugagaugacuuggccucaccugcacucugcuuccccauggcaggguucaugcagggcucuccuaagguucucaggcugcaccgcacuccagaacugcagagaacagcgggggagagauguagcgaauggucccugcucucugggaacguaggauuaagcugaaagugguaggccugugaaaagacaugcaguccaaagagacuuuggggauccucaaaagagaucuggcuggaccugcuuuuccaacuggucucagauguagggccuggggaagacaggcucugagcagacaagcugggaacugaggcgugagcucagauacugaucucaguguagaggacucaaguauuggaggaacgaguguagggcuugguucacugcagaaaaggacccagagcuucaaucuauaugguggccuagacagagcuuugguccuggaauguguaguagcauuuagacaggguaggaggugcuguaggcagggagacugaggggaaccucugugaagggacaggcagggggcugggguaucccuggggauguugaggacagugccacuuacccauucccucugcaggacuuggccuggaugcucagcuucuaugcccgcaucuucuucacuuacaugccgcugcuggggcugaaaggcuuccugggccuuuucuucauugucagguauggacauguggugggauguagagguuggcuuggaaaguacaggugacagaugggucugcgggcugugcggggccccagccccaggggucauuuggggcauuggcuugggaaagucacaggcugguguugcaacuggggaauaagaacuccaugguuggcuuguacugcuuauggccauaugccacauucaacagguuccuggaaagcaacugguuugugugggugacacagaugaaccauauccccaugcacauugaucacgaccggaauguggacugggucuccacccagguaagagacagucacuuggaagaccuggacaugcccccagcuacugaaaaggguagaugcuggacagaaauagccaaaguuguuuccucaaacaaaccuuguuaucuugagacuucucccacugagggggugaccagagauaggggaauaguuccacacagccuccccagggaagacccagcacucugacauggagaccugcccucccucuacuuucucccccagcugcaggcaaccugcaacguucaccaaucagccuucaacaacugguucaguggccaccuaaauuuccagauugaacaccagugaguagagagaccuaggaaacagggguggugcaaaggcggggaauggauagggaagcagaagccacugacuacucugcuguccccaaagccucuuccccaccaugccgcggcacaacuaccacaagguggcaccccuaguacaaucccugugcgccaaguacggcaucaaguaugaguccaagccccugcucacagccuucgcggacauuguuuagugaguaugagccugggaagcuggcagugaggaggaaagccacggugaugggcaugcggccugcggugggguggggagucacaggaaagauuccuggucaucagcaauggcaccgccaggccaauggcacgguguguugguccaugaccagcccgacuuccucuaagcaaguggguaaagccucugaggggaaggggaccuaucugcaggugaguggcucagccucccucacuaucugcuccuauugucccuauagcucccugaaggagucagggcaacucugguuggacgcuuaccuucaccaauagcagcagcagaccuccauauggaggaggaagaggacaccuggagccaaagcaggaguuggagggacaaugccacuaugaaucuaauguuuaaaagguuagggaacauggauauucguacucacaucugcgccccucccccuugccuucuggguaccaaacuugagggaggggagagcuguugaagcaggaauucaaaacuguuauuucuucuacuuuggcaggggagggggacaaauggugguaccuacagagcucugcaugaaguagggaccccacacuagauaaccccucuuguaaaguaugagcccaucucacugggcuaucugacucuccacccuccuuguuagucucugaggaacagugcaacuccuucgaacaugauuuagaaagagggcauucaugcauagaauucugaggccuggcacaacucccugcccaggagcacagcuugcugcugagggcugggugugaccgugucugccucuggcugcugggagaagcuguuuuucaguuucagaagcaggcaggacaaaggccaggacugugguuugggaggcauuuggcccuggaagguccuggcacacgcaauucuugggucucauuccauccagguuccagagagaacauuagaucuuagcucuugacaaaacggauggcagauacuggccuuugaaacucuguugauucaucucuucuaaucgguccccaaggagaaagaacauaaacaaagagugaggucuucccucccacugaacacuauucccauaguuuccuuuugcuccccagccuguaauucuaaguucaacaaaacaguugucaacaaaagugacugaggcuuccaccagagugccagggcucugugcagacucagaaucccuguucccuaugucacguuccagcauuguauagcacaguuccaugucacaaacaggaagguuagaaacacuaaggucugugaacaucacugcugcagcgaggcagcuccucugucuacucguucaagugucuuacucuacuggaugcuggauagaaauuuaggguaacuucugacaaagugugccggucuaacaauaaaauaggguuuuguaaucuucugguugguaaaagauauguuccggagaauauaggaacaugcccggagagaccuaaccuguauguccacuuucaugcucuuguuccccaaaccccugggcauuguugucugcucaagagauucuacuggaagcaugaugacccaccugucugggaagagaaaaccucaagaaggcaaagugcagugcguguuuguggucaagaugaggguguuaagggauguuggagucugguguagagacaggcagguugcagaaaagcacagaucuuugccagugguuggcccugauugaaaaccuguuugaaacagacuguguaggaaaaaucaggauuaaagagugcugccuuuauggcuccuucuucagaauaggugcagaccccuccccgugcccguucccugccacccgggguaaggagguggcacuaccagucugucuaacccacucacuggcuuugaccuucaacugccagucugggcaaauaccagugagcucuguuguaccaagaccaggucuucagagcaucugaaccacuguggccuucucuucucagccuucacugugacacgggggacauugagugacaagccucagaauguuacagagguaaagugaggcaucucaaauccacugacagauaagaaaaccgcguuagagggaaagucaccucugcuauuguagaaaguggcagaauauccaaacuuaacucuagcuuccaugucugucuuuauuaccuucaucuuccuacuuccugucccaccggcaucucacuuaauugagccuaaugucaguaucugugugugccaaugcuguuaccacauccuggugaagcuaaaaaauaaaauuuaauuuggaccaaaagaau

SEQ ID NO: 9174 - RNA, 4238 nt, Mus musculus
agcagcuggcccagucuguguggagguagaaaacucacccuaacucugggcuaccccuucuaguggcagcccacacaaaaggacauggagacuuuugcuucuugcccaggcauccucuugcugagacaucccuucucugguauuagaaccuacuucuucauguagauugaagaucaguugagacaucccuuguggacuaaacuacugaauucuugacuuucuuguuggauaccaauuguuaggcuaucgggaccacacccuguaagccacuuuagugaauuuccuuuuaacauauacauagcucauucucuguuguucucugggaaaaccuaaauguauuaguacucaaaaacuuucauucuucccggacaccugaaaucucaguaagaacaaggcuucuuuuauuuaccuacuuguuuuauagguuuguggagacaggauuuguguagcccuggcuggauguuauaagauaguuuaucuaaacuacaagacuguuccaggggacuccuuuaucucacagaugguggaacgugugaaauccagucaagcuaugcaaacuccuaaguacaaaaggcuggugccaccacagcugcuguggccaccuuacaugggcacagcgccaccuuguggucaguccuaaacuaaccacuuguuaccagggcaaucccagccaggcuguaggggauuuuagagggggaaaggaaaccauuauauuuauucuacaggaaacuaaggcacucaggguguuuucaaacauucagacacauucuggucacuuuuauaauuuuauuguuuuuuuuuucucuucacaucuuuuaaaauagaaauagccuaugaacaacaguuucuucucccaaaaccucaauucaauugauugccucagaaaggcugucagaacaucacuuggaggcacaggucaguggcacacuuaaugccuuugcccuggggucaauccccaacacuggagaggggagagacaaaaacaaaaaacuacaaaucaaaacuuaaacacugccaucucacucccugcacaacuacuggacucagcaggcagcaaguucaaauuucugcccacaaaaaucagcuggucaguacuaaaucuguugucagccagacuucucucugcucgucucuuugcaguucuuccaucagcgaaucccaggcugaugggcaucuuucagggcacagugaaauuagaaggagcaguagucagucagguucuagucaccucuccuccaccagcuggccagcugggaaacuaucuccagccucgcucccggcuuuaucuucuucuuccuuaagacauugcucgcaguugcacagaacaaugacuacaguguccauuaaccugagaagugguuugagccugacaucuuuccugagcuaaaaaugagaaaaagcagagcuacggccuuccugccacagggucaagagagggaaagcucugaagggcagcgcugggaagcaaugaacucuccucaagacgagggacaagagggaugugcugcagccgaggguacaaaacagauagacagccuggggucaaggacaguggaggggaaggacagguuuauuuuccccuucggaacuuccccgcucccccagucuuugcuuucuucuuagcaggccccuuggguucuggcuccuugcgcuuagcugaggagagugagccugucaccuugaagaaaucaucgaggcgucccugggugcugcccuggcggcucuuacucagccgcuugaccccacugcgaauucgcucuucagaaaacugcuuuucaccacacauaaauuugaccaacucuucuucauuuggcucgcuccacuucagcuccacagacucuggguccaguacuucuggcuccaggaagagcugcugggcuuccuuguggagccaguucucuggaacgggguacuugcugggguccagccgccucacgaucuccucgaugcucuuauguuucuggaugagauccacagcccgcuugggcccaaugccacggaugcucucgcaguagucgcuacccagcaggaugcacagauccacaaacugcuccugguucagacccagcuccugcaggacgcggcucagauggaacucuuggaugggcagcuucuuggccucacuggcaguuaagugucgcauuagcacggggcugccaaaagugaggcaguccauguccuccguggccgcagcauagacuuugccagccuuugccagggcagcacagcuggccucugccucgcugggugcaucaagguaagggaugcccaugaggcucagcagguguuugcacucaucauuguguugcuuggugaccuucacgagccucuuggugaacuucuccaccuccuccuccaucccagccuccugagccugcugcaguugcuucucagccucggcgcgccucucacugcgcuuggccagcucgccugacuucagcuguggugguuugccaucaaagacguacacaggcuugaugccauucuccaucaugcggaugguacgguagaacaugcccaucagguggcugguggucucacccuccucguucugcagcacauccccacccugacgaacagcaaucaggaacugguagaugcucauggaggcaucgauggccacuuugcgaccaaaguagcucuugaugucauucucacggauggcacugggggccacaucagcaauuaguuuggcaaggccgugaauucccaugguagcacaggagcaauggcuaaaacaaagaaagaagaguaagaggaggaacuuggaggauacaaaaggaacaaaaguuuuaaguggcaacauucaccagucucaugguucaucaaacuuaacaugagacacagcaggacuccaagccagcagagcagaagaggcaaaggugaacaagauccaccauucucaagcaggccuccugacaaucagaagcuguucugggcgcuucaaggaaugagaucugggauguucuuuuguuuuuguuuuuuuuuuugguuuuccgagacaggguuucuuuguguagcccuggcuguccugaaacucacucuguagaccaggcuggccuugaauucagaaauccgccugccucugccuccugagugcugggauuaaaggcgugcgccaccacaccuggcaugggauguucuugaauaacuuaagggcucugaauaacgcaauggcaccaucugucacagagugacuucaacuuuaaccugcauuaaggaucacagaagacagagugcuuggcucagcuugaagggcccugagaucaucaaggcagacgugaacccucaggagcagguaaguaccagcuaugcgaauaugacuaugucugauuuauugcuucuccacagaugucuaaccgaugcagcagaccugagggguacaccucugcauaaggacagguggccaccucacugcugcuacucuucccuucccaucucccuuagcacuugaggguguuuuuaucaggaugccagaggaguuuuaaguccuccucuuuguacucucuuccccccuaagucugaacgccaugacuucccacagauccugaacugagggcuggcaugcuggauucacacaguccaauacugcaugcacuucuguaguacuuccaucaaaucacuccuagggaagcauuuucaaaacuacccucacaauuuuuggcuccuccaauugaaacauuaauuuuccuuuuaucuaauuauuuuucuuuaaauggacuuucaagaaaaaaaaauuggggguuagggggcaaaaaaccuaguugugagugauggugcaugccuuuaaucccagcaccuggaaggcacagucaaguggaucucugaguuccaggccagccuagucuacauaguaagucccaggccagccagaguuacauaguugagacccugucucaaaaacaaacagaaaauuaaguugggaaagagaauccauuuuaaacaaaaauaucugcauugugucagucaagucauauuaauguguuaaauguacaauaaaaggauuuucuaauaugcaauuuauuaagguuaucuugcucgcccaauguuaguguguccacaccauaagaaaguccugucaagggcuggugagauggcucaguggguaagagcacccgacugcucuuccgaagguccagaguucaaaucccagcaaccacaugguggcucacaaccaucuguaacgagaucugauucccucuucuggagugucugaagacagcuacaauguacuuaca

SEQ ID NO: 9175 - RNA, 5040 nt, Mus musculus
auucuggucacuuuuauaauuuuauuguuuuuuuuuucucuucacaucuuuuaaaauagaaauagccuaugaacaacaguuucuucucccaaaaccucaauucaauugauugccucagaaaggcugucagaacaucacuuggaggcacaggucaguggcacacuuaaugccuuugcccuggggucaauccccaacacuggagaggggagagacaaaaacaaaaaacuacaaaucaaaacuuaaacacugccaucucacucccugcacaacuacuggacucagcaggcagcaaguucaaauuucugcccacaaaaaucagcuggucaguacuaaaucuguugucagccagacuucucucugcucgucucuuugcaguucuuccaucagcgaaucccaggcugaugggcaucuuucagggcacagugaaauuagaaggagcaguagucagucagguucuagucaccucuccuccaccagcuggccagcugggaaacuaucuccagccucgcucccggcuuuaucuucuucuuccuuaagacauugcucgcaguugcacagaacaaugacuacaguguccauuaaccugagaagugguuugagccugacaucuuuccugagcuaaaaaugagaaaaagcagagcuacggccuuccugccacagggucaagagagggaaagcucugaagggcagcgcugggaagcaaugaacucuccucaagacgagggacaagagggaugugcugcagccgaggguacaaaacagauagacagccuggggucaaggacaguggaggggaaggacagguuuauuuuccccuucggaacuuccccgcucccccagucuuugcuuucuucuuagcaggccccuuggguucuggcuccuugcgcuuagcugaggagagugagccugucaccuugaagaaaucaucgaggcgucccugggugcugcccuggcggcucuuacucagccgcuugaccccacugcgaauucgcucuucagaaaacugcuuuucaccacacauaaauuugaccaacucuucuucauuuggcucgcuccacuucagcuccacagacucuggguccaguacuucuggcuccaggaagagcugcugggcuuccuuguggagccaguucucuggaacgggguacuugcugggguccagccgccucacgaucuccucgaugcucuuauguuucuggaugagauccacagcccgcuugggcccaaugccacggaugcucucgcaguagucgcuacccagcaggaugcacagauccacaaacugcuccugguucagacccagcuccugcaggacgcggcucagauggaacucuuggaugggcagcuucuuggccucacuggcaguuaagugucgcauuagcacggggcugccaaaagugaggcaguccauguccuccguggccgcagcauagacuuugccagccuuugccagggcagcacagcuggccucugccucgcugggugcaucaagguaagggaugcccaugaggcucagcagguguuugcacucaucauuguguugcuuggugaccuucacgagccucuuggugaacuucuccaccuccuccuccaucccagccuccugagccugcugcaguugcuucucagccucggcgcgccucucacugcgcuuggccagcucgccugacuucagcuguggugguuugccaucaaagacguacacaggcuugaugccauucuccaucaugcggaugguacgguagaacaugcccaucagguggcugguggucucacccuccucguucugcagcacauccccacccugacgaacagcaaucaggaacugguagaugcucauggaggcaucgauggccacuuugcgaccaaaguagcucuugaugucauucucacggauggcacugggggccacaucagcaauuaguuuggcaaggccgugaauucccaugguagcacaggagcaauggcuaaaacaaagaaagaagaguaagaggaggaacuuggaggauacaaaaggaacaaaaguuuuaaguggcaacauucaccagucucaugguucaucaaacuuaacaugagacacagcaggacuccaagccagcagagcagaagaggcaaaggugaacaagauccaccauucucaagcaggccuccugacaaucagaagcuguucugggcgcuucaaggaaugagaucugggauguucuuuuguuuuuguuuuuuuuuuugguuuuccgagacaggguuucuuuguguagcccuggcuguccugaaacucacucuguagaccaggcuggccuugaauucagaaauccgccugccucugccuccugagugcugggauuaaaggcgugcgccaccacaccuggcaugggauguucuugaauaacuuaagggcucugaauaacgcaauggcaccaucugucacagagugacuucaacuuuaaccugcauuaaggaucacagaagacagagugcuuggcucagcuugaagggcccugagaucaucaaggcagacgugaacccucaggagcagguaaguaccagcuaugcgaauaugacuaugucugauuuauugcuucuccacagaugucuaaccgaugcagcagaccugagggguacaccucugcauaaggacagguggccaccucacugcugcuacucuucccuucccaucucccuuagcacuugaggguguuuuuaucaggaugccagaggaguuuuaaguccuccucuuuguacucucuuccccccuaagucugaacgccaugacuucccacagauccugaacugagggcuggcaugcuggauucacacaguccaauacugcaugcacuucuguaguacuuccaucaaaucacuccuagggaagcauuuucaaaacuacccucacaauuuuuggcuccuccaauugaaacauuaauuuuccuuuuaucuaauuauuuuucuuuaaauggacuuucaagaaaaaaaaauuggggguuagggggcaaaaaaccuaguugugagugauggugcaugccuuuaaucccagcaccuggaaggcacagucaaguggaucucugaguuccaggccagccuagucuacauaguaagucccaggccagccagaguuacauaguugagacccugucucaaaaacaaacagaaaauuaaguugggaaagagaauccauuuuaaacaaaaauaucugcauugugucagucaagucauauuaauguguuaaauguacaauaaaaggauuuucuaauaugcaauuuauuaagguuaucuugcucgcccaauguuaguguguccacaccauaagaaaguccugucaagggcuggugagauggcucaguggguaagagcacccgacugcucuuccgaagguccagaguucaaaucccagcaaccacaugguggcucacaaccaucuguaacgagaucugauucccucuucuggagugucugaagacagcuacaauguacuuacauauaauaaauaaauaaaucuuaaaaaaaaaaaaaaaaaaaaaaaaagaaaguccugucaauuguucuaauuuguucccagucuuacuucacugugucuuuucugaagcccaaguggcccuguauaguccccuuccuuccugacuacaaacaccucagcacacguuacuuguauagcacagaagccuagugaagaggccugcuucucucuuuggucuucuuccugcccuccuuccuuacuucuuccugguucguauuacugugguuccucuaagaauacaagcagcaaaaacucagucuuaaggcuaaagacuguagcucucccugguacaguggcuugccuagcaugcauggagucccauguugaauccucagaccagaaaucaaauaaaaaacucauccuugaaucugguauucuguguguggguauaacaauggggacugagcuagagcccucacuccugcuagcaagugcucuacaucuucaagauuguguaacacaagucacuucugaguuguuaaauaagaaugaauaaccauuucugccuugcagaaccggucaaccaaaaacccagauggaauacacacaucaccagaugccgugccauguucccuagucaaccauaugguucacaccucacuuacuacguugcuagaaugaauacaggcuauuaccacccaucaugucacacagagggaaaccuguucuguccugauagucucagucccgccuccacaggaccuuccagauagcaaagccuuaaaugaaauggcugcaggcaggauaaaaacacaccuaguuccccugcuccccacuccccagaggccuacugauuaaucaccguauuaacugggccccacuguucuacggagucuuccagacuucccuucaccagaaauguccuuggggcuuuuccaacaccugccucagucagaaauacaagaaagcacugucucuggaugucagcagaacaugaacccauuuccuuauuaaaggcacagaacuuccccgcuccauacuccucacaagggcccuaggaugaacacgcucuggucucugaguccucacuggaaggaggguacuaccuucuuccuaccggcgaagaggaauguucggagcagagcgaauggcccaagcccgggcugcccggugcuguucccgcggcucugccgcuuucagagacgcuuccgcgagaccucaccccgucucgagugcacgagccuuaagcagcuagcagugguuuggaguccacagcguucucuggacagucccgagcccguucuuucaguaucguucccagcuucgccgccuuccaaagcccgcgcucucgucacgugaucugccaggcgcgaacagccuccugggaaauguaguguaugccccaccagguccgauagcagcuuucauagugggcguucuuucuggggaaaaaaugaauuaaaaccuaaacuucacaccacccuuucccacaguccgacuccaugcuacucacagcagguccgcauaguccuaguucccguuacuccugagaacaugggacuacaagucccacaaugccacgcgcaagg

SEQ ID NO: 9176 - RNA, 1164 nt, Mus musculus
gcggaggagacaaaccucuggaugcaagagcuggaaaagaauggaccgcucaguguggcccucucccccucucgguggggccccggcuggaaagagggagcuguggucagugcccacagcugggccuccagcaaaaucucacucuauauaccuaagagaggcagcucugagaaccgcccccagagggacaaaaccucauugugaggcacccgccagccuaggcauccccucccccaaguccuccucggagggccaccgcaagccugcugacugggccacaucuggagcucaggcucugacugcccuucccccaugcuggccacugagaagaagggagacagaugggagaauaggagagcucagggggucucacucgacucccugcaaagcugggcuugugcuccaccuuaguuuggcagccacugccagaaagagucaaaaguucuaagcuggcuagguugguaucuugauuugauaguaaguuuucccagccuucuggguuguuguuguuguugcuguuguuguuguuguugugugugugugugugugccugacuuuguaaacccccacuggcauugcacuugcaauccuccugccucagccucccaaguacauugguuauagguauauucccccacgcuucgggaggcugcucaguuucaucuuucccagacagugguaaagcuuucugguuuugacuuccuaugccuaaggguucucugaggaugugcccugaaccacucuguaguguggugauuuacugggucugggauucuagaauccuagaucuaggguucugaaguuuacaggugccauucuccauacauucaaccuguacuuuuugaguaccuauugugugugagguguguguguguguguggggggggguugguguugaaguuauagcagugcccucauaggccuuccugagaaggagacuaauggaaacuacaugcagagcuacgcgccuaugagggugagacagguugagguggaguaacugcuuuggaaagaauaccccaagcugggcagugguggugcacaacuuuaaucccagcacuugggaggcagaggcaggcagauuucugaguucgaggccagccuggucuacagagugacuuccaggauagucagggcuacacagagaaacccugucuugaaacc

SEQ ID NO: 9177 - RNA, 2366 nt, Mus musculus
aaauaucacuauguagccagcaggagaccugaaaggauccaaaaucucgguuauaaagagaacucagcucuuuccuucagggccccauacauagguggaacaugguagaaaacggaaauguaagacagcaauguaggcacugccucggcagacccuggaaagauuuuugguuuuauggugcugcagauugaauuaggacuucccucacacauaguaggcaagccccagccccagccccagccccagccccagccccagccccagccccagccccagccccagccccagccccagccccagccccagccccaggcccauagccccagccccagccuaugggaggaaagugaaaugauuguccuccagcaauguaggguagguaggacuggggaaggaagucaacagaaugcaugugcacugaaaggaaggaaggaaggaaggaaggaaggaaggaaaggaaaggaaaggaaaggaaaggaaaggaaaggaaaggaaaggaaaggaaaggaaaggaaaggaaaggaaaggaaaggaaaggaaaggaaaggaggaaggagggagggaaggaugaauagaagaggaacaaaggagggagggaggagggagggagaaaaggaaggaggaaagaaugaauggaaggaaggaggaaggggaggaggaagaaggaaggaaagaaggcaggcaggcaggaugggccaagaagagcagccugcuagaagguuuuccuugaagagcucuucagcauagacaaaugguucucaaagugagauuccagaucagcagcagcaguguaguguuguauguucucaggccccacccaugaaccuccaagucagauuuccaggugacaccaagaacugauugcaggagaaguugaauaauaaauagccccugggcugcaaaaggcuagaggaagaaagagcucuuaccagugcaagaggggcagcaccccccaucucucgggggaacugggugggaacagguagcgucacaccuuacuccuccacaggucaccucuccauccugaaugcacaaacaggaguugcaguggugggcagaaccuagacacucccccaaggcagccuggggacuucacaccuaccuggcacaagcacugagaacauccgggcugguuccagcggcugccugauucauacguggcucccaggugccaacaggaagaggacccugcucccagcuuugggcuuucaggaccccuaggugaggaaggggucccuacagcccccuggaggagugagggggguccaaggguccccaguggggaggaacuuggcacuggaguggauaucaacugugugggaaagaauguggguaggaccugggugguagauggcugacugauuguucuaacuccagugggguauccuggggccccuggaggagggcuguguccuggggacagggcaggccggccugccucagggaggagcagggacaucuuagcaggaugcugucggggcugcaggauggcagauggggccagaacggccuucgggaaagcugaaauggaagcacagggucuccuaaggaaggcagcaggggcaggaagugggguucgagaggccuaaacagguccucagccacauaaaguaacaggcugugaccuacugaggccacagcgacagccacaagggaagaaggcugggaaaacacuaaugggcaagaaaagauccuaaaccaguaacaaggagguccggcagcccaagacucagcugcccuuccuuccuuaacagcuauaagggaacacaaguuuuccugaggcuggaaggccuucaggguccauccuggaaacaacucuccccaacugcucugggcugggguuucauugcguccccugcuucccaucuagcuauggcuucccugcaguggagcuagggcucaggaugagggcucagcggaggguucccugcaguggcacugucuggucaccuugagggaggaggcuccugcccacacguaaagaccugggaacugaaccggcauuuccccuacagaugaacaucuacugcaccucgucacaaaaacggagaauccccuuauggcuguuuuuuguuuuuuccuuuuuuuaccauuuguaggcaauagcuggcgacagugaaaagggaaaggacugcauaaagaaguugaagaauggggcuggagagccaucucagagguuaagggcacaggcuucucuugcagaggagcugguucuguucccagcagucacauggugacucauacaauccacagccccagucccaggaggucacuucuuggcccuucuggagcaugugguacacauacaaaccagcaggcaaaacccuuauaauauacauaaaauaaaucuuucuaaaagccccaac

SEQ ID NO: 9178 - RNA, 1020 nt, Mus musculus
cuguuuuccauccuuuaggggaggcgacuugucccccuggaucagguuucuauuggagaguccucaaauuucccauugguuaguucugcuucaugacaucucacagaauccagugucagaguguccuauggacacauggguucucuguuauugguggcagguagguugugacuuggguagguaggaccuggucugcccuccauccugagugccaagcagacgucaccaguugaucccagcacuccugaccucuggauaaagcuguagacuccugagcaacauggguccccuucagcagaguguccuacuagucagcauuggcacuuguucgggagugauugguguuucccaaacccgacuccuuucuuuggaagaggggacacugagaccugcagcguguaacuuaccaggaucuguaagguaaggcagagaggcacugaaauucaugguuucugacuugggcuuggucaaccucuuccugggguggcguggggaauagaugccgagagucuugagaggggagacagagacgcucagugguaugggcacuuuccgagguccacagcugccacauauugaaguucuuugccugucuccacagcucaccagacccacagccucagagcagaaggcgacagggaccauaggcguacuugcagcuggacuggcagcaggaagccagagguggugcuacagguuagcgcuggaccaugcccagcuuggcagcccacagcauucccuccucuucugggcaagcauggcaaagacgcauaaaaccacgagcaccgucuacuuggacuuugucaacuggaaccagaugcccagugagccaugucuaccauguggucugcacacacccugggauagcuaacaaugcgcguagcccaacacaaaaguuugaacuuacucaaaauauuaugagacuuguuuuguaugugauuuuguugucguuguuguuacuugacuguacaguucuugacugugaacuuggaagugacaccguguuuuaggauugaaaau

SEQ ID NO: 9179 - RNA, 20838 nt, Mus musculus
uaguagcuauuuuaucauuugugcaagcugaggcuggagcaagggcauuaggcuuccaucuagaaccucuagauagguggcugggcagggccugcccggaguuuggagucugggggaaggaguggucuccagugggcggggcccucacugacgccccuccccgcaggcagcuggagccugagacugcugcugaggagguggagcggcgcucccguggcugccgccugcaguaccagagagcuggugugcgcuucuuggugcccuuugcggcucacccgcuggacgguggccgucgccucacccaccuacucgguccugacugguugcuggaugugagucaccucguggcagcccaugcccaugugcaagauccucgcauagccuccuuggaagguggccgcauccuagugggacgggagccuggagucaccucuaucgaggugagccgccacaggggacgccaaagagcaagacuuuguccccuucccacaggguacugguguccccagacuguucaugguuaggugugaaggcugcagacggggcuuacugugaccagggagaauaggugggcagucggagcauaggggacuaaaugagaauggagauaacuguaggaaaugcuauaggugugaagggauaggguauaguauagguguguggggaccaggccuccagaaaaaggacacaguccucugguauggauuggaguguguguuaguguagagauggugaugccaaaacaggguccuuuaggggagacugugugggggagacccccucacuuucagucgcuuucuacucuuagguucguuccccgcugucugacgccauccugggggagcaggcacuggcugugacagacgacaaggucucagugcuggaucugcgaguacagccggugaugggcaucucacuguccuugagccggggcaugucccacccuggagaagucacagccacaugcugggcccagucagcucuuccagccccaaagcaggugauggccgggggugagagagcauggucagauaccauagguggggggugauggaggagaaggauaggaggaagugggcccugguauguggaccgcuugcucugggguuuuccaaauaaggacuacuucccugugagguagugaguucucuggcuggaagugaugaagcaguggcuggcuggaguauggcguugggagguucauuagguguuccugaggacucagaccccugggcugaguggcagacaggugauugacacgcguccccucucucccuguguuuuguccauucgccugugucucucuucccuccgugcucuuucuuccguguggccugucacugugggaguguucugugugugcaugcgugcgugcccucgcgugucucugcuuguguccgugugcccugcaggagguggcccucucccuguggcuguccuucucugaccacacuuuggccccagccgagcucuacgaccgcaaugaccuggggcugucggucucagcugaggagcccagugcuguucugccagccgaagagcagggagcccagcuuggugugguggugaguggugugggugccgaagggcugccccuacacguggcucugcacccacccgaacccugccgccggggccgccaucgcguuccccuggcaucaggcaccgccuggcugggguugcccccuuugcccacaccaguuccugcccucccauccagcccuguccggaccucaccguucacagaagccacgguggagggaaagcggcagauagcaggugauauggggggccauguggguauuaggggcaaguuugagcgggcagaggaagaagcugggaaggaagaaaaugaggccaaagaagaggaggaagaugaggaagagauggugccugccccucagcgugucaccgaccuagagcuggggauguaugcucuucugggcaucuucuguuuggccauccucaucuuccuggucaaugguguggucuuuguguugcgcuaccagcgcaaagagccuccagacagcgcuacagacccugccuccccucagccacauaacugggucuggcugggcaccaaucaggaggaacugagucggcagcuggaccgaugcucuuccucggguccacccaagggggaggggggcugcccuugugaaaguggggcaggaggggaugccucaaccguggcccccagugcuucagagagcccugcuggcuccucgagcacccuggcccgcaaagaagccgggggacgucggaagcgagucgaguuugugacauuugcaccagcacccccaacccagccgccugaggagccuguaggggcccccgcuguacaguccauccugguggcaggugaggaggacauccgcugggugugcgaggacauggggcugaaggacccagaggagcuucgaaacuacauggagaggauccggggcagcuccugaccacucccugaccugccaggggcagcuuggcccaccagcucaggcacugggaccaaugggaucgcuggcuaaucgucuugccugacccucauucucauccucuggugcuuguugaucugaguccccugcuggguccccucggggaccccgucccaggccccuuucacccccaccccuugucauggacuauggucaagagggagggcgcaugccccuuauuuaugggaaccacuucauucuacuguuggguacagaauaaaugagaaaagaaugggcauagcugguacugcugugacacucucugucaggguggguggagaccauuagccucugacccugcuggacgagcgcugggaggcuggguccuggcgaguccucucauagcgaccagcaauccagagaaacaggacggcugugacagccucaaugccggccagcaggaagaaguaacgguccaucugacaguuguugauguucccuggggacgggagggcuggcauguggguggggagaggcucgauggguuaguagcuaaagccacacuccaacuggcguggccuaagaaugcuggggagagagcccucuaguaucuuaacgccccaaguguuucuugguaugucucccauuccucuauuugaaggcuugaagcaaacaucaggaagcaagaaggugccucugagggccacugagucuaaagcauggcuguucuucccaacccuaagccucccuccaguccugucuucucuggagaggguccccucucacuuaccaaaguccuuggggcaguacauccagcccccaggaaaagacaguagggccaccaagccagagccuagcagugagcccaccccggaaaggcagaagaagaugcccauaauugcacccugcauggagcguggggcuucugaguaagcgaacuccagaccugugggagagacagggaagggacuugaacuucagggcgagcagagaugggucaaaguguguggaaucccacucucccaaaccucucucugauuccuuuggaugccgucguggcugacagcaccggcggaccugacgugaugcacguuaucugcccugcucacccacaccugaugaagcacucagcccggauuccauaaacaugacccagagcuccugggucccccagugauggggacagguuacagcggagucagcagcugcuucagcuucucccucaccuucugugcccaccuuccuuccacaccaucaccaaaaccauuuccauccagccucuaaaacagguuccaaauggaggccucccuuucugccccauuuuuccuggagccugaccucaucacccacacaugacuggaagugucaccaugcaggcucagccacuggacccaugugacucugcuccucgagcuuuccucuccagugccaucccccucccuccacuaccaugcuccuggcccauguaguuagcacugcauuaugauccuucccacacuugcugaguucagcuuuuccagaagcccgucuugucccucccugccuuacccacaacccagccacacuuuacagcccccaggcuagcacugguugugccuuuuuguaaguucacaguuuuaucaucaaaacguagaauuuccaccagggccuaguggaagagccuacccacugcuuacaguccuggcucccugaccagguuggaacaggauuaggaguguacacacacacacacacacacacacacacacacacacacacacacugauuucccgaagggaggagcccccaagccaggggauuauugaggaaagaggcaaaagcagaaggccgacaguccccagcacgugggaaucuauggaaagugccuuuuaaccaacuccacagggucugcuguagagcuggcucaagccugaaagucccucaaaccucacuggaacagaugcagaccucccucauucaaaaccacggcucccuuccauacagaggccacagugcugugcccaugguucccuccugguuuggagguaacacccaagcagagcccagaaccagcguaagagccggggagggaauccgguguaccugggaugcuggcaaagaucucacugaccccgaugagcagguacugggggaucugccaccagauagacaguggcgcugcauaguauaaguccuucccaaucagcugaggcacugucugguuggcagcaauguacuguaagcguucuuucuccaggacuccuaagggauugugggguggggagcaagagaacaucagaccaccccaggcaguuuagagcuugaguuccaacaccccacccugccaccuuagcugcuaggaaucucagcuaggucuugcauuucauaggaguuauuaacccaggcuguuaugacauucuuugcaaaugaagaaagugaaacuuagguugagcaauccgcccagagucacacaggugauaaucaguuagaguuaguuagaaucuuagucccaguacaucugguuuucaagcggggcuauuuuuccauaagaucacauggcuucucuagggcaagguuagguauaauggccauguuuccaaccuagauuuuaucgucuucuccccuucagugcuuggggaacaccuuugcccuggugaaugaaucacaaucagauuggacuuguauuccaauccuggcccuuccauuggcuuguugugcaacccuggccaagucaucuaaccuugcggagacuccauccccuuacccaagaagcacuaaaggcccuggggauagaaugccggaggauggcauaagacaaaauauuuuaaagagcagaggcauaaaagaauuucguuuguguugugaucaacaaggcaguguucacuuagcuuuguaauuuuuuuucuuuguuuucagacagucucagguagcccagguuggccuugaaauccugguccuucugggugcugagggccaccaagugugcaccauccagugacuuucacucucuuauacuaugugucucgagggcaggaccucucaaggucugaaugaacacgaugcaucacgcaccugccacaaugauggaggugaacccaaagaacaugcccagggccauuuucugcagagaugagggcagcagcuugcaccgcagcagcagaggaucaaucaagugauccuugacagggaucagaaucaggaucaccgcaacauuggccaguaggagccaggcuucugggaucugggggggagagagccaggauaggcaggcuagcugagcagaaagagcucugggcuggacaauaucccugaguaaccgagggcuagugguccugucccaacaccaacacccauggaacuucucaguuguggugaccagggggacaggauuauaucaaggaaggcaaagaaguucuuccuagacacaacuuuacauccugagcacaacauggaaagggucucagagaaauaggagaaaagucagugaacugggggguacaaaaugcacagugaacaauggcguugggagacaccuggccugaguucugugggcagcugaucuugcugagaggggggacuugguguugcauaccaccaccaccaccaccaccaccaccaccaccaccaccaccaccccgcaggugcuuuucuuguguucuaagcaugcugccucacugagagcuggggugggguggggugcagccagcuucauuuccuccuauucacaaaggauguagauucucacaacccuggccuggcuagggcuggccaagcacuuacucucuuacccuguaguuacugcuaucugaucucagcaacaaagagauguuaggguugguccugaagauguuggggauauggagguggagaccuuggaggacauagguggacugcaucuguggagagaaggagacagguugggguggagcuggucccugaaccucuggcuccaggaugcuucaggauagacauuccuuagccacagccccggggcagcugguccuucuccauaucagggaaaggcaccuucagccuacuucucauugagaggcagccuugggcauggagacuucugauguucuuaggcuaugggcagugcccacagaugaucucagaccuagcugcugccacucaccugcucuuccuguuugucuccaggucucacacaggguggguaugggcaaguguuuacugaaauggggaacauaauggcauggcugccuccacuggaauuuguccuccaacaaugaagacaagcugagugcugaagguugacacagccaguggagagguacugaucuaccacagggcuuuggaaacaguugcuggaaggagcagguuuggugcccucaacucucgcucuaccagacauugccagacuagcugcccuagagugcugggauucuaggagacuccuggcagaggaccauacugggggugcucugggaucccuugggucagcagccacuuguccaccacuucggaaggaugucaauguccugacagcuguuauagacaucuugcccaugucccuguaucaugggacagucugugccacccuagacuagcagccuaugauaggaaucuuaggcucucuacaaugaagaguguguagguggcaauggccuuguuacuuggggguuaggaguggauuagguugcugcccugauuccacacaugugcacucugcauaugaagucuguguacacacaugcacaugcauggauacauacaugccugcacacacacacacacacacacacacacacacacaccauuacccugggggaaguaaugcuaugucuuuuaagacagacugagcccaugaggggcuggggugccaggccccugaucagaaggcagaggugacuaccuggaaauauaccauccaauaaggcacaagggucaccaucacaggcaggaucuucaccagcaccuggaaguuggccauaucuucuuguggagaagguccaggcugguuagaccucuggucaggcaacaggugggcacuuucagagucccuuuaaggcaauagggagaaaaaaagagacagccacaacucaacucucucuacaaccaaggccacuguuucucccuccaccauccuccuuccagaaucccauugcaugagggaugaggauggggguaggguggcucagcugguaaaggcacuugccuuuaaucugaguuuaauccccagggcccacacagugaauggagaggaccaacucccagacccccccgaaucccagccacuccuagcagcagcuccaucacccuuacuaucaccccccacuaguaaggugauugaugccacccaagcuuucaugggcggucucagacuucucucaagcuauacacagcauuuggauuagggugguaaaaccagggucagaggaaaacagucuucagcgauucucucucucucucucucucucucucucucucucucucucucucucucacacacacacacacacacacccauggcauccauuuacuacaagaaccaugaaagucccaguacacaccugacucagagucugccacagguuugaugugccccaguucccuugcugcugaccccaagcccauccucaguggacuuaacaaugagguagagagcagagaggcagagauggaagagccauuaccaggagaccgaccaccacucuaaccuuugccccuugcccuuaggguuucugaaccuuucucaucugaaaguccugagcuguccucugagaugcuaaagggaaaauguccagcuggucuuccucaggaacagcugccaucacccccuccccacccaucauucuguguuguuccuuaccagcacuaugguggguuucucuugccaaauccaagcuagcuuugcgacacuuggaccaugccaugcuuugcaaguguaagccucugcaagccuuaagaagacccacagcuucuucagccucccauggucuggaacauuccuccuuagaaucuucccagacaccgucgccaaagaagugcaagcaacagaugaggccauacgaaggggaaacugagguucucaccagcagucccagcugagcucugaccucaccaucuauucccaccaugugagaauguucuagaauccagcccuuugaagcucccaaaugacccagugaugucaagagcagcagaagacaagccccacuaacccuaguuauccucagcaguugagaaaggaagaaaagcuaguacuugaguuaguugcgguggguuugugaagcaguaagagcuaauuaaaccaccagacuccuugacacugacagaccuccagcaaccgaacaggcuggggaaggcugguguauccuucugcucuagaucccacagagcccagcuggggcuggguccaggcaggaguuagagcuagaucugcuugucauaaguagccaacuguacauagcagaauuuuauucaauucuaaagaacaaugaaauuaugaaaucugagggaaauggguggaaguagaaaguauccuaguaagugagguaacccaggcucagaaagacaaugcuguauggucucucgcguguguggaucccagcugcuaacuacugcuacauguguauauguaugugugauuguguuuagaugcuaggaaaccagaaaggagaccaggaaaggagaacaaaagaggcuuaaauggaggguuaggaaggugauagaaugcaugagauagaaagcaggacgcaaggauaggggcagaaggguagagugaggaguggggcagagagaugaagagggaaggguuaacaaaaacuuaggauguaucaaaaugccagaaggaaaccugcuauguuguaagcuaguuacaaaaagagauuggaggugcagcaagauggcucaauagguuaaggcucuugccaccaagucucaccacccgaguuugaucccuggguuccauaugauacagagaagcaguucccacaaguaugaucuccauaugcauguacacacacgcacacgcacacaggcaugcacaauuuuaaggaggaaaaaagaaagccagagggacacugauggucuuggcagcaguggugauguguggaugggacuggcaguaaaaaucaacacugccaguggguugucgguaacaaucagaacaggcagauaacaggguggccacagggaagcuuccugagauaugaucugaaucuuuagagagguguuauccuuucuugaaucucaaaggaugacacaagguucuuggacaagaaaaaaauuuggguagucucaggauaaagggcaaggagcaaaggucaaagguggagccacaguugaucuaguuauucuaaacuaaacagcccuguuaucaagugaaauagaauauucagaaagcaacuggcauggcuccucucucaggagcucacaccugagagaaauguccauggaaacgcuugguagucaacuuccgucuuuuucauccagucuuuaaaaaaauuuauuuacuuaauguuugagugugcaaguguguguguguuuguauguguguauguaugugcauguauguguguguauuuuguguauguauguguauaugugugucuguuuuuguguguguaucuguuuguguauguguguauauguguuuauuuguuuauauguguuuguguguauauacaugugugcauguguaugugcaugugugcuguuguucaguacaugaacacaggugucuuaguuaacuuaacugucaagucaccugagaagagagucucaacugagagguugcccagauaagauuggccuguaggaacgucuaugggaaguuguuaugauuuuuaauugauguaggaugccccagcccacuguggugagcaccauuaccugggcagguggcccuggguuguauaggaaaagcccacaugaaccagggcaagcgagagagaaguauuccuuaauaguuucugcuucaaguuccugcccugacuuucuugagcgaugggcuauaaccuguaagcugaaauaaacucuuuccuccucuaaguuguuacucuaaacaggauuucuuuguguauguagccuuggccacccuggagcucguucuguagaccaggcuggccucuaacucacagagauccaccugucucugccuccuuagugcugggauuaaggaccugcccaccaucacugcccaguuucucuaaguuacuuuugaucaugguguuugucacagcaacagaaugaaauuacauuaugugugcacuuuccuguguaggcuagaggugaugcugaguaucuuucuuaauuccuucucaccuauuaacauguuuuaaaaguugugugugacagaaggagagagugguaggguaggagggagggagugagaaggagagagugggaggguaggagggagggagugagaaggagagagugggaggguaggagggagggagugagaaggagagagugggaggguaggagggagggagugagaaggagagagagagagagagagagagagagagagagggagagggagagggagagggagagggagagagaaagagagagagaagcacacauacacauggaggccagaggucaccugauugagauagguucucucacugaaccugaauugggcucuugaccagaaaaccagugauccucugucuccacucccuccaccccccagugcugggauuacaagcaugcaugugaccgugccuugcuuucacauggguucuaaacucagguccucaugcuuaugcagcgaacacuuuauaaaguaagacaucucucaagccauuguguguguguguguguguguguguguguguguguguguguguguuuacacaggugcaaauguuugcaugugcauggagaggccagagaaugacguuggaagcuggagucucauuuucagggauacugucugccuucuuugagaugaucucauuggccugcagcucaagaauuaggcuaggauggauguucagcaaguccuagugacucaccugucucuaccuccccagugcugagacuguagguuugugccaucauggcaggaauuggcgaugggggccgguacugggguuggaacucaggcucucaaaguacuuggaaaguaagcacuuuacugcuugggcuguccccacaucucugcccucgugaucucuaguuaaggaaucaccaguaauacaccaccaacaucagcaccggcaccaccaucacuuucugguuaaccacccuccuccaucauaguggcuccaacccacugcagagcagcuuuucauucagugccaggcccgaagcugaaccagaaacaaguuggacuugcccccaacccacgggguggugcauggcaggcacuuuugcccauuguuaccuggaagaggaccuccggcagggacagcaguuuuggaacgcaagcuucagcauagaugacacuuggcugccuguugggggcuuggugaugaagacugguguggcaaagagaaaaaugaagaaugccaggcccacgaggcccacgaugaugcuguagccccauaggaagcugauguucugcucgaugaaagccaccaccaacagggacaauauggcacccagguugaugcuccaauagaaccaguugaagaagcggcggguggcaucgcgcccgagauccaucaccugccauucagccaggaaugagagugagggaggacccagggggucaguguauacauauuccauuaaauauauauuauccauuaaaugaaaaaugaauauacuuuuucauguaugugguauacauauguguucacgcauguuugcuuguacauagguacacauguccugagagugcucaugcacauggaggucugaggcuuguuaucaggagucauccucaauuugcuaguucaccuuauucagugagguagggucucucaaucaaaccuagaguucaccaacauugcacgucucuuuagccagguuguucuggggauuuuauuucugcuuuucaaggcugaaauugcaggugggccaccaaguccacuugacagucuguguggcuucugggaauucagacucuggucuucauccuugcacagugagcaugcuaauugcugagcaaucucucccauccgugacuauacccuucuccugagugccaguuaacaacugaaacacucucacccagcuguuuuuauaugcucaugacacccauugguuuuuuauugucaccaacuaggacauacaacaacugucuucaaagccauucuacucacuucugguugauuuauuccuuugucuuugaacaaaacacacugugcaucacuuucauaaucagcaaaaaagucucaguucauuccacacuauuaaacgugaccuaugcuggcuacugaaagauuagacugagacugauuaagaauuucaucugcagcuugaguugcaaccugaguauggcauggaagguugccccucugaugucccucccucccuucuauccauguucaaacagagcagguggguggaggugcuucuaaauguauagcauucugagcagacucugaccuuaugaaaaaaauaucuuucacagaccccuuagcaaggucagaucuuaccccaggauuuaggucaaucuacaguagauccucccacucuggccugcugccucuggcuagcugcacuggcugcauucccagaccaugaccccuagauuuugauucaauagcucagaagaaaggcccaggcuccugcauuuauaaaaagucuuaagaacugagggucacuucuuaaaugaaucgagagagagagagagagagagagagagagagagagagagagaacaugugugcaaguauguugagguuguaugcaugcauuauguauuuguacauauguguaugugcauauaugcgcaugugugcaugugugcauaugcaugcgugugcugagguuuaucuaugugugagcaugcacugggaugacaggcaugugucaauguaacacugugcuuuuuacagggcuucuaggacccgucucggguccucauguuuuuguaccauguagucuuacccuuuuacccucuagcuuccaugcugaaggucuaguuuaggggcucaggcaugcuacacaugugcucuaccacugagauauacccccagcccucuuugacuuuuauuuugaaacauauuuucacuaaguaguagagacuaaucuugaacuuacuaguggagaauuuaccauucuccuuuccaaaccucccaaguaguugggauuacaggccugccauaccagaucuggcuaacagccauauuccaauaaccaccaaaucucagaauccuucccuauccuuccacccuuuccaagcaugggauacauauuuccacuuacuaagaggauucucccaugcuuuccgugcagcuguuaaugcugaggaagagacaaauguuuuucuccuuaucuaaauguaaaguuauaacccgaacagaugugcuuaaaauugcagugccuuggggauuccaugagguacccuuggcgaaugaaggaggggcacagccaugucagcuugccgggaauccuugccuggaccuucaagcagaaaguugaauacaccccauuaugaacagcuacuuccauuuauuaauaauuggaaguaaguacacaugacaaguguagcugggagagaaaggccaggcagcccaugcgggauauaaaugaggccuucuagagcaagcgaauaccuuguggagaaugauggauggcccuuccugaaaucagcaagugugcugaacucguagcuccuaggcauggcucuuuuccagauggugccuacuccccaagucccuagacugacuacuuaaucuccugaaugcuacagcagccuaucuagugcucggcuacucccaauccuguggccccacccaucucuccacugaguagagccaucucuaaagaacucaaauccaauguagucuacgcugccucaaggcaguccguugucucuacgguuuccuagggggugagauacaaagacagcaaagauuacagggaugugggaagggaaaggaacccuucaacccagagucugguuugaagccucucacaggccgagguucaagaauuucagcacaaugaauuuguugugaagguugccaacacagaaauaaauauuuaucuuauacauagcgguuuuuguuaaaauaacaauaacugagcucgagagaugacuuacugaguaaaaccauggauguuacaaaggcucagugaucuguugucugggcaaccagcucuuccaccagaaggaagaagagaugcucaguggcugaggcccuuggaaguauggugggaaggccacugaugagaggccagaaaagagaaaugguagccuuuagaaaauauucacaaguguggucuaggaaucccaacugcuaguggcagacaacgcccuguaacccuaccagggcugaauuuugaucaauaggaacuaccuagauuugcauaacucucauuugcauaguuaauauuacccaacagaaaauucuauauauagcagcucgugcuaaccucucagaacugugcacuccccaucugagcugucuuccuucauggggcccaaaaucacaugccuggaaugcccacaaagagacucauucuaaccaaaugaagacucacacauuauuacccuguacuguaggcagcauaacagcuacuucccagccugcucucccggguaucacauucaauaucaauacauuuuucuuuguauucaguuuuauagaguaggucaauuacuugccuacuagccccuguuuuuguuuguuuguuuguuuugguuuuauuuguuuauuuaucuauuuauuuauuugguuucuucgagacacaguuucucugugcagcccuggcuguccuggaauucacuuuguagaccaggcuggcuuugaacucagaaauccgccugccucugccucucaagugcugggauuaaaggugugcaccaccaccgcccaacucuacuagccccuguuaauagucagccaucccuaucuacgccaggguuucaggacaguugggaguggguaaauaggugggauaucaaucaaagaguacaaguuaauagaagaaggaacauuccuuucagugaguguugggaaucuccuggucucaggauguucaccaacaccuauaacucaaacucccagggaccuggcaccuucuguagccucuccuaugcaucugcucacaugugugcacauggacucacuugcaaagacacaaacacacauaagcaauacaauaagugcuauuaaaaaucaugggaaguccuuaguaaaggacucuggucacaguaggggcgcuggauuguggaugccagccagaagacaccucauuuaaaacugugagugcuuuugaggagggcagaguaaaugagagagaaguacagagcgcccaguagccugaacacacugccaccgucaccuguccccccuucuauggacaccucaucuuucccauggcugucuauuuguguuucugcauuccaccugugauuauucacaccgugugugguuguuuuaauaauaucccuuccuaguguuuauuaucaacaaucccacuugugcacagcuacccaaacggagccaugcuggcaagacuuugucagucauuuacccacugccucugcuguuucugggugagaaaaggcuggcuggcuccugcaccugcacccaagucccagugacacacucagacagggcucaagccaggaccugagacucagcugcuucaccgucccucgggaccugcucucugucaucugagauaaguugaggggcuacaacacuacucaccugggggauaguuaagaggaccacauuaaaacauggaaagggggcuggugagauggcucaguggguaagagcacccgacugcucuuccgaagguccagaguucaaaucccagcaaccacaugguggcucacaaccaucuguaacaagaucugauguccucuucuggagugucugaagacagcugcaguguacuuacauauaauaaauaaauaaauaaaucuuuaaaaaaaaaaaaaacauggaaaggaacuaggcaugguggcucgcauuugaaauccuagcaccuaggagucugagucaggggcauagccacaaaugcaaggccaaccugggcuccuuaaugaauucuagacugaucuggguuacagagguguagguuaaaacaagaaagacagacacacacacacacacaucacuggggcagacaugguagcuagcaccaugggagguucaggaguccauagcucuccacaggcacaaaucaaguuggaggccagccuagaaaauugggacucugucuuaaagaauaaaaggcaauaggcauggggcauggggcauggcucagagggccaugggagcuguggcuaguccuccugaguccuccugacucuuucuagagcaagcagcccaucuguuuucauauaaggaaacugauguugagaggggaaguaguuugccugaagucccucuggaggcuagaaccuccaucucaggauuuccagucccccuuggccuccguggcacaaugccucugaccacucaccuggucagccccgaacgaggugagggugcuccugacggagcuggcagccagggccaggagcagcaacaccaaguagaggguggucgcgcaguaggggcuggaccaggagccuuggcagcuugaggaugggcaggcagguuccaguggcaacucgggcaucucuccacagaaggaucugcggccaucauuggugaugguggugagcaacaagccagaggcagccagauagagcagcaggcugagcgagauagugaggaagcgucccagguacacgucugccagccagccccccacuggagccagcagguaggaggcgccuaggaagaggaguguggcccgugaugccuguuggccgucccaauugaaguucaagcuguugagguagagcacgagguuggaggugacaccaaagaaggcagcgcguuccagcaucugcacuagcagcaccgcagcagcagcuguccgucuccaccgucgugguccccgcgggccucgggccaccagcgguugucgcucuccggaccugcuugguugcucuuccgcgcgaggggcagacauccuggccuuccugucuccgugacccagacucucuccucuguccuccccuccucuccccuaacccugaucgcccucuuuucucaccccgugucguucucucucucuuuuucccucaggucccucuccuugcuaccuaguuucuaucuccacuugaacucuccacucacuccuuccccucccaguucuucuuguucaucuccccugugcuucuaucaaaucgucuccuuuccuuccucugcucuggccuagucuacccccccccccccaacccuaccccaucauccugcuugcuccacuaccuuauccucccggccccccuuuccucuaguguccccgguuaacugccuuuucuaauuguccccuucucuuaugauaccugggccucaaugucuccccuggcccggccaccuccucuacacacuccuuuuugcuugacugcuucucuuccuuccuuaguccccucuggcucuuccucucagcuuagccucugucccuuuuucugcuucuuaagaaacccugggcuuccccuuuuuacuggcccuguggcugccuacgucacccgguauuuaggagaaaugaaagucugugggucacagggucccuucucauccagcuuucuaaaaaucucccuucuccuggacuguugccugcccucuuagcccgucugcaggcuuuccgggggccaggaagggagccuuccuuucaguuucacuccaacccauuucccuuuccacccuaaagcauccuucuccgcucgaguuugaucgucuccguagcuggggacuuuggaugaggcaggcagacacugagaggcaucuucugcccagggagccacguguggaggaguuucaggcuccuucagcacuaacaugggguggugacgcugagaccaguccauuggaucugugaaggccacauggagcauuugguaggcccaggugucccuucacagaugcagagacaaagcccaguagggguggggaaaggaggugagaagugacuggauccugguaucugagccucagggcccacaacagccuaugucaaaagaagugcugacaugaacguugcauugcaaaagcaguagaggggaaggaaguggcgccauaugggagccacaagauugacaggggcacugaccucagacuaaaucacagccaccccuuacucagauccccuggugcccuacaggaaaauaaagaagagucagccacuucuugaccuaaauguuuaaagggcgcugaccucaucgcaacccacuuaguguggucugcugaucuuucugcucgccucccaggcuggcucagugacuugcucugcugucucuuguccagacaggcucuuccucaagcccuucgugaggcuacuuucucuuuauuuagguggaaagaucucucucccaggggccuucccagaugcucugagguuagcaacugcccaguuggauuuucaccaucacacgcagcaggucacacuaucucagcucaaccuugguggcuuaguuacuguuuuaugcucuaccccauggugggaaagggcucacuauugaggcaggcacauuugagaacauuccuaguacuucccagugcuuagcaauggcagccauucauuaaauauugguugaauaaaugacagagaaugagagugguuuaagcagcagcaagaacaacaucagaaagcuaaaaacuaaaauaaacaccuuugcuaaaaagccagagucaccaucaaacacauggguuuuaaacguguauguguaauuuuuauuauuuuauuugcauauauauuuauuuuuuauuuuuauuuuauguguauuaguguuuugccugcauguaugucugugugaggguugcagauccccuggaacuggaguuacagauagcugugaacugucauauggcugcugggaauugaacugaauucuuuggaagaucagucagugcucuuaacucucaacucuccguuugcuuguuuuuuuuaaaaaaauauuuguuuguuuguuuguuuguuuaauguaugugaguacacuguagcuguacagaugguugugagccaccaugugguuacugggaguugaacucaggaccuuugcuagcuccuguccacucacuccagcgaggcucacucuggcccuguuuguuugguuuuugaggcaaggucuuaauguaggccagguuggcuuguaacucacacgauguagccaaggaugaucuugcacgucugaucuuuccauuuccaccucuagaguacuaggacuauaggugugugucaccaugcccaauauauguggugcuggucauuaaacucuggaccuugggcaugcuaggccuccacucuacaaauugagcuacacgccaagccuguuuuuuauucauucuuuuauuuuuaaagaugcauuuauuucuguuuuaugugugugaauguuuuacacguaaguauguauguauauauauguauaccacaugagugccugguccucucuggggucugaagagggcaucagauccacuggaauuagaguaagagacaguugugagcuaucauguggcugcuggaaaccaaaccaaaccuuuucucuagcaaagcagccaggacuuuaaauuucagaaccaucucuccagcccuuucaucccaguuuuuaacauuuuauaucagggaagaagaagcccagcugugacagagaaaaagaauccacgggggcauaugguucacuguagagagggauaauauaaucugacuaagauagacagagaggcaaggccaggaauggaggcacauacuucuaaccccagaauucaggaggcagagacagaggcagguagaucucuaugcgcucagaaccaacuuggcuacauagcaagaguaaagaaaaaagaaagaaagaaacaaagaaagaaagaaacaaagaaagaaagaaacaaagaaagagagaaacaaagaaagaaagaaacaaagaaagaaagaaacaaagaaagaaacaaaaaggcagagacagggacagaagaggccguucccaacaacucaccucuucucuuggaggauguuucaggauccucugacacuaagacguggcaaugaagcucaggucacauaagacccagcuccuuccuucauuagccauggagguaggcagagaugacaaaugcugauccagaagacaaagugauaucacucacuugaugccagucaucuucagggauccaggaagagggcguuuucucuucugcagacaaauuaaacaguggugcugggcaugauggugcaccccugcaacuccagcucucaccagccugaggcg

SEQ ID NO: 9180 - RNA, 12114 nt, Mus musculus
caaucugcuuagucuccagggacgcugccuuauuccaauccuaggcacccuaggcacggggccacgcucuggguuuugggauccgcagggcacuaggacccggcggggcgaaggggacagcccaugugccugcguucccucccaccccacugcuccugcuccauugucugggaacugcagccgcgggccggcggcgcagggaacuagcuggccacagcggcuggcgcggagcgggcgcgggagauguggggacagauugcagccaccugagccgcgcgccgguuacccuccuuuggugggaaggagugcgccucgaugacugaacgcaaggcugcggccccucgggggcccuacggugccugguucugccuccugguggcucucgcccuggaagucgugagaggucagagggaagggagggguggggaggggcgaccuggcccuguccguccgaggccacgcgccauugaugcccccaagccacuggacucuagaacuaaaccuagagcgaugcccuggagaggucuaaccuugggaaaccgguucccagccaacagcccuuuggcuuucuucucugugcaccaccuagaugcuccuaaagucuuuucacucccaucuucacuagcccggucccaacuccucugcgagccccucuccagccgcgacaucuaacccggcugcccugcuuccccgugcaccaccucuuccuaaccugcaguucuaguccccagaaacccgcugguuagucacaggaaugcaaaacaggcucuuugccugagacccgagagauaugccucugccccccccccucucucccuuucccccucucucucucccccucucucucccuguuccaaggagaucuccaacauuggagucuucugggagagucccagccuugccuuuccgagcccuugugggugcacccaucacugaguacgaaaggggcagcagcuaccgcgugccugccauaagcuggggcugaaagguggaagauguuaugggaauugggagauggcgaaguagucucuaccuuucugcccccaucaagagggcuggauucuccgugaugggagaccauggaaguccgugggagucaggcuacugagcaucuuguaauuauggaaacauugaauuagaagguggaccggagccacccuaaggaccaacaacagucacucacuuguuacccuuagggauacuggugcgcgggcgcgcgcgcggggggggggcacucuagagaaaagccccgccgucccagcucagcuguggggcugagagagcugguucuggaacuucuuuuagguaccugcuccaaacccugcagaaccaguggggguccuaauaaccccuccacagugagggaaggaaagcuuuuucauuuggcucacuaacaaucucacuuccaguaugaucuacaccaagcuuccaaaacccuccccugcucaccggguuaugaaauacucccaccccuuguaccagugaggaaggaaacccaggcuccaagaugcuggugacuggcccaucuuucauggaguagagcuagggcauaaagucagaucucuccccuuaucccccaaaccucuucagggagagucaugggaauuacagaaugaguaagacagagccugggguucacauaauacaggagaggcagcagagccaagcccauggacugcacuugggguuccagguacucuggagaaacgggaggauuguuccccaucuuagaaaagcaguagcagcaagcagagccggaacaagguguccagcaaggggcugaaugaccacagaaggcuuccucgaggaggcaggguguacucuugacccugaaggagggugggggcacagugugaaggccacauggcaugcugggguugcccuggauggaacggcuggguagcuagguggugagauccugacuggccucucagguccacugcagguuggagaacccucauacaucauuuuuuacauccauuaaguggaauuuguaguaauagaauuuaauccaaagaauugugugggaacugaaagacuuacuacauguaaaauugaaucugugugggguuaagugcuuuaaaaauuguuacuauuuggggaugauaguacaaaucaauauagccauaguggaccuuugugcuuuuuaugaacaaauauuccaucucuucugguucguguucccacccuuagggagugccaguugcugcauggaccuauuugguacccucccaagugucauugcugaaccccaaucccuagcuaggacuagggcuugguccccagaaugggucaaguuuggaaauuugaugugggugugccaugacaguaauuggacuuggaaggggugaccagccauguccaugaaaggacacggacacagcaaaaacagacuccauuucuacaaagcucaacugggaaccaucuuuuacugaguaguucccaaugcaggaggagcuguguccuccaaaugcccuaucugaggcagggauauguaggggagauguugaaaaggcucugcuggagggagagauaaguucuggguaagauagaaggaauagcugggaaguuuacauccgaucccugacucuccaacucugacugcuuuuaagaggcucucaguaccucagucaccucgucugugaaaugggaugauuccucuacaucugggagaugguacauuuguaguccacuuugcccucucccccccagccccacacugagaaugaagcccacccaguccaaccucugugaguucuguagcuaucugacaucuccuuuccuuauuccucuucaguuagcaguaaccaugauacccuggaccccaucuaccugccaguggcccuggaacuccuagaugccccugagcauuuucgugugcagcaggugggccauuacccaccugccaacucuucccuggccucccgcucugagacuuuccugcucaugcagcccuggcccagggcacagccgcuucuccgggccuccuacccacccuuugccacucagcagguaaggcuagggcccgggaacucccaggcaaaucagagucaugggguucuggggcucuucucauucuccuaucuaaguaccagcaagggauugggcacauuagggugauguggccauagacaccuuuuccccauucucuacaccgagauuagaagccugaaaucccaccuucccagaccuggcuaugguguuaucugccucuccacucgacccuacagaugagcauguuugcccuuuuccagguggucccuccuagggucaccgagccccaccggcggccugucccuugggaugugcgggcuguuuccguggaagcagcggugacuccagcagaacccuaugcccguguccucuuccaccucaaagggcaggauuggccaccaggaccuggcagcuugcccugugcccgacuacaugccacacacccugcaggcacugcccaccgagccugccgcuuccaggugaguggguuguuucuguugcugcaccaugcagguguggugccagggucuaaaggaaaggacccuaccacagucugagagucuagggcaucgccaccuggcucuguuuugguucccgauugcccuaggagagggcuccuugaggauuucaguccaugaugcaugguuuuagggcacauaauucccaccuauagggaacuggagaagaaagaaaugaagcaacugucagagucgcugucacagagucauuuaccuuuguguguggugacggaacuuuuguggguucuauuuucauuauugugcaguugagcccaaauacccacuggaaagagccguuccuuuucucuccucuccucuccucucuucuccucuccucuccucuccucuccucuccucuccucuccucuccucuccucuccucuccucuccucuccuuuucuuuuuuuucuuuuuucuuucuuuuuaaucuuucauuuauuuuauaugaguacacuguagcugccuucagacaaaccagaagagggcaucagaucccauuacagaugguugugagccaccaugugacugcugggaauugaacucaggaccucuggaagagcagucagugcucuuaaacugcugagccaucucuccagccccaagaacuguuucuugauauucugagcucuaggcaaguccugggaugugguaaagauuaucccauuuugcucugagucuguucaagaagagugaccuacagaguagucugagacccagaucuggugggucccaggagacauccuugguucugccuuccauagguuuuucugcuaaugggagcaagucuccuucccacccuucucagggccaaccacagccuuugcucucuuuuguguuugcagccaucucugggugccugugugguggaacugcaauuccccucucacugguucucccaaagugccaccacaagggccgaacuggccuacacgcuggagccugcaggcgagggcccugggggcuguggccuuggcacagaggaggaacccagggagcaggcucucccagugggugguguggagcugcacccugaggaccccccacaguaccaggagguaccucuggaugaagcagucacuuugcgugcaccugaugugccaaugaggccuggccagcucuucacugccacccuucugcuucgacacaacuucacugcgagccuucuuacucugcggugcguaccaggccccuguggguggaagagguaauaggggcuuaagugggaagacaguggguuucuaguuuuccuguggucuugcuggagcucugggucuccacuaacagugaguucugcauaaaaguccuaaguaguuuauugcaagauacugugcuggguacaauccagaaguagaaagacucccugggacuuuauguccugggguagaggaggcaggagaggcuuggagccugagaaguguaguguccagugcuggguuaugcucaaacgauguuaagauggguauggcuugaguuucuccugcuugggcgggggcuuuggacaaagcccacuccuucccaucaaagacacccauucuguuaccuuuucuauaggaaacuacucccaagcauccucugucauacccagugaagcuggcaaggauguguaguguaacuuccccucuacauuugugggucucugggagucucaccccacaugacucccuaccuaccccucaggccuacucagucucugccauccacuggcuccacagaucuuucaguacaaguccugugucuccacacuggagcuguugcacagaagugugcaaggccccgcccccaucuguaccaaggacuggaagagaaagcaugaauuagaucagacagcaugggaguggggugcucaggugaagcuaugauaaacccugaggacuugggcagaguaggggaaaaucaucuccuaccuccaagaaauaguauuuaggaagaaacuuagacuaggcuguggguguagccugggcaaaggccuggggacaugaaugugaguugggcuagggaaagaugacucuugguguggcccaaacccagaauguauaaagagaugucacugcacuuauugaggcugagucaggaccugaaggcucuggaacaccauaccugggcuucaacuugugggcaguagagaguuguaaguggcuuugggguaggcagagaaauaugugaccugucucgaguugggguccuucuggaaggaauaaaaggagauucuaguuggaacuggggagaccagacaugggggugauaucucugguuccucaucugucuuccuaaagcaaucggcagcucagucuccaucuugaccaacaaccuguacccucuuugcaggauuaaggugaagaaagggcugcaggugauagcugcccgcccagcccagcccacccucuggacugcuaaguuagaccgcuucaagggcucaaagcaccacaccagccugaucaccugucaccgugcugggccugcagggccagauuccaggugccuaaagaguucuagcccuggaguguuggggaauagguugggcaucugaugggucauuuggggacauagauuagugguucugaggauguucaaaggggccuggaggccaaguugggcucuguagccaggauucaagcuuaggcucugucacuuuccacugugaucuugggggauucacaucacuucugugccuuggccuucuugacagucaaauggggauaauuguaaagccugcucaugaacgcaguggguagcuggcgaacacucagcucaucucucuucugccagcagcccccuugaacuguccgaguuccuguggguggacuuugcaguggagaacagcacugguggggguguggcagucacucgcccugucacguggcagcuggaguacccaggucaggcccccgaagcagagaaggacaaaauggugugggagauccuggugucugagcgggacaucagagcccucaucccucuggccaagguaagagccuacucuuugugcucagccccacuagaagccuggucccaggaaccccaggaggugagagcccuggaauuaaaugccccuuauacccucaggcugaggagcuggugaacacggcuccauugacuggagugccccagcguauuccggugcggcucgucacuguggacagugggggagccuuggaggaggugacagagcacauuggcugugagucagccaauacacagguccugcaggugaguggcagugcuugucccuaugagucugcacagccgaacaaaauaacuuugcuccuuacugcaguacgucuccaagggaacagcuucucaaccccagaccucacgggcagggacaggaugucaaucucccggugcccccacuucccccaaucguggucucuagaguagagugggaacugaaagcuuagcccuaagcuuuauuauuaucauuauuauuauuuugauuuuucaagacaggauuucucuguguagcccugacugucccugaacucacucuguagaccaagcuggccuugaacucagagagauccuccugccucugccucucaagugcuggaauuaaaagccugcaccaccacugcccagacuuaagcuuauucucacauuuauuguccagucguccaucuuggcccuggccagggagcuaagcuggaagacugcgugugcuuuggagucggggagguuuugggggagaccuguguuaguuacuuuucucaaugcugagacaaaaugccuggcaaaagcagcuuaggaaggaaggaaggaagggguguucuguaguucugggguacguacgguccguuacggccggggagaagaguggaggagcuggaggcucccucugcaccggagucaggaggcagagagaugaacccuggugcucacugagcucaguuguggaauucccucacagacacgucuccagauuugucuccuagggaggucugggucuugucaagcugacacuauuaaucaucacagcccaucuuuguuauuagcugugugcucaugugcaaguguccuaaccacucugagccuccagucucuccacuucuaacauauuauuacguugcuggaagaaugaaaaguaccuaagacagugcccagugagagcaagaacugaaguaucggcaguuacugcuguuauaauaugaugaaucaauaauaauaagcacuguuguaaugaacuggggggagggaguuaagaggauagacaccuuccucugucucgaggucccagugaggaagcauuggcccagaucccaggcaguagugacagcaccuugggggcuucuggagggauaggugggucugucuagccccucugccaucaaguacuuagcuacagcuaccgcuggcuguuaggugccuccagcaccaaugucugagauuggcaccgaggagcuaaaguugugaguucaacccagacccugcuaggaggacccugcuagcauguauguugcaugcaaauggcccagcucaucccuuggggaaccuacaguaacgccccuggaguggauuuugguaguacagcaaaauacuuuaagcuaagagcaccuccccccaccccguccagaccaccacacaacauguauuuaugauaucagagcugaauuugaauuuuguagcccugcuuauagcuggaguaggugacgcuguaucagugccuaucauuugugucuccacacaucucugccuugccauagguaucugaggccugugaugcuguguucguggcuggccaggagagccggggugccaagggggugaggguggacuucugguggcgccgacuucgggccucacuaaagcugacuguaugggccccacuccugcccuugcgcauugagcugacugacaccacucuggaacaaauccgaggcuggagggucccaggcucagcagaagggugaguacagacccgccugcaggagcgcauaggacacagggcuuagugaauuccuucugggacuaaagguacacagcagacacuuccguggacccgggcuggggucugagacacugcucgcuacuugcaaugccuucugcccauccaacccguauuaauuacuuuccguguugccaugacaaaauauuugacaagagaaaaagaaggaacacgggguugauuuuggcucacaguucaaaguauaauccauugugaugggcuagucauaguggcagggguugagacagcuggacaggccacacugcauucaagucaggaagcagggagguagauggauggauggauggauggauggauggaugcuggugcucaucccagucugaacuucuuacucaguagugggaccccagcugaugagaugcuacugcccauaguuagggugcaucuucccaccucagucacccugauuaaaaagcuaccuugcugucaugcccagagauuugucuccuagaugauucuagauuuuugucaaguugacaauauuagcuaucacccuaccuuugacugucagaacccuggccacuguaguguaaccuggcaaccuccauacucccucucccccugaaaguguucacuauucaaagccuugaauggcuccaagcuccauagaaauccaucacacuggguaguggggaggcucaucugaacccgagagcaaggaugaaguguacugugaggaauguagcucuuaggcccuguagaaacugaguuguuaccccacugccuugucaccgucccacuccagagguauacagaaacagcagcagucaacugauagacuggcacauuucauuagucuggacuaggagccgggcaucacugaccugagcagaaagacucagcacccagaaagaguauucagaacagaguuuaaagaacaagaggcauacaccagucuuguuacuguaguagcuauuuuaucauuugugcaagcugaggcuggagcaagggcauuaggcuuccaucuagaaccucuagauagguggcugggcagggccugcccggaguuuggagucugggggaaggaguggucuccagugggcggggcccucacugacgccccuccccgcaggcagcuggagccugagacugcugcugaggagguggagcggcgcucccguggcugccgccugcaguaccagagagcuggugugcgcuucuuggugcccuuugcggcucacccgcuggacgguggccgucgccucacccaccuacucgguccugacugguugcuggaugugagucaccucguggcagcccaugcccaugugcaagauccucgcauagccuccuuggaagguggccgcauccuagugggacgggagccuggagucaccucuaucgaggugagccgccacaggggacgccaaagagcaagacuuuguccccuucccacaggguacugguguccccagacuguucaugguuaggugugaaggcugcagacggggcuuacugugaccagggagaauaggugggcagucggagcauaggggacuaaaugagaauggagauaacuguaggaaaugcuauaggugugaagggauaggguauaguauagguguguggggaccaggccuccagaaaaaggacacaguccucugguauggauuggaguguguguuaguguagagauggugaugccaaaacaggguccuuuaggggagacugugugggggagacccccucacuuucagucgcuuucuacucuuagguucguuccccgcugucugacgccauccugggggagcaggcacuggcugugacagacgacaaggucucagugcuggaucugcgaguacagccggugaugggcaucucacuguccuugagccggggcaugucccacccuggagaagucacagccacaugcugggcccagucagcucuuccagccccaaagcaggugauggccgggggugagagagcauggucagauaccauagguggggggugauggaggagaaggauaggaggaagugggcccugguauguggaccgcuugcucugggguuuuccaaauaaggacuacuucccugugagguagugaguucucuggcuggaagugaugaagcaguggcuggcuggaguauggcguugggagguucauuagguguuccugaggacucagaccccugggcugaguggcagacaggugauugacacgcguccccucucucccuguguuuuguccauucgccugugucucucuucccuccgugcucuuucuuccguguggccugucacugugggaguguucugugugugcaugcgugcgugcccucgcgugucucugcuuguguccgugugcccugcaggagguggcccucucccuguggcuguccuucucugaccacacuuuggccccagccgagcucuacgaccgcaaugaccuggggcugucggucucagcugaggagcccagugcuguucugccagccgaagagcagggagcccagcuuggugugguggugaguggugugggugccgaagggcugccccuacacguggcucugcacccacccgaacccugccgccggggccgccaucgcguuccccuggcaucaggcaccgccuggcugggguugcccccuuugcccacaccaguuccugcccucccauccagcccuguccggaccucaccguucacagaagccacgguggagggaaagcggcagauagcaggugauauggggggccauguggguauuaggggcaaguuugagcgggcagaggaagaagcugggaaggaagaaaaugaggccaaagaagaggaggaagaugaggaagagauggugccugccccucagcgugucaccgaccuagagcuggggauguaugcucuucugggcaucuucuguuuggccauccucaucuuccuggucaaugguguggucuuuguguugcgcuaccagcgcaaagagccuccagacagcgcuacagacccugccuccccucagccacauaacugggucuggcugggcaccaaucaggaggaacugagucggcagcuggaccgaugcucuuccucggguccacccaagggggaggggggcugcccuugugaaaguggggcaggaggggaugccucaaccguggcccccagugcuucagagagcccugcuggcuccucgagcacccuggcccgcaaagaagccgggggacgucggaagcgagucgaguuugugacauuugcaccagcacccccaacccagccgccugaggagccuguaggggcccccgcuguacaguccauccugguggcaggugaggaggacauccgcugggugugcgaggacauggggcugaaggacccagaggagcuucgaaacuacauggagaggauccggggcagcuccugaccacucccugaccugccaggggcagcuuggcccaccagcucaggcacugggaccaaugggaucgcuggcuaaucgucuugccugacccucauucucauccucuggugcuuguugaucugaguccccugcuggguccccucggggaccccgucccaggccccuuucacccccaccccuugucauggacuauggucaagagggagggcgcaugccccuuauuuaugggaaccacuucauucuacuguuggguacagaauaaaugagaaaagaaugggcauag

SEQ ID NO: 9181 - RNA, 11347 nt, Mus musculus
acucggaucugcaccgaaucccgcaucgagcaccaacucuacccacgccacagccucgacaguucuuucuuuccccuuuccugccaaaggcuucgcuuccguuccaacuccaauuuccggcgccauucuucucuuggaaauauuugggagggaaaaaacacguacaaaccauaauggagcgagcagagcgcaugcguccacgaugccugccagaaagaccugccagucuccuccgucgaccgccccgcgcaugcgcagacuauaaaccaacaccccgggaguugaggcgccgguuugguggcgcguuuucuagcgaagucccacgugaaggauagcggugaccggagcagggugagugagggccgagaccagggcuguagaugcagcuuaaaggacagauuugcaggagguaacagggcggagccgcaaggccuugcgagcccuaguggggaggggucgaacguggaacguggggcuuaacaaguaugggacccagauccucguugcuaugcaaccaggggcguuguuacuagguaacccuggaggagaguguuucccgggaugaguggguucgagcgcugaggucuagcccuccggagggagcagcugccagauuugggggaugaggccagugccgaacugcacaccucccccagccccaugguccagccuccugccgccucaguuggagccccccucaggguauccugaccucaugggccucgcgacgccacuauggagugcuuggcaggggaugugcuguucgaaauagcacaugccacugacccuauugccuggagucugggccuugggaagggagcggcaaggcugcacacccccccccccccccuuugcaaacacccugccccacaaacaguugcuggguagcagcugucagggguuuagcgagggcugccuccgaccugccagaacgcugacuucauucuccuuaguggugacuucgccacguuuaggaccuucuaucucagcugugcuucucauguggcugucguauauuuggacugacuauucaaauaaccuccuccccuucccucccccccccccccccgccaccucuccaugucuuuauguccuacacuuguggcuucuuggcagggcuucugauacucauuuagcaagcacuuagucauucuaugcuaggugcuggggauuccaagaaaaguuaaugucaaguuagucugagagucacugggaggcugugggacaaacuuugaacacagugcuugcacaaauuaucuaacuucuugaaguaacucuuaacccaguuucaacagaacuuacauuugaggagauugaauuucagauagguuaaguaacagguguaaagguaguggcggcuaacuugugauagaucugaaccuguguccuuuguacagagagcucuuaggaggcuuugcuuaaaguagacuuuucucugcguugcugaucuuugcaaccacuguuugauuaugccucaggaauccuggggagcuuuaaaaacaaaacaaaaaggcugagcuccucccugggagggucugaguggguugccuggguggggcaaacacccuuguuuaacaggcuagucaggcaggucagaugggcaauccagagugaggauugcagauccacaggacugcagugaguagugaaggaaccgugggggccagcagagggcaccaaguuaguucuugccccuguagugauuuauagcgagaaaggaaaaagaagaggaaggagcacugacuggagguaguguggacagccccaccccgcccuggcagagcaaaccacagcugaacauagagugacgucucaccaccauaguaaguaaagcaguuccccagcugagacugucccuacuaagcugaauugcagcugucugaacaggaguggccagucucagugcuaucucuggcugucccuucuuacucucuugguguguaaccuguaaacucucagcgggugggucaucuuccaguaugaaggcuuuucuugggagguuugggugucuucggcuuuacgcucgaugguagguaauggaacgguauguucccauaggcagagagcaggucuuaccaaggcaguguggacgugugggacaagcaaaagggcaagccugagcugcuggacuuggggacacggucccuauuucuguucucagcaaaauggggugucaugauaacuauagggcuggugagaugcuccauggggggaagggaccugccacuaagccuaaugaacugaguccgaucccugggacccacaugguggaaggagagaaccaauuuguuuaaguuggucuuuggcuuccacacaugcaaacauacacacuuguauacacacacuguucuuuuguaacuaagugguaaagugcuugccuaccuguuagcucugaguuugauuuccagcuacacacacacacacacacacacacacagauugucauaaaaauuaaaugaaguagacaacacuuaguaaauuacgaaucacuauuaaaauuugauaacuuauacacauuuccauguguggaguaccuccuguuugaggaaacaaaaacguuucagacauguucccaucuuucagaggccaacgcuguuugucuuuuaauggccauagcaucuuucuguauuaauaauauuuugaugagugcuaguauguauguccuuaauugguaguauuugcuuuuauauacaaagcccuggguccaguuccuagugcaacacacagguaacacacacguggcacauaccuguaaacucaauacuugguggaagaaggaagaucaggaguugagagucaucagcagcaugaggaguucgggcuagccugggcuacaucaggcccugacuuaaagagcaaaacugcaaaguucuugaugagacaugaggaagcaugaugauggugggucagauucauauugccugagccucacuuaaaaaaggaaaggaaaggaaaggaaaggaagaggaacugaugaagaaaguagcuugccaguuuucuucacacccaguguucuccagaauccugugagauucuggcacacuucagcucaccuagaagagcagugcuguccucaagguggagggguuaaguucaagguucccuagacuggggcagguggcugcuuuaaguugaaacuggcccagagaacaggcugcugugggaguugcagcucaugucacccugaccuucuaguagggaagagacgacaccugauuccuccuguuggagguccuuggauauaggauccaacccaagauagcaggccuguucuuuagggccccaaucaugauugugacccagauaccuuaggaaccaacccauguuuuccgcagcuccuaccaguggcaggcaggaaccaucuggcucuugauuugugccaaagagaagaagauucuuucagcuugaggcuuuuucacuugaauuguguguccugcaacuccauuugaccuuggggggcggggugugucaggcagcuguuucugguccagaagcuaccccaaugaaguauuuuuagagucuuuuuuuuuuuugcgccuucucugcccaaaugguggaacaucuuucuauucccucucugcuauccagaugacucuagauuugcagccaauuccccccaguacucugguaaccacacauacuucaaacccuggcuucuccaccaccuuagagccucggcucagccucggcucagaagcucugacucacaggaccucucuggagcugcagguguccuuuugaggccaagguagaaugggauuuacuagaguccuuugacguuucucagcagaguggcaaagaagaagugggccugcaaacauucuucuuaccuacuccuuaccugcuucaauagguuggugcuugcugacuccucacucacguguggcaucauguuguggaugagaucagagcacagagcacaaggugcuugggcaaguuuucgccauaauucccagagaugguuggugaaugccaaguguguucgagcuuauggauaaucuguuaugugacuuuauaaguaacuucuaaacuugaacacaguucagcaaagagguuguggaccaagaaggagugcucaguagaucuaucugaacucauagcuugauuuucccacacacugccuaucuuuccuugauuucaucauugggaugacggugccuacucaaugauaaguaucugucagacugagaaaaguagugcaugcaagaccagugucuugcuuuuuauuccugauaaucuuucguuaagggcuggcuguuccugaacccuuugcuuauuuuggcaauacgaaguugaagucauucugcaucaguggugugauagaucguggugugauaccagcaguuugcuugcgcacacacacacacaccagcagcugguuuucaucuacccuuccuugcucggaucucauauaucucuuauaauuuaaugcaugggaacguugccuuugucaaaaucaucagcauuuugcauggcuuccugcaucaucuccagaggauaaagggggaaagcagcccuuucaaauauaccguccaugucaauauuuccauuuuuaagaaagcccuguagauagcuaaaggauuggagagagagagagagaguaguugccaggggaaccagucaugucaacucuuuuguugguaccucucaggagaacaggugacuacugauugaguugauuccaauggcuagagauuuuguugaucacacuuauauaauauaaugaaacuucuaggaaaauacagauaagaccagauuuagagagcuuccagaucgcuaacauauguuggagaccuuccgagggugauguaccuagguagggcaugguagcucugcacuccuucuuccagaccuugugcuaccaucuuuacagcugguguucaucaguauccuuuaaguauuugugcuuauccagugaaccuaagcgcuucucugaacccuugacucucuucagccaguuaauugaaccugacagagaggucgaggaaccuugacuuagagucagacagagcacagauaaaauaagcuagcaucuaaaguuguagacauaaguccugccucucauugcccgaaagcaaacacuugggagagaagaauuggugggaaagaaaucagauucauucagggccugccucugagaaaacagggguguuggccucaagucuccaucuuauggaauguaguuauauaaagagguuuguagagaggaagguauagggugggggugcuacaugcugaguggggucuucucaccuggggcaugcagcccccccuuuuuuuucuuucuggccaaaaugccaugauagaccuugacuccaaccuccuggggcuaguuccuauaguucuuagauggauauuacuugugaguaaguuagacucuggagccauuuauauguuuuguauuaguuggagcacagaauuaaggaacaaagaauaauauuacacauccugauauaacccaaaauucaccagcuguuauggauucuauacauauaaagauuuuuuaagccagugaugggggcauauaccucuaaucccagcacuaggaggcagagacaggugaaucucugaauuugaggccagccugaucuguagagugaguuccaggacacucagagauacacagagaaacccugccucaaaaaacaaaaaaaaaaaaaagauucuuuagugguugguuucugucugucugucucugucuguccuuuuaaggauugaacccauggccaugcacaugguaggcaaggcaucugucacuuagcuaccugcccccagcaacaguugacauuuaaucacuauaauacaucuucucuucagagguuagcaguguaucaguggguaaaagaaugggaaaucacccuggaaaggauaacccccuaaagaagggucacauuaguuaggugugaucugccaaaucccugguuguaggaauuaacucagucauuagccauccuuccuccucagagguuagggaugagaaucucaacccucuaaaggcauggcugguccccuugguaauuaccucccuaauccugugguuagcuagggagugcucuaaaaauggucuuauuaucauggaaggcauguuggaaagggcugucuuucacccuucaucucugaagauguugcagaagccaggcuaaaaggcuaauuacuuugacaaaggaaucuuuauucuuuuuguguauuauaugaaaugugugagcucugagccaggaagguagacaaaaaccaaacugcuguauguguguuuauauguaugucuguauguauauacuagaucaugaucauugacacagaauggcuucaacucccacucccaaauaggccaagggacaugacucagucuucagguugguagugucagaaacuaguugaauuagaagauguucagugcagaagggauugcuugcuugcugaggauaagaacagaacagaacaccucgcacagguagucacugcaaucuuauguugacuguggaguaacaguggggaagaaacagcguuuggccuuagaauggaucucagcuuuagaauuauugaagagcuggucucuaugaccaggucacacagagauagugccauuagaaccagugugcuuagauagggacacugacaugccacucucaggugaugucauugagcagccccaguugcgauccacugaauacuuuauccuccaccaaggguaggguuuggaagcagaggcuuggguugaaauccuucuaagcccagugcccuugcacaagugcuuaccugcagucucuuucuucacaccugugcccacaggggccagggacaaaaaccaccuugcauaauggccccgcggagauacuguugcaaaugcagucauucuugugucucuguuaaccuguaaaugcucuauuuuauauugguguacaaagugguaauccuacuuauuugcuauuuuuaagugacuuuucccuaucaucuuuggcuuaaguacauuaugagcuucugagaaugaagucuuuagagauuuaaaagucaugucuguucuuggugccuacgcuguagagacaggccuucagaugaagagucugcagugagagcuuggcuacuuuaaggcacaggggccaggcggugguggugcacgccuuuaaucccagcacuugggaggcagaggcagguggauuucugaguucgaggcuaaccuggucuacaaagugaguuccaggauagccagggcuauacagagaaacccugucucgaaaaacaaacaaacaaacaaacaaacaaacaaacggcauaggguaguacuugcugguguauugaucugguagagaauacaaaagaggaaacuguaaaucagaugguugugccagcauagauuccaaguugugguucaucuuuuuugguaaacaguggauuuuagguuuggcugggaugucugccgugggccaggggugaagaaggggaauaacagaucaguugggagaguaaaaauguccauugguucuggcucacugcuuacccuauggcccugucuuggcagacacaaacauggcaggcgcacacagcacuccguuauggagcagacaucugcucaaagcuguccugaugguccucguggcccuuuuccucguccacuccgcaucagcccagucucaucgagaguuugccucaccuggucaacagaagaaggagaccucagcugauauuuugacccagauuggccgaucucugaaggagauguuggauaccuggcuagggccagagaccaugcaugugauuucagagguaagaaagguugugccugugguggcugugugcagaaagaaaaggagagacauugucaaugccaccucaccucaccaccacaucuuuuguccuaguugcuacugccuagagagagccccaccuuccacaaacacauccuggcacuucugccucuuguaagcugauugccugguucuugccguccaggcuuuuugcaccaacccaucuuucucuaggcuugguccauuuggccagaaaggcuacaaaaugagcuacccuuauaaacucauguugguggguacccauaacuuccgacuugaccuaucaucuugagcuggcagagcucagagaucugagucccaacucuucaccugugaaagugagguggagcucaugaagggccgauggcaggaucaguucuuccacccagugccauuucuaguguggugucucacccuucugauaguucauacuggacuggagagauggcuuaguaguuaagagcacugacugcucuuccagagguccugaauucaauucccaacaaguacaugguggcucacaacuuucuguaauggguucugguggccucuucuggugugucugagaguucauaccaaagugccaagccagugguuuauaagauccggaauauagggcuggaaaaaugucuuagugggucaaguguuuacuauguaagcaugcagacacgaauucagaucuucagaacauacauaaaaacugggcaugguguauauguccguagccucuagcaguggaaagcggggugagaagaguuaggcagauaacaggagcuggcuggcuagacuagcaagcagaaacuagagcuccagguucaauaagugacccuggcucaagaaacaagagaggcuggauagguagcucagcaguuauagaagcuugcugcucucgcagaggaccagaguuugguucccggcacccacagaugguucacaaccaauuguaacuacagcuccaggggaauccagcauccucuccuggcuucuuugguugcaccccaccccaacacuuauucauacacaaacacacauggacacauaaauaaaaaugaacuuuuuuuuuuuaaagcaaguggagaauugaggaagggagccuaaugucagcuuccaggcuccacauggcccuguguagcuucguaggcagacacacaaauccauaaugcaguguaguugucccagcccugcaugaacauucuuccacauacccuuaugauucccuuggaggccuccaguuucauagggcggcuaccauagggagauagugauucacacacaagugcacauccugcuaccuccaaagcagcucagcugaccaacugaugucugucuuagauguccuggauucugggucagugaggaaauaugucagaagggccccuucacuggacucagaguccauggaucuuuucacacagacccauuuccacuggggaagaaacagggcagagacuucccugcaggugugguccaggcugagagggccaggcaggaagagaugagccuccuccaugauggcuuugucuuuuucacagacccuguugcaggugaugugggccaucucaucagccaucucuguggccugcuuugcccugucugggauugcugcccaguugcugagugcccuggggcuggauggugaguagcgggaaugagagauagccagcugugccugaccuugcuguuagcggagggggggcuaucugcguggggcuagacagauguuugcugauguccucagagguacaguaaaaggggaggcuagagauucuuaccaccuuacagagguuuacuuguguuggacauugugcaaagauguacugucuccucuuugguuaaccacagccuguggaggcacacacacuguucucauauaacaaaugaagcuccauuuccaguagucuuccgggagucccagucgggaagauugggauucaaaccuguuucccaggccuguaaggaugggcuaugccuuuguaauuauggcuguugggucccuucugcuucacucuuucuugccccucuuugcccucaccacauugcuagauugcugacucuguccuuuucccuuucaggugaacaacucacccagggcuugaagcucagcccuagccaaguccagacccuucuacuguggggagcagcagcacuggucaucuacugguugcugucccugcuccuaggcuuggucuuggccuugcuagggaggauccuggggggucugaaacuuguucuuuuugucgcuggcuuuguggcccuggugaggucugugcccgacccaucuacccgggccuugaugcucuuggccuuguuaacucucuuugccuugcugagccggcucacuggcuccaggagcucagggagccaccuggaagccaaggugagagggcuggagcgccagauagaagagcuuagagggaggcagaggcgagcagccaagaugcccaggagcauggaagaagagugacaagggcguccccaagagacacccucaccguaccaaagagcugagcugcuucugggucucacggaccuccuugcagcccccuugcccuuuccuugccuuguguccggaaccuucacaccuuuaccccugcgcuagccccuggcugagaggagagaaccuguccucugccggugcucagucaagugauggcucccugcccuucugugcucccagccugccucccccagggcagguuggagcccucagcccuggcuucugcucucagccagcaccacugcccgcugaucuccgugaugauuaaccugcugcuuccuuacacaaggccugcccaggcugaagcuccuguuugaccacuccccccccccccccccagcucuuuucuuccugcucccagccacacuaccaucccaagucccuugcggcccucucugucuuccucauugcacugcaaugggcagggguaggagauuggagauaaggaugaagggggaggaaagggucccuggaggccugugcaucuaugcucuguuacaagugccuuagcaggagucagcagcacccuccaggugccccuugccacacugaaugugggaaagugugcuguggcuacuucguggucagagugagccccuugcagaauccccacuccagcaaacaaagcaacggcccugcugggauugucgaaucucccuugaggguuucagggaccuugaaaagggcaggaggaccugcugucuugcaguuuuaccccuguccacucucugccauccagaagcaagcguuggucaguguugugucccaguagcugggaagggcacggcuuugcccugaucuguucugcagggcuaggagugagccugccacuaaccccucuccaccacuugcucacucuuggccuuggccuuggccuuuaggucccugguggagggagaugacccaugccagguccagcacaagaugugaagauuaaaugccuauucuuacugaagguuugauguggaaucauggcugcagugauauguuuuuaucagcgcuuggugguuuuaaagugcaugcuauuuuauuaucuucuucugaauaaaauguauuuacucaaaagucu

SEQ ID NO: 9182 - RNA, 923 nt, Mus musculus
ggaggguuggugaguucacagagaaacucuugggaaggaagaccugagaagugagcuaucgccuaaaaggcuauggggaagcuaggggguccugauaacacaacagaacaacuggguauguucugucaggcuguccugugggcaaggagauuggaauuuacccuaucugugauuacuauguagcccacugcucccuagaaguguauccgguaaaccuacaggggcuggggagacagcuccguuaguaaagugcuuucuaggucaccaugagcugaauuuaauccccagcaccuaauguagaaaagccaagcauggugagcccuuccucucagugcuggggaggcagagacacaaggagcccaggaguucacacacaaauugaacugaccuaacuagugggcccuagacuaaaacccuguuucaaaacaacuccuaaggaugauauccaaaguaaucaagccucugcccucuacaugcauauguacguaucuguauuccccguacgaauacacaggauuacaaagggccaagagaugacugagugaucauguucacugugauggagcuugcucuagacuguuguaagcagcagugagcaugccagggucggugggcauccugggccaugacgcucaguggguugcugaguugugguaggugaccauagaagcuggagcggugaggcagucagugcuggagugcguucucacaaguuccucacacugacauccauucuggacugaagaagcuguggcuucucgugggauugcucuaguugaacaugcccucaagcaguuuuauuuccuuuuucuuugaaggcuggguuucucuuuauagcccuggcuguccuagaacucacucugucuccugagugcugggauuaaaggcaugugccaccauugcccagugaaguguggucuuua

SEQ ID NO: 9183 - RNA, 7839 nt, Mus musculus
ugaagcaguccuuuuaaaacacuuuaaucuugcaguauggaccugggagagcaacaagaugcaaaaguagccaucgaggaguuaccuggcucuugacugcuggccuccagguuucuacacauuuaagagcaaaaguacuuaauugccuagggaucuugcuaggguaacugauaagggucggguaaaauuuuguauuucuauuaccuuccuggcagcucgcccaaggcacuugggaaucacacagguuaagcucacagccugcaucucauaacucccugcuuugugaaugggacaaagggagucggccaaucaguauuuaugggggucagugagaggaaaaggguugagaccagccaacugccaucauuuuuaaucccccauuuggccugagacaggugcuuuaaccacaccuugcuagucagcuuguuauuguuauauauggugauauggaugugucaacucccacuagggauuuucacugcccaguuuuagggcugcugcugcuggcuuucagcagcacuggaucaauucuaggcagagagaacaaccuacccuuauuagcugccuggcagggagagggccuggcagccaucacuuccaaccuacagguaggaggggcaccugugccagucauggaccuucuaucacacauuucauguccuccccaucauagacugcagggaagcuggcugauuccucuuuaccuucuaggggaaggggagcugaugucagaaauugguaaauauggaacagggaugggguagucucaggaucuccugaaccacgcaaggccaggcugguugucaguuguguugagcaggccucaagccuguggcaggcgcuucucaaacuggagaguaaaaugucaccaagucccuccugcuuuacucaguguaccugucacaccauuauuucaaugguuuauuaugauaaugaaagccaaguggggcaggggcuucuguccuucggggagcccagagcuguacuuaugcagauaccaauaaacaccucugcaauagagcagguagguaugacucaagccucgaggcuucuacaguccaguguggcaaaggggugcuggagagaaacucagcucccuguaacacccuacuuuaaucuuuuagugcuaaacuagggaaaggcuagcuucaguugacugaggggaccaaaucaguagaauccacaaguggccaagaugucacugaaaaaauggagguacugacuucugacagcagaccuucaggcguggguaacacccaggaccccaagucagggauuuauuagcucacugggaaacaagaauucacagcugaagaccucuuuuguuguuuugauuuuuuuuuuuuuuagauacgacuucucuguguagcccuggcuauccuguacucuauagacaagacuggccucgaacucugagagcugccugucucugucuccugagcacggggauaaaaggugugcauugcugcaaccacccagcaacaguuuaugacuauaaggcacuuuggaacaggcgggaaaggagauggggacaguuaaaucucucuugagucccagcauagucgucaguucccucugggcuggagucuccgucuuaaugugacagcguuggugugcuggcuccaggagaggugucagucaguggccugagaagugccuuguuugcugaggccuauggacuguccugaacucagaccuuggcuacaggccucugggguggcuguuucuggagcaaggccagggugucucguuuuucaauagaacgcaacugcuucuucuuugcuuucuugagcuuggcaggauugcggaucugaggaggaaauaggaggcaucaguguggaugagaacccucugcuuaucuuugaggaaaaggagacgggaggggggcaagggcccagaacugcagcaggacaaugaaccauguaauacagggggcccaagcaccuuaacggccucuuucaccaugccacagccugcaucccuuggguggguacucaccacuuggacaaucucagccuugcgcucauuuucuagacggcgucucagguuuucagcccggcgcucuuucuucuccugaaacacagagaagagcaaucucaggcuaggaacugagauggucuaggcaucuuaggccacuggugagugagaacugacacaauccuaggaggaaggguagaggccuaggcacuucugggggaagaacagggaugcaaugccugcaaugagggccuggagcugaggcccaccacggcaagaguacccaguuccaaaucagagacccugaaggcagggucuuacacaggaugacuguaugggccaagaugugggugccuucccgcucagaagucacauacaagcagaauggccccuugugcuagcugccagaagguuggggcugguuccagguuuucuucugcccuggcucaggugucccagaaugagaaugcaaggucagguuacagcugggcuccgcaccuggcccuggguaggggugggaaggaugaacuguccaaggcucuggaggaaccuaguccagccugagucuucauucuucuacuuucgaauuagggugcuguggcugagccuguaccuucacuuccucacugcuacaguaaaguugaccacaggaccuaccucaucaggcugacuuaagaaauacgugugugacuaaagccugaaauaguaccagcucuccagggacacucagagccuguucugggggugggaaguccaggguuuccugccacuguacuagcagagcuagggcauggaugauggcuccaacauugauggcuaugugguuaggucuuucuguggcucugacaaccuggggucaugggguuggccugggcccuuggggaggaagugacccgugcuccuauguauuaggaggagggcugggaggaugcaccucucuaguugcucacgaguuggcaacuguuuuggccaagcaggagucuaggcugcacaggaaaaaugacagggccucagugccagcuagaucuggaacgacucaaagcuagguggagggaugccuuagugauugguccaucccuccacccaguggccaagcuggaaccacagauuugagacaagucauuugaaucagugcuccuucuguacccugggcucaccagacuagcagugauagcugaacucgguccuggggacaauccugcuaaccaacccaguaugaccuugcuuacucaguacugacugcuaaaguaaaacuggggcucuuuucaagacuuccuggaggcuaaagguguugggaauaagccuuugugguguuggugacugagcccaaggcucugugcaugcuugucaagucucuagcucaugaucaugaaccucuaaugaggacauuuuugguucugagaugguagaaaggggagugaacuggaagcaaagugaaaggaccaucuccaugguggugugugggagucucuucuagaaugacagugacaaauuugaggcaagcuuuucccucauaagcaggucucagagaggggucugaccccaccacauugaaugcugcugccaccaaguuggccugcuggcuuuuaucucaggcucacucuacuuccaggucuccuccauguccaugagagcagaagcuuagcuggaugguagagugggaauccuaucaugacccucgacuauucuucuuaccucuggggcccucaugaccaggggcucugacuaagucauacuccugugccuaucaugugccuguccagugucuguugcagcagauaaguguuugucgucugggauccaggcuuggaggaauggucccuuaccugccggcgccucuguuucuccuccuccaggugucgggcgaaguccuuagccagcuuucucuccugucgcuccuucaucuuccgcugccaggagguacgcaggggcuuguccugaaccaucugggagaaccuuggcaggagaggaggcaguugggggaccucuguggugcugccuucauacacugcucucacugagcucugggucugcucuuuuuucuuuuuuaacugaauauuuucuuuacauuucaaauguuaucccuuuuucugguccccuucuucccccaccccagagccccgcuaucccauccccccuccuccugcuucuaugaggguguucccccacccacccauucccucugggucugcuucuuguccucuccuaccugccuggcauucagcuuucuacagaaacuuaggauggaacagguugcuaagcauguaggccuguuuccucuacagaggaacuaaccaagacuucaaaaguccucucauuccugaguguagauugaagauuuuuuuuuuuuuuuuccgagacaggguuucucuguauagcccuggcuauccuggaacucacuuuguagaccaggcuggccucgaacucagaaauccgccugccucugccucccaagugcugggauuacaggcgugcgccaccacugcccggcugacuugaagccuuuugugcuaauauagccucagcugugaaauuugcugccaccaaacaugauaagcucggagugaaugcuucuggaaaugagauacucaugcccuagaggggugugcaauaacaaggccuuuuuguaacaaauucagauuauucuccaguuugggagaugugaagguagagaacugggauuuggggauuucuguuaaguguggcuuuucugaagagucaaauguucuuagagucauagaagaauggagaugacaucuguaagaacacucuagggugggcugaaacauuccaggaggggguaagugcagggacaaggaacagaagauuaagcugagccaugaaaugcugaaaacuguugcaacuggugauaggacuccuaaaacucagcucuuuccuuuucuguaauaaaaaguaaaaauaaaaugaagacaagccuucaugucuggucucucuccuacuccuugcugagugugcugggugucccaugggccuguuuucucccccaucuuaucccuagaacucuaaggcuccucagcagauccguucacaguggcccuucugcuuccuacacuaaaaccuugacuccuguaggaguuccuuuuuaccugccuguuauaggguagcucaagccaacccugugucuaaaggcuuggugcaugcugggcagucuguugcugaccagacaaaggucaauacggccuuucugagccaccugcuuccuuccuaggagucuggcacacacaguuuggaaccuggcaccaggcuuauccauaggcauccuguuucuguccccuucccacuguaagguucaauagugauacaaacaugcuccucuccugccaaguucgccagcuggcucaagacccagcuuccuaaacacagagcaguggugccuuguggacuuccuuucuacucuuaaaaauguggcucgugacugcaguacugaggcagaguugauguucagcacuaguuacuggagauggaagacaggcuccgagcccauuacucacugccuaugcgagccugugcaaggaagccucucagccaccgcgcccuucugugugcgagcccgucuggcuggucacccguggccaucaguggccuguauugugguuugcucggacagggaaaaggaacagcuucaaaguuucuccgcuuggugccuuucucuuuaagccucacuuuccucuguuuaauggggugugcuugcgggagggguuauccccugcgcuuaggauuuaagaguauaacaaaaugacuucuguaaagagccugcacggagccucgcacgguccacccuuauucaacgucauuuucuuaaaaucucugaugcccugcucccuuacucuuacgaguucuugucucuggccaguagcugacacuucaacugaacccuacuucuccuucuccagacacugucacaaugucuccagacauugucacagacacugucuccauccaugucacaacaguggacauuucaacugaaugccacuucucuuccccugcugccuaaacaauguccuuuccacaugagccuccuuccucauuccuuuacugagaaaucuaaacugagcacucccaugccccagcacugaagggacagggaagaccucaugucuuaagaaggcuggaacccaagggaagcuggccaccagaagcagguuaacggguucacucacacgcuuugcaaucaaaccuaugcucccaucccgugucucaguuagccuccuugagccuuggcuuccucagauguacaacaccaauccuaguaacaccugcuccaaaggguagaugauuacaugugcugcuggcuaugaaagccucucucuuuggccauccuuaccgugauacauaaccagugucccaugauacauuuuuuaucaaagacaacagcuagcagacaacaguggaaaggaccucacuauguucauauaauggccgccuuucuugcucugccugccacacgagauguggcggacaagguaaagguggcacgucuauaaacccagcacuagggaagcagaagcagguguaucucugaauuucaggacagccagugcuauacagugagacccugccucauaauaaaaaaaggaugggaagaaagcucaaaagaacaccgucuagggcagacauuaaagaaaugaucuuugaggaucuaucucccuccccgaccuuagggcauuuugacauuaugaucguguuuguuaauuucauucgggugaacucuuuacaacccuuggauugcauucaggcgaaggcaagguccaaauguacuaagaacccaacacaucacccaugcuacccccacuuuaccucuucuuggagcggucuuuccacacacgcccggauuugggcuucccuuucggaauuacaggaagcuccuccuucucuuucaauuucuuggacgcuggggccuggggagaggcuauaacucgcuucuuuagguugagacuuucuguuacugucucucccgccggaggcagcuugccuggcuccaacuggcgcucuggggagcuaggugccuggaccgucagcuccugugcuggcugagagggcucgggacccggugcuugcuggcccgggcaaggcucgggggauccugggaucaccuccucuuuagcgugggccgccucagaguccaguucucccugugggggagguaauuuggauggcugcucucguugcggggauuccgggcucgacucugucuguccugcaggugacuccaggcccagaucuugaugagguugaagggacccggggugaggcucuggcugccuuuguggggacccaucgucugcauccugucuaggaccgggugauccggggcucgccucuggcugagguccgggagacggaaggcucagugguggacagggcgauccggggcucgucucuggcugagguccgggagacggaaggcucagugguggacagggcgauccggggcucgucuccggcugagguccgggagacggaaggcucagugguggacagggcgauccggggcucgucuccggcugagguccgggagacggaaggcucagugguggacagggcgauccggggcucgucuccggcugagguccgggagacggaaggcucagugguggaacucucguagacuugagcucuccuguuucuucugaguucgacuugaaaucuacaagagcccguuucgcccgagagacuucggggacaggaagguuuucuggagacagagguuuuaggccuuccagccgccggcugcgccucagcggcguauccauggcucacguguagccucuguagccuucggaacugucggcgccuucauaugacgucagacucguccauuuccguaccgggcaggaa

SEQ ID NO: 9184 - RNA, 1736 nt, Mus musculus
aaacccacaaaacuuuacuuucauuuuguuaguucuuucagaguuucauacaguguauuuugaucauaucuaccccuagucccacuucucccagccccacucccucuuuacccacccaccuuuguguucucguucucguuauaucuguaguuuaacacaccaaugagaguaaaguucaucucucaacccuuauuagagaagcuuccuuuugcccuagauagagguuaacacagagaccaagagcugaucagaauguaaaugauaaggaacugaaggcuuccaagcucuaaaugggacaucuaugucauacccccuucuuccaagauucagggcucacugugaaacagggagcagaaaaauugaaaaagaauaagagaagaggaugacugcaaaaucuuuauacguuaauugucacgaguauuugccauacugaugggaagugggcaacuguaaauggauaaacgcuuauaauggaaaauaugacagaaauuuauaaaaugaaggcugggacuugaaagguuggcucagugguugaaaugguuggcugcucuugcagggguccagaauucaguuuccaguaccgauaucaguagacucauaucugccuucuucuggccucugcaguaugcauguauacacauacacagacacauacaacuacacaaagaaaaauaauaaaaugaaucuuuuaaaagaaauuaaggaaaaaauuacaaguaauucaauaaucuuauuuacaaugccaauuaaacucuuacuauuacucaaaauuacucuucauuuaaacauaagugaagaauaacauuaaucaugcaguguuggcauaugucuucaucugaaaaccuacaucauaauuaaauaacuaaugggaaauaguaaaugugcuuuauuaaaauuaaaaucuguguacagauggagauaucccauuauaccuugcugcagaccauaaggaaaauauuugaauuaagggguaaaaauuauauuauuuaaauaugaauaauaauuauauaguaaacaucuaaaaaguacuaaaugaaaacuaauuaaaccuauuagaaguuccuaaagauggcuaguaaaacauuuuauaaagaaauuggguauauauuuaaauuaaaaugugcauuugacuguuuaagaauugaauagaggacugaagagauggcucagcaguuaagagcacugacugcucuuccagagauccugaguuaguucccagcaaccacacgauggcucacaaccaucaguaaugggaucugaugcccucuucuggugugucugaacacagcgacuauguacucacauacauaaaauaaauagauaaaucuaauuuuuuaaaaaagaauugaauagagacucuuguauaaauauuaaauauuuauaaagcaucucagaggaauaucauuaggaaagaaugugaaguacacauaauaaaagugccugaaguaaacauggugaaaccagaaaagccaaaaccaaaccauccaaacaaacaaaaaaccucuugcagaaauguuuccaggcuucuuacaaaaaauagaaauuauauaaaucaaagcuaagaagaucaaguaaaugacguaccaguaugaaguuacaaaaaaaaaaacagcaaaagguuugaaaacuaaguguaaagaugauuaaagaaaugaauaaauauuuguuagcauugaacaaaggcucccugggugguacucaccugucagagccugaguggcacagcaugugaccuu

SEQ ID NO: 9185 - RNA, 820 nt, Mus musculus
aguaaaaacaaauucugggagauaugggcagagccuguuucaucaaagagcaaagguuguaaacccacaucauuccuggcauucccugaagaacugcuauucaucccauuccaaagaagacauaagccaccuguuuaauaauccuggcucuccagugcuucucagaguguacaaggccccuuuguucuuuacuguugugaguucuacaguucccgugugaacuguuggcugaagacauaagcuaagacauauuauucuaucaucuggaagucaccuuuuucagcaaggccagaacaucacagaaagaaagcccuacuucaauucuggagaagaccaagagacugucuucucuaagaaaucugucccaaacaacuggagaagggguuaugccaaaagcuguugccuguaccuggaauaaguucuucuagguggguugucuuguguggccucaguagguaaggaagcuucauagggacuuaaagugccagggugggaggauacacucagaggagaaggggaggggaaauggagaaagggauguaggaggggagggugccaaggaggagggcuuugagcaggauguaaaauggauaacuuaaaaaacaaaucuaguguuucuucuccuuuuccaggaugccuacugucacuguucccuucacauugugcccugugcccucaucacugucccagaaccuagugaauuagugagguacagcugcucuucugagcuuuggccauggugaaggguagccucuugagggcaagcauacccacuuuugucugcaggagaauuugcuaauaaauuaguugaaucugucaa

SEQ ID NO: 9186 - RNA, 4585 nt, Mus musculus
ccugucuuguguccgcgggccggcaaagcucugaacugggaaaagccacuguuguaguugagagaaaccugacccggcagcacacgcguggccauguggaggcuguugacgcgcguccccgcgccgcuccugcggaugcacuuuucaggucagaaaccuguuucaucuuuuaaaaaggcauuuccccgaucuuccuccccacauuccaaagucuaugcuuacugcgauagguccugcgcuuuccuuacuucuuccaccuccacuaugcggaggccuggguccuggucaugugcgggagacggugcuccgugagccuaguugcuuccuuggaagcccauuuaguggaacucguacccccgugcuucuagacaccucugucaggagugaucagaguguaacaguaaugguuugauuugucauuguagauucuugggcagcccuucccaccagugcuggucugaagacgcuccucccaguuccaacuuuugaaagugaguaccugucauuuccacuuauuuuucucugagaaaaggcaucgaagguguguuugugcuuccucccuccguugagugauucaacagauauauguaaggaaggcaaacugcagcgaagucccucgauguugcaaagcagauaacuauugggcuaguucccaggcauccuaccacugauguguggcccaugaucuacccagucagcacuaacugggcauauaucagauuuuuuuaucuucuaaauaauaguacagauaugcagacacuuagcaauaguagccaggugcucugcaguccuguacaucuaacuuuuuaauguacuaaaaucuccaaaacugcaaauggccuagacaucugagggucuucggcacauaacuguuaaacuacugugugggcuggagcaauggcucagcaguuaauaacacuuguugcucuugcagagaacccagguucaauucucagaacccacaagauuguucauaaccaucugggacuccagcuucagggguuccuacauccucuucugcacauuaauacaugcagacaaaacacuccuaacauuuuugauaaauaaggugcugugugugcuuagaagugcauacuaacuugcagauguaagaacguauuaccaggucucacaguagcugcccauagaagucagugaagggagaguaguuuuuguaacuuggaacagcaacuuuauuauuccauuaaugaucugauggcccuuugaggcuuccuguuuuguuuauucuaucauggagccauucuuucucauauuuaauuuuuuuuuugagucacaguuguuuuccccaggaugucauauagaggauagugacaagaaaaauccuacuuuguaaguuuaccaagaaaaauacaacagaagguuuuuuuuuuuuucguuuguuuguuuuguuuuaaugguauuuuugcaaucuagaggagcagugaguuuuguuuuguuuuugguuuugguuuuuaagagcaugcuucuggcuuugauguuuuaacugaaguuccucuucuuuaaaguagagauuagaauaccacuugcccaauuauguuucuuggccuagcugaaaauuauguaugcuccuguuuucaauucuuuuuauuuuuaauugccuuuuauuuauuuuguaugcaugcacuugugugggugcguaugugucaaggcauauaucuggaggucugugacuacuuuugggagucaguucucuccuucuaccacgugggcccuaaggcuccaacccagaugggcaagcagugcuuuuuaccgguugggacaucuugugggccccuuguuuucaauuucuaauacuucacuuuguauuucccccauuugucuguuuaguguugaagcccuaaagaaauauaaagguugccaccacucaguccagcacuuccugcagguucgagguuacacagugaucacaugacauccauaagacugucucaacccucugcguacauguuguggguguauagcgaagucuucaugugggacuccuaacggggcugucucugacucuuuugacaguuuuugggacccuuuucuucaucuuggguugccccauccagucuuaauacgacagaaggugccuagucuuacugcaacuugauaugccacguuugguugauauucaugggaggccugcccuuuucugaauagaaacaggaaugaguagauugagaugggggaagaggggagacuacaguugggauuuuuuuuuuaaaaaaaaaaaacaaucucaaaauaccaaagcugcuuuaacagugaaugaaguaauaauugagaacagucccuacaaauaggggcugaacauacagggggguaauaagugaauuuggcugagaaacauuuguguaagcauuguuauagcugaaagaguccagugucgcuagaaacauccagaggcaaaugguaaccgcuggaauuauuacucauuaggcccucugcgucgugcaccuucacuuauucuugauugucuuugcuccugcuagaugucuccaucccugaaagguccaagcuuaaauuuguugaaagagucccacuugugccaaaaguaagaagagaaccuaaaaauuugaaggacauacgagggccuucaacugaagccacugacuuuacagaaggcaauuuugcaauuuuggugagugauaaaagagauuaacaaaguuuucuucucuuugaguugauucuagucucuuccuccacauuagaacugccacaccuacauccacauuccaauugcucuuuaaauagauauagaacuaggcuacuggguucccaaggaaacgugaguuauauauuuuucuacaguguaggauugaaaacacaggagucccauacuagaugcuugagaguuugcacugaauucugucuauaagcccugugauaauguaaaggauccaauaaccuaguggccaacaagcagguagccuauacaacagguauucacugaacagguagaugguucagauccaugugaaauuguguuaacaaaaaucuagcaagguuagauuuuuaucuugcuauuucagaaaauauuuaguugaaauuagaaguuguuuacagcaggauggccacuuacuauuucagauggguuggaacuauagaggcgguaaggaagguugcuguaaaagcaaagagcaaaggcgcuacuucaguuccccaguuauaacaagaucuuuucaagucucugguaaaaaugaaguauuugugggugagaauuagaacaccugcuucaugcuguuucuauacagugguuucuguaaagaauaauguuagugccguggguggcuaugugcuagcauuucuggcagccagagugauggugaagucuucuucccuggccugcacuguacccuugagcgcugcugcugaccucucagaaccuuaugcccacucugcauuccuacccuaccccagcuacacugguucuacuuaaacuaccaagcccuuuguugugucagggcauuuacaucaauguuucuccaccugggacuguccucuucugacugguucuuaggauucucuccucagcuuucagugucaucuguaaaaaguccucccugggcucuccaugggagugauuccauccuugcugucuuuuauuacuguagcuuagguguuuccuccauauuacuaauuacaacuuagaugucuacuuuucauguguaucauuaaagccaguuacuauaaaagaggcggcaugauaauagacgccauacuuucuaaaucccccuguguucuaauuuaucuguucauuuuuaggcacuuggcggugguuaucuccauuggggccauuuugaaaugaugcgcuugacaaucaaccgcuuuauggaucccaagaacauguuugccaucuggcgagugccagccccuuucaagcccaucacucgcaaagguguugggcagcgcauggggggagguaaaggugccaucgaucacuaugugacaccugugaagacuggcugccuaguaguagagauggguggacggugugaauuugaagagguaaaagguauccugaaccaaguugcucacaaguuacccuuuccggcaaaggcugugagccguaagacucuagagaggaugcaccaaaaucaaagagagagagaacuuaacaaccaaaaccccuggaccuuugagcacauagccacugccaacauguuuggcauacggaaauuccugagcccauaugacuugacgcagaaagggcgauacuggggcaaauucuacaugcccaagcguguguagugaaagcgcgaggaacaugugcgcagccuccugagcgacaaucugcgccuuuacuguccugagggucuuugcugguucuuggauccuaacuaagcacaugagugagugacuucugaaaaacugugucaccugguugauucuaauuaaaguuugaauguaaccucaggguacaacuucucuuuggucaguuucaguugcuuacaggauuaaggacaguuugauagccagcugucccagcacucaggaggcaaagauggguggaucucauuuguguucaaggccagucacaucuacaagcaagauccugucucaaaaaaaaaaaaaaaac

SEQ ID NO: 9187 - RNA, 950 nt, Mus musculus
cucauuguuuuucaagcaggaggaagcuuaucaccaccuuccucaaagcauccuugaguucucuguuccucaugcuguagaucaaaggauucagcacaggagugaugaagguguaaaccacagauacuaccuggccccucucaggagaguagcuggagcugggacacaaguagaugaggcuuccacauccauacugcaggaggacaacggucaggugggaagaacagguagagaaggcuuugugccuccccucagcugagcggaucuucaggauggcauccacaaugaagacauaggagagagugaugaggaggaaagggauggugaggacgaugacacugaccacaaacagaguggccucauggacaugggugucugcacaugccagucucaugacagggaggacaucacaguagaacaagcugauuuccuuacugcuacagaaaggcagucggaagaugagcacagucaacugcauggccaagaugaaacccagcaacagggaccccagggccagcuggacacacaagugccagcucaugaugaggguauagcgcagagggugacagauggccacaaaccggucauaggccaugacagccagcagaauacagucagcacugcccaggaagaugaagaagaacaucugggcaccacagccugccaaggaaaccacaguccucucuguggacaggaugcuggccagagucaggggggcuaugguagaagaauagaagaucuccaggcuagccagguuggccaggaagaaguacauagggguguggagacaccgauugguccagauggugaggacgauggacauguuucccccgaugcugaccagguacaucaugaggaaaagcacaaagaucagcaucugcaccucagggaguuuggagaaggggcggaaguggaagaggaccaucccagucugauuuccuucuuccaug

SEQ ID NO: 9188 - RNA, 2053 nt, Mus musculus
augcacuucagcacgagcagcacaugagcccuucccagcagucaguuuguuaccaguuucccacucuugucucuucugccacuugugcuacaccaacagcugcuucuucucuaugagaggugcagaagccucuugggcaugagacagaaagucaaaaggagagauuuauaagcuuaaaaagcuuuucuuaggguggaaauuccaacuuagcuugucagcuaccaucuauguggauucaauguaggcaacaucaacuuugaccaaaucagaguugguaccacguguuacucauucuguggcccaguagcaauaccuacauuuccaauuuacuaccuucacuaucaacauagcaaacacaccuuuagcuccagcuauuaacaagaggcuuuuaaagaaagauguagaacucuaucccaaagaccacccaauagugaaaacucuggcuccuucugggaucauaaaaaucaacagaggaaauauuuuaaaaugucaagaguauaugacaggcagaggcuagaaaacuguucuacucacaaggccaacgcauuccuguucaaacagaugucugggugacuggauaaacaacaaaacaaacucaaccaaauuuaaaggaaaauaggguuucauauaacacaguaucaaaaaguagacggaacagacuaaacgcaccaacugguggcagguaaguccacagccuauugugacagguccuuccagcaucgaucagauuucuucucauguuuucucaagguuguuuuacagauguggugacuuuaacaagagucuaacaggcaggcgggcgggcaggcaggcuucaaucauugguuucaggaucugucugugccauguaggcauccaauucagcauccaggugcccuuuaguuuucgacauguaugcauccaauugguuguccagcugcuccuuggucaauacagggcgagugagggcaccucucccucggccacgaccucggccucuaccuccaaagcccucucuuccccaaccuaucauaccccgaccucuaccaccgauuccgccacgacccauagcuccacgcccuagggcuccucucccaggaccuccacgaccccgaacaccaccucuucuuaggcccauucggggagcuacggcuccaccucggagcagguuuugaccucggagugacaucccaccccuaagcaggguucugguagcacgucccccacguaguccuccucguggcaagccucucuggauuauggguaggccucuuccuccaauugcuccccuggccacggcaccuaugggucggccuaaccgugccuggauaucacucuuacccaggcgcugcuuuaagcucuucugcuuaaguuuuaaugcugccuggaaagagggucuauucucuaucugcugggccagucuucuguuucuggcacuggcuagcugcugcugcugcaucgaagcccgaauauucacuggcaucggcuguuuguucuucagcauauuaguaaagcgcucauuuagagacaucuugauggugcuuuuuagcacaacuuucggcgcugacuguucagccaucuucaaaucccgagaaucgaaggagauggacgcaagcgcuccucccaggguugccaccacggcugcgggggggcggccgggaaccugaggugaugaaccugccugacgaaccacggcugcagcgggccgcucagguuaacuagcugggcgguuggcuuagaugcuuaaacgguaggaugcgaggcuuccucguuguggguugaguaucuagcugaccgauccucccgcucgucaagccugcccuuuccugccuuucgucugggcccccagagccggcgccgccaacucccgcuuggugucaaaaaaaaaaaaaaaaaaaaaaaacgagggaauuuauuaugaugacuuacagccuguaguccaauucccuaacaauggucaguuucgaguuggaaguccaagaaugugguaguugcucagucccacaaggcuaguuguuucagcuggucuucuguagaaguagauuccaacagauggguuggcaaguaaaugcaa

SEQ ID NO: 9189 - RNA, 32700 nt, Mus musculus
cgaggcgcgccugcgcacguccccacgcacgcuccggcguacggcggcggccaggggucgcgagccggugggagacccgcgcgcgcggagcagcccggggagucggcgcuucuuuucccucccuccccccacuccccuccccgcucccuuccccccuccccaagaauguuccgcuacgaggugaguggcugcgaccggaagugaccccucccucgcccgcgcgccccuuuuuuuuuccucugcucgcccgucgcgcgggucuugugcggcugaggagggggcagggcgcgggcggcugggaaccccgcuucggccgcgaggcucgggugcggcccgcagcgcaccgcggaggggcgggacuggcgagagccggccgcugguuugcggcggggagagcccguuaagugcgguaaccugacccuuggcuugcgccucugcucgcggagcugccuuggagaccugcauggcuccuacccggugguuuuuccugaggcagaauccccggggaaugcccacggaagcguuucccgcccugcccccggaaccccuucacccggauuacacacagcccugugcacgcgggcugccgucagguggaggggcagggacugguccucgggcugagacuucagucggcuuggaaagaaggcugggaguggggaggggggcgugucccgcagaaguuccuucuaggagaagggagaaaaaguguggguuuggcgacguuguuuggagaacggagcuguuugcugaccgucucuuacugcugugugaccuugagcaacuccuacucuuggggccaaacagacuccggauuuguaguuuaaggacugagcuagggaaauccuuaccgagucauccugauuugguccaguagaugauugccauuucauagagaguugcuagaaguugcuucugguguggaggcaguugcagggcuggcucuuuagggggaggaagauuggguagaaacggccccuaaaaguucccagguaaguuauaucacaagcuguuccccuagaguguggaauuccaauuuggaaucuuuaaacauuggaaacaguagaaagcuugagcuuacacuugugacucaacucacuuuuuguaaacaugaggagagaugaugagauacugugaauagaaguugccagaagcaaagaaaacuuaguaaacugaauaaaucuguauugggauaagugauugaaauuaggauauaccaagcuugucuagugauuuuuacucccuggagacugcggcaagagaaucaggaguucuaagccagacuguaccuagagaaauaguaacuaaaacaaaauaaauuagagcauacccaagaugugauggggauucuaguuuuuguucagcuuucuaaaaucuuugcuguguuuaauccucacacagauuucuuucaaaguuguguuuggcucagaauuacaguuuaaggcacagagguauaauaccuaguacagagucugagacauagaggugucugggagcuggagagauggcugcucuuccacaaaccccugguucaguucccagcacccacauggcagcucacagcuuguaacuacaguuccaggggaccuagcauuaucacauagacaacuuuguaaguguagaaagaaguugugauuguuuuuuaacgcuuaacuuaaauugcagcuaaaaaagaugguguucuguuuucuggcuagaguuuaguccuacaggaaagaggaagaaaaauggacagacuuaaaagcauugggaaaacgacagggauguaaugaguaauauggaauuuuguugaaaaaguuacaugaaacucaggaugauaaaguauucauuuauaauuaccacuauuucaaacagugauauaaaggaauuuuguaucauuaaaaaggcccaacuuuaaaugacuauauaaaugucuugagaaauuaaucauccuuuuuuuuucuuuuguagucuuuggaggauuguccucuagaugaagaugaagaugcauuucaaggccugggagaagaagaugaagaaauugaucaauuuaaugaugauaccuuugggucaggugcaguugguaagugacauauuuuauacugucuuuguugaucucaucacgacuuugguauuagguccaccuguaaugugaguuuucuguguaugcaugugugcggggguggguaagcguguuccauggcugucuugugaaggccaaaggaaggccucaagaguuggagcucacauucucccuuguugagccaggaucccuccuguuucuuccacagagcuacauauguaaggcuaggugacccagagaucugggucauuccugugcuccaucuucugucccaaaguagaauauucggauuacagauguugaccaauucauccagcuguguucuggggguuagacugagguugucagauuuguacauaaauugauuuuauuugucagauuuguacauaaauugauuuuuauuuacucaggugagcugaguguucuuccugacccaguuuuguuuauauaauacagucuucacuaaauaauagcaguucaucuucuguacugcucaccagggccucuuugcuucaccuauaauagcagguauucucaauucucuguagcuauagguugccaauauaaggaauuuaaauaauuggaaguagacauuuaaaugagguugaaaguaauccuggauaaaggauguguuuguagagaguucaaggaaaacgaaaacuaguggauauaucgaaaauucugacguaguauguaagacauuuuaaaauucacuuuaccacaaucagauggaggaagaacuugaguucuaggcuagccuagacuacauggaaaaaccugugucccaaaaaaggggaggaaaagcuaggcaauagugguacccaccuuuaaucccagcaucugggaggcagaagcaggcagagcucugaguuccugucucacacacacccuuaaaagugggaggaagcuccuaggcuaucacuaguauauugaauaauaauuucuacugucucagaaguguuuucagcacaguggaaacacuaugcaaagaauuugggugauaaaauguucucauaaauuaguaaaaguacuuagaacaaguucagagaaaguagacuaagguaaaguuuauacuuuaaaagagcaaguagaguauacagaugccuaccugaaauguagagauuccugcuucagcuuguggagugcagcagugacgguguguagguugguguguguguaacuauuuguuauuucuuuggaauugccgaaguucagucuguacuaguguuugaaguucaauaauaaagaaagucaggaaaaauacaacagcagugggcguucaguaccaaaaagcuuuaaaaaucuuacagaggauacugauuuugcaauaauuuaaacaguuuaaagucuucaaggcucacagaauuaaaugaaguggcaaaaaugaaagguuuguuuuuuuugucuagcauuuacaaaagucaguagaaaucuaaaacucuccugagggagagcagcaagaaaucugcuaacaguagaagcagugcuugguagacaagaguuaaagaaucuuggaagguagccagaguuaggagaugagauuguucaggagaaugacaugagccaagaugcuguugucugucuccauggcgauagcaaaggaaacuauguagacuagaauugcaagcacugagaagugauacgaauugcaaauuguauuuagaagauaguuuagcaguaguuccuaaaauacaguaaaagcuacaaacacuauauacuuuugucaagauuuuucuauuaaaauacuguauagaauguuaccauuuucagcaaguucuucaguauuaaaauggauaugcuuaacauacuuuacuaagaugagacagcauaguauguucucaauuuugaaccuugacaaaaugaucuuugccuucucccugacacucagaguuuugacagugcacccccuccaauccuguuugucagcacaagauagggacacugaccugaaaagaauacuguagacuucuuuuaugugaccaaguaaagguccuuggugcagaguaaagagcagugaguagcauaggggcaacaagguaacauagcuagcuuacuuuguaccugaaggggagagugauuaaggacuucuuugccaacaaagauuauaacggagaaaaguuuguaaauugaaauucuuucuuucuuuuuuugggggacgggggugggggcaugugguuuuguuuguuuuuuuguuugagacuagaguuucuuuguaugacuuuagcuguccuggaacucuguagaacagauuggccuugaacucagagaucuguaugcuucugccuaccaagugccagugcuaaagguguggcaaacugaaacucuuaauuccuuacaucuuuguuauagaaaaaauauaacauuauaaaaauaugccuccuaaguugaucuguaaguucuuuggaaaaccauuauagagagacagaggggauacagaguuuaaaccaguguguaaaguugacuugaugguuuguaauuggugggucagcacuuugaguacuaccuguuagcauaguggauacuuuacuggcuacaaaaguucugaugucuccuuucuauaagaagcuuaaccuuugucuucugcauaaaaaaacuuuucauaucucagaguaacaaaugguguuacaguaaucccuauucauuaucugaaaauaaguuuacacuuaaacuuauuuaaaggaaguccagaccuuuaaucccagcauuuaugagcagaugcaaguggaucucugaguucuaggcuagccuggucuacagaguauguucuaggacagccagggcuacauagagaaacccuggggggggggggggggauuguuacacuuacuuggugguaauaggcuccauucucaauaauuuacauuuauuauuaauauuuauagcaauguuuguuuuuccuguacuaaagauugaaccaacaccacacaaggcaagugcuuuaccacuuauauccccagccccaguauuauccuaauuuuaacagauaaggaagccacgguggccaagggguucagaaacuaacuacaauuaguaugaacuacugguuguauauagugcagauguuuuggggaagucugagccacuuuaauuuggaagagcuccauguuccuucaucccuccacuuucgaguugacuuagaacucgccugaagcuaggcucugagugugcuagagcuuauggaaaccguucauugggguguucugguuuauucggugaaggacugucuccuuccuuucuuuauucuuaucucuuugaccaaugcuauacuuaggucgaacauuggcguagaguuaaacaacuauauuuuuaguuuauuuguauucauguuuuauuuauuuguaugugcuuacuguguguaaaguuuaguuucacuuuuuaucauaugcauuugugugguccauguguguguucauguuuacaugugugaggauauggagguuaaugucaggugauuuccucagucacucuccuacuuuauuuacugagauggaagucucuagcugaauccagagcuagccaacuuggccucaggauuccuccccaccaacuccauuacugcuagguuuacagguuggacacccacucggguuuuuauauggguugcuagagauagauuugaacucuugaccucaggccugugugccaagugcucuauccauugagccaucuccccaguuccagucaugauuagccuuugauauauaaguauaguuucccaagacagggcuuuucuguguagcucuggauguccugaaacucacuuuguagaccaggcaggcuucaaaugcauagagaucugcuugcuugagugcugggauuaaaggcaggugcuauuaccaccuggacaaauaauuucugucugaaguauauuuuuauuuuugccuuuugaguaaaacaaagguuucuuucuuucuuucucucucucuuucuuucuguuaagauuuauuuauuuauuauauguaaguacacuguagcugucuucagacacuccagaagagggagucagaucucauuacgggugguugugagccaccuugugguugcugggauuugaacucaggaccuucugaaaagcagacugugcucuuaaccacugagcuaucucuccagcccaaauucauagcuucucauaauaaaguggcuccuuaaauuauuuucuauaagaugacauuucaagaaaaagugucacuugaccauacgaggggcuaaaaaccauacaugacagaugacuuauguauagaagcuuggauguauuacaacucuugccuuuucuagugauacagaaugauccauugauuuaaagacaccuuaaugggacugauguguuccuauguuucuaaaauaggaggccuugaguccuuugacaacaaaaucuugaauuuggaaguccuaccagcuuaggguucuuuccuucuuucuuucuuucuuucuuucuuucuuucuuucuuucuuucuuucuuuccuuccuucuuucuuucuuucuuucuuucuuucauuaguauuauauaugugauacauuucuacuugauaaauaguagauuuuaaauacauagaugacccuaaaagcaagagcgccuacauaaauacuuaagauucuaagauauaugcaucaaguuucuuacaaugugguuuuaaaucauaugaauguuuuucuagggaauaagcuaaauuauaguuuguugauaaaauggguucacauauagugguuaaaaaagaugagaaaaaaaucaguaguuuuaucuuguauuuuuauuuaugagaagauagucaagauaacauuuuguagcaagggagaguuaaaaucuuguuucuguuguuauuuucagugugacuugucuuugaccauccauuuauuuuuauuuucaguuggccuuucuucuauguuccauagaauaauauucuaaugcagugugucauuugcuuauucauuguguuuauuuucuuuaucugagggaaauguggagguagcaucuuguguucuuaacacaguaccugucauauaauagaggcuuaacaaauaaugaaguagauucaaaggcuuggauucuaaguucucaaccuugcuaaugcucugucuucaguuuagaaaucaguuucagacuaguguucagauaccuuuaguugauacuuuaaaugguugguugauccaaaagcuugguuuuuagggguagaguccaguagagggaagguucccacauguaugaccaggugcaugcucuuuuguguguguguagaaaaaaaaccagaagcaggugucagauccugggagcuagaguaccagacaucugcaggaccccugacuuguuaugcuggugcucggauuaaaacuccagucuuaauuauuauacagcaaguacuguuagccacuaagccauuucuccagaccccccccccuuaauuuguauuuuauuccuaauauaaguuuuuuucuuuuuuaauaaugaaaaguucaguuuauguauguugugucugcuuacagaaacuuaaauauaacacccuuuaaaagagauagguggaggagggagggggacuuuuugggggggggagggggacagggucucauugugcuacucuggccggucuggaacuuguuauguaggccuggcugacucaaaggucacagacauacaccugccucugccucgcaggugcuaggauuaaagacaugcaccauccugugcaacugagcuauauuucuuaaacugaccugucuugcagaugaugauuggcaggaagcacaugagcgccuggcugaguuggaagagaagcuaccuguggcagcugaugaacaaacaggcaauggagagagagaugagauggauuuguugggugaccaugaggagaaucuagcagaaaggcucaguaagauggugauugaaaaugagcuagaagauccagcuaucaugagggcaguacagaccaggccaguuuuacaaguaaguuacucugauuugggaacucacaauggcucaaauaacaacagauuaauaauuaaagugcugagguuugucauuuauuuucuguuuaauaauagaauugcauguuccauagacaguggcucacaccuguaaucccagcacuagggaggcuggggcaugcagauaacuguggguuggaauuagccuagauauuuagcaaggacagccugggcucagaacaagacacugucuuauaaaagaaaacaaaucaaaagguugauaauuccugauauugacaacuuuguagaugaaguuggggagucauguguauucuaggacacuguggcauauuccccaguaguucagguucaagucugagagccacaccauucuagacccuguguguauguuuuccuuuuuuuggcagccucaaccaggaagucugaauuccagcaucugggauggaucugaaguucugaggcgaauccguggaccacuacuugcucagguauuaaacauuccucuuuauguagaaugacucauagcuacagauaaguuggcuccuguuuucauccuguucuuacuguaaucguauacaaguaugcaucauccaccagggucaccuugacuacuagcgcuccuuuccucagccucagguuuuaaaggcugaaaggggguugcuagaacucacagaugucaguguaugauuuuaguuaguuaaaaaucuagccaaaacugcacgucaaggacugugauggggcacaaagccaagggcugauuuuaaaagguuaacgcaaaggaauuuuaugggagugauaaaauugguguauguacuuauuaaaagucagagaauuguauacaaaaaggaugacuuuuacugagugugaguuaaaauuaagauaauuuuuuaauguaucuuuggcaucuguagagauuauuaaaacaucacaaguaauuucucuguaucguuuuuaaccacuuccucaaucaggaaaugccuacagugucuguauuagaguaugccuugccucagaggccccugcagggcccagaagaugaucgggaccuuucugagcgagcuuuaccaaggcggucaacaucaccuaucauuggaaguccuccuguuagagccguuccuauaggcaccccaccuaagcagauggcuguucccagcuucaaccaacagguaccuuucauuaacguacacagcccaggauauugggaaucugggcaaaauuauuugggauuccgggaggaggguggauguuguggguaggcauuaaaagaauagccaauuagagaaguuaguauaaaugagacacauucccuaauaccauuugcugcuccugcugcugcugcugcugcuaccuuuuaacugggggagaaaagaguagcuagccacauuaguacauauguccuuuuuuaaguguuuuacuggcugccggguacauuagcagaaagaauacugaaagcuggggggagugggaacacucagcauuguccacaucccuuuuuaccuuuaagauaucccugcuuucccuagagccugugcaguccuguuccauagacuuuccuccaccugaaaccagcagcugaaaaggaaggccaauuuggaagguauggggggagggugguguugguauggccuaguuaggcucaauauccuaagaaaugguggagucacaauguaucacaacauugcugagcauggcggccauaucacugaggcuucagaauaggacuuaguuaauccuccagcuuucuuaucauuccuucucccucaauauaaccaaaccauauccucuuggagaaaauuuucaagucagaaugucugcugguacuuccucagauagcauggaaggguggggauacuggagaauuagcuaaaucaucuucaguuaggaugaaacugauuugugagaggaagugaccagagguucucuuuuugaauccauagccagaacaauuugcuuagaaguaggguuuuucauugaguucugugucucuaccaguacuugaggggagggaguguaggaaggcaaaagacugauuucauugaauguaguuuuguuuguguuuguccuaauagauccuguguccgaagccuguucauguucggcccccaaugccgccacgcuauccugcucccuauggcgagaggauaucuccaaaccagcucugcagugucccgguaugucccuuuacaacauaacaggacuguuuaaugugaacuucaugaucaccauuaguguguauuguguaguauguacuagauuauauguauuucuuguaaucucuuuuauuuucuagaauuuucagucccaagaucaaaggacaaaaguuuacuuugucucuugucacuuuaagauucuaaguccaggggcuggagagauggcucagugguuaagagcaccaacugcucuucugaagguccugaguucaaaucccagcaaccacaugguggcucacaaccaucuguaauggaauccaaugcccucuucuggugugucugaagacagcuacagugucuucauauaauaaauauaauaaauauucauauaauauuauacuuacauauaauaaauaaaucuuuuuaaaaaaaagauucuaaguccagcuuggcauugcuauaucugccuauaauccuagcagacugaggcaaaagcauuccuaauuccaggcuagccuggucuucauagcaagugaguuucaagcugagcuacuuagcaagacucuugucucaacaaaaggaaaaagcacagaaagauucuaaguucauuuuaaucuugguuucugcugccugagccuuuuauucuacugcugucuuuuuccuguuacacagacauaguauaguguuucauaauuuccagcauucuuuucugauauaagaaucuccagcuugggaguuuuuaauaucuaacuuuauaccaaauuuauacugaguuugcuuaaaauuuugauuugcuuguuccauauuaugaacauaauauccccuuuuuguguccuuagaacuccucccuccugggccacccuuuuccuccuaauguuccuccuguacuuaguccccugcagagagcacagcuucuugggggagcacagguaagccuacaguuugcugaacccauaaagaauccugcuguccuaagagucauugcuugacacccuuuucuuucgcuguuagccacuugucccccugcccccuuuuuguuuucucaagugaaguuauuaauggaaacugcuugcuuuuugguggugcaugccuauguucccaacacguaggaggcugaguuaggauuauacaugugaggccauccugggcuguacagggaguucccaaacauaaagagacccugucacaaaggugggugaagccggugacgauugcuaguucuucugugucaacgaucuucuccgucuuugcagcuacagccuggacgaaugucucccagccaguuugcacgggucccuggguuuguugguagcccacuggcugccaugaauccuaaguugcuacaagggcgcguugggcagaugcuucccccagcaccaagcuuccgugccuucuuuagugcuccaccccccgcuacgccaccuccacagcagcaucccccuggcccaggaccucaccuacaaaaccucagguauaaaaccaugccucugaugaucgauugucagcccucccuuuuaguuuuauaugguaaaaguuucauaaucucucguuuaguuuuauaauguagacgucuugggauacuuguugaguacaguauuugggaguccccggacccuugcguugucaagagaacugcuugagucuucaggcuauacacugcucucaggaaugucaugcuuccuuugcacgugaucaauuaucugccgcuuuuacuuuuucugaaguuucacuucauaccauuuugcaaacacucaugcaguaaaaugcacagugcucgugacugaagaauuaccacaaauaauagguggcagcagaagccaagaggcuagcugaccucagugucagcugaguugcucgcuucuacuuuuacuugguuucugcuuugauaaaauugugucuuauguaaaucauagcaauuuauguucuuaagagaaacaucaguagaacauacauaaauauggggagaguuaauuuuaggccaaggaacugacuggcaaauuggaaacccauguagcaaacuagaaacuaagagucacguugcaauuuugaucuugaaguaugucagcuagauacucagcagaacuuuauuuccugguacuguuuacuucugaaugacuugugguuugggcuguuaggcuucccagauuauagaaggcaguuucuuaaagucaauggauauaaguguaaaugucuacaaaaugauuucauggcagcuuccauacuaggguuugguuaaaguugaguaucguagcuggucagguugacauguaaaauuaacugccacccauauacuuccuacauuauucccacaaaaaaauuaaagcuaaauaauacauuuaaaaauuaggaaugaaaaaccuguauuguuuuaguacuagugcacggaguuucauaguuauccucuuggguuugagaauuggucauuggggaaaaaauauaaaaauaugccuuuuccuucuaaaaguuuguuuauaauacacuggcugucccuucagugagccagugugaaguuauccugcauugaccgccuuuuuuaaaaugaagucaauuaagaugagauaaucaaggagcauuuuccuuuuuccuuagaccucaggccccaauguuuagagcagacacaacucaccuucauccacagcaccggcgccuguugcaucagaggcagcugcagagcagaaagugaguauccaucacuccugauauguuagggaccuggugacuugggugaccucuuggguuacuuucuuuguuuucuacauguacuuaguauggagcuuauuuuguuagccaaaugcaguccuuuuuucuuuuuucuuucuuuuuucuuuuuuuuugguuuuucgagacaggguuucucuguguagcccuggcuguccuggaacucacucuguagaccaggcuggccucaaacucagaaaucugccugccucugccucccaagugcugggaucaaaggcgugcgccaccacaccuggcuaaaugcaguccuuucauguuuuguuuuauuacauuuauuuuaugcuguauaugugcauauauguaccugugggguucagaagacaaccugaaggcauugguucuuaucuuccaccaaguugguucugggaauugaacucaucuaucaagugcuccaacccacugagccguauuccuuaccccugucuguucuuuugggggggguggggggggagaaugcauguguacauguucggucaggcaguaacacuauaugcuguauagagagagcucuuuauaugcuagcucuagauaauaucucucugcuacauuauuuacuucauguaugugacaguuuucuuucagcacaugggucccaggaacugaauucagguugucaggcuugaugucaggcacuuuaaagacugagccaucuggcugguucagaugaucugauuuuuaucaacaaauucauaguuacaguuagguuggccuuaagacauaauuaaugguugagcucugacauuuauauuccuuuucaaauuuauaaucccccuguuaacuaccuuuuucuuugucuucuaauucaaaaguaaucuuaaaauaauagccaacucuaaauguggguguuaugugagcccacuggucguucugucucucucauuauuucaucuucauucagguauaaauauauauuuguaucuguggcccuagcuguguggccaaacuaugguaagcuuuaaaaacugaaaacaguaggauaugcaaagccucugccuucuauaugaagucauuuuauaauuauuuaccaagauaaauuagggaaacuaaguguagguaggagggcccuuccucauccauuuuuguucuauguguauauauguaaaauuccuucucacuuccaaaaauguucuagaauauauuuuugcaggggagaaaaaagagacaauugcagacuuaagacaaaacuccaaauauaagcuauauagggaaagauuaguacauuuuaacuguauuaaaaguuaagccuugccagguguugauaacacaugcuuguaauucuaucacuugaaggccugggccuuaaaaacggaagaagccaacaguaauaaagacagcuaaaaaaaaucuuuuuuuguuuuaaagaagaaauaaaaacacuaacaacauaucaaaauacuccagucucaguagaaacaaggugauugaguaguuccgaagaccuaagggauguucaagcauacuuauuucagagauaaagauucaaauuagauaauagguuacaaucaucacucaaagcaaaauuugaagugucucagcaccuaauuuggugaaaguauugaguagaccgcucuuugggagaggauuuaggcaguagauaauaaaguuaaaacauggcuagauccuugcaguuggacuuuauaguauuuccaagauacauugugauauaaagaaacaagguuacuuauguaaccagaagcauacagaauacuacuaaggcaacaagaguuaagaaagaaagauauucuauauuggauauuagcccucuaugggauguggaguuagugaagauuuuuuucucaaucuguauggagguugcugauuugucuuacuauguccuuugcuuuacagaaucuuuacaguuucaugauuuuagagcaugagccauuggaguucuguuuaggaaauuucccccuguaccaaugaguucgaggcucuuucucacuuucucuucuauuagauucaguguaucucguuuuauguugcgguccuugauccacuugggcuugagcuuugugcaaggugacagggucuacguucauuuuucuauauacagacagccaguuagaccagcuugaagauacuuucuuuuuuccauuguauauuuuuggcuucuuugugaaagaucaaguguggguaugugugguuuuauuucuggaucuucauuucuaacacauugaucaaugugucugucucuguauuacuaccaggcaguuuuuaucacuauugcucuguaguaaauagagcuugaggucagggauaaugauuucccccagccguucuuuuauuguuaagaauuguuuucacaauucuggguuuuuugccuuuccagauggauuugaggauugcucuuuccaugccuuugaagaauugugaugggauuuugauggggauugcauugaaucuguagauugcuuuuuuacuauguuaauucugccaauccaugaacaugggagcucuuuccauuuucugaaauaugaggcccgccaacacaguacagcagagaacugccaggucuggguucagucagagaagaugcaccuaacccucaagagacuggaggccccaaggaguuuagaagucugggaaggggguuggugacguucucaaggaaacagggggaaugggaaggagguaugggagguggaacagucggagggugggcagggaggggaauaaaauucuggaguguaaaaagaaagaaaaaagaaagaaaaauacauaaauaauaaaaaguuuucauuauguuacauaaucaaagcacuuaaguagguaaucuaaaaugauugagucugaguaugcccaucuguccauaaguuuagaauaaaguuugcugccugcccauaguaaaaaaaccagacaagacaagacauucaaagacagauacauaagcaguacaaagauaagaggagaaggcguugaggagagaccauacaaaggcagcauggugauucuucugugaagaggaagcuauaagagggcgggagagaugacucagcaguuaaagaguaucuccuggggcuagagacaugacucaacaguuagagcacugacuggcugcucuuccagagaaccugaguucaauucccaggaaccacaugauggcucacaaccaucuguaugggaucuaauacccucuucuggugugucugaagacagguguaguguacucauauaaauaaaaaauaaaucuaaacaaaacauaacaaaaaaaccuuauuuuucagaggaccacaguccaguucccagcaacuaugucguucagcuucauaaccacagauaacacuagcuccaggagcucgaacaccucuucuggccuauauaugcacaaauauacauaaaacaucuuaaaauaaucuuuaaggcuuucagcuaaccuguauuauuugguuuuugaaacagguuuguucuuuauaguugagacuggccugaaacauuauguuagucuaugcuugaacccacaguccuaaguaagccguuuuguuguuggugauggguuuuuguuugguuuuuugguuuuuugagacaggguuucucuguauagcccuggcuguacuggaacucacuuuguagaccaggcuggccucgaacuaagaaauccaccugccucugccuccugagugcugggauuaaaggcgugcgccaccaugcccggccuaaguaagccuugagugcugggaguaugauuggcuguccaugauuggcugugugacuucaaagugaagcaaauuggccuaaauacauuuuuaaauauggaugaguagguauuuauuauaguacuugcuugugcuucuagcuauguuuaaauguuuuaugauuccagugaguuaaagaaaauuauacagacuucagaaucugauuggccugcauuuaaauauuacucugccaccugguaaauagcuuuuaauuuuuccuggucucaguguauguagaaaaaucuccccgcuaugagugauuauaauuuacacaaaaguccauguaugaauauugucuuagggguucuacugcuuugacaaaacaccaugaucauaaagcaaauuggagagaaaagaauuuauuugccuucacuuccaaauugauguacauuauugaaggaaguuaagacaggaacucaaacagcaggauccuagaggcaggaacucguacagagauaauggagaggugcugcuuacuggcuugcuuucuuggcuugcucaaccuacuuucuuaugaaaccgaggaccaccagcccaggaauagcaccacucacaagggucugggcacuccuccauugaucacuaauuuaaaaaaugccugacagcuguauuucauggaagcauuuccucaccugagauuccuuccucucugaugacucuaguuugugucaacacaaaaucagccgguacagaugugcuuauugguggggaaaggacucagaucuuaguuuuauuucugugauuaugugucacauagcucuuucagucuguuagggugcaguuccguuuuccuucacaaaaaucaaagggggaaccagccuguuguauucuuauauuucaaaaagcaugacuaauaugcugacuuggccugaaugcagcaugucuuugccuuucagucagcaucggaaucucaaugguacuggagauagaggagggcaccaguccagucaucaagaucaucuccggaaggauccauaugcuaaucuaauguugcagcgggagaaggauugggucucuaaaauacagaugaugcagcugcagagcacugaucccuaccuggaugauuucuauuaccaggugaauagccaggcuagcuuagagaacaguuugucugcuugugcuaauaauaaucacuuauguaaugguaaaguugaauacuuguagacuuucuauugagcuauugcccagugaauucaaguugauagcagauucuguccauuuuuaaauuauagcuguguguuuucagauugguguuuucauuugagcauuaauaaucuaguuuuuccaguuaauaguaugguaguguguggcuggggauguagcucaguaggagaacacuugucuagcaugugcaagacccaggcuucaaucccuagucgccccauacacaccaaaaaagaaagaaaauauuauuggcaauccaacuuuuaaaaaccucuuugcugggcgugguggcgcacgccuuuaaucccagcacuugggaggcagaggcaggcggauuucugaguucgaggccagccuggucuacagagcgaguuccaggacagccagggcuacacagagaaacccugucucgaaaagccaaaaaaaaaaaaaaaaaaaaaaaaaccucuucauuaauucaaauuuuaaaaauacuuaaaaaauuauauugugggcagugaguacugcuaucagggugaugacaugugaacgucagggggaauuaguugguuuuuuguuuguuuguuuuguuuuguuguuuguuuuuuuuuuuuuuuuccuuuucacauagauuccagagauuaaacguaggacauaaugccuagugauaagugccuugcccacugagccaugaaggcugggagauuggaaagugugugugugucagagguuugugaugcuggccauugaacccugggccuugaacaugcuauaaccucacucuguuguugagguguaccuguaguucaucgauugguuuuugauaaaagucaugggugagaaccaggcaugguggcauaugccuguaguuucagugcuugggugggaaccaggcaugguggccuaugccuguaguuucagugcuugggugggaaccaggcaugguggccuaugccuguaguuucagugcuugggugggaaccaggcaugguggcguaugccuguaguuucagugcucgggaggcagaucucccgaguuugaggccuggucuacaaagugacuuccagggaaacuacuaacugcugcacauagaaucccagucuccaaaaagaaaaaaaggaaagaggccaaggauggguguacgccuuuaaucccagcacucuggagacagagacaaguucgaucucuugacuuugaggccagccuggucuauguaguggguuauuucuuugauaaaaguacauuaaaaauaaauguguauguguguguuuacaacaaaguaacaaaacuuaggaaucaguguguuucuagugcccuaguuguguuacuaccacugguauaauuagugugaaguacaguauuagucuguauuacuuguuuugcaacaaaaaucaucuucucuuguggcagaauuacuuugaaaaacuggagaaauugucagcugcugaggaaauacaaggugauggcccuaagaaggagcguaccaagcucaucaccccucagguggccaaacuggagcaugcuuaucagccugguaagguccuagcccaccugagagacuacuguuuuaauaaacuagagguaauuauuuguggagagcaugacuaucuugacagauaaacucacagagucuuugcccuuugagaguccagaauuuuuaagaauuuacugcuuuucuuaguacuucuaaaauugauaaaggagaauuuuucuuuugauaauuaauaguaaugaagaguggagaauagauuaggcaaaggaguugcuuuagcuggcuguagcaggucacaccuauaaucuuaguacuaaggaggcaguagcagaagggucaugaguucaaagucagccuaagauaaugaggccuugccuuaaaacaaacaacaaacgaaaggaaagaaaggggguguacaguccucugggaaguuacugagccgugggugaagaacagaaaacagcuuuucaagugcucucugcuguaucccaaguguucauuggagucuuuuuuguccuuucagugcaguuugagggcucguuggggaagcuuacugucucuagugugaauaauccucggaagaugauagaugcuguugugacaucucgaagugaggaugauguaagugccagcaaaagaaguguucauuugugguagccauuggaaagucuguccgcugacucuccuacuuucacacccucggggccagcucacccgcagacagggccaggcaagguacucagacaaggugcaguaccugcucuccagaguguucuauuuggugagggacaugggcaguuuucccacucucuugaccucagggccaucucuaccaccugccauagauguugagggacaaggugggggaagagaagggucucucccuuguccgugcuacugcccagcagacaagaggcagggucagaucucccacacucacauccuuaguggccugcucaccuggccagcucuacugugggguguccaggugaggugcaggucccacucucugaagugccacagcaauugagagucaggaccaguucccacaagcccuagaugacaaggcaugagggcaucuuuuucuugccugugccccauggcagacaaguugcagggccaacucucucucacauccucagggccagcuugcccaugauugcaucacuagggucaguucuacucuccuguaccuugccugcucuccugaguacuacagugggugaggggcagggccaauucuccugcucucaugacccuagagcuaggucucccaccugucacaauuggugaagggugaggaaggaggaggguaaucucucccuccaugugugguagggucugcucucaugccuccagggccaguucuacauagccuucccaacccaucccuguaguagcucaagccaagacccuaccguggucucagguggcaacaccggcuacuaaccucaggcuguuccucacuacccucaggucucuaguugugccugucuucauugugcccacaucccucuauuuaucuuuucuuccauuucuccaccacuuacuugcucuuaguggucuuugagggucugggaucaucugaggaguggugucagagugcugugccucacuugugcguuauggugccuggcagggguccuuuugggcauggucugcaccucccaagccuguguagcucuggacugguuggugcucaucucagguuagcucccugucaggggccccgugaugccagucugguaguuguuucuggcucacuccugcuuggggccagagucccagacaggguucuucaaguuuuuggcuuguuccccauccugggaguucaucgggacuugccuggcaccugauugguaguugucucaagcuagcgucuuuucaggcuacuaaucauucagauagucauaggucaaagcacugagcauagacauagacuuucuccucucugcgccuacugacacaacugcaggcacacagcagccacauuuguagugcuucuaagggcagaguaaaauguucuaaagaauuuuuacugaauagucuuuuuuuuuuuuuuaaggaaacaaaagaaaaacaaguucgggauaagagaagaaaaacccuuguuauaauugagaaaguaaguuuuagaauuuauuucuauauuuaguuucaauuuaaaggacuaucaaauauauguguacccaagaaguagaagaaugaucaguaaaccagcauuuuuuauuauauuacacuuuauguaugggguggcauugugcaugaaggucagaggacagcuuguagggcuggguucuugccuucugccauguggguuuugguucucaaacucaagacuggcuuggguggguaggugcuuuuugccugcuaagucaucucacuggucccuguucuuuuauauuauguaagaauuggcuugugguaagcucuuguuguuuaccagaguauuuagaagugauugugcuacauaccuugccuaugggauccuagaaagaacacugcacugggguuuuguucacugcucuucaacuaauuacuuuugagcaggacaccuuuugugauauauaaguguguguguguguguguguagguguuuacuccagcuuguguggaaguuagaugauaacuuaagggaggcaacaugcggcuccuuccaacacagaugaacucaggcugucagcaagcaccuuuacccauugagcaaucucaucaacccaggucaucuuaagccuaauuaaaaacaggaauaguugcucaugaacugauuuaguuuuacaucauuuauugggugaaaugagauuauacauauagacugucuauaaagcauacaccauguucaagacuguagagcugcagacugucccuuuucggagucuguaaccugagacugaguuauuuauacuuuuaugcuguccucaguuucuuuguggagacaacuauaguaguuuuguuuugggguugaguuugcgaugaguugaauaccugugaacugcuuagacuacuggugucagccaguaaaauuaacuuuuuaccugguugguggugaugcacaaaaucccagcauucaggaggcagagacaggaagaucucccaguuuagccugauauacagaacgaguuaacaggauagccagggcuacacagaguaacccugucucaagaaacgaaacaaaaagaaaauuugcuugacuagcaaaauauuuaucaggaauccagggugguggauuuuacucccagggcaguuucuaaaugugaggacuacauagugaauuccagaaggacuacaaagugagacccuaucuaaagauugccagggcuagagaagaugguaaaauguuuguuugaagaucagaguuuacauccugugcauucacauaaaugccaggcagguauggcaagccaaugcugaggagauaagagauuaggauccuuggaggaaccuggcuaguuagguaagccuacuuggcuaccucuggguucaggugggagaugaugccucaauauagaaaguacugaaagauggagaaaaacggccagcaaucaagcccuggcaucuccacacucucaaacagccuucucacuggaagguggcaguguuacaguaaguuggguauuucagccuaacauugcugcuaaaagcugggcagugguggcgcacaccuuuaaucccagcacuugggagccagaggcaggcggauuucugaguuugaggccagccuggucuacacagugaguuccaggacagccagagcuacacagagaaacccugucucaaaaacaaacaaacaaacaaacaaacaaaacauugcugcuagaaauuuugggaaacauaauuacuucacuauuuuauuauuugacuaacaguccaagagagagaaaggaugaugguuaaaggauuauaucaccauguuccccuacauuuaaaggagcaccuuuuuaaaaauuucuuuuguuuaaauuacaugcuggcauuuauacuaguuaguccuaaacugugaagacauuuaucuaauacucugguccuaaccugccauguuguggccuauucugucucucuccuagaccuauaguuuacuccuugauguggaggauuaugaaaggcgcuaucuccuaagucuagaagaagagcggccugcccugauggaugaaagaaagcacaaaauauguagcauguaugacaaccugaggggcaaauugccuggacaagagagguaauuauugugcuuuuagaggagaugggagauucccuccauugccaaacaaaacuccacauacuugggauuaugauauacucuguccaacuauucauaagcuuagcaucuaucuuggguuuuguuguuuuuguuuugagagagucacauugugugucccugccuaucuuuaguuucacagagauccgguugccuuccaaacgcugguauuaaagguguagaccuuugguuacuuguuuuacaaccucuuggaaugugcucugaguaggagaaagucugguuaccaucuaaaagcaauuaacuggugacacuugggagauuggcacagaguucucauugcagcuuugauuauuagaaaaugaccuaauagcagucccauuaauaaaagagcuuaauaaucacagauauaauuuuaggaauucuuauaggaucaucacuaagucuuaagucaucuauuugucuauauaacaucacuacuagaugguacaucuucaugcagagaucugcuccaaaggggugugcuccuacuuagugauuguuauguauguuuaauaaugacaggaaaagcauauuaauagcaggaaucuuuccuaaaaugagucccucacagccuugcuuaaugacggcucaccugucgcagauuauauaauaauccgaggcagcugcaggaugaucaccugcuaguuauuagcucgucccauuauggcuccugacagaaguguuaacucuuucugugucgucuuucuccugcucauugucugaagcaaaccuaauugugauguuugauaaaucccagauacuaaauguaagaaggcuacgucugcuaauggcuccuuucucuuuacucaaggucuccugagccacaacuuacacaaacauagaauagacuucuuuucaacacaaccuuuguaguuucggucugauaaaugugauuuaucccuauauagacauguaauguaaccauuaaaugcauuuaguugaagaauauugacauggaaaaguauugaagagguugaagugcucacaauagaauacuugucuagcauacaggaggcucuggacucaauucccauucugugggggcaaaaaguaaauuacaaagcuauguaaauucuaugugcccuaauaacacuuacagguuaacccugaaaaauauuuaauuuuuacuuaaaucaaauuugaucacacuuuuauauauaauaugggcaaugauuucccauauuuguaaaacuuucuacuuuuuauuguaaaaaguaaaaauugguuggaauuagaaagucaucuuccacuuugguaguacaaaaugaucauaaagaugaguguugcauaauuuuuaaaaauguggguuuucuguauugccuuuauugacacuagauggcauucuuuuugcaggccaagugaugaccacuuuguacagaucauguguauccgaaaagggaagagaaugguugcccgcauucucccuuuccucuccacagagcaagcagcugacauucucauggcaacugccaggaaccucccuuuccuuaucaagaaggaugcccaagaugagguacccaccauguagggcaauuuccuuauaguucucaaguuggaaaacuuuggcucuugguuauacuuuuguggaugucaaauaugucaaauaucccucuuugcucuguugucaguaacuucacauuagccuggagguuuaguugaauggugucccacaggguaaaucuuuuuuuuggggggggggguggcagggggaggguuucgagacagggucucucuguguagcccuagcgguccuggaacucacucuguugaccaggcuggccucgaacucaaaaauuccccugccucugccucccaagugccaagauuaaaggcaugugccaccagugaccagcugauaauucuugauuaaaagaucucuguuuauccuuguaacagcucuuggaagauuagcuaaauuucuuguacuuuuucaaguucaagacaagaaacugguaaaagaauaauuaguggacuggugagauggcucagcugguaagagcacugacugcucuuccaaagguccugaguucaauucccagcaaccacaugguggcucaaaaccauccguaaagagaucugacgcccucuucuggagugucugaagacagcuacaguguacuuacauauaauaaauaaauaaaucuuuuuuuuuuaaaaaaaagaauaauuaguauuaguacauauaggauucagaaugaguuaucugugaggaaauuaauuguaguugauuaaaaauuuagaaauaaucaccugaguacaugccuauguacuucaaaacaugaaagagguagacauuacuacuguagccuuugagauuuuaguauuuacagaaaggaaugaaagguuuaaaucucaucagaagaaugcaacauacacacuuuuuaaaauauauuaguuuuuuuaguuuuacuuaugaguaguuugcuucccuguguguaugugcacugugugcacgguuaguguccauggaggucagaacagggcauuagaucccuacaauuggaguuaaggcuugugaaccuccaugugggugcugggaauuggauuugggguccucuguaaaagcaacaagcacucuaaauaguugaaccaucucuccagccuucaaacuaguacauuuuuaagagacuccaagaaugaaaaauggaguguaggaaaaauuuaaagauuugagauuugggggcuggugagauggcucaguggguaagagcacccgacugcucuuccgaaggucaggaguucaaaucccagcaaccacaugguggcucacaaccauccguaacaagaucugacucccucuucuggagugucugaagacagcuacaguguacuuacauauaaucaauaaauaaaucuuuaaaaaaaaaaaaaaaaaaaaaaaagauuugagauuuauccuaaagaauaaaagaccagaauaaaaagguacaccuauuuuagagcauaaaugccaaaggaagucaguggcgcagugggcacuuugucaguuaugaucucaugggaacccaguaauggaagcaagugugggagaaccucagucauuugguggauacucacugaauacuacaauccaggcaccauuuuacaucauagaacuaaagcuaggaguacaaaaagaucuucauggggcuaacuugcuagugaagacgcuuaguuaacucuguagaaaaguugugugguaacucaugccugauuuccccgcacuauggggacuaagacaggaagauugcuguaaguuugauaccagucuaaaaauauguuuguaguucauucucuuccucccucuccuguguguguauaaauauuuauguguacaugcaugugcugaguuuuuaacuuaugugaauuaaaaaguaauaaacgauguuucuagaauccauuuucuuuaaguaauagcugguuccaggcuuucucaugggaguacagauaauccuggucuuacaacagaggcaagagaacuacuagguuacuagggauguacaaaccaauuugaggggacuccuauuugccagaaguuacacauuuaacaucagaaagaaaaaugacagcaguaggcugaguuagauuuuauuuaaugaguucauacugauaacaaaaacaucaaucaugugcagugagugcuaggucaguaacucaucccaaaacugaaccagaaagaaucaaauauuuauccuucuuuuccaugacaaccaaacguccuugcacacagcgauagacugauuuuguauauggcaagcagccugcuggccacacccacuggugggaggugagugaggaaugguuugcaggguguaacgcucuuguuucuguuuuguaggugcugccaugcuuacugagucccuucucucuccuccucuaucaucuuccuucagugacugucaccagccuucugcaacagcuaaugaaccuaccucagagugcaagugcaccagcgcccuccaacucucaccucacugcugugcuccagaacaaggugcgccugucagucucuguccuuggaaacuuaccacuacuguagcuuucuuccguucaagaacuucauauccaucacucuagcaaaggcuagaacacaaacagugguuuggaaaaauuaguuucuggugaaauuuguagcgucgaguauuaagucuucuacaguuauuccugucauauuuagcaguagauucccguucucagaagauucuugcuucaaaacuguugugaaaguuaaaacuggcuuggcgugaggaacauagcuggguguggaugauuaagguguagauuaggugucuauccuguuuuauuaggacauuucccagaaauucuaacaagcuucuccugaguagcaguggccaggacauggcaugccugacaugcaccuuucagcuaaugucauguuaaagauguaaagacuaagacaaaacuuggugcacuuguauuuaaucucagcacucaggaggaaggcuggcauauaaaucucuguaaguuuaaggccagccuaguguacauacccagauucaguacaaaacaaaacaaacaaaaaccucuuagaggaaaccuaguaagaggaucaugguuucuaaacaggcaaguuucaguccuagcgugcccuauuacagccugaugauaggaugcucagcugguuuucuuucuauuuuacuuuuaauaauuuauuuuguuugcauugguguuuugucuguaugcaugucugugugagggugucauauuuuggagguauagacaguugugagccgccaugugggugcuggcaauugaacucggguccucuggaagacuagucagugcucuaaaccacugagccaucucucucuccagccucucagcugguuuucugaucuguguugugcaaguagugaugaagacuuugcauaguugucauaguauuuagauggugccugcuauguaguagguacuuguuuagagccaugguauacaaugggggucaagucucagcaccccuuucuccuuugaccuaccaacaauaacaaaguaucugaggcaguagaggauaccaguaucccucaggacauacagugaccaguugugcucuuccuguuauuuaaucucuguuuuaauuuugauaagagcaguagaaaaccaagaagucauacaauauccugacucuggugaaaauuugcuuacauauauaaugcagggaaauuuuguggaaaagaaagauuauccuuuguaauacaaacacagcaaaguagaaugaaauuccagagagaguacugccagcaucacauuuaaccuagugcuguggcauuuucauuccaugcccuuucagaguucauguugcugauuuuuaggcuucuauuaauagccuuuguaaguuuguagauuucagauaagaaaauacucugugcauacaugcacacuuuggaaugaugugcacauagaggcuauauagucagaggguggcaucagggcucuuuccuugauuauuccccaucuuugcuuuuugagauaaguucucugacuaaacuugaagcucacuguuguggcuagacaggcugccaugugcguuagugauuugacaggcuccaguucccagaggccgaaucacaggcacacacuaccauccucagcuuucugugauuucuugggauugaagcucagguccucacucuugcaugcagguacuuuaccagcagagcuauuuuccuagccuccggaguauaauuuuuuuuuuaauuuccuuucagcuuugauuuuuuccccuuuguauauuucucuauauuuuuguugauuuguuuuguuuugcuuuugagccauuguuguguauuccaggcuggccccuaaccuccuguguaguguagccaagggugacauugaacuuuuaauucuccugaaugcugggauuauagguuuauauggugcugggaaucaaaccuugugcaugcuagaaaagaaugccaccaacugagcuauaucuccagggucccauguagcucuuaaugccuuuucuuauuuauaaaauaacuuuacuuaauuuucuuucuucuaauuuuccaugaacuuugacuuuucuucuuaaucucuuuugauucuuuuaaaaaagagaaagacaaaaucauuagauuaucagugacugguauggaaaauauuuucacaacaggauaggguauacagaaguggcuuucuaugcuugucauuugcuaugugagaaacuaaaauuuagaggaaagacaacuuuaauuccaggcuugccugaccucuccgccuggcuacacaaagacuuugguauagaggccgucccauucagugccaugguccuaucagcugauguggaagaggcuuaggugcacuguauuuugaguuuugcuguuguugcuuuuagauuuguuuuauguguaugaguggaucuguuuguuugcugcgugugcauccugugaaugccagcagcugguugugaacuauuauguggcuucugggaacugaacuuugauccucuucaagaacaugugcucuuaauuccugauccauuucuccagccuuuuagauauauuguuaaguuuuuuuuuuguuuuuuuuuuuguuuuuuuuuuuuuaaagauuuauuuauuacauguaaguacacuguagcugucuucagacacuccagaagagggagucagaucuuguugcagaugguugugagccaccaugugguugcugggauuugaacucuggaccuuuggaagagcagucgggugcucuuacccacugagccaucucaccagcccuauuguuaaguuuaauuccaucugauuucuguuauaguuuggcuugucacugcuccuaauccuacuaagccguggagaagaccuacagaguucagauccugcuauagaaucaacgcaaaauaaccaguggucaguauugauagcuuaucuccuauuuuaaauauuuaaaauuaucuuugcucuccuucucuuucccuucuacuucucauacuguuuuggguuuucucucauaggacagaggugauguucauggcaacccgagaacuucuacggaucccccaagcugcccuggccaaaccaaucucuaucccuacaaaucuagugucccuuuuuucucgcuauguugaccggcagaaacugaacuugcuggaaacaaaacugcaguaaguugugaacacauuucacuaccuugguaucucagacaucacaccauggggaggaugaaguggaaugagaguaagagauugagacauccauagaguguguguguguguguguguguguguguguguguguguguguguguguguguguguguauguguggcgcgcgugugcgcacgcgcuaaaacagaucacuguauugugugugacaauaccucagaaaacaacacaagcugagaggcaucuaaggucuuguauuaugagaauucuuguaaagaccauaacuugaaugcaaaagauugauccuguuuuaacuuacucauacaaacaagucgucuuucucuucauauccuuaggcugguucaggggauacgguaaaagaucuccagaguauccuguaccuccuguuggcugccaccugcacugcugccaucaccaauggaguguuuuuaaugagggaggggagguagcuuaugacccaaagcaaagucuugugggauccauuccuguuuucagaaguuagcucugaaugccagguauucccgcugcucugauacuucugcugggugguacuucugcugguuucuuuuaccuucugcguuacacuuuugcauguccuacuuuuacucaauucuucucaauuuugcauuuucuuugcccuagagacacaacaaacgucccuuuaucccaucaccacuauuacaauucaaaguagguuguaguauaccaaaggacuccuucccgcuuugaagucuuuuuuucaucuccccuuauuaauaugauuauaggagagucaaaauuaaguagaagucaagauauagguaaauauauaaacacccuacacaaacauucguaugaucuccagaggguccuuaaagaauaaguuuguuugaaaaauauuuaguuaacauauaccucuaaaaauaaaccagccgauauauuuuuaaucuguuucuguuccaucuugucauuugguggauucuacuuuuuuaauauauaaauacaggguauacagcauauuacauuaaaucaaacuuguuaguuggcugaugcccaguucuaggcugagaggacuuuucuuucuccuaaccuguauuuccuuuguuucugacaaccauaauagaaacagcacacacacgguuaagccuuuuccugugaugacuacagcgugcuugagagucugucccucaagugcauucaagaguacccaagaugagccucacguagagccugcuucugcaguguagcuuuugugcgccugcacugucuuccugacgugacuucuguaagccaugcuucugcuccucuuccccauuuucauuuagugucuuggguagaaaccuccaaauguagccguggcugcucagcuugggcucugcucuucaguguccucuacccugcagcagaacugcuguccuggcugcugagucucaccugagccccauccacugcagccagcagggccugggugugaaucuuagggacacuucccuuccacucacuuuucuucccuucagcagucagccaggauaagggacucggcucccuagugguuacaguucugaaaaaaauaaauugaauuuauuuuauauucccuuccugauccuacuuucugcuguucucaccuuuuugaauguagucgggggacaggcuaugauauuuaaagagaauaaacguuuugcacauacauguauuguauaacaguaaagcccuccguuacaaccagcugucuuuguacucaucuccauuucuucucauuuuguggccucgggcuccaccagcugcuccccagugacagucccuagcuuccuucuaccaucuacugacugucuccacugagccuuuccuaccuucccuucacacccgaucaaguaaacacuugauuauuuuuuucuuccuuauugugcuuuuuguucaguucuaauuaauaaaauaaaauuucuaaauuuacauuuuuauaggguauuguaaauaaaacaaauuguauacuugaaaaugugugcuuuauaccuuucuguuucugcauuuguuuuuaauguuuuccauuauacuuggauucacuagcaaaacucuugauguuggggaauaccacuuugcucugaauaaauucacuauuucuagau

SEQ ID NO: 9190 - RNA, 940 nt, Mus musculus
ucaauggagcugggaaaucacacuaaggugacugaauuuauuuuuuguggccuuacccagucucaagaacugagcuuacucuuauuuuucuuuuuaucuauuguuuauauaacaacgguguugguaaaugucaccaucauggucacugugaccugggagucccgccuccacacgcccauguacuuccugcuucgaaaccucucuguguuggacauuugcuucuccuccauuacuguuccaaaggucuuaguggaccuucucucaagaagaaagaccaucucuuucaauggcugcuucacucagaucuuuuucuuccaucugcuugguggggcagacauuuuuucucucucugugauggcauuugaucgauacauggccaucuucaggccucugcacuaugugaccaucaugaguagagggcggugcacagcccucaucgcagccuccuggguuggaggcuuuguccacucaauugugcagaucuuccucuugcucccacuuccuuucuguggacccaauguuguugauaguuuuuacugugaugucccacagguccucaaacucgccugcacugacaccuuuguucucgagcuccugaugaucucaaacaauggccugaucacuacgcuaugguuuguucuucuccuuguauccuacacagucaucuugacaaugcugaggucacacacaggagagggcaggaagaaagccaucuccaccugcaccucccacaucacuguggucacccugcacuuugugcccugcaucuaugucuaugccaggcccuucacugcccuccccauggacagagcugucucaaucacccuaaauauaauuguuccuguccugaacccaaugaucuacacccucaggaaccaggagaugaaaucagccaugaagagacuccggaaaagacucauacuuucugagguagaauagc

SEQ ID NO: 9191 - RNA, 4509 nt, Mus musculus
auaaaauuuugccaaguacacauuuuaaugcauauuuauacucauuuuuguuaguagaguuacauguuuaugggacaaauauuaaaaaauucaacaggaaguuucugcauuaaagaucugggagucuucugaugugccuugcuuugcagauucagagaauuuacagaaagaagucucuccccguuccugaaggcugagacacuuggagcucuucaggagggccuacucugugcacaagagcuugauuguaacuaguauuuucagaaagauggcuggcuucaaugaaacauuaaaauauagcccaaacccacaaagcacacagagguuaagaagaacauuuuaacgcucaagaggcagguucgauggagagguugugcaauuagcccucuuggcugggcaggugguagggcagaauuccaauucagucauucauuccucucuguaucucaaauggaaacgaaugaggaagucucucccuguuccugaaggcugagacacuuggagcucuucaggagggccuacucugugcacaagagcuugauuguaaguguuaaagcaagaauacaucaucuuucguagaagauagcucacugauguguuguggugaauagauacauaauuucuaagacagcuguagaggaauuuccguguuguagagaauuaaauucucagauaugaaaauugagcaauaccccaacuauugccaguugucaaucacgaggccuuccagauaacccauggaagccauccuggaacugaaauacauaucauggccuuuucccagcuaacugugacauaaauuuuguuuuguuuuaaauuaccccaccccucuuccaagcagcgcgaaaaggcaaauccuaacagacagaagacagcgcuuucccaauagcuuuaguuuuagggaggaaguacuauguaagugcaggcucacugugacuugcgcauuuuucaccccuaggcagauaaaagcuucuugcuacaguccaagggguuuguguguauuccugugcacccucagcugugguaagaagacaaggggaaagacuguccagagagaggaaggaguuacauuuuugacacaugaacgugaaaccauacugcuugaucugccaaacuagagcucuguuuaguucuucauuuauaacccuguuaauugacagaucuaagaauucaaaguuuccuagaauacucucauugucucccgaaccccgguuuuuagccuuaauuuauuacucauuuccuuacuguuucuucauccuucauccccuaacagaaaauuauguuauauucccccccccccccccaggacuuguuugcacaguucagaagcccaagacugaccuagauuagcugugaggaaguugggaaauggaauuuguauaaaccccacccgcuucuccuucaaaugccugugaggugacucauggggagggcacugucaaucaacaccaaguccuuaaagcuaaagaguagggggcauguaggccuccuguggcauuucagggcacuguuuacugaaacccugagggccucuuugaaaacacaagaaaagaaguaauguacuuaaagcacagaccucuucagcuuacaaacuggaaagccuuucaaauucagacuaaaugcaccaaauccaauuucucccccaccccucguuccacacacaugcauucagguacagacaacuaugagaauggacgcauacaccccgaggcuuagucccaguccagcuuuuuccaaaugaaucauaccccuccccacaccucacuucaaauggcuccuuuaauuuccuggugcagaggccuaagaaaauacugccaggguuguaauagcugcuuucuuccuauggcgacugucacuucagucacuuaggaaggcagaaguagagaaaacaaagcaaaagaugugcuugaagcuguggcuggaaacuguuuccuuuggagacaauuaagcuggacuuggauccucuucuccauuaaggacuguugcaucuguugcuaagcuuccaaccaaacucuccugcuccucaauuuccugguauuccuucuucuuguacuuccgaguaccauagauggccaagguaaugacaacuccuagugcuauggugacucccaaagugauuccagcagcuuccccuccugacauuccauuacuguccccauggaugacugucauggcccuacgaagcuccagagguucucccagcuuccacugguuggucugaggauccuuaauccaggaucuggcagucucacuauuggucacuaugacaguguugguggcaaccuggcucauaagaggugguuugguauaaggugggagccugacagggagcagggacccuccugugaagauuccagccuugacacaguaggacacuuggcauccaucacugauaacagcuagguguuggcugaagcccccgggacacuuuuucagagauggugcucugacgucuuuagcuguaucagaauuaaccaagggguuccccauuauacaacugaagaacccaccaaaggggacugaaaacuugaaccccaacucauaauccagggacacacauaccuugaggcuuucaaacagguucagugggauguagccugcugggcaugacugugcauuugucauaggguugauggucuugucagugaagacuccuccaaagagaaguccugaguugucagguacuuggccagcagccacacaccaauaagcccuaaauucagccuuggccacucugaacacaucuucacacacugucuugcagaaaaucuugagggugcauuucuuuuuacauuccagacgacuguaacccucuucaugggucugggagagcagauggacagggguguagccagggggacaagagaaaucaccugugagcagguucuucugcuccagguuuuggcaaagaacaucaccugacaguucagugcauuccugauaaacuccaccaaaggugaaguuggugacuuucgcaucacaggaaucaucauccauauuggcuugaaaauuaaaguugggggaaucaacauuugugcauccugggugaguguuaaaaguguaauagugucucacagcaguuuccacugucuucgacagcuucuucaccaagggaccuggcaagccagguagcuugucagguuuaaugaagaaaugcagaggcaagccagcacggucuauugccacuaggugguuagugaugcccuucugccagguuucuaaggugaugccuggauagaagggaaccccuccaaaacucugcacccuggaguugguccuguucgacagguaguccuucgucaaacuggucugagaaauguagucuguuucaacuuugaaguucacaauguuuaagaaggcaaucccugcagaagcggucacgguguucuggcuauucugguuguccagaaggaaggaggaccuuacgugauccuccugaaccagugcagccccagcauccacacuagugauuacgugugugccauaguugaggaucaagagcucugccagguagguggccaucuucgucugguuuuucucuaguuggucacagauguccauaagugccuucguaaaccccaagcugagcucugaaguuggggugguuuucacuguguagauccgguuucuuaccugaacccugguagucacagcuugguccuuuacuugaagggucuucauccuuuggaacucaguagagaacuugccguugacucuggagaaaagggcgaguucuguguugauagaaagugaggugguacucugguaauucauccaggacuccaggacuucugaguucaucuccagguugcucucuuucugaggaauaguauacacuucaucggggaugauguacugcccaucuucuguggucuuacaguugguguaugucaaguccaucacccgucccaugucuacauuucucagauuaucccagccuccuccugguaggaccuccaagacagguaguuucagggcauucuugcauauuugaaauccagugguacccguuucuccaagaggcuugucugcuucagcacacgcuauuaucauccagaugaggaccaaggccaugaagcuguucauggcgcagaugguuuuggccauauaccagcccuaagcauucaccaacaagacuggggcaaacagaaggauggaaaagaaagcgguuguugaaacagaaaauucuacaguucuccuaaaaccaucaguuccucuuuaugcugcuccaauugcaaaacagagaagugaaagcugguuggaauauuagagaccauuaguaccuuguaaaaauuauucuacucuggauaugcaaagauacacucuucaauccccccccccccacacacacccuaugucccucacccugccuuucuucuacacagggguuuggcacccaguaaaaguguggauucaacaacuuaccucugucagaaggcucugucuggcuuuuguuucacucucuuugacuucaaaaccugccuuucucuucuuuugugaaaucacagu

SEQ ID NO: 9192 - RNA, 2632 nt, Mus musculus
gcaggccagaagaagaaggcguggggcugagcgugcguguguucgucaguguguguaugucagugcgagcaaaagcccuggugagacucaaguguaggagcucuggccgcggauacagccagcgcugagcugaaaacagacaggaaguuaguggcugcaaaccucaguccccgcguuggccccugggaccgggauggcaagcgagcuuuuggacacccggggacccgggaaguauccgcgggcgugagcucaccuuggcguucuuccggggaggggagacaccuggaagccucugagcggagccccagggagggagcugugccaccgccguugccuggcucccagcggagagaggacggagggcgugaccaugcaacuccagcgaggcucaacuggugcgaggcgggugcugcgucgcgcuugggccgugcgcccuggguggcuuugcaaggcgggcggcgaaugugcagggucagguuuuuugcaugaagccgcuggaccccucggagcagcggcagcgacaggggcgguggagcacaguuggaggcgggcagcuacggguccgcgucccggugccuaagcgacugcagacucccccaugaaccacagcugaggcuucccgggaggcgguggcgcccgaggccgggugugcaaggacggggaagggagcaucucagggcacuucaugcuccagaccucagccuuggacccuagugguguaggaauggcugaccgaucauggcggcuggugucccuacagcccugcugugaaacaccacuucaaggcggugcugcgcugguccacgcgcggggccagcgugguguugggcuagguggagagacagauugcccccuacaucaucgaccugcaguccaugaaccaguuccgccaagacacgggugagccauccaaaucccuggucuguccacugacucacccagugacuagcuuugcuuacugauguccucacgugauagguguugagggcagguguuucccuuccuuagauccucacaggauuccaagaccaccuucaaguauuuguccuggcaaguaguuuaaauugucuugauuauacaaacccagcuucggccuagcugcaggagaccccuuuaugcccccaucgccacccccagccccuacuggcccuuagugcaggaauucuaggacuuugcaguucccaaggaaugcggggucuucagcaagauacugcuggagcccuuuuacugcucacaccucagcugacuuugcuuugccucaagcaccuuuggggcugccguacaccucccccucccuucaaccuggcugaaucuggcccucuucuauggacccccccuucccacugacaacuccuggauguaagauuugggaagccguaggguuccucagugucuaguuacagucuagugugugaaaagugcuggaaaauuacugggaagagagauuggagccagggauuccagagcuggagcaucuggaugugguggagagaagaaccggaggacugggcuccggaaugccuggcagagaggcuccucccuuuguccacagaggacaggacagagugaacauucugcaacauucuccaacagccugcagaguggagaaugucuuugccagcuaugccucagacaggggcugggcgucuagaauauauaaagaacugcaguaauuaaacuucaaaauagcuagucaauaaaucagccaaugaauggaagauaccguucgcaaaaguaggaccacauauggacaccagagauuaaaaaggcguucagcauucuuaguuaccagcugagugaaaauugaagcuacguuuuggauuccaucuuccccuagugacaauuacuaagauaaagaaaagagacagcagugcuguugagguaauguaaccuaguacagccauuauauaaauuaguauacauuucuaaaaauuaaaaaaacagaacuucccuaugauccagauauacuucugagugugugaguguguguaugugugugugugugaguguguguguguguguguguguguauucuaccacagagauaccugcacauccacauuuauugguuuucuauucaaaauagcaaagaaauggaaccagcccaaauggagccaacagaugaauggauaaggaaaacguggcacauauauaaaugguauuuauucagcuguaaagaaaaaugaaaucacauaacuuacagaaaaaugaaugaauaugggaauuagaaaaaaaaacccuccagauuuagacagacagcacaucucucacauguggagccuagccuauaaagucugucugucugucugucugucugucugucugucguauguaaguuggggugaauuccuugacuguaggcucuggaaucagaaaagagugcacaaagagggaaagaaaguguugcagaaguagaggaagggcacagggaggugaauguggagauggaggauguguguaagguacaguggggagggggugaggguauggggggugagaaaggugaggugauucaacaaaauaaauuuugucugaaacuggcacaauaaaaccuaauucuguguguuaauuauuaaugaaaaauaaacuauuuacaaaauaaaacuaugaagacugagaaguauguacaaag

SEQ ID NO: 9193 - RNA, 3912 nt, Mus musculus
auggacacgcuaugcccauuaaauaucauucauuacuuugaauggcagucacucuugucucaggauuugcuaucagccugcaaauauuauuaagguaaagagcuaaaaaugaaaaucacauuuaaugaccuucaggugauaugcuacaggccacgguaguuugucauuuauagacagaaugugggaauugaaugagagaugugauuuuuuuuacuauguuaauuuuacaaauaugaaaauaaguaaguaacucuuacaaaggcauagaaaaaugauugauaacuauagaccuuaguuuauguaaauacgauuuuacuuauuuagcuucugccacacuaaguggaccuuuggccauuagcugaaagugcuccucagaagguaccuauccaacauuccauaggugguuucaugauuuuggacugacuccuauauggugaauguucuuucuuuauagaaaucugauaaguaucuauauugcauaaacacuaaaguaagaaguguaguauauauagaagcagagggcuguauggaucugcuaugaauuucuugaaaagacaaaagggcucuaaacuucucaaaccugcucuagguguaugaucuggaugauccaaccaguguuagucugaaguauauguaaaugucaaaauauucacuagaguacuugaugacuuauucaggagggugagucuauccccaaaaauaaaaacaaagaaaacauaaauguuaguuugauuaguaaguggugaccuuaucauguucuguauauauuuucaucucaguggaaguuacaaaauacaaacaaauaugcaaaggagguaaaugauccaucuugaaauaugaauauauuccuaaaaaugcuuuaaccugcaauccaauacuuuuugccucuaucucauauuaugauuaagaaauguauucagcuucugaaucuagagauuuucccccucaagcaguuuguguaauuuuagagcaucauguuucuuaaauacacaacuuucuuguugauggaguauaacacuuauauacuacaacacucacagacaugucauucauauuuuaauaccuuauaauauacacuaaaccuuaucuccuuuagcaacuaagaugaucauuuguuuuaagauugggcugccuugcugagccuugauauauggguauaugucuagucauuguaacuuguuaugcuauguucaguuuauauccauuuuaggccugcuuuuuucuaacagcaaacucaggaacaacagaucugggggagggguagaguguggcauguaacugagcggagugaucaggauguauuauaagagagacuaauaaauaaaaguaaaauaauuaaauaguaucauuucaccaaaaaaauccauucaaauaaaauacuuuccaauaugaaaauuaccaccuaaagaaaucugugaaguuauaaguggcccauaaacugagaacagucaaagcuuggucuccaugacuuuguuuucccaggaaaggaauaugagaaaagaugagauuuaaugaaaaugggcucuuuuacccuaacuaaacuauuguuucuaagaaaaauuauuuuuaaaaugaccugacuaucgaguucuccuuuuguagcaagaugcagcgggacuggaaugaagaacccaguauggaauagaggaaaaauuaagggagcaaaacuucuauaauucuugaggcuaaauuguugaauguggcauaaccuacauugaucaaacuuaaagacgaucacuucauacuuauaguaacaguauagcuaucacuuaauagacuguagguaacccucaaaaauuauuuuuuugauuuauguuuuuuuuucucccaauaguaucugaaaguggcuaucauuuaugccuucaaguuagugaaguaagaccuuuguggaaguuaugcuaggaccaaugacuccuaggacauaaaugguagauuugauaggcaucuaucucuccaggaacuucagcucuaugucuacuaaaucugauggcauaacauucuucagaagagacacuacacguugaguacccuccccugccaagcuauccacaacaucagcuacucuggguaugccaugguguaucucacgaaugcaucuucaacccacuugaauguuuagggauuugguaauauauauguugaugaaaauauguauauauacagcuaugaaaugaauauauauauauuauguauauauguuuuagacaguguugauauuaaagaaggcaugaucucauauacuugauuucaugguuuucuuucuuuuaucaccaaaaugaaaaaaaaaauguguggcagaacagauuaaacuacugccuaauccacuagcuuguaguuaacugugaaacccaaaauuuugguauguuugaaccaaaagaaugaguucaguuaaauucaguuuuaccuaagaaaauacagagaaaaauauuuaaaaacauagggucagagcuuggcacgaucuauaacauauuauugauagaaaauagagaagugacauaucuaaaaagacauuaguaguucuugacaggugagaggaaaggaaauguuggauauugcuaaaguaauaaugggauacagauucauggacagaauuguucauacaagucauauuaaucaauuuauuagauuguuuacauaacaauuaaugaauauauaaaauuuugaaauucugaauuccauuaagagcacuugaauaugacuuguguguaauugauucacccaaguuaauucuaaagcccgcauuaucuucuggaauguacaaauacuaguuggcauagcuagugaagugggaagaaucuggaggacuugagagaaggggaaagaauaugauaaaaauauacuguaugaaaaaacauuuuuaaagaauaugguucauauuuuuaaguuccauggaauuuuaaaguuuuaacauuuuucccuuuauuacuauggagaagauagugauuauaagaugacaauaaugaagaacaggacagaagugacagaguucauucugcuggggcucaccaaugacccaggcaugcagcuuccccuguuuaucaccuuccuucucaucuacaccaucaccguggugggaaaccuagggaugauccugcugauuguccuggacucucggcuccacacccccauguacauuuuccuugguaaucuguccuugguugauuuuuguuacuccucagcugucacacccacagugaugacugagcuucuaauaggaaaaaaggucauuuccuacaaugacugugcugcucagauguucuuuuuuggagccuuugcuacuguggagaauuaucuguuggccucaauggccuaugaucgcuaugcagcaguguguaagccccuacacuaugccaccaucaugacuaaaaguguguauacaaggauuaucacugccucuuaugggaucaguuucaugagugccuccauccauauugcagacauauuuacucucuccuucugcaaguccaaugugauccaucauuuuuucugugauguuccugcaauaauggcucucacuuguuuugauaaucaaguuagggaacuuguucuucuuuacauugagagcuuagauguguuuuuugcucuaauaguuaucuguacaucuuacauguuaauuuuugucaccaucuuaaagaugcacucggcuucaggacaucacaaggcuauauccaccugugccucucacuucacugcaguguccauuuucuauggaacugucauuuucauguacuuacagccuagcuccaaucauuccauggacauagacaaaguuacaucuguauucuacacaauggucauuccuaugcugaauccucuagucuacagcaugaggaacaaggagguaaagaaugcauuuauaaaguugauacuacauuaguaaggaugaagaaugcauucauuuccgaaaaggua

SEQ ID NO: 9194 - RNA, 4734 nt, Mus musculus
cuuacauaaaaauuuuugcccucucaaccacuuucuugaaugcauuguugacuuccuuguuccucaggcuauaaaccaaaggguuuaguguggggaugaucauaguguagaacauagaugcuacuuuaucugcauccauagaauggcuggagcuggguuguaaguacaugaaaaugacagugcuauaaaauauggagacuacagugaggugggaggcacagguggacaaagcuuuuuggugucccuggucugacuucaucuucaagacaguuauaaauauaaagagauaggaaacugagaugaucagaagagcaaagaagacauugaagguugacaaaaaaacaagaaucacuucacugagguguauaucagagcaagauagagccaagacugcuggaacaucacagaaaaagugauggaccacauuagauuuacaaaaagagaggcugaauauguccccaacaugaaaaauggcauucaagaaaccacagauauaagagacaauguucaaacaaauacaaacacuuguugucauccugguagaguaaugcagggguuuacauacugcuacauagcgaucauaggccauugaugcuaagagguaauuuuccccaguggcaaagccuacaaagaagaacaucugugcagcgcaggcauuguaggagaccaccuuggagacuaugaagaacucagaaaugaccaugggagugacagcugaggaguaacccaaaucuacaaaagacaaguugcaaaggaaaaaguacauagguguaugcaaaugagaguccauaagaaccaacauuaucagccccguguuuccaaccacaucaaugagguaaaugagggugaacaugauacaaagggaaaccugcaagccugggucaucaguuagucccaagagaaugaacucucucacuuugguacaauuuuccaucaauuaucuggaaguaaggagauguccuguagaaaugagaauuaaaggaagagaaugaguaacaaaaauagauuuuagggucaauaaaaauaaaguuaugucauucaaggcagaauggauauuuaauaacuacuaaugguacaaggauauagagaaaauagaacugggagacuuuauuauuuguuccugugaauauaaauuacuacauaggaauguaaauuacuacagagacuacuguauagguuccucaaaaauacauaaauaucagaagguauaccuucuggguauuaauccaaaggaaaagaauucuaucagucuaugaacgaguugccugccuauccacaugcauuuuacaguacuguagacaugaaaucaaacuacuugagaauugauucccucagcaaggaguagauuuuaaaccaaauggucaacccugaacacacauacaauuaacauuauuauagacugauagaauauaugauauauaucaacaauuaaugaauaauagagcgugaaccugaaaaagagcaaggaugguauauggaaguagggguuggagaggagaaaaaggaggggaaaugauguaacuauaaucucaauaauaaaugaaauaacuuuuuaaagugguauagauagaaauaaauuuauuauucagcuauagaaagaaugaaauccugucauuuucagaaaaaaaaugauagaugaagucuauucuaaauaaaauaaaccagacaggcaggcaggcaggcagacagacagacagacagacagacagacagacacacacacacacacacacacacacacacacacacacacaaauguuuauuuccauguugaaagcuuuuuuaaaaguugaugcagauacuggauaguaauuaacuagccgcugaggagaaaguggaaaggaguuagggauugucucauaauaggcaacuaaaacagucaugguuggaugaaauuagcucacaauaaacuguuguaucuucuauaaagaaugagaagaaaucaguuuagagucccacaccuaaugaguuaaaaaugguaauaugccuuauuucaucaauacaaguucaacacauguguagaacccagaaauguauacaauuauuacaauacacacaaauugaaauaaaauggaacauuuuaaauguaaauauauauacaugcauuuguauuacaugaaaauguaaguugcuacagagaguacuguauagguuacucaauaaaauacauaaauguuggaagggaacuuguuaagcaggcugaaaacuuuuuuuuucuuugaaagcugcugcuuucuuacucaaauacuugauuggucuggaaaguacuccuauugaauuucauucuuaaaauccaggcccacagccaaacaauggacagagcucagggaggcuuagacaagagaugaggaaaagauugagggccccaaaaaggauaggaacuucacaggaagaucaacagaguuaacuaaccugaacccuuggagacucugagagacugaaccaccaaucaaauaguagaggaguuggacuugaccccacucacauaugucuucaugugaguuccacaacuggagaaggggaugucucuaaagcuguuaccugucuguggcucccauacccucaacugggcugucuugucuggccucagugggagaggaugugcuagcucugcugagacuugaugugcuugggggagggggguaauacccagggggaccuccauccucucagagaagaagcagaggaggaggaggaauuguguaaggggaugacagggagaaaggcagacaauaauuggaauguaaagugaacaaauagauaauaacagauaaaaaaagaaauccauauagccaaguaugaaaaauauuauugaacuuaguuuuagcuuggaaucaucauaguguaguugaauaccaaucauuagaauuuuaacaacauaauucuuggauuaugaucaauccauggguauguuugggugaaaaucauuauugguaaaauuauuaauugacuuacuuauugugaaguuuuaaauuagaaaaagcaugcauccacugacagugauuccauacaguauguccauagagucuuucuaagcuuagcuuuaagaagguaucguauuucauaagucuucaucuuagaugaagagcuauaggaaauuaaagguugcuaggaaacggagaauaaguaaauucuaggcgagaacccccugacauguuaucuaaucccaagugauuagccaauauacauaugaacaauaucaaauauaagaaaagcacugaaaguuaucuguuuuuguuaauucauuuagccauaucuauguauuuguaaagugucaauuuacacguuuguuguuuuuguuuguguuauccccuauggugggcugauaaaaucaaaacucaaucauaauauuucccaucauauuuguguuucuucucuuauggaaccuauauucauuuugugagaaucauuauccucaucacuaauguaaguucugauacuuaccucccaguauugccuuuaggaaaaaaaaaccccaacaucgaguucuguauuuaguuaccuuuuuauguacaguuaucucucggcuuuuauauaaauuaaacuuuuuacuaaaccauaugcacagcuuuguauauaccauucauacccucauaaggugguuuuuauaaguacuaaaguauuggaagauugcuuacgcuguaaaguguuaguguugacaauaugaggaccugcauucagucuccagaacccauuuuaaagaaaguaaagaauaauagcauauacuuaaaauuucaaugcuaggguggagucaaaucuuugcagcuuacugagaagccagauuuaucugcuuaggaaauuucuugagagacucugccucaagaaugaaugaaugaaugaaugaaugaaugaaugaaaaaagccgucagacaacacaugaggaaugacagucaagacuggucucuggccucuacauaugcauacugguacccucacacacacacacacacagugacacaaauaaaaaauguacuuuugcuaucuguguauauaucagaaguuuaccuugccucuggacaagaaacaaauuuuaauuaucaauaaagagucuaaaaucagaacuucaaccauguaacacauaaugcucacaagaagugaaaagaacaaagaucuccaagaagaggaaaaugggacaaagaauauuaaccugggaccauagaccugggaucaagacuugacuacagaauuuauucuuacugugccuuugaacuggucacuuauuugcugacugaaaacuagacaaaauaaaauaaccccuccaacauaauuaccagaaucauaacuauaauaggaaguuuuuaccuauuccuuugaguaaagggacugaaaaccuggguuuuacaagucugaaacuuugucaugacaaaauguguaaauuuggggcugaacagagaccucuggcuaggaacucuggcugcuccagaggacccacauucaaaugucagaagccaagugauggguuacaaccaucuuguaacuccaauuccaaauguuucagugcccacuucuggccuucuugggcacugcuugcauguagcacagaaacauacauauaggcaaaacacccacacauaugaaauaaaaaaaaaaaguuuuuuuaccaaaaaaaaaagugaauuauuuuggagaaguucuguuuuggagauaucuuacaaaugucacuuaccuuacuccaaccucgguuuugaaucaaguauaccauaaacacagaauugugucucugaagagaaaaua

SEQ ID NO: 9195 - RNA, 1091 nt, Mus musculus
accaagagccaaacuuaaaaggaaaauaaguuuucuuaauuguuuuucauuuagagcugauugucauagauacucuacuccacacccaaaauaucaacuagugucagaagcugguacauggaagaaagaguuccucaaagcaucuuugauaucuuuauuccugaggguguaaaucagaggguuuaguaauggaguaccaaagauauaaaccagggcaauuuggcgauccucauccucugaggugcuggagcggggucucagguacacuaggcuacaacagccauauuguagcaaaaccacagugagaugggaggaacagguggagaaugcccucuggcgucccucugcagaaugcaugcguagaaugguagaagcaaugaacacauaagagaugaaaaugagcaggaaugggacugucagaacuaggauacuaacuacauagaggacugccugguucacauggaugucagcacaggccaggcgcauaauaggagccacaucacagaggaagugguugauuucaaggcggugucuacagaacggcaaugugaaaguaaaggcaguaagcuccaaggagagaagaagugccaagcucaaagagccuauuaccaucuggacacacaguuucugggucaugaugagguuguaguguagugggugacagauggccacauaucugucauaagccaugaccgucaagagaaaacaauccgugcagccaaagacagagaaaaagaacauuugugucccacaaccagccagugauauggguuuuuggucuccaaagauguuggaaagaaucaagggcaccacaucugugauguagcagauuuccacaaaugacagacugcccaggaagaaguacaugggagugugcagggagcugugguugcacaccacccagauaauggugguauugccacagaggaucaucaaguagagaaggaagaagagggugaagaggauugcuugaaauuccggaacauugguuaagacacggaacacgaacucugguggaccagauuuguugaagaaaggguuucuauccaccaugucuucugaaaaaaaaaaaaagccaaugauugauggcu

SEQ ID NO: 9196 - RNA, 947 nt, Mus musculus
gauggcugggaggaauuacaccuucgugacugaguucuuucugacugcauucacugaacauccugagugggggcucccucucuuccuuuuauuuuugaguuucuaccucgcuacccugcuggggaauacaggaaugaucauucuaauccagaagaaccgccgacuucaaacaccaauguacuucuuccucagccaccuuuccuuuguggacaucugcuacuccucugucaucaucccucagaugcuggcugugcugugggaacauggcucaaccauuucucaaguucgcugugcaguucaauucuuccucuuuaccuucuuugcuucuauugacugcuaccucuuggcaaucauggccuacgaccgcuauguggcugugugccaaccauugcuuuaugucaccaucaugacugagaaggcccguguaggucugguaacuggggcauauguggcugguuuuuccaguggcuuuauucggacugucacagccuucacucuuucauucuguggaaacaaugagaucaauuucauauucugugaccuccccccauuguuaaaacucguauguggggacagcuacauucaagagguggugauaauuguuuuugccauuuuugucaugccugcuugcauuguggugaucucuguguccuaucuguuuaucauuguggccauuaugcaaauccgcucagcuggaggccgagccaaaacuuucucuaccugcaccucccaccucacugcuguagcucucuucuuugguacucuuaucuucauguacuugagagauaauacagaucaguucucggagagggacagaguugugucuguguucuauacaguggugaccccauuacugaauccacucaucuauagccugagaaauaaagagguaaaagaggcaauuacgaaaucucugagaagaucaaagauuuccagggcacccuagu

SEQ ID NO: 9197 - RNA, 1515 nt, Mus musculus
cauggcuaaggugaaucucacuuuggugacagaguuccuccucauagcauucacugagcauccugaaugggggcucccucuuuuccaccuguuuuuauuuaucuaucucuucacuuugcuagggaacucaggcaugauuguuuugauccgcauggaucgcaggcuccacaccccaauguacuuccuucuaagccaccucucuuucauggauaucuguuacuccucugucacuguuccucagacaauggcugugcuguuggagcauggggcagcuuuauccuaugcacgcuguguugcucaguuuuuccuguuuacuuuuuuuggauccaucgauugcuaccucuuggcucucauggccuacgaccgcuauguggccgugugccagccuuugcuuuaugucaccauaaugacacagaaagcccuucuaaguuuuguggcuggggcuuacauugcuggccuccucagugccuuggugaggacaaucucagcauucacccucucuuuuuguggaaacaaugagaucgacuuuauuuuuugugaccuuccuccucuguuaaagcugaccuguggugagagcuauauccaggaauuggugauuauuguguuugccauuuuugucaucccugcaugcaugguggugauugugguuuccuaccuguucaucauuguggccauucugaggaucccuucagcaggaggccgggccaagaccuucucaacaugugccucccaccucacugcagugucacucuucuuuggcacucucauuuucauguaccugagagacaacucuggucaggccucagaaaaggaucgaguugugucuguguucuacacaacaguaauccccauguugaauccccucaucuacaguuugaggaacaaggaagugaaggaagcacugaaaaauuuucucaauagagugaagacuuucuaaccucuucccuccuugcgaaucucaagaagaaccuauucucaaaugccagcaauguagggcuucuuuauuuacacuaugcucaauauugaaauguggauaucauucuacaugguuuuauaaaaaguaagaauguuuaccuccaggaagagacaagaaguaauggaaacuucagcuggagaagagauuugagucuggacuauggcucucaggacacgugcaaucuaaauguggcagggcucacugaucuaugagauaauagaacaagauuauaauuuuugcaaaauuuuccaaaaaaggaaguuuugaaaauauuauuuagucaacuccuuaugcucaauagauucuauccauuuuaauauuuuauauguaguucauuaaaauuaugaucacuuuauuaauauaccaauuuauaaaugugcuuaucaaacugugauauguuuuauucauuucaauaaaacuugcaggaaaaaacauuacaacacaaucacuaugauccucaaaaucauguuuuuauuugagauucaaaauuuagaauguacuuauauuuuauuuaaauuuuaaauaaaaaccuuuugaga

SEQ ID NO: 9198 - RNA, 1319 nt, Mus musculus
cucccuccccuccccccuccagcuguuccuuaaccccaucccaagacugaacccugggcuagggccaggucgcaggacagccccucaaaugaggucagcaauguugaggggcaucucuucaauggagguguuguaaaaagucucauugucucgaagaguccucuugucuucuucugucaccauguuaacagccacacccuuacggccaaaccgaccaccucgaccacuucugauguaguuuucccuguuggugggaaggucguaguugaugauuaaggagaccugcugcacaucaaugccucuggccaacaggucagugggaauuaauacucugcuagagccagagcagaacucccucaugaucacaucucguuccuuuugguccauaucuccaugcauggcagaaacagugaaaucucgggcaugcaucuuuucagugagccaguccaccuuccuucugguguugauaaagauuacugccugggugauggucagcgucucauacaagucacacagugugucaagcuuccacuccucucguuccacauugauguagaauuggcggauacccuccagggucaacucuuccuucuugacaagaaucugaauagggccucucauaaauuucuuggucaccucaaggacaucagaaggcauuguagcagacaacaaaacuaccuguguguugcuguugagcuuugggaauauaucauagaucugauccuugaacccacggcuuaacauuucaucugcuucauccaguacaaacaucuugauguauuugggggacagguaucuccgguuaagcauuucaaacacccggccaggggugcccacgaugauauagggagcuucuaucugcagcuucugcaccucagcacacacauuggugcccccaaugcaggcaugacaagaggcacccauguagucuccuaaugccauaaccaccuuuuguaucugcugagccaauucacgagugggugccagaaccaaagccugaguggcccuuagaucuaauucaaucugcugcagaauugauauggcaaauguagcuguuuucccagucccagacugggcuugagcaaucacaucauaacccuugauacaaagaagaauagcucgcugcuggauggcagagggcuucuuaaaaccauaggcauaaauaccacggaggagagacucugagagauucaugucaucgaagcuauccauaaucuuguuccaguuacucucgaugacaccuuccggcuccaucccgucggggccauugucucuggaucgagaauccugacucgcagacaugauccuuagaaucuagu

SEQ ID NO: 9199 - RNA, 1208 nt, Mus musculus
ugcuuuuuuuuuuuuuuuuuuuuuuuuuuuuuuucugaaugcaaugccuuuuuauuuguacuugacaaggaggaucaacacacucugcagcucaggugacuuuugccuaccccacugagaagcaaggggcuuaagagggucucucuccacagcagcacuguucuuuagacacuugauaccuacgcagccaccugaucuggacagucagggcucagcuaagaugggagucuugaguugucucaguugggggacagggcccuuaaagaccccacugugcccgguucuggacaguuuccuuguucaaccacucacagacaccaccagcuccagcucuccucuagaccugauccuggcggagugcuuccuuuuucagaguugcuuuuuuuauaucaacaacagaaugacuccaugagaacauuagaccccuccccagacggaaccuaaacucaaucaaacagaaccugggaugggacuauccagaaucgugacggcuggcagcaagagggaagacacccuaaaccucuauccuagcacagcuaagaacucccaaugagaggguagcaagggggcgggggaggaacagcaugcuuuacacaacuuaacaaggcugugggggccccugugcagcaccccuacuucccugacagcugcucguacagcuugggcacauagucaucccacucggcuugguagcacgugcccgccgccggggcucccagguuauacuucuugcggaaggucuccaccuugaacuugccgcgauugucuccagacuuguugcugagaaugggcucgucgcagcucagcggcuguuccugcucguacaccagccagacauagcgguggagaccugugccacugggaggcccggagcccacauaaucugagaggacagugccacugcuaaugucguuacccuucauguugaccaccaggaagugccacucccugaauuugggauccuuccugcugggagcaucggggucugugaggaccaggguguagaguuucccaggaucaaggccgucccaugaaaugcugcugggccuguucauaaccugggugggcguuagcacuuugcccagcucguccaccgucaccccggcguagucgacccgcagggcgugcuggggcggcucguccaccuccugcaagcacaagggcccggcccacuggcugaugucggcggccauggcgauggagaguuc

SEQ ID NO: 9200 - RNA, 1208 nt, Mus musculus
gaacucuccaucgccauggccgccgacaucagccagugggccgggcccuugugcuugcaggagguggacgagccgccccagcacgcccugcgggucgacuacgccggggugacgguggacgagcugggcaaagugcuaacgcccacccagguuaugaacaggcccagcagcauuucaugggacggccuugauccugggaaacucuacacccugguccucacagaccccgaugcucccagcaggaaggaucccaaauucagggaguggcacuuccugguggucaacaugaaggguaacgacauuagcaguggcacuguccucucagauuaugugggcuccgggccucccaguggcacaggucuccaccgcuaugucuggcugguguacgagcaggaacagccgcugagcugcgacgagcccauucucagcaacaagucuggagacaaucgcggcaaguucaagguggagaccuuccgcaagaaguauaaccugggagccccggcggcgggcacgugcuaccaagccgagugggaugacuaugugcccaagcuguacgagcagcugucagggaaguaggggugcugcacaggggcccccacagccuuguuaaguuguguaaagcaugcuguuccucccccgcccccuugcuacccucucauugggaguucuuagcugugcuaggauagagguuuagggugucuucccucuugcugccagccgucacgauucuggauagucccaucccagguucuguuugauugaguuuagguuccgucuggggaggggucuaauguucucauggagucauucuguuguugauauaaaaaaagcaacucugaaaaaggaagcacuccgccaggaucaggucuagaggagagcuggagcugguggugucugugagugguugaacaaggaaacuguccagaaccgggcacaguggggucuuuaagggcccugucccccaacugagacaacucaagacucccaucuuagcugagcccugacuguccagaucagguggcugcguagguaucaagugucuaaagaacagugcugcuguggagagagacccucuuaagccccuugcuucucagugggguaggcaaaagucaccugagcugcagaguguguugauccuccuugucaaguacaaauaaaaaggcauugcauucagaaaaaaaaaaaaaaaaaaaaaaaaaaaaaaagca

SEQ ID NO: 9201 - RNA, 2678 nt, Mus musculus
ggagggagagagagagagagagagcgagagagagagagagagagagugugugugugugugacauacacacgcgugagcauucucuagcaucugauagcuuggaguuuuccauggucucuaucaugauggucuccuuuucuucugacauaugcaguagcaguagaaucccagugagugucacuauacuaauaucuuaucucuuagaagcaucccacaaggugguaucccaugccuuccugguuuuaaaaaacaaaacacucagcacugaauguccuguaguuuguucucgccauguuguuugauucuucaccaugugccaauugcucccuugcacaggccucugcaucaauaagacugagacaaaagcacagaaagcauaagccauauauguuuauagaauaggggccuagaguggucagaucugccugugcugcgggccuuugcuuugggggcuuuucugugucucugaugcaguugaaauccucaauggcaguguuuuucaaauuauagaucuuaaccagugggucaugaggucaguuuaauaccuaaagacaaccauaucucaaaauuggaauguaaagaaguacaugaacaagagaacacuuaagaacaaauacucuuuguuuauaauuuaaaguggaauauaccacuuuguaguguuagauuucuuuuaaaaaaaaaaaaagaauaaaaagaauaaauagcccgaaagacuagggagggcaucgugggccaccugguaacuguuggaguugugcucuccauccugggaauaggauggcuugaguuggugaggaagagcagauuuggagcaagcaguaaucuuuaggguggaaagucaagagaacucuuauucuaguauaugaaguguuuuuaccuccuuuuccucauagaucaguaggaucagauaaggcauagaaaaugaauucugcagaugaccccuaaaaaguccacaggcugugguagagcccccucgcuauaggucaucuuacucccauuugccuucugucugacucaucaugcagguagcaaaaaaaucuugaaaauggguagcuagcuauguaggagacauuauuguagaacgagagcacucacuugcugagggugccauauacauaucaguacccuuuaacuagauagacugcauguccucguuuucauaagacccagauagaaaaggaaaagacuugcauuucuuacaccagauugaauauaaacucaucagucugguuuccuuuggugcuccauagaaucauguaucacuccucccucuagaaaggagcccuucacacgcugcgugagcauuuaaguuuauacuucauuguuaaugcuaaccagcugaguuuacguuaguuggauaaacuguguucuuuaugaucuguucaauguagcauggagaugugagcacuauacccacuagcauggcuuccccacugacccaggaggugcugccuucaaaauuugaaggggcugcaucuuacucagaaaccccauggaugcuuguucaauuggaaccucuucuacuuuauugccuuucuuguaaaauaacuuaccucaugucauuuaaaguauuuuuauguuaacauuuugggcucuugauuuuuuuuuucuuuuuuaagcauuauagcauucuuuaaauaaggaaaauucagguuacccaaagcuugacacauaggaaaucuaacuuuagauuuuauaggucaauaagaguauuuuuucaaaauugaguuaguuauacaaauauaaauuuaaguuguaguuuaacacugacugugauauauaucaaguugccuugacuuagaaccucugucacugaacauauuugugugauuaucaguguuuccuucuaguaaaacuuugugacaaagcuguuaaaguaaaaaugucuguugguuagaaggguugccuaaagcagagcaugaugcaggccucaguguuucuugugauguccucauaccgcuguugauuaauugacuacccaaaaaucgccaguauuugggcagaaaaacauuucaaaaccaauauuaauaucauuuauaauagaauguucuaaaugucaaugcuaguacacuuaugcccaccaguaauuauagauuauauuugggacuuauuagaacacuguauauaaaguuuuuuuuuacauggccaccucuguauacaaguguauuauaguuaagaaaauugccagggaagauauacuuuaaaaauacuucauagguuugaaauuguauaguuccauuuuuaugaaguguccagacuagugucuuaauuauuuucauacugacuaaguagccuggacgucuuugguauguuuauuauuuggugcaaacaugaccagugguuauuaugguucuuaagcaucuauuucuucacugugucuguauccccuucaguuucccauuccuaguaauccaugaccuaaugaccuuucacauaguggcugccuuagcugccuuaguuuuguguauuuugauauagucuuauuaaauaacacaggcauuucuaaugugguucuuauucuuaaaacucaucuuagucucuuucuugcuaaaacguuguuggaaaucccaacuagcacuugaaacaguguuucuugaagggguagauuuggauugcaugcuaagaugacggucuaguuuaaccgcaugugagucuaauaaagcuuccuggucuuccau

SEQ ID NO: 9202 - RNA, 1466 nt, Mus musculus
ucauggguaauaaacgaccaaaauauacacauuuaucaagauguuauaaugaaacccauuauuuuguaaaauauaugcuaauauauucuuuaaaagcuuaaaaaaguuuacacuauuuuugcucuuuuuuuuuucugaaauaaauuugagauacuugaugacuaugcacaaaauacacucagugccaaaucaggaugugccuugcgaagagaaaguugaaaguguacugcugccucugaaauccucagaggauuaaugucgguucuguaaguugcaccucugucuugugaccucaggacuuugggaccaauuuucucuaaguccaagcguggagcggagacacuacuuauuuuagcuuggccacuaaggcucagaggugucuuucuugguucuuggcaggcucucugcugucuccggacugacucaaacgugcuacucuuuaacaugacuggcggcuuucacauaaaugauuugaccggaaaaaggugccaagagcaguugcacauuaagaacuuggaauuuaucucccaacuuuacucucccucgccccuccucagcacagauuaguagcugaggaaguaagggaaggcaacugaagggccaguucgcauccuugccaggagaagggagaacgucaggaaguacccaagcaccaaggcuggccgaaccucacaacugguaauaaugggggaaaagcguccugggaaacugccucaggaaacuucccgcaaccucgcaccaagcuguacacucuccacucuuuggaucccgcgaucuuaguuuucucuuucggaagcggcguuccugucgguuaucaucacgccccgccuccuagagaaaguucgcugcggguaaaaaggagaaucauuccggggcggggucuccagcgcucgacugguguucuguugcuaagcgacggauaggaggcgcggccggcgggagaggcccggcgguccgcucgcgggcaagggcgggcccgcggcugcgcagccgccguccuucacucucgcucccggccgcgccuccaguuccgcgucggucacgcccccacgcgcagcccgagcugcgcacgcguggugcgagcggcuaccuuccuucuguggggcucgcggucggguugaggggacccggcagcacccgcaccguagcuggagcgggccgggagccgguaagccgagccgucucgagggaggagcagcccggguagugccgcggugcccuccgcggcagagaggaaaaaaaaugguauucgagucgguggucguggaaguguugaaccgguuccugggagacuauguggugaaccuggacgagucccagcucucccugggcauuuggaaagguaacggggucgccgcuccagggucgcgggagacggcggcgcgguuucucguggcuucgguccuuggccagcccggcgccgccaccugcagcugcccgccucgcccuucaaguuauguaaagcg

SEQ ID NO: 9203 - RNA, 2166 nt, Mus musculus
cuuuacuuuuggaaucuggagcuuugcucuuuaagccuccgccuuucucuuuugugcgaacuaauuacuuuagcugucccuacuauccuccucgaccccgggucacagccacgaaauguaaccguuucucaaagaacccacuaacccccucuguaccccccgcccccgccguaacagcgaguuuauucccggugucguuuucuuguccauuuuccugaccacggaaauaaugagacaaaacaugcuccuucccuuaccaucgaaggcaaguuuuccucaaaaggcaggcggcugcggacuccgggggacugaagccugggcucugaaguccauuucugucacucuguugggcuucucccggauuaggucguccagguccugcuccagaaaagaggugaacccuacuuccucuuugccuaaaauuaguuuucacugaccacguuugcuccucucucccauaacuuaccgacuuuuauuacaauagaaacucuuaccugaaaaugggcuuucauuaauuaaucugauuuacaagauaguauaaacacagacaccaggaaguuacauuuauucagaccagugcagcauuuagcucaaugccaaguuugcugaccuuccuggagcacccucucggucugggaccauugucucagucucucgacaggcgccuucucaccggucgcgggguccccuaagaaugcaccaacaccgaguguagggagcuccccuugcugucagcccugccggcugcggugggcuccaagagaggggcugugggugaggcggcggccgcgcacacgguggagggagcaggcagcugcugcgacgccguggggacagacaacgccggcggcagcguggucacgggugguagcgcaggcgugggcuugaugggcaccgguacagcuggcaggcucugguuugccgaguggcacagagccuugacuggcaccccgaaugccccauacuccgggccuaccgggaccccagcugcggcggcagcagcggcagccgcggcuaccgaauccaucacgccaacaugaggccacacggagccgacaacauugcugagcuggcccggcacgggguagcccaaguggugcaugaccgacgccaaaggcaacccuccagccugcagcacgcccuuguagucccgcccgaugauguucucuauggcgaacggauguuugaagccugugguggacgcggcggcugcagcggcggcggcggcggccgagcccagcccguagggugggaacugagacagacgccccacgcugcccaccgcugcggccgccgccgcugcugcggccgccgccacggccgccgccuccugcaucuugccgggaugggacgucugcggaggcugcgacugcggcuguggcugcugcgcgggcugcgacgggagguguggaggcugcggagccggagccggcugcugguggaaauagggcaccaugugcggcggcggcggcgggggcggcugcggcggguggugaugguggugauggugugcggcgugguggugauggugguggugguggugugcgugguggggaugguggggaugcaggugaccuccuggccccgugccgggcgcgcccuugcugcuuccugaguguaggugagcguggucugcgcguagcaccuugaagcgcuugcggcgccgcaggaagcugccguucucgaacaugucaccgcagucaggguguagcgcccagaagcugcccuuaccggguugguccggccuccgagggaucuugaugaaacagucguugaaggagagguuguggcgcaggcuguucugccagcgcugcgugugcucgcgguaguaggggaagcgcuccaugaugaacuuguagaugucgcucagaggcagcaucuucucagccgaaugcuggauggccauggcggucagugagauguaagaguagggcggcuuuuggucgcuguaggaacucuucccuggccguggcaucuucccaggcucuuccacuuccguccggcccacagugggccuuaacgccucucggaaagccggauaccaggcuuaaguguccccacuaauucucucuccaccugcgcagccugauccccagcuuucuugguccccagaccccuuuugccuugguccuccuccuucggggagcugccccggguccccgcaau

SEQ ID NO: 9204 - RNA, 747 nt, Mus musculus
agaguucggccaauccaaccugcggugccuucccggacggggcugcgcagcucgucgcuagcggcaggagcgcggcugccggguccccugcccacggccuagagcuccacggccccgcgacgcgcucaccuguggggaugcccaguugcuuggagccgcggccgaagccacgcaccaccuggccgcggcagaagaacggcaggcuccucaugacgcugaccucggaggacgcgggcugcuccucgcuccgugccugcgacggagccgccgugagugcggcgccggggcccggaccagccgggggaucccgcgggagcugggccggcggagcgagacaccugccgcgaccagugccugcccgcaggauagcacccagccgucagaucccagcggccgcucggccggaacuacgacaaccgcggcgaaugcacaggucugcggcccaggcgaccggccugcucggcuuccguugcucucccgccguagccccgcccccgccguugcggacccgcccagaagccgcgccccgcucgccgacaucguagugcggaccguccucaccuccugcggcugaggccccgcccucgccucuguggccccgcccucacccauagcccagccucuaauugucgccuuuucagcuucugaguuugggcuuugcugaaauaagcguugcucacaagauaacuuaaguuguucuuuuccuccacaauuuugaauaaaauucugcccaaucuuugcaaucac

SEQ ID NO: 9205 - RNA, 20521 nt, Mus musculus
caggcccugcguaggggaggcuaugaaagcgcaguggacuucgcugccuaggugagcaccgggcagugguaggcaugaaacgcucuugaagcuugcucugcgacccugcugggaaggauucgaacccgcuucggugaguacccacugccugcugcguacacacggcgaggccugggaaucuucaagagucuccuucgcuguauguaccaggaaccugaucgugucuagggaaaccgcggugggacuuagaugcuccuaaaaagcaacuagacacugcuagcuguaggagaccccacauuugcuagcuggagaaucgggucuugaucccccacgggacaggacagcuuuuucuacagcaucugguuaacaaacuccaacccacuugcugccuggcuuuuauaaagacuucuaacagugcuuuuggcguuuuuuaaauagcugagacaaaagcauaguauuuuguggcacacgaaaguuaggggaaacuuagauuuccgugaccauaaaauuuuauuagaacacagcaugcucguuugcuuaugcauuggcuuucuuauuacaauuucagaguugaauaguuacccgcgaagucaaaacuauacuacuggcugguacuuuauacaaguugcccaacacgagaguuuauguucacacauaaguaaacucacaaugucacagucaauauuauaugccuauuguauauuagggguaauaaaaaugaaaauacugguuauguaagaaacuacagggucagcacaaugguccagcugccccugcugccaaaccugaugagcagaguucagccucuagcacccacacuuuggaaagagaacucccaggagaccuaugaccugagcauguguucuguggugaaccauggcaugcaccugcccacacacaugcaccgcaaccuagauacaaauguaagaaagcaacuuuuuaaaaaagaaccuccacaaaauggaccuucaacaugucuauugaagguuaauuuacggggaaaaaagugacugaaacuucaaggggcaaagguuagcaggagcuuggucauggcuaugcccccaggccuugcuuaccaggaacucuaccugugggggauuucugcuuaccaaaaggguucaaaguugaaauuaguccuauucaugggagcguauccagauaacuguagccugaaccucacggaaguccugaaaccugggccuugaagucaucugaagagcauguguguuugcucuuguguuucucagauuugauugaugguggaguucuugccgccugcugacucuucccauccuccugggaaucauucugugcuuuagaagucucuguucagaguggaauagauugaauauaaacauaagccaacuaugaagaagauuuaacauuucacugggauuaaaucaaagauaguuuuaaacaauucugcguaugagccagucuuggcgaggcuugccuaugaucccaguacuuuuaggaagguagcuuugccacagaggcagccguggcuguguggcaaguuccugaccagccuggacucugcauagugagauucugucucaacagauaaauaauauaacaaauaagaaugauaaguaagugugaaaaagauaaauggcucauuuaagguuugcuccucucccaucuuguucuucucccucucuguggaaaggauacuagcggccaagaagacacugcauaaauaucccacaggauucaagcugacaggauacccugacuucaagacucugaaagguccaaaagguggucucuccagagacauuaagauguacaguuugucuuggcucugaguugugugugcuucacaacaucucugcugcaagccagguguacagacacacaccugcaaucccaccacucuguggcagagaguagagaccagaggugcaguauaugauuguucuuuaagacuuuaaggcuaggcugacccgcaugaaaggccucuaaaacaaugaaacaaaaacccucuagcacauauaugaagcaugacaacuugcucaacauuugguuuugaaaccauguuuaaggaggcucuaauauauaauaaaauagaaugauacagauguuuauagugccaugucugaaccuggaaugaaugucuugugaauccaacacaguuuuuggauggacaacucugggaauuaguaggccgcucacugcuccacugggcacucagccuggcacaagccguguuucugcauggcccaguucuccacccuucucacaucaccugcugguucuuggugagauagguccagaauucacccgaacagcuuggaagaauugguuuucuccuuccaugucaguucuggggauugaacucagggcagcaaggaacucuaauaguaguaguaguagaacucuaauaguaguaguaguagcaaggaacucuaauaguaguaguaguagaacucuaguaguaguaguaguaguaguaguaguaguaguaguaguagcaguagcagcagcagcagcagcagcagcagcagcagcagcagcagcagcaucagcaucucgggucaucaggcugauggggagaggggaaugcugcuuugauuugaaagaaaaaacacagccuuccgcuuccuuguauuuggcuaugggaguuucugccccuuacuuaagggauguuaugauaagguucuuccaucccauuccuccccucugaauugcuagaguucccacacagagaaacccuucaagucuagugucacaaccacauuacuucauccuguguaauugaagcaguauccugaaguguaugcauagauaugucaaguaggaaggggaccaguauuuuccauuaacuguacacagcaaaugcauggcucuucaauaaugcaucaauaggaaugacacagauuauccaucagagccugauaagcuagcauacaauuaccauccuuucuguggucuugauaaugaagugcuucauagccuguccuuaugauaggaugauguucacuuaauugaucuaauauaccaggguaagcuuuugugugugggggugagggggauggagagaagaagagaaugagaaagugacuuuuguuugccucuuccacuggcagcuguaccuucuauuacuuagaaaguaggaagggcauauauuagucagacuucucuaaaggaacagaacuuacagggaaaaaaauauauauguauuugcguauuugugcauguguauguguguagugugugagagagagagagagagagacggagauggagagauuuauuagagugacuucaagaauucaguacucgcucagcccaugagguuggaugucucgucuggucuucaguguaugccagaaucccacaguagcaaauucuaaugccagugauggaaagaacuugcuagcaagagugagagcaagcaggcaaagacagcagguguccuuuguccauggucauuauauaggcugucaacauaagguguuucuuccuacuucaggagauccagauuaaaagugggucuucugugaugguuuguaugugcuugggcaugagaauggcacuauuaggagguguggccugguuagaguagguaugucacugugggugugggcuuuaauaaccuauugcuagcugccuagaagggagccuuccacuagcagcauucagaugaagauguagaacucagcuccucuugcaccaugccuuccuggauggugccaugcuucugccuugaugauaauggacugaaccucugaaucuguaagccagccccaauuaaauguuguccuuuauaagaguugccuuggucaugguaucucuuaacagcaguaaaacccuaauaagagagucuucccacuucuucaaaugauuaaaaagucccucacagguguacccaguuccuuuaguuuuaguucauucuugauguagucaaggugauaacuaagaauaccuuucacaaggugacccaagaaaaugguucacacaggcauaacauuaguuaacagauccuaagaaagcaucagcuauugccagcaguguggguaauguaggcuugaaaccaccgauccccucccugugagcuguuacuucuucucaggacuaacuguagaccacuaaagacacugacuuuauuuuaucucuauauauuuuaggauauauuaggaaggugugauuuccaaagccaguuaugaagagauuugucauuggaauuggugggugaguaauuccucuauaaacagcuggaugagaugcuccagauggccagaugguuuuucaaguggacaugggagagaaagcuguggggagccccaaguccuaggcagagugcugccagugaggagggccaggauuucccagggaaggaagagguagggucagcaguauuuccauuuauuuucaggagcugacacuggagcugaggccugauuggucguuccuuuggcagggggugauuaucauuucuuauguggguguucuggcaugguguaaggaaaacaaaucgcucccuucuguuuucuauggccagcuuuugaaaugaggaauacagacuucccuacaucuaguccucuuccccccacccuuaggguaaccaggugugcuauuuggcuaggcuaguuuguguugcucuggugugauagaauccgaguaucccacugucacaagcauucuaaauuguggugaccuguggcaccagaggcugauguaccaaugugacaucaacagcuauuggaaagauacuauuuaucuugcuggcagacugugucugucauucuucacaugugucauauugacaaaacuccguugugucuuauugaggaaacuuuugaaauacuaaaaagguaauuugagggagaugcucaguugugaaauacaggaaucaauuaggacucagguggaucuggggcuaguuggguagcagagcauuugccugcauggggaagguccuagguucuaaccccagcaucaggcagggcaaaugaagagcgagcugagcagcacagcgugccucauuguggcucccauccacccagauccgaggcugucuuugucgcucugcaggaccacccuuguccugccccucauuucacgcucagugcuacccuccuauaguaggccaucacugcccuauaaccuucuaacucuccuugcacacaucuauccaauuaauccuuguguuaaaaagaccccugcuagaguuaaacguugcuucccacuccagcaguaagcagucuccuaggccucccuuuccucagcugggauauggggggauuaauaucacccuguuauggaagaauucauaucuuguuugauuaaguguaacauugguuuuagcuuucaccugggcuucggcacccucuuauuaccuugcauguuaaaaaaaaaaaaaaaaaaaaaaaaaagaggaucucugugcauuuacucggaaacaaggaagggaaagcauuguguacccucgcugcucucccucagauccuaaggucauccucuggcucucuucccuggggcaggagagcuugugggagggagguugugagcucgcugaagggaaaggagggguccugaggguccugaggcgucuuccgacccgggaugcuuacauuccaaguauggauugcagguucugagcucugugaugaaacucuuucccaguccgugcggcccugcaggauuucucucuggggcuucugcugaaucaaugggaagggcucuaucuaucgccgauucaguuauaugaucuuaaaagaauaaguguaagaaaugacauauuuuucuugccagauugcucagaccauagugaaguugcauccuuuuaaacaaaagcuuggccucuugaauauggacuucuggcauggucuauagauauuuuucuuaaaggagaaagggucacauuuuucuuaaagaauagaagguucucaguauacagauuaacacccccauauccuaccacguguguauuguaaggacaaauggacagucuuauuaaugaauauauucacagauauaauacgguauauacaugauaauuuauauacaguaaacauucuuuagguuuuguuguuuuuauuguuugguaggauggaucuuucugaugguuugugauuucuuuuugguuuaaacauaggcaaggucuucguauguagcccuugcuggcccggaacucacuguguagaccaggguggcuuuaaacuaacaaaagaucuaccugccccuggcuccugaguacuaggauuaaagccacgugccucaccacaaguccuucugaugaauguaucccucucuagguguggugcugaucucagccagaacucaucacagguucuugccaguggauguacagucaggacguuuaugcuacagacauuugguguguggugaaaaaucuugaucuguguucagggugacuuuaagggcacaaaauaaaacacgggaauucaaagaaagucaacuuauuaguauacggccauaaagccucuacaagcaaaucugugagcuugugauagaucauugcagaguaauaaacaacauauguaaguuugaaacaauaacgagcacuggugaugcuucaucggcccacuucuagcucagcgugcgguucuuguggauguccaaauccaagcacugucacaacuguagucuauuacguacaauaaaagaagcugcugauauccugcuagaauuuagugaaggugauauaaucucuuucaacuucacaaugacccugaauucuuucauagaauucuuugcaugugacugagcucugagcuaaucaccucuuccaaaaaaaaaugauagcauaagccaggcacggugacugauaccuguaaccucaguacucaggagguuccgaccaacggucugcuguaaguucaagggcagccugagcuagcuacccaagugggucaauaagggcaacaugacuacuguuucagaagaaaaacccaaagagaaaagaaagauuaacuagagaaaugccuaccccuccccaugcaggagagccggaaacaggacacacaacucuaucaggcaccugcaucuccagaugucaccggccagccagaggcaacaaacacugaccugagggcaagaguaacagugggccuccaccugggcccagucacagagagggggaggggagggagaggcauggcccaggaaauguggguucauggacagccgggcuucuaauaagccauuccuccuuuuuccuacgugguugaaacaaucacuguggcugugggcaguucuagaagccugcagaaaggggaagcaggauguucucuggugugcauauugagcccgagcuauuuugacagucaaaacaugacuguguguccugacagugucuguauuuugaaguuuugguauccaguucagugaccucucucucuccguccuuugcuucuuuugcugugaggccagggucucucucaaaccugugauuucaccugcaaaacaaaacauggucuguggaagugaguguuuuccccaagcaguaaauauuguuuuaaauagccuuuuuuaaaaacaucguuuaacaauaguccauguucccuaaugucuucuuggaccuggugguuuuucuuggcucagugugacaaacggagggaagacgacacuggcuaagagcuugcagaagcaccuucccaacugcagcgucauaucucaggaugacuucuucaagguaucuaugaagguucuuagauaacuuguugaacacacacaaacaaaaagcuuucacgacaaaguuaaguaaauuauagccaaaagcuauuuggggagaauauacugggugccauaguguuaccugcccacuagagggcaccaucugucagugaccaccucugagcuugguccuccuauuccaagacauuucuuaaagucuuaacuucuuaauuguauaauugcaccauuucuucacuccauagugucuugauggauuuuuuuaaauuuuuuuccagccagagucugagauagacauagaugaaaaugguuuuuugcaguaugaugguaaguacagccacauguugaauaauaugagguuauauucauuuucuuuuucaaauccaaacaacuucucucucuguuaacauaauguuaaauguuuaaauagggagggcagaaggcgccauggguagaagcacuugucacgcaagccugacaaccugaguuugauuuccuagaaccuuuggaaagguggaaggagacacugacuccacaaaguuaccccuggucuccauaaggaugcuguggccgugcacacacacauauccuaacacauuauacacgugcuuucuucuguccucuguggacacugcacccacgugcacccacauacaugcaggcaaaacauccauaaacauagaaaaugaagagcuuuucauuuaauaauauuaaaaauaguaacuacuuuccaaauacaguauauguuauuuaucuuucaaauguaucuauagacauucuguguuccaaaauuggaguucgaggcaguugugagccaccauguggguacuaggaauugaucugagucuucuugaagagcacuggguacucuuggccacuaagccaucucuccagaccuaauuuaauuuuuauuuucaaggaucuggcuggagauguaguucggugguugagugcuugccuaaaaaccagaaaauccuggguucaauuucuaguaccauagauuuuuaauuuuucaauaucaggaaggaguuggugugguagucagccaugagguuaugguagccaaggcuggagggugagugagagaacucagaaaaggcgcuuacccaagucuaacagccugagcuacauccuugggacgcccaugguagaaggacagaacugaaucccucaagaugaccucuaaccuccacacauacacaguaaauacaucaguguaaaaaaauauagcuagaaauagcagcaugcuauucauuguauuuuauauuuguacaucauuauuuuuccauaauaaaacugccuuagacauacaacuuaaaucucucucucucucucucucucaguguuuuaauugagcauuuaagguauuuaguauuagauaccuugaaggauaauaaacugcucucauaucauacauguacagagcccuggagaugcuuaucacaaaagccaucucccccccaccccccagaaaaaguuugguauauuaauuccauguguuuuauguuuuccucagugcuugaagcgcuaaauauggaaaaaaugaugucagcaguuuccuguuggauggaaaacccaggaagcucugcgggaccagcagccuuggaaagugcucaagggguucccauuuuaauuauugaagguuuccuucucuuuaauuauaaguaagccuuccuacugcaauaccaacuugaaggaauguggggguggaggagggcugugggggugggaggaggacggaugcugguguggaggagggagagagccuuguggccugaauguggugucaucguaggccucuggacaccauauggaacagaaguuacuuccugaccguuccauaugaagaauguaagaggagaaggagguacguccggggacugucucugcauuguaauuccaaagaugaaauacagggaaaacaagaaaagugccauuauugaaaagucuuaauccagaaaucaaauacuuuucuauaaaugcuucucacauuggguagcauacaguaacuucucuaagaaaaagggccagugucauccugucagccccccgggguacuuggaugaccacauguggcccauguaccuaaagcaccgguaagaaaugaacacugucaccggggagauuguuaagugccuuucccccuugaagccuuuuacuucucauucacaucaaaguacaggaaagacgggauggcaucccgucagcuccuugucccucacccuucauggcauggucugcucuagcugcagagaacaccagcuggauaggagagugugccagccucucaguaucucucuccuuauuuccucuuguacucaucccauaauucuuuuauaagacucaagaggcagaaaaaagauaauuaugagguagugaauugcaggacuauguuuuagauagguuuggaacuaaagccauauuuucucccuuucucacuacaauagaggcuaaaacaaguggucugaauuccucuuuagauuuaaccugaaugauguucacauucucuugaccagugaucuauuuacuuugucaaucauaaccuguuuccuguauguuuuuccaguaccagaguauaugagccuccagacccuccaggguacuucgauggccacguguggcccauguaccuaaagcacagacaggaaaugagcuccaucaccugggacauugguaagucccucucuccccuuuaaggccuuuagggucuuauuuuuacaucaaaguacaggaaagauuucuuggaaaacacuucucuuuaggaguuuuuaaagaggugcucagguacuccccagcuucuccucuccugcaacugguucuugcugguuucuuuuucaacuggcaguuuuuguuaagcuuguccgauuccaaaugaucgaucguucauugaaccaucccugccugaauguugcccauugagauggaagggaagcaaggcagacccagucucuacucuccccagcagugauaucauggcaaaaggcuauuaaaagugugaguuuuacaaacaucuuuuucuuggguaagcacugauauuagguagccagcagacugcccaccuccaaguuccucgagaaagcuccuuguaaccaaacucauaugaguucaacuggacugagguggagaaaauuaaguuagggagaaugacugucauccagaaagaaccuagaaaagaccuaggaacagaaaggcauguguaguaccugaaagaggcuguugcguuugcaguagagaagagcaaggaaagggugugcugcugcugaccaugaugauacaggcaagggccaggcccucugaugccaacaggauauccaaagagaauuaggaagcucucuacagagaggcuugaaacauggucgugguuggcacauaaucuuuucaguaagaucucuugagaucuggaggguagauuagaagucacuguacugaacacaaguaaucaguagaaaugggacuggggguguuaaagaugacggacacuccaggaaccaacagguguuacuuuagggggaaacuguggagggguuguagauaugcgagcaaggacuacauauauguuuugaaggaaauaagauugaggccccuuacagacaauguacagauuuggaggcaauaugaauacuuggaccugggcuaagagacuaucccuggaacagagugcucguguggagagaugguggaauaagucuccuggacagggcagaggaaucagacuggcauaguuuucagaacaaaggggauucauccauaggagaaagagccuguuggccuccagggaagacagcuuuguucugauaugugcagaaaggucacagaguccgucucagcacuauuucuggguuaugccuacaccagcagcuacugugcuauacaggagacacauccuuuacuuccuucauguaaacugcaagucuagcuuuguccuugcccuauguccuaguuaaugucagcugucaacuucacaguagagucuucugagggaggcucaacugaauuauugccuagagcauaucagccuguggccacuucugugaccaauugucuugccugaugguuggugugggagggucucuuucauaaugagcuugucacccucggcaggugggccugggauguauaggaaaucuaacugagagggccagagagcaagccagugaacagcguuccucuagcguuccugugacagguacccuguguuccugucugacuuuccgcaaugaagugugaucgagaagcauaagucaaacaaacacuuuauuccccaagcuguuuucgguuagaguguuuuaucacaagaaaauucagacauccuguuuaaaugcaauugguccaugguuuccagcuuuuggggauaaaaucuaaagagacaucagggcacagcgcuucuccaaaauaucuucucccaggcuguuccuuccccugcugcuaagccccuuacaccucccaacaggcaaauccucuucagaccuccuuauccuugcuuuauuauaacuagagggcccuuuucucuuuaacccagguaacuucuuuuucuccaaaaguauuugugugaauuuuauuaaaaagacauaucuucuggucucgguagugugugauaagagucaagacugacacacaguuuuaaaagugucacaguugaucccaguuggggaauugcuccucuuugggccucuugacgugcuaucaugugacagucaggcaccaaugacaaaccaaguacacugucccgugucuggcuuagugaaccagugaguuuauuggaguuaaagauaagaguguggugacucagaggccgcugcaucaccaaaaagccuaccucaccauggugaugccucacaaaagcggcaucccuacagcugcccguacaaccuucuggcugcucugggcaugugagagucuucuguccccagcaguugauacggcuaaugcaaccucuggaaggauuuuugugaaucuaacucucaggaguucaaugagcuaauaaguucauuuacuuuggagucuuuuuuuuuaaaccuuuuuuuaaauucauuuauuguauauaaguacacuguagcugucuucacacacaccagaagagagcaucagaucucauuauuaaugguugugagccaccauguaguugcugggauuugaacucgggaccuucagaagagcagucagugcucuuaaccacugagccaucucuccagcccuaguuuggagucuuacaauccuccuuucucccucugggagggaaugucacaaagcagaagaaauggguacaccgugugccauaggcacaacauauaaccucucucuuuguuuucauuccuucccucccuccuucccuccuuaggccauaauccugggcuccuagguggaggcuauuggugauuacagaaaugccagagcauccuuuacuacuaagccugucaacauuugaucugcuauuucucacuuuucaguuuaccuggauggaacaaggucugaagaggaccucuucucucagguguaugaagaugucaagcaggaacuagagaagcaaaaugguaaaguguucuucugucagacugugugguggaggaaagagaauauucacaacaguugauugcauagcaagaacggugugcauacauuucacaaggacugcauuuacuggguuuauuuaucgagaauaacccagagucagagauggacugauggugcccggcuggaucuugaucauuuuguuugucagauagcuuuagguuuagaaauauuaaucuuuguuacaucucauagugguuugaauguuaaacucauagcaggagacugacccuaugggcuugugaugcugauucugguauaguuggagcucccccuuggcuuuauucucucaaauauuuucaugaaguuucuguuuggcaaauacaacauuucugaacgauggagaaaaccacccaaaucuggcugagugagaagaaaagcaagaggugucaaugacuuuaggcucagcuggaggacgaggcuagaacuguguccgcagggcucugccacaguucuguugggguuuguuuugaaaucaggcugucagcauucagaaugaagugauaguuuacccuuagcacaauuguuguuaguggauaaauuggggagcuggauacuccugcgcuaucuuuacuacuuccuagcuaaacgaugauuuauuuuauauagguuugguuuuguggugcuagggaguaaauccaggccuucauaugcuuugcaucgcuaggcuauauucagccuucaacaguuuuauggaguuuauguuguuguuguuuauuguuuguuuguuuucaagacagggcuucucugcauaucccuggccauccuggaagucagucuguagaccaugcuggcuucuaauuuagauaucuaccugccucugccucccaagugcugagauuacagguaugcaccaccacugccuggcaaucuucaacaguguucuacaaaaugauuucccaacuuaacucaccuaaauugauccagggaagaguuuugcauugauauaucuuagaucacgugacuuacuaaagcuauuucuauggccagagagauggcaggugauugauuggucauagcuuaaucauguacuccgccaugguugaagacccucaggugagucuugguucuuaaaauuuuuuauagagaaagcggaucagaaaaaguguaaagaacccagaagaagccgggcgugguggugcacgccuuuagucccagcacucgggaggcagaggcagguagauuucugaguucgaggccagccuggucuacagagugaguuccaggacagccagggcuacccagagaaacccugucucgaaaaaucaaaacaaaaaacaaaaaaacaaaaaaaacaaaaaacaaaaagccagaagaaagaaggaacaccguggugggauggcaaaucucuagcucuaacugcugcuagauuugaaucauaagaaugaaaaugggaguuagagaaugacucagcagcuaagaacuguugcugcucucgaagaggacuggagcccaguuuccugcuuacagcugccuggaaaucugacacuuucuucuagccacugguggcaccugugugcauauguacaccucucucucucucucucucucucucucacacacacacacaguaaaaaaaaauaauaauaauuuuaaguaagggucucacuguguagcccugacuagccuugaacuauguagaacaggcuugccuugaacucacagaaauccaacccgcuucugcugcccuagagcugggauucaaggcaugugugucaccacauucaguguuauaaaaaauaaauccuuaagaagcaauuaaagugauuccuaugcugagcuggugguacaugccugugucacagcacuuaguuuagaggaggcaggaagucacgaguucaaugauaacuucagcuacagagugacacccugucucagaaaaaggagaagaccuguggcugacacagauaaaaugucacagucagcugguucaagagaaagccucguagagcucaacagcaggaaagacuguagcaagguuuaggaugagacaaacaugcugugggccacagucagugacccgguaagaauuacaaugagucucuccucaucaacuccucgcucacuaaccauccaagcuauccggacagcccauugacccugacuguugcugacugcaaggucaguccuucccacaggcaugaagccuuuugaggaaauguuaggaccauguuaaauuuucuucuuauaaauagaacuaauaauccauaccaagucuuccaucccaccccccccccauucccuccccuaccuucccaccccugccuuccuacccaugccauguguuacuaugauggagguauguuucccauaaugcagcccagggcucuucaguuuucauaagugauaaccuugagccagaacuacucauuuaagagagagcagauccucuuccuggcccagugagaggcuucagggucuuuuaagugccugguuaccaguaucuguccucucagucauggccaagacuuagaccaaagccaggcgcucgccuuuagucccaguacuugggaggcagaggcagguggauuucugaguucgaggccagccuggucuacagagugaguuccaggacagccagggcuauacagagaaacccugucucaaaaaaaacaaaacaaaaaaccaaaaaccaaaccaaaccaaaccaaaauagacuuagccccaguucccuacuagugacuaaguuauauauugaaauuuggccuuaguaucuaagugggagcucuagucauauucccaugccaccucaaguucuuuuuuaucugccacaagggccaagauauggcauguagcagcgugugauguaagcccacaagauagugccuguccauguauggaacuaacucauucucucucucucucucucucucucucucucucucucucucucucucucucucucucucacacacacacacacacacacacacacacacaccuuccuugccugcaucuagacuagauucuagaggugggugagaaguguucaccucaagucuaucuuguuucuguucuggauagcagauagagguaagauaauaacagaaauacuaaaagaugcaaaacuuggaagcagauucacuuuuccugcccccuaccccaagauuuaugguagucuucuguugcccaaaugagugacugugcuauuaauaguaaccuguuaccuuuccgaguucuuccagccagaagcguccucagcacagccuguuuuagcccugcgccucagcuagccagggcggccguucuaacgucucagauguugacccuucuggguuguuucacuuugaacucuguucagcaaauucuucauuauaagaauauagagucgucaucaugacaaggucuuuaaacuguuagguaaauaaaauagauugacguuuaauaagggcaggcuauauaaagcuauacguguaguucaguccuaauucaaaucugaagcuugaagcgaaagguaauccuuaccgaaucuagcugcaccaaacaaggcaaucuuggccccaggagcuuccaaguuucuuuuaaaagguuuuacuauccuuucauuacaaaaacacacugauugcaagcauuuuuauggaaaagcaacauggaagaaaucauaaccguguucacaucaaucccugucuuacaagaugcagugagcacaccagggacucagucgugauuucugggcuuuaguguuccguuuuauacagcuuuguagagguuauuguauaaugaagccaaaugucacugccauuagaagaucaaaggcuuagauacuuuuuuuuuuacauaccaaggugaaaucuaaaacuuagaguugauauuuuaguguagaaccaagauguccuggagcagauaccagauaaaaggauaagaaauggaaaaaaaugaaauuuuuauuaucaaguaauuguauuuuccuacacuggauuugaaauacaauuucuacucagcaaauauuacuauaacuaugauacugccauaauagcccaguucacauaacguuacugagucauuugcuaauuguuuuggacacuugcugcuguaacaaguguuacuauugauacguaccuucucccggccccaaaucuauauguguugcagucugucuuaguguuaccauuacuguaauuaaauagaugaccagaagcaacuuggggaggaaaggauuuauuuucacucauaguuccauacaacaguucaucaucaaaaggagugagagcaggaacccaugccggcuaggaacuuggagagagaagcugaugcagaggccauggaggggagcuguuuacugccuugcuccuuacggguugcugggccugcuuucuuauagaaccugggaccacuagcccaggaacggccccacccacaaugggcuggacccuguccuaucaauuacugguuaagaaaaugcccuacugccugcagcucaaucuuaaggagacauucucccaauugaggcuuucuccuuucagguaacucuagcuucugucaaauugacauaaaacuagucauggggugcaucgugcgugccugcgccuuucucugcaucucugauucucucucugacuguuucucugugucucugucucugucucucucucucucucucucucucucucucucucacacacacacacacacaugugcauacuguugguuuucuuuuuuaauuacauucuuggaauaaguucucagaagcaugacucauugggccagagagcugucacuuuuacauuuuacguauuucaguaauuaaauauuuuaccugaaaagauacguuuucucugacaaaacugaauaauacgaaugcaucagguuuuuucuugaauuuccaaacaguucagcuaagcuuccuucaucaauccacuucauuaaauggauggaagguuaugauaauucuuccuacgucuagauaacacucagaaacaggaaccauacugcagccagcugcccuuagaugcccuucugaucuucagaauuuaucuuuuucugcagccaaguacccauaccaauugcaaauguuauugggcaucuagcccucccauuuuccguuucuugcugacuaugcauauauauaucacaaacuuggccauccccagcacccacaacccucugucuuuacccucacacuuccacggagcccuucuucccagagcauggccucugauuuucacauaguuuucucugcuuacuuugauuguuagcuucguuggucauugcuguccuuuuugcuacauucaguuuaaucggggcugagugaucauaugccaagaguacuuagcauagcagagcauagacaacuaauuuaccaguggcugcaccacugcagaaaauaucacgucucccugacacucuuagcugcaauaauuccucagaaggaguggagccucaggagacccuccuuaucaugauagagugcuggcgggccccaucuugggcagguccugucuacgaaaccacagcugcaaugaguucagcagcccaacagccauuucaaaaccaaaagauaguguuccacauccccacccccacccccauauuuuggcucuuuaauuccuucugccucuucuucuacaguguucucugagccucgggaggcacucucuaucuaugucuuauguauagcugagugcucaguaguugcuuauucucagcacucgagccuguuaugagccuucguuaacuguugaggguguuucuucagauaggcuuaaaauuugaugcaaguauuaaaacaagaggauuucauccaauguuguucuucguggacaaagcagaauuuuugccucaaaaauccuuguaaaauuaacauucuuggccuggugagauggcucagugguuaagagcacugacugcucuuccggaggucaugaguucaaagcccagcaaccacaugguggcucacaaccauccguaaugagaaacaaauaaaaaaaccuaugggccugagugagugggaccuggagcaagagggagaagggaagggggaaaacauuaacauucuuggguuuacaguuuuggaugagacgaucuaaucaaauaagacauauuuuucucuguauuucuaagguuugugauaacaccacacagauggagugcagcaaguucccgggauggauucagauacuugaagggcuauucugaaggacauuuacagggaugcaguauguccugcaggacaguggcagcucgucuguauguucacuuuugugccauuguccccaacauccagagccauguguugccaugccgucagacagaaaccccuccugaaagcaagaauggcuugaccucacccugcaggaggcacagcacaguucaugcacagagggucaguuccucuauaggaacaaaagccaagagcuccugacuguuaccuagcaccaaaagaccauugucgucuaggccaacaaugggugcuaugcuguguaugcuucugcguuuguguguauaguuguguguccaaguuuguauguauauuucuguauguauacauauacuccaagacuacaaaaugaaccuuguauacuacacagaauguuuuuuuccaguuuucauuuuguuuguauugauuauaauauauaauuugaaaaauugucucauaguaaugccgccacacacacacacacacacacacacacacacacacaccugcaaccagcaacauuaccugaaguaauggucucacauugacugagucagcaguuuacugcagagccuggagacuuugugcuuguagccauaaauucacuuguaauuguuaaauacugugugucucugugagauuuuuuuauaucaauagaaguguuugguagggggcuggugagauggcucagcgguuaagagugccgacugcucuuccaaagguccugaguucaaaucccagcaaccacaugguggcucacaaccaucuguaaugagaucugaugcccucuucuggagugucugaagacagcuacaguguacuuacaaauaauaaaugaauaaauauuaaauaaaagagaaagauguuaucuaaaaaaaaagaaguguuugguagguuuuacuugguuuucugaagcuaacacucugaauacagaaucauauaguuucuucaaucauauaggaaaccagggccuuucuuagaaaaguacaggcagaugugagcuggggaauuucuuaguaccucguucaaugugggaguuaaaauuaugaauauaucuagagcagcccuaauucaaauaugaagauuguuuauuaauaauaaaaauaauugaccaugaucuucucaauucauacaaaauauacuguuacauugccucau

SEQ ID NO: 9206 - RNA, 39588 nt, Mus musculus
gaggggaagauggagcugaagguuuuggaagaaagagagggggcugagggacagaggaggacagaggaggaggaagaagaagaaaaaguggagcagacgcaccuggccuggagaaaccgcaaguucuaagggggcucgaugauguggaagaugguaguguagcaggagaucugcccguccuaagcacacagcauauauucauauuaacuaagucguguuuucauugcccggguuuauuuagguuagagauuuacugaaacaugcuuacaccugaacgccuugacaacacagauccuuaaaggcugcacuauuaacagaguguagcaauucuuuccauaaagaauuucaaaauguuugauacauucccaaggauguuaaaaacuggguaagugauuguuguaacccaugacauucugaacugugucaauuaggccauucuggccugugucauaguaugauauuguauguguguguaagcagaacuaguaauggcuaaaacuauaaggauuuacacauaauuuccaaacauuagugaagaaaaaugggaauuagaaaaucuggaagaacaaaugaagugggguggauugugucuggauaugaaguauaggugacuaggaacaggauaaagagauuacauuuguacuccuuugcuuucuucauuagauguuugaacuauguuaguuugucagucuuaaaucacugagggagugguauaagucuuuuuuuuuuuuuuuuuuuuuuuuuuuugguuuuucaagacaggguuucucuguauagcccugucuguccuggaacucacuuuguagaccacgauggccucgaacucagaaauccaccugccucugccucccgagugcugggauuaaagaccugcgccaccacgcccgggugguacaagucuuuaaucccagcacucaggagacaggagcagguggaucucugacuuuuuugucuguuguuuuuguuugguuuuucaagacaggauuucuuuguguugucuuggcugcccuggaacuagcucuguagacuaugcuggccuugagcauacagagagcugccugccucugccuucccaaaaugcugggauuaaaggugagccauuacugucugaugggaucucuugaguuuuaggccagccaggaguacauagugagauucuacaccuuccccccccccccccccccccccgccacacacacagagggcgggggaggggggggagagagagagagacugaaacaccauccucuaauuccucuguuggcacagagugcuaccagucucagguuuaugagagcaucuguauguauccacuuugacaagacuggaguccagaugggcaaucccugcugagggcucuacuuccugggacaugguauccaguuuuaugacaagauaccaagugacagggccauuguugagaagacccuauucaccuuauuuggggagacaggcacuggcaagaggcaagggcucagagcaguguuuguagaauuggaacucagucacggaugaagaucacacuaacgccuacugucaguucuucuguugugagguguccaccagagaggacuguucagacauggguuuaagccaauggaaagcucgauuagccggccauugacgacaccggauguucgggaucccaguguagcagugagccucuugcaggaugaccuuuauacacaaaaauuauguuuuggguugacacacuaaaguuagcaagaacagguagccagaagcagacguccaagagcuaaaaagcaaguacauuuacagacuuccccggagcuauggacuuugauggauucagccuuuguuuuacuuuggcaguggugcugucugugugcugaguuuuacagccuuaacggcacuucaucauagauucaggugagcuaaggucucagggccuucuaagaucuggggcucugcuacauuucuaucucgaguagcucaucacaggcgaggaagaugcuaugcugccaguaacuauucccauagccaugacauccugagcaaggaggucacugaugucauuguggagugaauuuacaagacgagcgaccagcucacaaaccuucagggcuugcuucucaguuuucugaagguuugauuggaaacacugacucugguucaucucccagcuaauggaaugucuucugauucugcaacuuggacuuuucccugaagcacucuuaauugugccuucaugggugcuuaaagggaauccacuuagaaaacgaguuucaagggcuaacuuaagaccuugccuuuuugaguuucuaaaguuaaaacauucaaaaucaauuccugaaaacccacuuuuucuuucucuugcccuuccuuuccagccucagagcccgucccacuccagcgggccagauucguggccccgcccacuggcucucauuggugccugcugcucuagcaccgcccccagcaaaggagcuccuccuccagcuggcccuagaccccgcccucuaagcguauucggacgucagcgcgucguagcggaagcccggcagcgaaugaacgcgggcggccgcggccuuagccuggucgucggcgcgugcgcgggucccgaaacccuggcggagcgcagcgcgaauggaggccugagggcggcgggggcggggcgugccgcgagcgggggccucggccgcggccggcgccgucuagaggaggcccggccguucgccaccacgcacucgggagccgggaagcgcaggcgggucacgccgugggccgcggcggcgaugcagcgacgacagcgcgcuccgcccgcgucucaaccggcccaggacggcgggcgaagcgaggacguggaggugcaguucuccgccgggcguuugggcucggccgcgccugcggggcccccggcgcgcggcaccgccgaggacgaggagcggcuggagcgcgagcacuucuggaaggucaucaacgcguuccgcuacuacggguaaggcgcgcccgcccgcccgcacgccgcagucucggggcccgccucguggcugguucgcggagcccgcggucaccugcgcgcgggcggucccguggggcugccucccaccucacccggagccgccggagcgagugugcacuuuuuguagagaacugaacggugcugccgaguggcucugaccggaugguggagggaggaagagaucccggaguugcaaaaugugcaucuugguaaggaaaaaagagagcgggcaccggagccggcuuuauguucuuguggucugcgaguaaguacggaauuccucucgugggcuaggcaugguugugggacucuucuguaggcucuccauucguaucgcagcuuccuaacuucuacauauggucuggauagguguucagauagcccaaugagaaugcccaaguacagaucuguucgcgucuucgugcacccgggguuuugggcaaggagaguuaguacauuuauauccguaagcgacacaguccacuguguucugaaccugugguuagaaccagagagaugagcgugaccucgugugcggaucaaaccaaccuaggugguacucuguugcuauuuguauuacaguuguuuauauauguaacucuuugcccaggucugacucccaucgagggcaaggacgaaccuuacuuuuauggcacuguguuuggcaaugcuguugaagcucuauuuuaaaaauaaaacauaguggcaaaagaggacacucccccaacagcccuaaucagucuugcgcggugguucuauuacuuuguuacuguuuugaauugaacaguuauuuaggaucugaugguuacagagugucagguauggcagguguguggaacccaaggccucaagcucucaaguucuaggcucacaggcaguucuugagucaaagacuucgaugaaauaauuuccuaauugaacucagaaguagaggguauuuucugauagugccacauuuuacuguugcaaaacauagauucugggaaacaccuuggcauauaguaguaggcucgguuaaacauauguaauuauauucaguuuuaauauauuuggagccugagauucuauuauuaguuauuggaugggccauuggucuaggguagaggccguuugaccuggucuugaguacugcaguauagaaaaggcugcuugcugugugcauuuucuaauugugacaugguucccugugcuuucgucucucucuacccauugaauaugagauugggggacuuuucaccaaaauuuuucuuuacuuauauaaugucucugagaaacacgccaaaucucuggaaaaaguaguguagccuauauggcaagcauuauguugcuuuccagcauuuuugauagucuggcuuugaagugucucuacugcagacacuagucacguuuaaacauaaauuaaacgaaaguuagaauugaauugcacagccucacuagcauguuuaaagugcuccaccuguugcuagugugucauauuggaguguguggacagaaguccuuucaucacaugaaagccugccagcccuguucuggacuccuagcacauuuuauagggcuuacuuuuaccacuaaauguuacagugaacugaagacuguaaagaucauagggggagaaaugccuuuuggcuccugaggggguaccaaagccauccuuuaaaagcagggugccauccaaguuucuuucuuuugccaaggauaaaguucuuaggcagugaagucuuuauagauguucaccuccauacacaugagcauaauauaagcaaaagggcuuggauggccgcucuacaaggagguuacaaaugaucagacagcuagugggcuguagcuuauaguugcgauaauaguagaguuagcuccaauucuagcauuguaagagacuaugcuuucaguucuggggaaaugcccacccgucacuaucuuuuguuaguuuguuuucuuuguugugugguucuagagugcacuuaagcacaugcuguaccacacccugcccaaacccuuuaagaguuucccagugugucuuguuucuggcagcuuuggagaccacagaucccuggggguuaaggaaugugccuccccucccucacccagcgacccaccuaucagcuguaccagcaaauacagcuucaccagccccacuccccugccgccaggauggcacuuggucucuuugaacaacaaaagcagaagcaugccuagcauuguuucuuguucuuauugaaacgcagagauuugaaaaggguaaaggaugaaguugugcccaggagaauugcuggcugggcaggggaggguugggagaccuuaggugaaggcugcaugcgucuauagcaguauuccuaggucacaccucucuagugcuuuuuagccauaauggggcuuguccaccgcggggcugagaagggucauuuggagaugauagcucucuggugucaguauuagcuguuuaggaaggggaugcauguuacugaaagucuguuugagguucagugagaagauuguagagcagccauugccuaggaacacuaggaagaaagcucuguaauaagacugagcugcucacagugagcuuuaaacacuugccacuccgcuguucgccuaacuuuacuaagcaaacuuuagaacuaaauauaaauugguuaaaaaaaaaaaaaaacuuccaaaaaucguuuuguauuuauccuuucaagcccaauaauacgacuuuugaaaauuugugcccccucuccuuuuuucuaauauaugcccucagucauuuauguguaaggaauaaaggcuauauauauuuggcucaugguguuaaaggguaggaaguugaaggcuguggagcacauuuggugaaguucuuacuaguggagaaaguccauggagucuuuuuuuuuucccuuggagucuugaggugguguaagacaucacgugguagaggacuugugccuccuuccgguuuuuuguuuuuguuuguguuuguguuuucaaggccacaaucccaccagguuagggugcugccuuucagguaccauuucacuuuuaauauuucccgaaagcccuaccuucagagaccaucauugacuuaacauuucuaccuacuuuauaccgcacaauaaggauuaagguuuuuuuuuaacauuuauuuauuauuauaucuaaguacacuguagcugucuuuaaacacaccagaagagggcaucagaucucauuacagaugguuguaagccacuaugugguuucugggauuugaacucaggaccuucagaagagcagucggugcucuuaaccacugagccaucucuccagcaccaggauuaaauuuuaaugugcauuuuuguggccucuuucaaaccauagcaaauacagauugugaaugcagaaaagugcacuacucagugcacugcaguuaggaaaugccuuaguaaauuuugguugcauaaaguagaauguuaacaaucauuuuauucuuuuuauuuauuuauuuauuuuagagagcauuuacaaaucugacaauuuacaaucugacaaaaauuguucugauaaggacaaggaauucuguuucucagacuggugguauaucuuaagucuuagcuaaaaggacauagguguggccugguguauauuccuaaccauuuccaagugcucugcaauuauguguaccacaugaguagcuguuacaugaaagcaacccaggcacagaaagaccuccuguuguuauguguggaaucuaaacagucauaagagcagaacgguaguuaaccaacagaugggaguggaagggugaagucguguggguacauguuggucagaggauccaguguuugacuaaagacccugauaagugugggacgugauggguuaacuaacuugcuuugaucaucccucuuuguacauaaaguaucacuuuaugucccguaaauacauauugccagaauuugugcauucagucaugaaugaauuugucuuaaacagcuauaagaugaguacuagaaguaguuccuuuuggaagggggauggcuauggcucuuccccugaguauuuuugcuuuucuacauuugucuguuuguauuuucccugugaauguguuaauauggaagaaguagguaugccugcuaucuuucucaguacuauauuagacucuuugccacucugauaaccccaauguaaacagcucagggagggcaaauguauuuugauucacaguuuccaagguuuuaggcugcugggagggaagaugacugagcagagcaacugaucugguggccagcaagcugaaagagaguaaggcucuggacaagguacccagaagugugucaucaucaucuacccccaccccuugcccccaagccccaugacccaucaccuccaguuaccuccuagaguuucuagagccucccuagaagguaccaccagcuaggaaucaagccuuuaguacauggauuuuuauuuuuauuuuuauuuuauuuauuuauuuauuuuuauuuuuuugauuuuucgagacaguguaucucuguaucguucuggcuguccuggaacucacucuguagaccaggcuggccucgaacucagaaauccacucgccucugccuccugagugcuggaauuaaaggcgugccucaccacgcccggccuuuauuuuauuuguuaaggaaaagaacuucauaucuaaaauaaacuguaacaaguacugacuauauuuacuaaguuuuccuauccagugaagguugauggcaugaacagaggacugacugucuugugggcuuuguggagauuuguuccagccaaucucuguuauguacauacuugacauuuauuaaauuucagcaaauacuuccaugaccguucuaucauuauuuuuaccuuguuuuaucaagacacguugggguguaaaagagaccacauaguaaaauaacaaguuagauuacaguauuucugacuugagagcaguccuaguaucucaaguguaaaaaggcagugucaguaaaacuccugccuagguguccucuuccaucacccucggggccucccucccaugugcuacacgugccuuuagaaacaggacuguggccgguauggauagcaagagcuuccgugcuuccuuacucuucagaauguuacauuuucaucuuaaagaaguacuugaauuauuuguguauagagaauguaaagaaugaugcagugaauuccugugagcccuccacccaguuuccauagucugugcacacgcccacauacacaacacauccugcuauacaugcaugcucacacacacaccacauauugcuauacacacacacacacacacacacacacacacacacacacacacacagagucucauccuuuuuccccagagaggguguuccuuuccaugcacauuggcuuggcuccugaacaauguguuguuugauguuauauaaaaugaaguuauguaucauguguacuuuaauagugcuauuuuaaacaaauauuugugcuccugauuuuaucuuuuagaguuguagccgugcuuuguuuauuucucugcauuccccaguaugauuucuucaucaugaccacugauaauaggcuuucuguuguucgugggguuuuguguuuauuugacagugcuguggugaaggcagcuuguguuucuugaguauguuuaagaguauaauuccuagaucauaggguugaucaacauuaagcuuuacuaaggaugcuguuauuuugcaaagugguuauagucauuucuggauucaccauugguauguaaauguucuaauuuuucuauaauucucaaauguuugaccuaguuggauuuauagguuuuugucaauuugguugauauaaaaugacauuuaccuuuuaaaaaugaggcuuuccucuuuacuucauaaauaagcaauccucaacguaaccauuagaaaaccuuuggaaugcaaauugugacgauuacauuugaaacccuaaagaauuuuaauuuuucauuuguuuaauauuacuuuuguaguauauaauuuauaguuuucaaaauucaacuaggcuagccuuuaguuagcuuccaaacauacucuauauucuacauuuuuacuguuuugauucuggggauuaaaucuaggccauuuuaacuuuuaccgcagcauguuacugcuugaugauguagcuacgcuaucauccaguuuugcacaaaauguuuaauuugaaaauugaaauuagaaaaauaauuauaaauuaaacuuugauguguccucuuauuauugcacaugucuuccuauucauuauaagccauuuuguuguugucgguuccucugagaaguauuccucaugaaguaaaagcauagcagacguuccuucaaacgucaaaggguggggccuaagggugguguccagcaggacuucggaauaacaguuaugcaagcugacagucuuaaaaugagcuuggccucugaugagagaauucauuugccaauuaaaauaaaacaccuuuucuguuuuagcaccagcaugcaugaacgagugaacagaacagaaagacaguuucggucccuuccagagaaccagcagaaacugcuuccucaguuuccucuucacuuggacaagauccggaaaugcauugaccauaaucaggaaauacugcugaccauugugaaugauugcauacauauguucgaaaauaaagaauauggagaagauguaugugacauuguuucuaucucuuuuaaucuuaggguuauggucugucuguccagcucuugugcaugucaugcacucuacugagagagugggugugcuggggagcugggugaacaccaugcuagagaucgcaucuguucaaggcuuugucuuuguucucauacguagaugauugauaauacuuucacgugguguuuuagauguacuacuauuauauacgggacuuaaauuccuuaaaagacuuuacuagcuagcucuauuaguuaauuucccugguuucuucaguaucuuuauuuguugauauucaucuugccuuuaaauuuauuuccaucacuuaaaucuaaagugauuagagacugccauauccagggauccaucccauaaucagccuccaaacgcugacaccauugcauacacuagcaagauuuugcugaaaggacccagauauagcugucucuuguuaggcuaugccggggccuagcaaacacagaaguggaugaucacagucagcuacuggaugggucacacggcccccaauggaggagcuagagaaaauacccaaggagcuaaagagaucugcaacccuauagguggaacaacauuaugaacuaaccaguaccccggagcucuugacucuagcugcauaugcaucaaaagauggccuagucggccaucacuggaaagaggcccacuggacuugcaaacuuuauaugcuccaguacaggggaacaccagggccaaaaagugggaauggguagguagggggguggggggggaggguaugggagacuuuugggauagcauuggaaugaguuggaaauaccuaauuuaaaaaaaaaaaaagaugauuaaaaaaaaaaaucuaaagugacgagcaguaacugucggcucugugcauccagauagacucuggccaggccgacgugagcccgucacugaacucgucacugaacucgacgacgggcuuucuuaccucuguuggagggugggguguaugucuccaugguagcucagugugggucccugcuccaguaaggacuguugaggguagaaaugagagcaccaaccuuuagucacauaggaucccaagcuguacuugagccccucccuaggugagaggcuaauauuaucaucgacacaccugcaucuuagcaugcucauuuaaccauauucaaaauugacucuaagaaaauaauucuuuuucccccccuuuuaaacaggccaauggaaagauuaugccagcaucuacauuugacauggauaaguuaaaaucuacacugaaacaguuuguaagagacuggagugagaccgggaaagcagaaagggacgccugcuauaagccaaucauuaaagagauuaucaaaaauuuuccaaaggagagaugguaaauauuaccacauuuuuacccacuuucuguaagguugaaucauuuagcuccagcauuuccaccuuaugauucacguucauaguugcucggugccuguguguucucacguaugugagugguauauuuguuacuggaugcuucaguugugugccauugacguuuuuauguuugguaacauuugcccuaguaaauacuagagauuugaaacguuagaguaaauauuuauagucaacaauacucacugcauuauaaguuguuuuuagaacacaaugauagugauagauuuuauuuuaucucaugaugacauacgcaaaagaauugaggcauccauccauaccacagagaagugacuaacuuuugaacacagaaccuuuggggauucugaagcuccaccucugcuuuucagacucacguuuguaaaugaauaagugaaaugcauaggacuacaaagaaccauuuguuuuaaaagcaaauuugcggagggcuggguggugcuuguuauaauacaugagggccuguguuuggauccccagcaucuguuuaaaaagccaggcucuuuguagccccagagccaggggauuccauucucucucagaaaauaagguggcaaaccacugaguaagacauucaacaaacgcauaaacaaaaauaauaaaguaaaauaaaauuauauuuuaauuaaagcaaauacauacuuuuuuuacaauguauugauuaaauauagccugguaguggguauaagugcuaucuuauaugaaaaugcugaauacuuuguacauuauuuugauaaaaguguaauuccaauugaggauaacaucacauaauaaaccuacuaauauucauugccugcauuuuuggaauugaggacaagcauaauuaaagauuauugcugcuagaaucuguuugaaaguagaaagaagguucaguagugagacuauguucuuacugcucuugcaaggacccaaguuccguuucuagcugaacauuauuaagcucacaguuacuuguaagguuccagcucaagggcgcccagugaccucucuggcagcugugggcaucuacacucacacgugcacauagacacacauagacacaugaaaaucgucuauacuuacaauuuaaaguagaccuuuuuaaauaauaaaauugaguguuuccccauucucaaaagcucagugaauuuugucucagacccugggauccauagucccguguguucagaacuccugaguuuggguguauccuucgaggacugucaggaucuucgucucuuuuucucucuuuugaacuuuaauuuugaaguaacuuaacaauuaugguucuuuaucaacacucaucacguuuuggcauuuuagaacaccacugucuaucauccccaccuucuccguccucccucuuucagcauguggauguguaaaaccacauauucagaauuauuguaaaggcauuugagagucauguaguauuugucaugguuucugacugcguaauacuucacagcuuuagauuucagggucucacuguguagccauggguggccuggaacucacuguguggaccaggcugaccugagcacagagauccaucugccucugccucuaccuccugagucuggauuugagguguucuccaccacgcaggcgcagagucuguucuugagaauggaucuguucacuuucugucgcagauccagaaaguugacccugagcacaguucuggaaccugauagucuaucaguuugggcugagacgccugggagguguggucuucguagccuucacuguucucaggcugcucucuaauaaaggggcccuucuuucauuuucuccauagagauguauuucaaggacuuagaguuccuauuucauucagugaauuaaaaucuuaaauuacuauuguuuuaauucuguuguuuaaauucuucuauccuuggggauuucuuuuuuuuuuuuuuuuuuuuuuuuuuuuuuugcugaaaaaucuaagauauuugagacugguguuguagauccugugaggcuugguuauuucucuaagcauuugguugcuuguaaugugggaugcaacguaggaccccaaauaagccacacacucauccucagugcuggccccuaccugccuuguacacagggucuaucucugcuguuaggugcugaacuucaugguuuuccgaggcaaggucucacuguagcucacaaguucaugcuggccuugaacuuaaaauccuccugccagagugcuaggaccauaggcacgugcugccacaccucagcucauuucagugauuuguuuaaguccuuccgaaguaaucccgacauuuguguuguuuuaggauuuuuuuuuaaacuucuuuauuuucuugaguuuuugcauuaauaguuuuguuuugguucagcauuuuaugcaacaacaauaaaaaaccaacaaaucgugaagaugagagugaguaaauaaguuaaucaaaaauaaauauauuuugcuuuuucugucagacacuaguauagagggcugaguaaauaauuuguuuuucauuucugaaauacuuauaaguauuuauugcuucagacaaucucuuaagaaacuuuucuauaaaccuugcaucaagaaauguaagaaugugggaauauugguuuuuuuucuagaaaaugaacugaauuauaaacuuuuguuuacuuuacauuuuaccuucuauuucauauacagugacuucagcauuuuccugagacagauuaguaggaaaaauuuugcaacagugaguaguuacugaucucuugcuuaaaauaauuacuucuucaauagcaaaucaacuucuguggacauaggacaucagcaaaagcuaggagcaagauucuuuuguugccaagucagguuuuuuuguuuguuuguuuguuuguuuuguuuuuuuuaaugaaaaaagugaauauuuagauuuacccgucuggacugaguuuagcuggucccaaucuuguuggcuacauccagagcaucauuaucaggagccaagugaacaugcgcccucuucugucagucaggccuuaucagggccugacuuugcccacauuagucucuuaguuucuucacggccuguuugaucuggugcguguuggccuugacauccucugcagugaacacaagcauuuguucucugucuucuucauggcagauucacuggucagggggaauuugaugauggcauaguggucaagcuuguuucucugggcacacucuuuugaggguauuugggcugccuccagaacugccaggucuugggccaccugaaggggggugacuugugggagucccuuuguggcuguggacaccuuucagcauuagcuuucaaggacuucacuuuggccucugcuuugggaguggugggagcuuucuuugcuuuuggcuccaugauggcggaaaagcagaguaaacuuuuaacauauacuacuugacuaacugugugugagugugugugugugugagugugugugugugugagugugugugugugugagugugugugugugagugugaguguguuuguguguguguguuuuaauuaucuaagcugucacuguuuuuuuucauucaaaguaucaucuguucuuuuauuuuuuugaguuagcauacaacauaauggguuucauuauggcauucauauaugucaaacauggcucuuguuuaucuacuucuccgcugagccacggaguuuauuucucaggaaaauaaauaccguaaaagucaugacauauaugcuuaugacuuuuggacauuuugagcuauacuuucugaauaggaucuaccuuucuuauagaugauuuuuggagguauuucccauauguuagaucauaucaugcaaaaaguuuuaauuucuuccuuuccaacaugaaugccuuuauuccuuauuuuuauucuuaggggaaagcuuuuucuuuucaccccugaguauaauguuaacugugggguucucucucucucucucucucucucucucucugucucucucuuucucugugucugucugucugucugucucucucuuuuaaagauuucacuuauuuauuuuauauauaugaugaguacacuguauacacugcagcugucuucagacacaccagaaaagggcauuggaucccauuacagaugguugugagccaccaugugguugcuggggauugaacucaggacgucuggaagagcagucugugcucuuaaccgaugagucaucucuccagcccccugugggguuuucuuaaugccccuuuucuuguuggauauuuuuccaccuuucuuugaaaggauguuggauauuguuaaauaccuuuugauucuauugggauaaacuuguugaggucuucuuccacccugucuuauuaaaaucucauuuucauguguuaaaucaaaucacccuugccuucuuaggagaggucacauuuggcuaugguaaauaauuuucuaagaacauuguuggguuagauuugcuaaugucuuguuugggauuucuauacucauucauuguaagggaucguggccuaugguuuucauuugcuaagacuaagccuugccuuuuacccauugagaggacaacaaauuguuuuuuauucuucucuggaagauaagcaguaaucuucauuaagaaugauuuugaagacuuugaaucagaauaguacagauugccauucuuaaaggcugcuuguguucagccagcagugcuacuacaaguaaucuguguaccuguuacacuggccuuaccauugagcuacacucuugccucuaagauuuuuaacagugacacuuaaagaaggauuccauaacuguuagaguaaugagcuaauuucuuguauuaacuuuuuauaguuuuauaauugcuuuaaguuuuaugaacaucauuacuucuauggggauauuauuuguuuuuaaguuucuaguuuuuagucucggaaagucaucaaugcuuugcgcaauaaagugcuggcuaauggcuucuuuaaguucuaaguuauuccugaaaauucauaguaucuuccuuucugaaaguagcuuguaaagucaugcuuuuuauacuuugagugucccaaaguuugaaugaauuucagaugcuuaagucaauaugacuucugauguuuaucauuuuuauuuauacuuaaaauuacugaauaauauaugcaguugugucuggucagccucucaguacuagcugucuaguaaaaagcaugucauugcuaaagguacugaggagacuuguauacucgauguuuuacaguuuacuuuucagcuguacaggguguaacaucugguaagcaggaauuaguuuuagguggugcuaguaaauagaacuggaaauguaaaugaagaaaauaccaaaaaaaaaaaaguaaaagaauaauuaaagguauuuuuucaguagguaaagaugucagaguuugggcuggagagauggcucaacgguuaagagcacugacugcucuucugaagguccugaguucaaaucccagcaaccacaugguggcucacaacuauccuuaaugacaucugacgcccucuccuggugugucugaagacagcuacaguguacuuacauauaaaauaacuaauaaauaaaucuuuuaaaaaaaaagaugucagaguuuaggauuaagaaggacaugagucuucugacacggcuauccaucuaccccuccccauccccgaaacagcgaguguuacagcugugacacagauauauguccacauacaaauucauaaacuuuaaaugagauauacugggggaaaauguuuaaucccucagucuuggaccugaugggagaguuucauauucuauaucauuucauuuuguuuuacuuggauuaguuucuuuguacuagauaagcaagguaaacuuuaaguccacauaaacaguuaauguugaagcuuuuccauaaaacauaauccccagaagcagguguagguguggugucuccugugccugugccacaugucugaggcaggaugcuugggaauuugaggccagccuguguuggacagcgaaaccuugucucagagaaagagaagggccuggaugaggcacguuagaauucugccccucagaauccaaguucuggauaaagcauugucauuugggucucagaucauuccacagcaggcauagaacaugauguccuuacguacacuugagcuggacuuaacucaguuucaacugccuuuccuuacugagauuucagugaauggacauccugauaugucuguuaaaccuagcauagucaaugaauaugcauagaacuaccuguucuugcucaauuaaaauguuuuauguaaacacauuuauuuucccuguuuguccauguuugggacuaaugugauugagauugggaauaauuuugaagguacagauuggccucugcauucuugauaaggaaaugcuuuccacaguuuaccaaugcuagaucauugugucuguuuugguuuuacauaaagguauauucuaugcugcuguuuugaaccguugaaugaugaaguuagcaagcaguacucuucguuuuuguuuuauuuucacuuaaaauaaaagguuagcugaaugcaguggcucuuauaucagcaauccuagcauucaggagaaagaggcaggaggugcgaaacaagcccaagauuaguguucauuuuaggccauccagugcuaacuaaguauggagaccuugucucaagcaaaaaauaaaugugagcucaagaccuaaccuguuuuuuucaaauacgaacacaggaauaguguaaugcuaaacauuugauagaauaguauauaucgaaauuuucacccagacaaacaguaaagaaaaccaaccgugcaaauguucagcuuccucaagugucugcugguucaugcuggcuguaaagugcaugcaugagaaggaaagaaacauuugagccagccuuaaaggcugggauuuuuuuuuuuaauuauaaaaacuauuaacugauuugcuauuuuuuguuuguuuuuaaaucuuaauucauuagccuaucugaagaccauuugggguauuuuguuuaugacuaugucaguauuuacuguacuccaagaagacauugacugacuggcuuguugaaaauuuaucuuucacauaguuuuuaggaaaaagaacugaguuaaaaaaaaacuuguuuucuauuuuauauuaaaauagaggcauuaacuauauuuauaaagggauuuguuagcuuaaaggaaucuauuuuaaaagagaaaauagugaaaauuuuacaaugucguaugcaauuguauagaaugaagaacauuuuuucucauucuuucuugacugaaaacauguuuuaagcuucuuccaaaucaguauuuuaaauguucauaauucuagaauaacaccucagugauaaaacuaagauuaacaauucaagaaaaaauggcauaaauggacauaaauuggcaaaaaaggaauauaagacaaucucacaagaaaauucaaauguaaaaacuauguuaagccaguuuuacaucauguuuugcaaaaauugaaaauuaagaaacaguaaggcuguggagaaacaugucuccugugaaagaaaaaaacaggagaauuuuuauaaagacuaguuuggugguguuugcuaaaaucuuucuuagaguucaacauugcugcguuggauuuacagaugcacuucuguguauagaaauuauucuaauauuacaaugccaaaauauuauagguaauguagaugucuguaguugggacuuuuuuguuuucgagacaggguuucauauagcccaggcugcuuuacaccugcuguguugcuaaugaugaccuugaacuucgcgcucuucugcuucuguacccagaguauuggggguuacacagagaccacugugccuaguuuucugcagugccagggcuuccucuaugcuagagaagcacuagacuaauagagcugcaucucuguccugguguaauguuuuaaugacuuccuauguaacuuaugguuagagggauagauagauauccaagagguuauccuguucagaguucauugacauguacgggcuaucaauauaauguucucauguaguuuaaaugcuuugauagcuacaaagaaaaguaaaauaggaugaauuugauuaacuagaauuucaauuuguaucacuaugaaagauuacugagauuuuuuucauucaucuuaugccaaguuuuugagguccagcuuaucuuacacuuagagcauauaucacuuuauauacuuuaaaucauaugaauuuugugcugucugcuauauuggacagaauagcugugauuccgagaacuacuuuugcugcuuaaaaguugcagauggcuggauagguaagggugcuugcugcguagccugaugacccaagcuguuuguucuucugagacugacauuguagaaagagugagccagugcauccaaguugaccuuugaccucuacaugcauguugugguacaugagagaacacacacacacacacagguuggggggaguugcauauaauccuaccacuaggggucagccaagugucaccgugcugauaccacaaaacaaaguauauuauauuggaguuugcuaauuuguaaaacaaagauacaguuaagccugcaaauacauuuacuguugguaaaauggccuagucugguuuuaaaacuuuaaaaucacauauuuaaaguuuguuucucgucauuuuaacaagaaauguuuaagacuucuaaaggauucauagcggcauguguaucuuugggggaaaaucuacuuaagauuacacauuuaggaaagcauucuugccaucccacucauucuuuguuugguuuuuuugaucagucguuuuauucuaagcauauucuaacuuuguuuuaaaacccauuggaaacacccuuuugucauaauacaaauaguuugaugaucugcaguagucugcucacuucugagguagggguuuguguucuguauuuuuugucuugguggcuuuuaauagcagucuuacacacuucaggugcuaguguaccucugggcacagaguggaggcagacgguucaagguucugguuagggaaauguugaugaaagaaaugauaggcuaaucuucuauaaguuaguuacuaagucguucuuguugguuuuauuuuguuacuuuaaugacaaauguucucacucuguagcccuggcuggccuggaucucacuauguagauaaggauggucuugaauucauaacaaucugcuugccucugucucuggagugcugggauuaaagguguggccauuccuggcagguguauuaauucaaacauauguuccauaaaugauuuauaaaaaaacacuuuacuaggugagccauuucccuggccguucucucucucucucucucucucucucucucucuuucucucucuuucucucucucucucucugucuuucuuucuuucuuucuuucuuuucuuucucuuucuuucuuucuuucuuucuuucuuuucuuucucucucucucucucucucucucucucucucuuucuuucuuucuuucuuucuuucuuucuuucuuucuuuguagaguaugcaaagauuauccuguagaauauacugcuaguaaaaauguccuguugcgcucugagagugaaggccuuggggaacagguagcuugugagauuugaauaguuugaaauugaauugguuuugugaaccaaauuuugaaaaugugaucauuaaauucccucuuuauagacaugacacuaacugauuacauacauuuucuuuuugguuccuauacaaauguugucuccucauuuuuuuaaaguaaaguuacuuuuaauuaccugugugugugugcauguguguaccaauacaugcaugucgauguacauucuaaggucagagggcagccugaaaggguagguucucuugcacucugugggucccagugagcucggccugucagucuuagucagaaccgccucuacccgcugaacuguuuugcuaacucugaaacggguuggccaggguuccugaggacagguccucaccgccuacagccuuuuccuccuaaagcugauugcacuucuauugaaggaauggcagagcucagagagaaggagaccuagaaugaauggcgauguggcgaggugauggaaccucugcuguggugcagucuguugucuuaaaugcucccagaaguguuugcaaggggagcuguggcagcaaggucacgaguuugaggcuagucaggauacuuacugacacccuuccaagaaggcauugcucauuuucuccaagagcauucacccccgucugaccuuuucucucuuccuuuuggaagagagguaggggcagcggacacagaguccuaugugaucucccaagcuacucugcaguuugcuauguagaccaggcuagucucaaacucauugcaguccugcaagucuccaaauucugggauaacaggucugagcuccugugcccaguaccccugcccuuuccuuuuuauaacugagagcuauacaauuuuagagauauacuuuagacauuaaacucucaauggaguuaauuuacuuguuucuguaauccguguuguaugaacuuagaaguaagguuuuauucucugccacauggugaaauaauucaaaagucccacagauaaugagggaucacuuugggcuaauuuaucuucccagaaauaagaaugacuauacaucuuuagauacaauguaauucuauuuuuuuguuccugaaaaguauuuuugggggaaugaaacccuuacuugauaauauuacaauucugucuaucuuuuauuuuuauugacauuuaguaaaacuugaguuuuaagaagucaggaguccaaguacgcuuauuuuauugaauaauuaaauaaauuuuuaguuguuaauauggauuuugucuuuuuuuucuuucuuguuuuccucuuugaggggcuggauauaauugccuuguuucauuucagggauccuucuaaaguaaauauucugguaccuggugcuggacuaggaagauuggccugggaaguagcuaugcuagguuaugcuugucaaggaaaugaauggaguuuuuuuaugcucuuuucuuccaacuuuguacucaacagguauuuaauuuacuuuuugauggaaauaguaauuucuuaaaaucaaauugccuugccuauuuuugaacaauucugaauuagaagaaaaauauauaguacuugcuugcuguagaucauauuuacauuaaauucauaaugcuuauaccgauggccacuguaaucaguguuaauuuaauuaguuguuuaacaguguugacacagggcaagcaaacaacucuuuagaaaguaauugggcauuccaugaagcuaaaauaauuucucuaagcuuuuucacuuuuuguuucuuggugagguaagaguuuauuuuagcaauuguaacuauuuucucugacgacuuccuauaaguggccauaccuguucacaugacaguggauugaggauccgagaauuucuguguccucuaccagaagguaguagaaaagaguuauuauuuuuaagucagaagaugcaguguauuugagacaaagaacuagcugccuguuucaauagcacguuacugguaacuuaguacaaugcuguguuauuggugacaauguacaguuuagguugcuggugagcuggggaaggaggguuauuauguaaaauaguagaaauggguagaauagcaagacuagugugcuuguuauauucaccuuugagguucaggaauacauuuuugcugggugugguggcacaggccucuaaucucagcucuugggagaggacaacaggaggauuaagaauucagugccauccucagugacacaguggguuugaggccagccuggcuaccuaagacccugucuaaggaaacaagaacauuguaguaauuuuuaaaaauuugaaugaauaguacaugaaagaaucucugaauuucuuuuaauccaugguuggucaucuaccuguauacacagugucagauaacuuaguacaguguaguguuggcacucuucaagucuaaugauuuaccucaauuaauagaugauacuuuugugcuuaaaguagguuuuuuuccccccuagguaaaauguguggcuaacauugaaccauaugcucauauuuuacagauguucugaaauuaacaaauauaaacuuuaucccuggauccaucaguuuagcaauaaucggagaucagcugaucagauccgacccauucuuuucccugauguugacccccacagucuuccuccugguucuaacuuuuccaugacagcaggagacuuucaggagauuuacucagaaugcaguaaguucaaagcaaguauuuaaaaguucuuaacaguuauucuagaaaugaucuaguguuguaaccauuuaucuugauggcggaauauaagaugugcaauguuagugacaauguaaaguauuuucagggugguguaaagacaaugacaguaaguguaaagaaauuuauguauauucaggagauguugacuguuaacaaaagacaacuuaggagcacaaauuaugcugaaugcacuaagaugaaaauaagcgagugugggcuggagcucuguaaagaggcugugacuggacagacagaugaauaguacuugagguacugugaugcaaagaauaagaucacuggggaccgcagcaggccuagucugacaagaaaagaaacuuuauggaagcauggcuugagaguuagguuagcuucaguuguagaagacuuguaucggauuggaaguuacauuuuagccugaagaccauuggagggaugcaggaaugggaagaaugaauuggcaguaauaggaaaaggaaacagaguugugaguggcagcaagagcauccuuucaacauauaucuguuugucaccucuuaaaugccaaguguauuaaagcacaacagauagcaaaacgaagucccuagccaagucuggaagggacagagaggccauaacauacaauauuguuugggaaaaaaaauaauguggagaaguaaguguaagaauagaaacaagaaugaacuugccacuuauguguuuagagauagcagggguuagccccuguguucagcagggcuguggugaagugaguagcaggaggagggagauaagaggguugcuuaagacaacucgaagcaaggaguuugaauuguaugagagggacaggaagccacgggaaagauggcauagagcaggaguagcaacagagaaagauuuuguauaucuaguuuccuaaaaaaaaaaacuuuauuuccccuaaauucugagauuggaucacauucauucugaaguuaaaaagggacaacugggaggaguuaaccuuuugcguauauguugaggaaucagaucucaaauaggagugaacuuggugaaaagcuucacacugcaacugagagucacuguccucuccugggacgggaagaggguuguuuuaguuaggguuucacugcugugaacagacaccguggccaaggcaacucuuagacacgauuuaauuggagcugccuuacaauacagguucagagguuuaguccacuaucguuaaggcauuggcagcauccaggcagaaauggggauggaggggcugagagucccaccucuuuuuccaaaggcagcuagagaagacuaggaugagaguacugaaucccacacccacagugacacaccuauuccaauaaggucacaccucuuaauagugcuacucccugggccaggcauauacaaaccaucacaaagguacaggugaucucuguugggccagccacuuuuacuacccugccuggcaacagcuucccaccucagccuauggcuuccccagacaacuucccccugaugauuaucaagucauuguaaauauuuggguauuuguugucauuuauuuuuccaauuggcaagaaaagcuuucucuuaaaaccagccagaauuaguguuuaacuccauuuagaucagaacucaaaaaauuaagaugacaauuauuuuguuuuagcagauucgaacugaagcuaggguagcccagucacagugcacuuccuagcucaagacccuaagguucagucacaagcaucacaaaaguaaacuugggaaaacuaaagccuagcagcggaguugacaaugaacaacucuuuuaacagugucauuugcuaauauauaguaauguuucaauaacgaaugauuuccaaauugauuacuauauauauuuuuccuacaaucauuuugaguauauaguguuaauuauaucuauuccuucaauuaaaugaaacauuaauaugcuauaagaguuaauuggcaaacuuaaaagguaaaaagaaaaaaacaaaauaacagaugcaguggucugauuucuguugauuagaugccugggacuguauugccaccugcuucuucauagacacagcucacaauguaauugauuauauugauacaauauggagaauacucaagccagguggaaucuggauaaaucuugguaagugcuuguauauucauuaacauuuuauauaucagucugaguauuuagagcugucuuuccauacuugagaacauuguaauguuguuguauuaucuguuagaccauuuccuaguggguguuaccuccugaaagcagugggaguccaagcauuagggccauucucguaugucagucuccugggacuuaacuucagaggauacuaaguuugaucugcugauuuaauacuuaguccuuugucuucccucccuccauguaggcagugguaguucauucuguuaagagacugaaaugacaagcaggggccuguguggaucugcauguauauguuuuggcugucagccugguguccuggggagacuccuaacaguggagggagguguagcucugauucuuuugccugcucuugagaaucuuuuccucuucuuggguggccuuguccagccuugaugcugagagcuuugccgugucuuaguguaucauguuuauccugucuggcugucaucucuuggagaccugaucuuuuuugaagaggaaauguggggagaaggaaggugagggggugaagauaggaggaauggagaaaggggaaacuguuuuugggauguauuguauaagagaagaaucuguuuucaacuuuuaaaaaguucacaaaauguaaaacacaaaaacagagaagagaauguuuuuauucuuuuuaauccuuggaggaaggagaggauuuuaccucgaucauagaauuuucuucuccaguagaugagauauaauuuuuuuuguuuuuguuuuuguuuuuuugugggggggaugaaauaggguuucucuguguagcccuggcuguccuggaacucacucuguagaccaggcuggccuugaacucagaaauccaccugccucugccuccuaagugcugggauuaaaggcguguggcaccacugcccagccgagaaagauuuucuaacuaccaugaguuuaagaagcaauagaaauauaauuucauguaugcaaaauaacuuguacuuugagccuacuacuugauacuagaaaucaaauuaugauugugacuuguaucuucaucaaucuaaaagaaauugccuguuuuuuccucuuaaagguaaaagaaguaugguaaaauguguguuuaauaugcacauaacauaaauauacauaaaagugugaauaucuuccuuaaaugugauguaugcccuauguucagaaaguuaaccaaguuagaauauaagacuuucaugaugaguguuuuguuuuaguuaggguuuugcugcugugaacagacaccaugaccaaggcaacgcuuauaaggacaacauuuacuuguggcuggcuuacagggucaguccauuaucgucaaggugggagcauggcaccauucaggcaggcauggugcaggaggugcugagaauucuacaucuucaucugaacgcugcuaggagaagacuugcuuccaggcagcuaggauauggguuuuaaagccaagcccagagugguacaccuacuccacacaagaccacaucuacuccaacuaggucacaccgucaaauagugccacucccugggcuaggcauacucaaaccccacaguguucuaccacagaaaaggacagauacauaaaauaccugcuuuauuguugagguucugucaacuguacuguguaaugauuuuauuuuuacuacaaccuuuugucaucaggaccaggauuugaaauaguaagucuucccauguugucuuuagaguucuguaggaauagaugagaacaacuguaaaauacagucaucauuagauccaaauaccuuaaaucuuagagcuuuaaaaguaaaugccuugggaaacuuagaccaaggaaugauugaaggauacuucugagaaucuauuuguuuacugugacuuaaguaccuuuauaaauacuuuaaauucauugcaaccuuaucuuguguuccguuuugugguucuagaguucagaguaggaccuggugcaccuagacaagugcucuuaucacugagcuacauccucagccucucagagcagcucuaaugggaaggcacuauuuaaauaguagaaggaaaugagucuuggcuuaaauaacuagcagaaugauccuguagcuuacuuaaggcaagaggcagacucacagccugaaacugucaggcuaugacauuguguuuagccuuaauaugacccuauuauauguuuacauaacugaagauuuggauccuacuugaguuaugauaagauuugcugucuuucuaagguauuugguuuaacucguauaaaaacugaacacuuaacauguauaacaaaugccugaaacagugcuggcccccuuauaagcaggagagcugcuagcuaaaaguaguugugcuaugucuaauaugucauaaccaacacaagucauggagcagguagcuuacaagaugacagaucuucuagucauauagccacaggguuucaaaauaauuugaggaauuagaauaauggaaaaacucacauuaguuaauacuugacaaauagaauauuuuguauauauaaguuaaaaauacuaaaagucauaaucagagcuggaaaaauggcucaggaguucagcuguucuuagaggacuagaguucauuucccagcacccacaucaggugacucaaccaccuguaacccccgguccagguaccucuagccuccacagaugccagcacacaugcucaaauacucacacauguacaccuacuuagaaaaaaaaucuuuaaaaauaauagaagaaucuaguuuuccuuaaacauugcuguauucuggaugucaccacugcucuauuuucuguaccaugugcuggguucuuuacuccguuccuucuguccaguugcaugguuuccccuacugcuuuaaauucuccaucaguaugucugaacuaaauacugcuuugugugccaagacaguuuucucuuacauagauuuaaaacaacaacaacaacagagucucaucaugauucugcugccucucugagaccuuucuauucugugaucugcucagacuaccucaacuaacacuaggaaaccaucuuuguguuguuguuaauuaggccaaacuacuaaaacauugccuaauagaucugauaaaaaaguuuauucuggaggguggagagauggcucagugguuaagagcacugacagcucuucugaagguccugaguucaaaucccagcaaccacaugguggcuuacaaccauccauaaugacaucugaugccuucuggugugucuaaagacagcuacaguguauuuacauaaaauaauaaaucuuuuuuuuucauaaguuuauuuuguccuagaucuagagauaagguuccagggauaauguguuagcugaguugaccuuggagaaggcgcucuucuuuuguagccacagguuguacauaguuauuguccuuguaaaggucacuauugcuaugaugaaacaccaugcccaaagcaaauaggggaagaaaggguuuauuugguuuuacauuuccacauugcucuucaucauuagaagaagucaggacagaaacucaaacaggacaggaaccuggagacaggagcugacauagaagcuaaggagugcugcuuaaugcuuguccuuucugaguugcucagccagcuuucuuauagaauaggaccaccagccuugggguguccuacccacaaugcacuggcccucccccaacgaucacuaauuaagaaaaugcccuucagcauugguuccuuuaauucaguuccuccuguuguggugacccccaaccauaaaauuauuuucgcugcuacuucauaacugcaauuuuacaguugagcaguaucuugguaccuaagaccauuggaaauaaaccuguuuucugaugauugagacccauagguugaggacugcuaccauaccaggcugcguauagcuggaucuuaugggggcauuuucucagaugaagcuuccuaguagcucuggugacuauaacuucuggaaaacugaugcaaaaugaguuagcacagcugcuuucuugaugcugcguauuuaccugacuuuuugguaaggcugugggacuggaaggagggagcaagaagacaaacauucuacuagguguuuuuaggaggacacuaauuauguuagauccugacucccuuuuaugugcucauuaaccauaauuguuuccuauucccugauagacccuaccuucaaaugcagcugaacuaaggcugccacaugccaacuggaaaggggaggcaugggucuagacauucaguccgucucguccucccucuucaccaucugcagaguugaucugaaagcuagauucguaaaguuccuuaguuaguaccuucuaacucuuucuaugccagaguuucucagcuguggcccuacugucauuuggggagggucauuguucagggaugguagcaaaggucuuuauccaucacuaagguuguuaaggauauccuuagcuuuuugccuaccagauucagcaguaucccuccagugugcuaagcaaaaugauuccuuagcaagaccgaacuguucccaguugagagccauugcuggagcuugaguugguuuccugaaguaagagugauucaguuguucucugggguggcuaacucuccgugucccuuucauuuuccuuuuuuuccccucucagauaggguuaccuuuugaacauacagaucugugucuaucagucuccuuacauaacauuauagcuuucuuaauaagugcucuccaggauuaugucuagagccuuucgugaucuugcuucuuauggcucugcauucuccccuguugcuaccccccccaccuuccuuuucuucaucucugaguuuuaugacaauaagacucuaaugcauccuagucacuuaguauggauccuggcaaguacugggcuucacugacuguuugugguaaguguauugaagaauugaaagaaggaacaaaguaauauucauguguuaaacagggagauuggcugcuuagagacaugguaaauuggcauuuauacugguaaauauauguucccauggcuuugaugucagccauguggaacuugaggcuuaguuuucuuuguacacugagagagguuauuaacccccuaccuuugaaaguggguuuuacuauaugauuauagagacuagaaucaguauuuucauauguaagaauugcaacugacagcaaucuucgaauucugagauugaagcagaauuagugaccuccuccucagauugaaucaagucagaguuguaaggauacuuacagaacccuuaaaggaaaaguugacacauuaacccuccucagguuagggaaagccaguaagcugguacuguaacuguuaugucuauaguaaauguagccuuuaucaguuuugcuugcccuaucagcugucaaugcuuuguacauucaggagaagaaaauacaagugauuuggaguauacguggcccauaaaacauaaaauacuugcuaauauuauacauuuguuaaauuauauuuucugucagaggaaaauaauuagauaagggcuaauacuaaaagucagugaacaggcaugcccaacaaggcuuagacuggaccugcaucccaacagcaggaaguggauaaguacuuuuaagacauccacaauaaacauauuccuuagaaaaaggaauaaagcauaagaugauguuaaaccacauauguaguacuaugcaucaggguaagccugcaagaagauagaguauguuuucuagugaaagucagugaaugaauuagagauagcuuuuuuuuuuuuaugcuguuucauguugccuuaacuuaugaugaugcucuacauuuuauggucaaggaaaaauauaucuuuguucuugcucuuaauaugaagaaagaugauaauuggaaaaaaccaacuggcagcugcuguuuggguuucuguuaacccaguuccccuuuccagucuauuauauaaacagagccauacagcacggcauauuaugucucuggcuuucauugucuagcaugaugcuuuugagacucacuuagauugcuacaaaaaacaguguguuguucccuuuuauugcuaagggauacuucacuggaugggugacauuuuaucagaucucuaugcauggacauuugaauuuuuuuuuuuuuuaaacgcaacacggucggauucuucucaacagcuuuauugcaggaacgcuucgaugcuacgggaacccagggaacacuggggagggcuauguguccuccugggauuggucagucugcuggcacuuuaauuugcaugcacccacucgggagggguuggcgccagauucgggcuagcgccugcgcagugauauuguuuacggcgacagugccaucuuuuaggcgccggcugccuacaccaugugguugcugggauuugaacucaggaccuuuggaagagcagucagugcucuuaccugcugagucaucucaccagcccugaauauuuuuuuaagccagauuauacuuugcuaucaacacuuggcacaaaaaucuuaguauggcuacaagauuuuauuucucuuggguuuuuagcaccugguaaagaaauuucuugguuauaugugauaagugcauagcauauuuugccagaaacugcuaaccuguguuccagaguaacauuccuauugcuucccaccucugcuaaagcagugagacaguacuccucaugcaguugugagugaaaauuuauacagaucuuuccuaacaucaaaguguaaauugcucaaaaagccaaaacaugccaaguggcaaagucccuacaugaucucaucugacagaucauaggcuaccuguacuaaaauacugugcaaaaugagucuuaggguauagaguuguaacuuauuacuacagccucaccauaagcaaagcccuggguugcccaguacuauccaaacaaacuaucaggcuaugcaauuaaguauacaugaaacacugggcaugguggcgcacaccuuuaaucccagcacuugggaggcagaggcagguggauuucugaguucgaggacagccagggcuuuacagagaaacccugucucaaaaaaccaaaaagaaagaaaaguauauaugaaacaaauuaauuuugugguugaacuuuguucccuccucuggauaccucauauauauuuguauauacauacauacauacauacauauacauaucuggauaccucauauauauuuguauauacauacauacauacacauauauauauauacauacauacauauauacauauacauacauauauguguguguguguauauauguguguauacacacacacauauacauauguagauauucuaaaaucuaaaacaccugugcucucaaguaagggaccuuucaucuguaacucuuguaguuuaaaccaaaucaguaaacauauuuguugucauuggcccucaaggaaugucuuuguguaagggaaaguauuugucaaaucacaauuuauauaaaagacuagauaacauauucacaccacaguuauuguccuugacugguaauauuauagauacuuaaaguuguauaaucaguacauacuaaucauuuuaguagacucaggagaaacuuaaaaacaucuuugggguggugagaugguucuauggauaggcgugccuguuacacaagaaugaggccuaaauuugauuccuagcacauacaaagucuaagagcacuugcuacucuuucagaagacuggaguuugguucccagacccauguuguaugguuaaugacagccuguaacuuaagcacuuugugaaucugauucuucuucaggcuucugcagacaccuauacacauguguucacucaacacagacgcauacauauaauauaaauaaaguaaaaauaaaucauaaauggaaaagccauaugucacacaugccuauaucccuaaugcuguuggagacggagauaagaggaucacuggggcuugcuggccaccacuauauauguccccagguucagggagagaccuugucucagagaaauaugguggaguguaauagagaaggauguccagugucacccucugaccuuugugugcacacgugcacuuauaccacacacuauguaucaugacgcuugauguuuagucggcacauuagagaaggcugaugugcaauguaacagugccgugagugaguuuugaaggauguuguacuacaaaaaguuugaucuuagcuugcagauuacacacagucaaucaugcagggaagccaagguaagcaggagcuugaaacagaagcagcagaggguugcuuucucuggcuugcuuggcuacuuacaaaaccugggcuugccugucuaagcacugcauugucacaacggacugggcucuuuuauaauauuuagcaaccagaaaaugcuucacuuccaugcccacuggccaggcuuaauggcgacauucucaauuaaaagauacacuucuuuccaggugaaucaaguugacaaacaagauuagccauuacaaaaaugaacaaucaggcuaaagccuuagauggauuucagcaaaauuuugaaguauagcuaaaguuugaguuugagggacaaacagaagaggaaagaaaauauaaaugccuuauuggacggaguguauaaauacaaacuauuuuucagaugcucuuaaagcaauagaccaaggguugguagagaugacucaguggcuaaacaagaucacugcucuuguagaggaccagguuuaguccccauacccacaugguggcagcucacaaccauguguaacuagaguuccaggaaguucugaugccuugcucuggccuccaugucguugcugggaaggcuguugagaggcucugcacucuguaaaacagcuuuaauauaguuuaggauugaacagauggucagaaauugucucagaaagaguagguuuuuaaagaacaacuacuaucauuuugaagagugugcuaacuuauaaauuauguucauggucauuuauucuagugguuuagauaggguaaaaaauaagaugggagccagcaugacuagaucuguagcauuucagaggcugaggcaggggaaucugaguucaaggucuucugggcuguauugaaaaaccacucccuaaaaacuaaaggagaagaaaauacuuagauauagaauguaaaggccucugaggagcagaaauggucucccuucuuccucccucccucccucccuuccucccucccucccucccucccucccucuuucuuucuuucuuucuuccuuucuuucuuucuuucuuucuuucuuucuuucuuucuuucuuucuuucuuucuuucuuucaauugcaguauguugucugaggacuguaaguggagcaaguuggauauaggauuuauuuuuagcucaccuaggguaaucugaagauacaguugugacaugaagauguuuucuuaggugaaacggauugguuuuuguuucagagguuugaacaguuguccauagcaaauguagugguucuuuucauuuuuacacuacuuccuauucaacuaguucaucuggaauuucguguacaaagcuacuaaugcaugcuuaaguucacguaacucauucauaguaucuucaaaccauagguccucuacuauaccauuuugaaaaucuggcaaaugaacugucuauagaauugagcuaugaggauauuaaaaauguuguucuucaguauggauuucagcuagagguaagaauggaaagacacagggccaaaauuuuuaacuuggaaugccuuuaaauaagaauauaggcauuauagcacuuaaugacuugaucucuuuacuucucuuuuucucccccagauagagauauuaauauuaaauagcuuucuuaauuguaaagauuugguacaauauguauauagagggaacacuauaguuccuguugaaauagacuuucaauaaugguagcugacaauggccuggguaaucacucacugacagauaccauguagauuaggcucuggaggagguagacagugagaaggcagguaucaaagaaaugguugucuguauauuauuuucaucuccccuggccuuuucaucuucccacaccauauuuguaguuggagguaugauacugaaguuacgugaccuguuauuuuauaaagggauuaugggugccacuagucuggggaucuguuuaaauaugcuuacaauaguaucaaacaacuaauaauuucuugguauuuguuaagaguguugccaucaugaggugauuaugacuuuuguuuguauuacagguggagaaagaaucuguauugucaacauauacugugaaugaucucucuaugaugaaauacuacuaugaguguguuuuguuugugguccggaagccacaauaauggucuuaagugcuauuacccagaaaaacauuuaauaagaguaaaugaugaaauaaacaacucagagucaacuaucggugacaacaggacacaaccucaaaucaguggugccuucuuauuccuaacaaaauuuagaaauagugucuauuuucuuaaugaugucuauugcuuuuuucagaaauauacuaugccgugcaaauuuauaccacacaaguaaaaaaaaaaaaaaaaaugaagacauuaucucccaugcagauaucuaauggaggaacuaucuucaaguacuuuuuucuuugaagcccugaauugucuuuaagaaaauaaacauaaacuccagguuucaugaagcuauugcgagucugcaauagaauuugaaacuauucuuucaucauucaaaauaguuuuauuuuauuuuuuagcucagccgcauuuagagaacaucaaacaugucauguaugaaaugcuaaaucaguuguaucacagguuaaaacucaugaacuacaguaacagagaaagucuuuguccauguuaaacugaaucuuauaucaaucacuggaucccuuugaaauguauguaaauauaaauauuuggagguccaaaagcuucuuuuauaaagcaguguuaagaaacuggaaaaauaagaauaaaaucugcccaucugaaauacauaauuucgaauuagaaauuaauuacaaagcuugucgugugauguuuacaaugauguguuuuauaaaguauguggcuuauggaagcaagcacuuuuuuaguuaacauguauucuagugaaaauuauaauagaauuaaugugagaaguucugaguauaaaauucagggauaaauuaaugccuguguucugugucuuccuaggcagcagccauucauggaauuucagauuaauacuaauuuuguccccagauaagaguuggagcugaaagaguauaugcugcuuuaauuuucuaccucuagagaggccuggucagagggaguuuuccuuguuaguuguaaugcuuguuauuccguuuccauuagcuaggaaagaagagguggaagguguuuuaacuucugcaggaaaaggaaguucuugcugaguguugcacaaaugugugaccucuguggcaucuggauuagauggauuuaauauguacuggugacauaacugccuuguugccaugcuuuaauaggacgccuuacuuuaaguccuugagccuuuguguugcuuagguuugagucuguaggaucugguaucuuucuaguugggagaauucuacacaguaugggaauuuuugucaucuguccuuccaucaugcaguacauggcuccacagagcaaauuuuacuucuuaggcuguguaaauccauagucuaguuuuugucuaaaaucauuucuuguucuucuauugcucacuacuuuacaaauguucauuugguggaaauucuuaucacuauauacaaggggggaauaucucucagaauuauuuuuuuaaggggaaaaaauaaccuaagaaauguauuuuaaaagucauccagugaacagcgaggaaugcaugcuuuuuaaguuguuauuuaggaaugcuuuuauucaucgaguguuuuuuguuuuuuuacaaagguaagagcagucugacaccagaggguugguuuuguuaccuaacgauuuuuuuuucuguuauguuuuacucuuuaauguuacuacuuacauuucuaaauuauguauuuuacuuaacucugaaaucaguuauuucacuuauuuuuuucuucauaucaugaacguucuaaaaauauuccuuauaaauuugcaucacuuuuucucuuguggcuuuugaaguuacuauauucuaaacuugagaagaugguauaaaucaauaauagaagagucacuggggagcuggugagauggcucaguggguaagagcacugacuucuuuuccaaagguacugaauucaaaucccagcaaccacaugguggcucacagccucccauagugagaucugaugcccuauucugauguguuugaagacagcuacggugaacuuauaauaauaaauaaaucuuaaaaaaaaaaaaaaagaggugucacuggaggaguuuaauuuuguauuuuuuauauuuagguccagcuauuaaaguguguaagucugggaaauuuaauuuuuuuucuuaaauuagugcuauauacaaauguucucaguuuuauaaggugaucaugugcuuucuguuuuuaaauuuacauuuucugagguggugaagacuuagguucugaucaauaagcaugauagggcauguagacuauacgggaaggcuccugagcccacaguauauagugagcaugauagggcauguagacuauacgggaaggcucccgagcucacaguaugcacuggucacgccggggaacuguagaguguaugggcucuguguguaauucacguucugacaucgccagaaagacgggacugggagcuucaugucugcaugaaacuuccuauaucuuuaauguguguauagacuuacuuuuucuuuaaauauuaaagucuaccaauugcuacaacaguucuugguuguuucccucaauguaaugauggccauagugggaauguuauuugagcacauuucucaauucuucauuagccuuuuuuuuuuuuuuuuuuguacgcuucuaggaacucaaugagcauuugagcuuugaguuugccgagguguauaguaucuauuuucacuuuguuucauucauguucaguauaaugaacuuggaaucuuccaagggaaaaagauuagucuugauccuuaauuuuguuaaaugauagaauaaacuacaaaggcuaacagcagaaaaaguuucaagaagagcaguuuuaucaucuggggucgcuucucugaacucuucucaacugggcggguagugucucugaggacuucugccaggugacuccacagugccucagcagguggcuacugggugaggacuucacucugcauucugaccugguauuuucuccuccccuagugcuuucucucuguauugucaacuuuuuauuucuaugacaacauacuuuuaaaguaaaaggauaauggguuuauuauucugucucacagcuucacuccuugcucacuuggcucuguguguuugugugugcgugcacgcgcgugugugugugugugugugugugugugugugugugcgcgcgcgcaugcgcgcgcguacagcagaacguggggguaaagagcauggaguggggugaagcugcucacccaccccaugccagcugggaagcagagggagcuggagguggacaaggccagaacagaaauaauuccauuagaguuagauucaccucauauuuuaccucccaucaaguaugaagccgucaaaggaauaauccauucaugaagucagagccuuucaccucuaaacaaucacuggggaccaaacacaugcaccaccgaggaacuucuuuagacucuaccuacugcguucacccauccacaaugcaguagucucccaggggucccugaguggugaagaccuaucuaucuguuaacgcaccugaccuuggcacgccgucauaggaggguggaagagggagacaguauggguuacuuguuuaccaagaaauugggagcguuuauucaaaagcagcuucuuucgcauuacugacagaaguguugagaacaggaaucugcugcaucuuauuuuuguuacauuauuuauu

SEQ ID NO: 9207 - RNA, 15118 nt, Mus musculus
ccggaacccugccagccuccuccgggccgugccuucccgucccgcggggaggggaccccggcggagcuggggacgaagcgugagaaacugggcugguguggguggcugagggcggacaauaggguuaaaaauagaagcgcugccuccguggacccgccgcagcagcuccacccagggccccgcgggccggagggugacugggcgacggugaccgcagccuccggacucgccccgcccccaagugcggccccgcccccggcuagugccugcaggucaggggcggggccucgucccgcgacgucaucgcgccgcgggcgugccgaccggguuuucgcugacgcacaggccccgcccccgccgcccuuucccucagaucccgagcgccggucagagccagagcgucagucgucgggaucgcugagcggugugcaucuggucaggcguccgcucgcugcccggagucgcgcagagucucuggcgaacgcggaagcccgaagagcgcaguccucgggccccgucggcgcucaggccucuccgcgcgccuccucacucggccgggacgucgcuguggaggcgugaggugccggcggccgggcgccuggagcggcgcuagccccgcggccugcgguucuucuccucccccgccgcccucccacccgagcugcggcggggcucggccgccucggcgcuucugcacgaacaaaggaggccuccgcggcgccagcgcagcuccgccugcgcuccgcuccgcuccggcccgcggcggccgcuagccagcccuucccggaggccucagcccggcccaccgcccggcgucgcgcgccagcucgcuagugcauccgggcccccgcaggguaaguggcgcgagccgggacggcgcgggggcgggagcacgcccgaucggcgagcacaaagacgggcccggccgggccagcgggcuggacgggacaaugcccggcgugccgcggcgccgggugccggccggccgaccgaccgacaggauagacaauggcagaggcggcuacugccgcgccuggcucccugcacagccgaguuguuccggcgagggaccgucgagugcaugacucagugguuuuuggagcaggcccuaccgggcuucccggagcgcggccugcgcugcgagggggguggggggccucugggucccgaacucggucgaaaucgcuggaaccgggacugacggcucuucucccggaggguuuuuaguuuuuuccaaugcgguuaagcuucucccucaaaauccuuugcauggaagcaagucgagcgccucucccuuuguuucuuuccuacgugaacauuugugaaguugacauuuugcuugcuuuccgugcacuccguguaguuguauucugagggaagguauuauaagcuaacugucgauuggagcugccuaagaauauuaccugagauaauuagaagaaaauaauauauaggucagagccuccuuucuuaaaaucgguauuuaguaaucaagggaauaguaagauaguaauuaauuuuaucuuauuuugauuuuuuuaggugagauuucauuauucaacugcugaaaauauuucacuuuuacauuucaaguuuguuuuugaagugucucgccccaaaauaagggauuucuuuuaguuguucuaaauuguuuuguggcuggaaccgguauuaaguauggaaagaagcucuuagaaaaaaaaaacuauuugacuguuuggcagaggugucugaaaucuggagacuaaggacuugcacaaggucaggcuuaguagcacauuagaguuuagaguucgggucugaccucgagguuagggagugaucuugccauuuugaaccauugccauuuugaaccaugguaugcaccugaaacagcuauuccauacuuuaaaagaaaacuucauucauuucagauuuugaguuggaaaaucauuuuuaguccagugagguuuguuuuaagcuaugagcuaagaaagaaaaagcgugaauuuaaacaaaacagagcauucuagcuaugcgggaaaggguuuauggaugacaaaguuuuuaacaacuuguuuugcaccacccccgccccagccccaauguaaggacaauacaguauaucuaaacuaacaaaaacccuauaguuauaguaacuguaaagaguauuugugcuuccauucuuucuccuacuuauugugccuacuuacucuccccuugccccacuuuuaauauucacaauuuacuuuaugauuuauucugcuuggguauuguggauugaaggugaggcuguucucugauccugcauuagaaaaacuuggaggcauuaauugcauuuuguuaugugagauaugugaaugcugcaucguuaguucuugggguuguguaggaguuggcaggcucugagauauaaauagaagcugauuucagaggccccuguugacuaggcuuuaugugagagccuccauccagcucagcuugucacauugcagccuugugacaggcugaagcgcccucccaugugaucuaagcuucagagaaguauuaaagcaagcugugcacaugugauggcauuuaaaaucugacuuacuagaagggaagaaaacuauugucuuaguucuugauauuucugugucucugccuaagauuuuaguuguuuucuuaagauccuuaucuaugugggaggaggccuugggugggauauucuucuuuaccauaagaaaagugcuuucuuauuaauaacuaaggauuguugaugugaucuguuuguuggucuuuggccgguguccucugaaguagucuaguaagugagauuagcauaguuucucgagcaggcugauaaaagccuaacuuuuugcauaggguaaagggcaguacacugcccggugaaaaugaagauauauaauuuauuauuugaaucuuuuuuuuuuccgaugcuuauguuuuauguuacacucggcauuuuaaaaccucagcuaaaaguguuuauuaaacugcacaaguaaucuugaaauauuuacacuguccugcucugaaaugagucagcuaaauuccacucacuauuuaaagagacagugucaacuaaauuacuacuauuguucuaaacuguggcuuuuaaucacugcaaacaagcuugauuugcucaaaauaaggugcccuugugcuugggugggguagggggagggagauugcuguccuuuaacuauucaagaccugcuacucauugucaggauucuguccuggucaaauugauuauuuuccuucuuucauuuuuuaauuuugguaaagaguuaauuggguguuucauacugugugauauuugggaaaaaugggugaccacaauuuccuuuuaaccaaauacugcuauauuuuuuacaaaauuuuucaaagauaaauuuuccuaauguguauuuuucucuuauacagugggaaacuuaguaaauuuagcucauuuuaaugcuaauguaaacaacuuuggaaaagucaugguauaguugcuauuuuaaguuuucugguagccuaacauuaaauauuaaucaugacuaaacauuuuuuuuauauuacuuuacuacauuaaguuuuggcuuagaaaaauuuggggcuuugacaggaaaaaaaaguacuuuuaaaaguuaauagacacuggaaaaauuuggggcugauaauuuucaaguuucuagaugagguuacagguagcugccuuaauggaaguauuacuugauggggcccaaccaaguaugucuuuuaagaaagguacugcuggguguagucuuuaaaaaguuauaggugggccauaaagauggcucagcuauaagagugcuugauuuuuguaagaaggacucacucacuugauugcucacaaagcuguuaacuggaacucccuacaguugcugggaguugagcaccagggauauaugugcgcauacauacacacauacaugcauacauacguacauaaaaggcagauauuuacaucauaaaauuaucuuaaaagcuguagggcuagcuggguggugguggcggcgcucgccuuuaaucccagcacuugggagacagaggcagguggauuucugaguuugaggccagccuggucuacaaagugaguuccaggacaaccaccagggcuacacggagaaacccugucugggguuuuuuccucccuauuuuauguuuagccuauugaaguaaccauuauuugaaugguuagccuguagaacaagaacagaaaguaaaaaaugacagguuucuaaaauugauucagacaacccggauaacuggcaagcugacauucucagaucucagaaacuaaaauuaaauaguagcaagauaaaaucguacacuuuaguguucaaugguauaauuucuuuuugguccucaaacaguucuuuaacucucacuguuuuaaagucaacaagauaacugcuuaauucacacaauuuugguuuuuguuaguaacagauuugguguuuagaaauaaauagcaaagauauaguggugauuguauuuaaauuuauuuuugugacaugcuaauuucugaaauucuuuuuauuuauagaagaaaaauauggcucaggagacuaaccagaccccagggcccaugcuguguaguacaggauguggcuuuuaugggaauccuaggacaaauggaauguguucuguuugcuacaaagaacaucuucagagacagcagaauaguggcagaaugagcccaauggguaaguuguuuccaagaaaaaacacuugaacugguggagagaaaaaucuaagaaucaagagaauguggaaaacucaaggagagaaugccugacugacaagaacuaacuaagacaacagcccaagugcuuggcgugacuaccucgggaacacaugacuguucugcagacuucuuauaacauucuuaguuuucuuuuuugaaguuuuguuuuauacauguguucuuugggauaugacuuuuuuuuugucugaaugucaaguauaggauugcagugcagugaaggugcuuagaucgcuaaauuaaaugcaaguauuaaugcuuacuaaaucuuuacuaagugggguuuuuuagugcucauuuguuucuuacuuacagaguucucuuuuuaaauagggacagcuagugguuccaacaguccuaccucagauucugcaucuguacagagagcagaugcugguuuaaacaacugugaaggugcugcuggcagcacaucugaaaaaucaagguaagagugaacguuucugaguuucucuaauagaaaaucaagcugucuuugcuauacacauaaucaucaaggugguuguaucagguggccuuggcuuugucuaccuugaguacugaaggauuccaucuauggaucauugaguaaagguguauaucacuacauacuccauaaacccugcaaggccacuguuaauguuguguucucauuuccuugaaauugaggguuagggauugaaagaguaagacuugcagugccucacaaaguguguuucaacacagcugcuccuuuuguccuuaaauuauaggcacaguuaaaacacuuucuagauauacagugugauacuauacaaauaugcagccaugaguugaugagccauuuaucaaauuacuuucuuuauucuuacucauuuaugcuaagcaaccaauaucuuuccaaauuuaaguuaaucuggugccauuugaucauguuggaaauaacacauaauuuaaaguugaauugacaacuuaucucaaaaaauaguacccuuaacaucuuuaaaaauaauuguuugcuugaacucaaauagaaaugugccuguggcugccuugccuguaacucaacaaaugacagaaaugagcauuucaagagaggacaaaauaacuaccccgaaaacagaggugucagagccagguaugcuuuuuaaguuuaauacuaguucaguucugaauuuuuugcacugugagaaagacuugaguuggugacgggauucucuccuuuccauugaaggagcacagggagagcuguaaaguauaggccaagcaaagaaacaacaucaaaaauagaaacuaguaucuucauccuguugugcucaucccuucauuacccucacucuuaaaaacaaaucaaguagucuggaaacuggaaagaacuuaaugacuuuaaaauucaagaccauagggagauuauaguaacuuuagucucagcccugucaguguugugguaaagagaaagcauacugaaugcugagaguuguaagagugugggauccuuauuaccugugcugugaaacuuuaaagguaugggagguuuuuuuuuuuuuuuuuucagugagcuaaauagcuuuggagcuauuuuuauagcacaaccagagguucccuaaugucacaagaagacugaauuguucuuuguucacaugacuuacucaaaucaguuuuauuuguuuaugguagagaagagacagugaaguagaaaaucauugugggggaaaauguuggguauuuuagucugucuuaaacuuaaugauguaccaguuugggggguuuuguuuucucccuuacuauaucaguuucaucaagucagauuauugggucaugaaauggaaggugaaucuguauuuaaaaugaguucuacuuuggaaaaacugaccaaauuuuguuuuauacauacacacaaauuacuuggaaguagaucagcuaauaauauaauuguuguuacuugauauaaaucugugauuuccuauuugucuuccucuuauuuuucuauccuccccuuccuuuguaugucugaggagcuuuugaauguuuuaggugugggcaaagaaauggcuaacguacaacauucucaagacucauacauuaaggaaaauuguauuaauguaucauaguagcuugagaaaguaggcggaauauuuucguuggucuaccacaagacucuugaucccauuauauauugcuaauugagaaguugacauaaacgcaaucugcuuguccuaggaauuugauaauacugagagcuuugaaauuggcguauuauuuaggcaaugguuuuaguauuguaugugccuaaaugugcuauucuuaguguuuggauuaauccuaaggauuuacaguuuacaguuagguuuaauauaaguacucacaguuaaguuuauacauaaauacaguuagguuuuauacaaguauaaguuuuuuuuuuugucuucugaagaacuaguaggaugacgcuuuaauauagcagucugcaguuuuucauuaugaccacaaauccuaauagaaauuaccaaaaggauuuuuuuuaaaguugcauggugauggcuuuuuauaugucucuuucuuagucaaagugaaaaaguaaguuaggucuucaaaaaaauuccuguucuaaagcccaguuugguagugaucuguaauccuagcacacuuauguauuagacagaaugguggccuccaguucaaggacagccuggccuagacaagacuaugugucaaaauaauagaaacaaauccucucugucugaaaauucuucaguaguuuaaaauuaauacuucacaaacauaucuuauguuugauaguauuuguuuaaaauuuuagaaaguggcuggcuguuuguuugaagggauuucuuaaugguuguuugcuagaaguauagacuaguauaauauuugucagaaaauacauuuaagagagguuagcuguuucucuuaaauauuacuacucuaaacuuuuaucagcugcugauuuccagacaaauuucuaauuuauaacuuuaucuuucaguugucacucagcccaguccaucaguuucucagcccaguucuucucaaagugaagaaaaagcuccugaguugcccaaaccaaagaagaacagauguuuuauguguagaaagaaaguuggccuuacagguauuaacacaauucauaucuuaaaagagucacuacaaaaggaacuauuuggcuuuacacauuaaaaaaaaauauucuaaaauuuccagaaaggauuggcuaauggguuaagaaguuagauuuaauucccauccacuuuaaauguuggccuaguuacguaauuaucauuaacacccaccaucaccccacacccccccaggccuucugaauuauuuuucuuacuuggacucucccuuuugaugccguccuuugauacugagcaauagcugagcagcagcagugaacaccuacuuggauccaggaaugaaguggucuagguguuuacacagaagugugugguugguuagguaguuuucacuuggagaugcuccuguguggugugauaaggcugcauugugaauucaagucauccuaauucuagaaccuacaauuugaggccagccuggucugcagagugaguuccaggacagccagagcuauacagagaaacuugucucaaaaaaacaaaaaacaacaacaaaaauucuaucgaauugucaggagcuguuuuucauaaagcauugaaaaucaguuucuuuucuauacagugacuugaccgauuuccccuucccaacacccccccccuccccccaauuacuacaaguugccaagugauuccuuuugucugugcaggguuugacugccgauguggaaauuuguuuuguggacuucaccguuacucugacaagcacaacuguccauaugauuacaaagcagaagcugcagcaaaaaucagaaaagaaaauccaguuguuguggcugaaaaaauccagagaauauaaaauuacuacaugugaagagacugaaacuuuguuuuuauuuuaauauaucguaggaaaacauuaaagagcagaugcauggccauuuuccuuugauguucuccagaguuuugcuuuauacuugucugucauauaauugaucuuuuaggauguuuggguguuuguuacaggcagaauuggauagauacagcccuacaaauguauaugcccuccccucaguaaaauuggacaaaaauaugcacaacaaauugaaauacacauauacuaggaacaaaauuuaguuccacgugccaaacuaaaggaaugaaaucucugcauguuugcagcauaucugccuuuugggaauguaaucaagguauaaucuuuggcuaguguuaugugccuguacuuaaaaaaaaaaaaaugguacaccagaaaaggacuggcagucuacuaccauagucaaacuucaccuuaauuucgacaugacuuuuggaagcaggaagaaagcuacaaaacugguauuugguaccaugugugagccugguuaaauuggucuucuaaaagcugucaauuaggacauucugcgaaagguaacaucacaacugguucuaagucaaaccaucaagucaacagcagggugccugagauaaucuuggaagcuuauugugcuggccugcaccagaagauaucugcauucucauuacuaaaauuguagcacagaacugcacuaggauuuguuuacaaggagaaauuaaacucuguuugguuuucacauauagcagcucuguuaaauaacaugcaucugaauuuuaaguugcaaagguaucugaacaguuaauuuuucaugugcaucuuuuguugaauguuuugguucaagaaagaauguuuaaagcuuuuuaaagacuucaguucuuaauguaacuguacccuucugcauggaaaaucauaaccaacauggcugcaguagacuucuuuagugguauccagcaccacuugcagagggcugcuuuaucauauuguacuuggguguaggacucuaguguucuuggguguauugcaugggcugcauuaucuacagcauuguacaauaacaacuagaaaaggcgguauacuucacugaugcuugucugguaauaucacuucuguguuaaaauggaagguuuuuugugauguaugaaacuuguguuuuuuauauauaaaugaguauaguuagauuaguguugugguaaugccuguuuucaucuguaaauaguuaaguauguacacaacaaggcacuacuucugauuuuugcaguguucaguccuaguuuuucuuuauuaaaacauugaguuuugcuucaauuuuauguaccuuaguucuaaguuagauuugcagauguguacagauaguucauauuuauguauugcacauaaucaugcuauucagcauugaugcuauauuguauuauguaaauaauaaaagcaguguacagagggagacuucuuguuuauuggguuuuuaagucuuagacaccuaaauagggaaaauaggaaaguuuucauauucaaauuuauuucauauagcuuuguauugcaguuguuuugcaugaucauucuugaguucagucaugggaaugccaugagcuggucaugaaucuuaaguguggcauaugauaggcaaauuuugaagagugaguaggcaccauuaauaugaagugguccuaaaauaugaaaaaggaaugaaauuuaaauaaugcuuuaccccgcuccuauguuguguuugucugguuaaauaauccugaaugagaauguagguaguuuuguuuuaaacagcagcaguuacuuuauucuguaggguuuuggauaugauguagagaggagaaaaccuaauucaaugcagguauugugcuuagaugaaauauuaaaugcuccagaccaccuaaagucaagaauagaaccauugcuuuucagaggugacuuuagagcagaaauaaugugauucguguccacccacucuugaauacaauuaaaugaaguauaaauguuugacaaaauccauguauugaacaguaguaaccccccucagucugcgggguauugcauugguugaguugaaaaugaggcguuuuaaagaaaacuuguuuuaaaaugacuacuguccacaggugucaacaaaugcuugaugcuuuacuguuuuuuuguuuguuggacugaaccaaaagucucaugcaugcuaaaggaagugcucuuuugagugucgugugggaguuaaugguagacucuugcucucuccucagugugugaacgcuucaguauacaauagugauuguauaaucauauuuuggggcagagagugauguugggguccuaacccuaguucacagugcagccuaaguuacccuauuccuugugauccugccuuagcuugcagaguccuaaaguuauaggaaugagcucuugacuauacaaacacacacacaggauuuggcuuuacauaauuugucaggaacguucaccagggagaauaauuucaguguguaaggcaccaggggagauuugaguucuuccuagacucuuggacuuagaaagugugucucauuccagacugaguuagcugcuaugcacauugaaauuaaguguuagguaaauagggaggucuuugcauguaaucuagugggucucaccuggaaagcuugggcuucuaaagcagugaaugguuagcaaaacuaggcuggcuuuguuuuuuguggugcuaaggauccuaaaccacacugcccugcuucagauaacaccuaauucaggaauaucaagaaagcacuuaaaaugguucugcuaccauaccacuacuugcuaguuacuuucucaggaugagucuuagaacuugaaugaaacaaugaauuugguugccugaagcuaccuuagaggccaagaucuguagcuuuguuuuugaucuugaaauggacucccuuuguacccuaggcuggucuugaacuggugguaaucauguuugagacugccaacuguaguuguaacagccaggcugucuuagacucccaccaucagcauuuuaaguguugaguuacagaugugagcugccaugccucacuuaagaucucuaacuuucacauaaaguaauuggagguguucuucugaguuagguuuucuugaaagaugucuacauuaaaguuccuguuaacucuggacagggaaaugccaauuaaaauagcaaaaugcuaaucaucuggcuuuguuuuuauauguucuuaggguuucaauauggauauaugaaauuucaguuugucccauauccaccacgugaaauguguguauuuuaguucuuuauucucuguaaauaccugcuuauuauguacaaauucaugugucuucauuugaaauaauucuuaaagugggugccaucuguaguauuaggucuuagcuuuggagagguaacucagcaacuggcugugcuuggugcucuuccuuaggaacuccuaacacuuaggacacacuacacauggcugccaccaagccuaaccuggacuugauccccaggacccagagaacugcuuauccuuugacuuguaugcaagcauucacaauauaaaacuaaaacuugcgaguccuguuuuuauauucccuuagacuacauuucuuucuguccaaguaaaaaugaguuuuguagaguaaauguaaauccaucuugaucauggcagcuaggugcgcuucuuuuuagaagagaugcauucuucacaugucagguuugaggcaggguccacauauacucauggcuguccuggaccuguccauguaagcugggcuauuaauuuugagauuagaauggugagugcuggaauuaaaggugcgggccacaugagauacuuauuaguaccaagcugaagaaaauuuuaaauuacuuuuaagaaaauugauacucuugaauauuuccuucagauuuuguuugcaaaaagaauuucuagguuuuagcuaggcaucuagggcuuugaccuucuaauuccugcacuccagaaugaggauggcagcaaguuucaagccagccugguuuguuguaggaagccuuuaugauuugggguuauuuguaucugggguggcgaaacauacaaaagcaguuccauaguuaauuugcuaguuuacucagaauuaauaggaaaucuuucuaguauauuucaaaguucagucaagggcaggaacuguuaaucaaagucuccgagugugugugugugucagcacuggcucaaacugaauuucucaagcagccuguguguaaaacccauggcaaauuuaaguucacuggccuuuauugcacacuuguguuuucuuguuccuccaucacuaaagauugauucaaacauauaggugaugacaaugcuugaggcugucuguugugucacauuuuuguaguuuuaugaaagccuuagguuuugguuuugguuuuaauucuuuguccacaccgaugagaaaaguacuucaccagaaugguauuucucgaggaagccccaccuaggacuuagggcauauaucuaauauaacuauauaaacuauauaguguacuaaguggcuucugacauuaagcuuugggguuauuguuacuguaaagccauucugcaguagaaacguauuaaagaaugguuacucugcuauuuguguuacacauuauacagagguaaacuagauacuuuuagagugccaucuuuaguuauucaguuaacauaaauauuagauuguguugaauaucuagggucacaacaguuuuaacacuccuagauauauaucagaaauaugagaaaaaauugucaggugauaccuauuugaaacauguucaaucuacauauugugguguuggcauggcuuuuaagcauuggguugaucaagagaauaaggcuuugcggugaauuaaagaguagcuuaucaauuguuacuuaauaaauugagaucuguaauuagcaggcagccugcauuauaacugguguuccugcuguguaaaacauaaggacuauguaauucaauacuaagaggauuauacaaguaaauacuagaugaaaaauuauaaaagaggguuauacuauuacauuccuggagugcuagaaccaggauaugaaauagaaaggucaaaguaagauugccuuuauuuaaucaacccucaucuggcucuaucuccccucaaauuuuguucagaauuuucuuaaaagguuuucugugguuuuaaucagaauacuaguaauuuaaauuuuuuccauguuaaagccaugguuguuuuuuaauuugguucuuccaacacaauuuauucaauuuuacuuaacuucuaccaggucugguuuaggcuuagcaaaaugcaguguguugaagcaaaacuuagaaauggugggaauuugcuuacccuagggaacaggucauguucagacuagagcacccagcacugcaugaguucaguugaugcuuuuaaaggccguaccuucuuggaagggaugauaaugcauggccauagccaugccaugagcuacaguuacugaaaacaucaggagcaaguugguuaggcugacuucccacuaucuagcagggaacaaaugcuguggugucuaagugcugagguagccuaaauuauauucuagccaaacuagaguuuuucugaccaucuucuggaguagggaggguguuuuuaaaaagaucucuauuaaaguauaccaggagggacacuauauuuauuauauacuuaugguuauuauagggcuaauaaccaaaaaaaagaacauuuuaaaauuuacuuacucaauauacuguuaacugagaagguuuguacaauguuuuuaauuccuuauacaggugcugaaauagaaauuuaaguauauauguaacuuuaaauuucuugauaaccacauccuaaauaauaaaaagggugaaauuaguuuuuguguauuuuuacuuagcccaguauauccaaagucauaucaguaucccagcacuugggagacaguaggcagaucucuugucuguuugaggccaucuugguuuauaugagucccaggccaggcugagcugcacagugagauuuuaccuaaaaauaaagccugugacugcuuaacuuaaguuacuuccucuuuugcaccuuagugccuucaucuguauagauuaagugauggugugguuaauggguugaguagcaaacgcacuauuaaauguaguuaaaauguaguaagaauuuacuaugucucuuuaaaauugacauaaacacacacauacauauauuugucuguguuuguguggguauauauuauguucaaguguacucagaggccagaagaggggguuggaucccaugaaacagagucacaggucuugugagucaucucauauggcugcugggagccaaacguggguccucuggaggaacugaaaguguucuuaacuacugagccaucccuucaccacccccuugccccaaaauacccaccccccccccca

SEQ ID NO: 9208 - RNA, 32768 nt, Mus musculus
gcucggcucugccuugccgcacauccucgacuaccggcuucacggaaagccuuccucggacccaaggugcaaguccggcuuucuucgaaucuagaacucccccauuggcucgaacgcggcuguccaucacggcggagggacggagauuccccguuccuauuggcucuucuuuuccgcaauccccgccuccugccgaacgcucccaaccugucucccggcuccguagcguagcgacuccgcugcgcaguuugugauugguggaaggugggcgaggccggugcccugaucgccugcagcccggagcccgggucagcuucggcgcccuccuccagucacugagcagcucgaaccgggccgcucgcccccccgccccccgccgcccucccagcucccgcccgccgcggccgcgcgcuccgccgccuggcggccuucggaggugccaaggaaggcgggcugcggagaaggcagcaccggcccugcgcugcggacggcgaccacggccgcgcgggaccucgggccggagagccccggcggcggccgccccucgcggcggagccguuagucagcagaacgcgaacgcgcguggaggggccccacgaagcgcgcccgggcaccgcagcucucuuucgcguccucgccgggccgggccgcgggcgcagagucggcgggcggcgccccgcggaggacagcgcguuggcggccgcggccgcccagcugcaggugcguggggcugggcugcugggccgucggggggucgccgcucugagcuggggaccaggccggguggcuucggagcggagcuaccgagcggagagccgugcgucccgggccuccucgcccgcagggaggaccgcaagauggggucgggccgccgcuccccucccuggaucugggccacuucgggcccucgcucucggcucgguguccgggucccgccagccucgauuuuagauggaguccgcccggagcuugagcuggguaucccgcuccgcuugucgcgggagcugcuuuccauggcuugaacuuguaucaucucugauugagaacucaaggagggagagguuggauuugaauugaaaguuggagaguucuguuugaaauuguauuuaauauuaaaccaggaaaguugugucaaauuauaguguguggaggacguucggagaguuuaaccucccuccgcuucuguugaaagaaagaaagaaagaaagaaagaaagaaagaaagaaagaaagaaagaaagaaagaaagaaagagagagagagaaagaagaaaacguucagagccuuaaucuuggugauuuuucugucaaaagcaggauauuuaguuucaucagugcugcucugauuuaaggcaaugugaagcagauuugguaaggauuagaauaacggggccccgcggaaagggugaccuuuaauuuuuuucugauaguuuaugaaagguauuccauuccuugugcaguauauacugcuugaucccuaggauuuacauuuuucaaaccuucagcguauaaagagaauuuuggacaucuuggggcaguaccuaaaacuacuaagucuugaguagaauuaauuaggugcgguuugugauugacauauuuguuuacauuaacggggauuuucaaucaacacuuauuuuagagaauguguguccauauacuuggcgcauggauucaguuggguaauaaaucuacucguagccaaugcaguauuuugaauaucaccauuguuaucggugccggugucuuaccaauggaaaacggagaaggcgaagguguuggaaguugaaaauggauacaauaucugcuaugccuucguuacuguuucagaucuuggaggaaauuaguagcgccuucaccguauuuugaccucucucucuucuccuacucuaguauuaauaagguuaauuggcaaggauaggauuagauuuucaguaggcuaggaagcuuuaaauuugucccuugguguacaauacacugguuaauaagugguuuguuuacuugaguaccaucgcucauuuugcauugugauaaaacgacagcugaaaaagcaggcucuugcccaccccaacgcauagacuuaccguaaaguacugggacaagauaauguuuuaguagcuuaauaaacucaguaguccacagucuaucacugaauugaucuacaaccccaggcaugcgguucuuggcugaauccguguccacauucauaauccagaacuauuaaaaugugccacuuguugcucuugcagaggaccucuguucccuucguaggacccacauggugguucauaaccauugcuaacuccuguuccagggcaccugacacccucauucaucugaucuccauggacaccaggucuggugcauauaauaugcauggagacaaaacauucauacauauaaaacaaaaucuaaaucucucauuuaaaauugucccaccggcugaguuuuuagaggugcuuauuaauugauaaacguguuugcgugugucaguauugguguguagcaguguccacaaggaaauuuagguuuccugacuuuguugguuuauuucacugccacucuaaagugauuucucuuguaagucucaaaauaaugucucccuuuccuacccuguuaggaauccuucacuacuuggccuugucuaccccagccuuguguguguguguggggggggggggggguuggcuuucuggcuuuuacauauuaaguaaauaaaaacaagagaaauuaauuacuuaaauagccuuaaguuagacaguaagaacugagacuugaacccacaucuuuugacuugucuucaauucuugguguugaaguagucuucugugccuugucuauacucaguuuugcuuuagucccuguaaaauggcaguguagcuguuuaauuuuggugacauaaaauuucaugaggauucauguaccuuucaccuagugaaagaaauacaacugcaaaucaaaaggauauuuucccuaugucuuguaaauucucccacaugcuacucucuuucucccacaccaacuguuaaccuuaaauugccagacuccuugcugucaguguucguauaagcagcaucuagauaccugaacacgugugugcauguuugugugugugcacgcgugcgcguguauuuuugauggucuuacauuuauuugagcacgauguaugaaucuuucuguagcuuguuuucucagucuggccaagauucauccauauucuuccuguauuucuguuuuguuuuuuacugcccugucuacauacaaauguucuaugaccaacucugcaacaacagucucaaaauuaccuugcuuaaugguguccuuggagucuuccuguaaguauauucuggcauuugcauaagacuauugucugacaauaggguucugaaaaugucucacugucuugguuuuuuaagacagggagagacccucgguagcccaagcugaccuuaaacuugagguucucaaccucacuaccaacaugucuucucauaguuaaauguguaugcaaaauaucaccaguuguugguucuugauccuauauucuccucucuaauuuuuuuuuuuuuuuuuuuugguuuuucgagacaggguuucucuguguagcucuggcuguccaggaacucacacucacucuguagaccaggcuguccucgaacucagaaauccaccugccucugccucccaagugcugggauuaaaggcgugcgccaccacaucuggccuuauauccuccuuuuauaaaacacuugaacaggguuuuuuuagugcuuuaguaaaaaccaaaauuauuucgcagcucaguacuugagcugcuacacucagacuuugcuccugugugaugcuauguaucgauagcaccagaagcagcugguaguuuguuaggccugcggugccucgggcccuacccuacaagguuaacggcacugcaggauuuguguccacacuuaauucucaguauugcuagagucaggagcucugcaccagugggugcaucauugucagcacaguugccaccacuguccauuccgauuguccuacugaauugcuuucagacaccaaaaagagcacugugacagacaaaugacuuucuaaaauaacaaacuuacuccuuaaaguuugcgcaagacagcaugcacucuuccuuuuucacacuagauaaauaauuuaaugucaucaucuguguuaaaacaauauaacuagacaaugaguacauuuuuagaaauauuugaccuuggaguugguuuuguuuuuccgcccguuucccagugaauauccaguagagaaguuaaaacuugugggacuuagagcagcauuaucuuuuucuaguuuguuuugauuuguuuucauuggagggguguagagguagggacucauuguguacucuaggcuggccuugaacuacugaucuuccacaacuaaguaaaagucuaguagcaucauuuucauacagggaaagcacuugccuucccuggcuuuuggguuaguggugcuuccaucaugauacccgagggccgucauugagaacaauuaccccaguucauaaaucucguaguagauugguagaugccaggguaugagcuucugcuuauuagauaacugccgaucuucuguucagcagaguugaaaugcacccuggugcuuaggucacucacuguguccauuuuagcggucuuaaaaaccccuguccgggaagugaugucacuugcaaguaggauggguccuccaguaucaaugaacacaaccaaggugauccccucaggcacacccagagguccaucucccaaaugauucuagauccuggaaaguggacagcaacuacccgcuacaacaacagacaaacuaugccaguaguggauggaauccauuuuuccauguaauugaugcuuuagacuuaguuucugccauuccaaggacagauggcgcuugauucuaguuucauuccuaucucccaauuauuuguauugcugguaauuguuugauuuauuuuuauuuguuguccacauauuauuucucugugauuuuuuuccucaauuuuuauugauuuuucugcacaacagauugggguuuuaauaccuucuuccacucuuuaguauggcuuucacuuugaaagugauuuccuuuauuuaauguuuugaaauggagucuuacucugaaacccuggcuggccucagauuaauaacagucuuugauuuagccuaucaggugcuguaauuaacaccacagcugguucugaauauuuuauauuuuauuuuaauguuagacuuaaucauacuuuaauguuuguuguuguaacggguagugcuguccacuuuccaggauauagaaucauuugggagauggaccucugggugugccugaagggaucaccuugguuguguuaauugauacuggaggacccauccuacuugcaagugacaucacuucccggacagggguuuuuaagaccgcuaaaauggacacagugagugaccuaagcaccagggugcauuucaacucugcugucagacugaaugcaguguaaccagcugaaucacacuccugaccccuuggcuucccaccccaauggaccagaauuaacuuccucccuuuagaugcuuuuugucaagaguauuuauuacagaaaaguaucuaaacaucugaaauugugcauuuuuauccauaauaaggagcuuauaaauuuguauucauugaaagaaaguaucuuuuuauugaaauuggcuuuuuauacucuugacauaguggugauggucauuggguuuaguuaguaucccuguauggaaaauuaaaauuugguaacucuccaucugaagaugccauucagugguaaagagcauuggcugcucuuccagagggccugaguuuggguucaagcaccaacauuguguggcuuacaacugccuaacuccagcuccaggggaucugaccuccuuuucuugcuccacagucaccugcauauaugcacaggagcaugaacauaaauacacagaugaauaauaaaacuuugaagaauaauaaaauuugaugacuauugucauugcaauugcaauauuuccuuuaaagagauucuuggaaucuacaaucauuccuuuauaaagaguacaaauugaacaucccuaaugcgaaaauuucagcucuaaaaugcacaacucuuugaguacuggcauaauggucaaaaguuuucagauuuuugaguauuuuaggauucuugacuuugagguuaagaaugcuuggcuaguaaauccuaagaaaaauauuucaaaauaaaauucugcuccuacucaucucacauggaaugcucaagcuguacuugggauguuguguuccauccgaggcugacauuuagcuuaaauguaaguuggcucagauacgggcccuuuuuguuuccuugggaacuauacauuaaaaaaacaaacaaacaaacaaaaaaacaacaccaaacauugaaacaaguccuuaugagcggcuaaagaggaaaagugugucaauguauauccugcucgcuguugcaggguugauuuugguggugaaaggaggcuuaugagcaaaauacauacagauggcuaacuuaucccuagaacucagcgucuaacagaggaucacucuuaauauggucaaauaaaaugccuaauaguguuggaaaguuauagauauuucagaauaaguagcacaagguccaagagggcaaaggaagcuguuugacauuaaauagggugggcauguuaggguucauugaccaggggggaaugagcaaugccacgcagucacugaaggcauuaacugugcagaucuuagcagaauccacuaagaguagacaggauagucuuuacaguaggccugugugccuggcccucccauuuugaaguugugugagcuuagcuuuuaaguuuauuagcuuaaaaacuuauauuauaguauggguuccucauguauaaaaguguaacaauguaagaaaaguauuauuaacauuaagagauaaguaaacggacccgcccccacuuuauucucauguggaacucuguacuuuguuuucacaguauaugucccagcuuguaauuaucugcauuaugguuugauaaaguuuaucucaucccuucugaaauauugaugggaaguaccggucaguauaguacuauuucacuaauauacucucacagacagccuugaaaccuuucgccauuuggaguuaucucuuacagauuuguugagaguguuuuguguuuauacagucucuuuaaauuggggcuuuugacuguaucacaggcauuagcucauuagucaccacgcaucucugugaugaaagcaguaggugugucucaucugcaccuuaagagcacuaaggcugcugaaucacagugacacaaaaucaaagcaaauuuggaucacagcugacauuugguucauuuuucuguccacccacuacacacauacaaaauucacuuaauaugugugaaaaaaaagcacgcgcaccauaaaucauuagauuuagccuuuggaaacuuaugaggaaacaugaaauuaauauucuaguuaugacuuuguuuccaaguuuucucuuaguacuccucaaaauaucugagaagaggugccaaaaaaugauucguguuuugagccuuuauucuuaagaacauagugucucuggggccaaaggaguucuuuuugguguggcuuuguggauuucagauuuacuuugaggauauauagucacaugaaaugguaggaguuagaaaauauguagcaggauuggggauauaguucaggagauaguggaagggucuuacuguccaugacaaggcccuagguacaacccccagcacuaggggaaaugaauauggcauaaauuuacuguagaucaggauaaagaacuaaagaauugaaacaacccuguugauuuguugugcucauuccccauaggacaaaacaaaagcauaugccuccaggaacaaauggaaggcuguuuauuagucaguugcaacaacguugcuuggcuucugaauuuaggauauccucaaguaugcuuugaaaacugacauaaugugacauaauuuguguaauaaccuccaaaaaauucuguccccagauugugaccuagauuuugauuuugauuaguaucuuacacaguguacagaucacucucucacaccacccccaucccugccaaaaaaaaaaaagauauaauuugguagcuuguaucuaaaauaguaaauguaccuuaaaaaaaaaaaaaaaaaaggaagggaguagauuuuugagcuguuuagcucugacuugccuccagucuuccugucuuagauacccaaauagcugguuccauuuuguucuccuaguuugcagguuacauuuuguuuauggacuucaguguaucuuuuauuaauguuuagaacaagaaggcagauaauauuguuaaggacuucuugucuuuaaagggcaucccaguauaaaccccuagagugcuagcuucaucauuuuaucuguuaggauccauaauauauuuuguuucauaauauggaaauacaaaaaucaaagugaaacuuuggcuaaagagaguaucuaaaccagacagaaugggcauauucagggcagauuuuuauuuuuccuugaguaaaguaaguaaaguaauaaacuuuacuuaagcuuugaugugggaaaugauaagaaauauuuuaucaauagauuauauaccguauacacaaauacacagaaguaaagaaagaaaaaaaaucaugccuguauccggcaccagcacgugcaggagaauaaaugaguagagaccaugaugcaguaugguaugcuaauucaagaggguucacaggacuauugaaaaauguaaacagauaagugacaucaccuggcagaggaauucagaguauugauuugauauauaugggguauuauauugugauugcacagugauuuuauagugcccgauggaaaauaguuaagaaauggcugagaagauugguggaagauacaggggaaaaggguacugguuuaaugugucacaaaaguacaagaaaaauacagauugaccuauuuaggggguaaaguuuaauggagggacuaaaaaaaccuuaagauuuagcuagguuuuggugucccuaguguguaaguggcaguuagagccuggagauuagccaaacaugacggcucauuccuguaaccuuagcagacuugagacuagcuuugguuggguaguagcggggugagggucuacuuuuggaggggggagaauugagaguuucaguuaaauaaaaaagcuaaaaaucaaaagaccaaucugucagaaaaauaaaauacuugacauugagguugcaaauuagcuuaagaaggaaggaaaggacaauaguguaacauaugugauacauuaggugacauacagacucugugcugugcuauuauaagagguuaaaagaagagguaaauacgagaucacaguucauuuuaggccugagaaggagagauuugauucucaagaaaucagauauaggagucugucucuguguguguauauguguguuuaaaaaaaucuuuguuuaacaacagaagaaauacccgugacugaugaauagggaucgccgagagauugauuaucaugaguaaaacucucaggagaaaaaagacaaucaugguuugauuaauuucuaauguuuagaagaauggccaaacacaugccuaccagcuaaaaacauuuuucuggaucuaguuaguauauacaggcuuggagacuauuuaucuuuccagcagagcuguaggucgaagcugagaaagggucacuaacguaugaugugaauguguuuaguuccagaggccaggccccagguuaaaaucugauguauuaggaccaguuaguuucuuugcaaaaagucugucaaucauuaucacuggaguuguauucugggaacucacauggucuuaacuuuaacauggauacugagguguaugcauguucucauaaauacaaauacauaucugugaacauagaugaguuuaacuuaauuuuaauugcaaaaaaaaaaaaaaaaagaugagaauagccgggcaugguggcgcacaccuuuaaucccagcccuugggaggcagaggcaggcggauuucugaguuugaggacagccagggcuauacagagaaacccugucucgaaaaaccaaacaaaaacaaacaaacaaaaagaugagaaugcuauuuagguuuugccuaguaaaucacuuuuaaaaauucccauuguuuauucuuuuuaauaguguuuugauuuuuuucgaaaagauagcauuucauauuauaaagguaggagaaacaaccucagaauagaaagcauucccuuaagugaaaucgugguagcuuaaaacugauauacaacuccccaauauuagacuugacuggcuuuaaaaagauaagcaagugaaguuagugaccaugcccauaacccaauacugaaaggcuugggugcaagacucugagcuugaggccagacuaggccacauuagagaaacugucucagacuaaaaguaaugaaauaaauuauguccauauuaaauuuguuuggcauaucgaauuuguccagaauuauuuguuuucccaaagaauagcgaaacuuuaucacaaacuagcaacucuccucaaacuucuaccgccuguaaauaaauaauuaugaaagagcaacugugugcaaaagcauaggacauuacugcuucacagcagagcccauuaggacuaaagaucucauuguguucauaaaaacagcuggauuucucugagcuuguuuguuuguuugcuuauugggggauggccgucgcugucguggcacucaauaugcagaacaggcugaccugaacuuagagaucugacuaccucugcauccuaaguguggggauuaaagauguggaccaccacaccugacucuuguuaaucuuuuaaugauucugcucauuguugagcugccaaaaaggaaaaaaaaaucaauagugacaaacugaaugaaguaacugaaaaauauaauucuuaccacuuccaucuauucugguaauuuguguuuucagguuuccugccagugaaggauugcauaagugucugauguuugcaucugccaguuacaguuuugaaaaguaaugacagucaacguguaauagcucaacacacaccauuaauuccaguguugaggucuccaguaguuacagcugaccaccuuuaauaaaugaccaggaagauacuugucaaauucacagcuuuugugaaguuaagggacaucaacuuaguuugcaucaacuaagggacaggugcuagcccaggacugcaggagcagguuacucaaucuuuuucaagugcuccucgccauuuaaaaacgaauacuugagggaggucaguccugccucuuagcacacauuucagaauuguugcaucaucuaaaaaaaacuccucaacaugcaggaauguguaauuuucgccaacuccaagcuucaucucuucaaagaccaagcugaccaaaaccugccaccuaacacacacaucacagcuggaaguguguccuaugggaaggaagaggacuaucugagauuuuuuguuguuguuuguuuguuuguuguuguuguuguuuuaaauguagcccaggaugaccugaaagucaaaauccuguuucuguuuccccagugcuaaauuacauuucgaacccuugccuucuccccacuauccaagugacaaccuuuaucauuauacauauacacaugggguguguguguguguguguguguguguguguguguuggggagagggguaccauggcaggcuucuugaucagaugacaacuuugugaaguagauucuguccuuccaucuuacaugacuucuaggcauugaauucugaucaucaaguuugaacaggaaaaccuuuagacacugagccagcuuguugcuuuccuaaauaguauuuuguuuaaagauuuauguuugauuauuuuuauaaguucuguguaaacuuggaggagguauaagcaugcgagugucaggaguccaugaaggccaggcaugccaaaucucucuggggcugaagcgacaggcaguugugaacacccaguguggauccugggaacagaacucagguccucuuguaagcacauuacgugcucuuggacuauugagcuaccucuccagaccuugacucccaugacacuuucuuguuauauuuucuuguauuuuaaauucugugucuaugugcuaguaucugugugaguacaugggugcaggcgcccauggaagucagagacaucgaauccccugaaacuagaguaaaagcaguugggagccaccugaccugagugcugggaacucaacucaggucuucugcaagagcaauacaagcuguuaacuauugagccaucucuccaaccccucagcugaaacuuugaaaggacacugcagccuuauggaggaagacauaauauauaguuugauggauaaaacauauagaauugcuuugaauauaacugaucaauugguaugggauuuauguuuaugauguaguuaauuaaugaagccuaauguagaagguaaauguguggcaggcaucacaauguucagcuaugugugaacccugcaaacuacaguagugcacugaaagugucaagagagguagagaggugagcuaagcccaauucauacaaggccugugauaaacuguauagaaguucaguuucauugcaacuauggagggaagcuaucaagguguuuuguuguuauuuuuguuucuguuuuuucuaaacgggaacauuuuauucacauuaauaaaagcccagaaucuuuuaucuuucuggaucauccuuacuguauuucuucucaaugaucacaagaugaccauuccacaagaaagugauaaccaguuuggcuaguuuugucuucuuuuaaauauaauauuucauuacuucuuugagaauuugcuauguauuuugaucauguccaccccucucuuuccuccaacuccccagauccaccuucuccuuccucugcuuuauguucuuuuuuaaacuuuauauugaucauuugugaaugucaugucaugcaccccagggccacucaucucucagucccuucccaaccacccucugccuuugcagccuccccccccccaaaaaaaaaaaacaaaacaacaacaacaagaauuaaaaagaaaaaaaaaaaagcaagagaagaaaaaucucgccugcaguuugccaggcugggucacacagucuaccuuuuuguucaaacuacuuacaaauguuuuuuggucugguuucaggcuucugcuacaccaucaauauuagguccuuaucgugacuacacucagauauucuguuguugcccagugucauggagacccugcaguuuugguucugcaggauaagccccuucauguguuccagcuguucauagaugggguagaugguggggugggccaacucaaagcucuggaucugggccugugugguagcucaauuggucagccuuccugcacugcccaggcuugcuuacccaagugcaguugccagcaaggggcagagccagaucucccacuucugcagaugauggaggacaaggacuaucaagguguuuuuaaagcaggcaguugaucaucuuuaaacugucuagauucaaaggacucuugaguagaaaaaacucacacucacuuuccaaaagguuuucguuuguuaugcccaguuugaauuguucuuucuuuuaccagucuuuuuaucaaaaaaccaggaacuauuacagaagaguagaaaagaaaauaccaauaaauacauuaccauuuaagaaugguaaaaauuucuuucccauuuacuuucaauuuuagaauuucaagaucuuuagaucaauggaaauguccuuccugugauacuauuuuggccuguauucaguaguguuccaaaaagacuguuguuuuucugucuggagauaucauaauuaauaagcuuuuuaaauauacuuaauauuuuaauggaauaugaaaucauauucuuuuucuguggaagcaagguaaggaagagacccaaucuaguaaagauguuaacaugaaauaugucccuuaaaaucuuuguaauggucuagagauauaguucagcaagugauacagcuuuuguaaagaugaagaggccacugucuuagcguuuccauugcuguaaagagacaccaugaccaaggcaaaucuuaaaagaacaacauuuaauuggggcuggcuuacagguucacaaguucaguccauuaucaucaagguggaaagcauggcagucuccagauaggcauggcacucacuggaaaaggagcugagagcuagggggagggucuccaagcccacccccacaaugacacacuuccuccuaauggugccacucccucaaccaagcauauacaaaccgucacagucacccauaguaaaugcuugcuuuguuuuucucuguuucagagauaaacaauggugacuauccacacuaaagauucacaauaccaucagguucaucuuacauaaguugucuuaacuaguuucauaaauuuucauucccucuuuguugcuuauuuuucuauuuauguggugauaaagcaucauaaccaaggcaaguuauaaaaguuuauuuaggcuucccguuccagggguccuugacagagcaaaggcauggcagcaggagaagggagcuaggggcucacuucuugaacugcaaguacaaagcaaagagaacaaauuugauugguauguuuuuaagcuuucaguguccaccuacauugacacaccucuuccaacauggccacauuuccuaagccuccuuagaaauuaccaccaagcauucaaaugcccaagucuaugaggaauagauauuugacacccugguccccacagucuuugucacggccuuaacacugaguucagacucuucugagacucaagauaagcacuuaauuguaagcccuauaaaauaaaaaaaguaaguuauauaguccaacauacagugacauaaaacaugcauugccauacugaaaaggaaggauuaggaaauagcugaacaaaaccaagauggaaacucaaacaccaaauccagcugguccacauucaaugacugggauuuuaauuuuaaagggcucacauggcuuuauuccuccagcuuugcucccugcauacauuucucucacuggcuacguuuccuauaugcagcucuccuuggcagauacuucauagcuuuggcaucuccaacauucuuguguauccaaugcaaccgaggccuuaccuccacaguuucaugcagugccagacauugccuggccucauuggaggaacaauccccucuacucuugcauucuccaagacucuaaagccacuaccauguggaccacacugcccaccugccagcuugggaaaguugcuccccaccccaccccaccccacccccaccccccggccccaguugcuuuccaggaccagaaaauccccugggcuuuuuuccuuucaaaguccagccuuagcuggguggauacucauaccuuuauuccagugugaaucagaucuuuuuuuuuuuaauauuuuuacuacauauuuuccucaauuacauuuccaaugcuaucccaaaagucccccauacccucccccccacuucccuacccacccauuccuauuuuuuuggcccuggcgucccccuguacuggggcauauacaguuugcaaguccaaugggccucucuuuccagugauggccgacuaggccaucuuuugauacauaugcagcuagagucaagagauccaggguacugguuaguucauaauguuguuccaccuauaggguugcagaucccuuuagcuccuuggguacuuucucuagcuccuccauugggagcccugugauccauccaauagcugacugugagcauccacuucuguguuugcuaggccccggcauagucucacaagagacagcuacaucuggguccuuucgauaaaaucuugcuaguauaugcaauggugucagcguuuggaagcugauuaugggguggaucccuggauauggcaguuucuagaugguccauccuuucgucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagguuuuggacuaguauccacuuaucagugaguacauauugugugaguuccuuugugaauguguuaccucacucaggaugaugcccuccagguccauccauuugccuaggaauuucauaaauucauucuuuuuaauagcugaguaguacuccauuguguaaauguacauuuucuguauccauuccucuguugagggacaucuggguucuuuccagcuucuggcuauuauaaauaaggcuguuaugaacauaguggagcauguguccuucuuaccgguuaggacaucuucuggauauaugcccaggagagguauugcuggauccuccgguagugcuauggaaucagaucuuucuuaauagcuucuuuccagcacaugccuuagcuauaaacauuaaaauugccaguuuuuguuucaucuucaaacuguacaguuuguauuucuuuugucccauuuguuuuuuuuuucauuauauacccucaugagagugguuuuacuaauaaauacucaacuagacaauacuaugcuguccagaaaucugcccccgcaauaguccauugccccaggcaaguucuuaggacauggacagaaaacaaucucguauuugccaaaauaucacagaaugucccuagcccaguuguuggugguguugccuugaaaccaggcuuccacagacuauuuuuacaccacugucuuacuauggugauacacuaggcucuucuuauagcauuuaaccacuuuuccaguccaaaguuccaaauaccagcaucuguguuaguuacucuuuuauugcugugauuaaaaacccaugacuaaugcagcucaacagaaggauuuaccugagaugacagguuacgguggguuagagccuaggguggcggaaugaaggcaaagcagcaagaagcugagggcucacauugcaagcacaaagcagagggaacagacgcaaaguagcucaagucuuuaagcuuuugaagccuauccacaguggcacaggccacaccuaaaagagugccauuaacugagaacagagcauuuaaaucccuaagucuaagaagagauguuguuaaaucagccaacccuucccguguugccuuauuuggccaacacuuuagagcaguuuguuggccuguuagcucuggcuaaaauacuuuucacaacuucccuaauagucauuuguaaaagaaaaacaaauauauuugcuauguucucccugcuugccuccuuuaaagggagacaaaaaucuuaaaugucaacaaauugugauugucuucacaauaugaggaaaaaaauucuauuauucauaauuuggauaaauaauuaagauaauuaacugaaugguaucacuaacacauuuuauaauauaaaugaccugacaggcccuuauuuuuaauacuccuuuuucuuacuaauguauauugggcauaacuucauacuguggguugguaucugccuuagguuucauuuucacaaucuuacauugaagccuuaacauuuugguguauaaaguuauuuacauuuaacauuaugugagucuacaugugauuguuccacuuaaaucuuggaauaacauauuuaaauguagagccaguucuggcuagguaaaaugugcccaguaaugcaguagugauaagugagucgugggacaacggucccuuucuacuuuuacuuaggaucugcuccaaaagaaggacaaaaaucacacccuccuagaacaugagacaagucauaguuagcagcuguggacaaucugaaacagcuccuuaacccacaccugggauuaagacaaaaccauauuuauauaacauaccugguuugguuugguuuacuuauucacuuugcauccuacucacugcucaguccuggucauccccucccauaauccuucacccuaccccacuuaacugggaguuuaaagaaaccaaaguucccacuacagagaugcacauuuucugccucucaaaugcuggaauuaaaggagugcgucacuauguccagcaugagauguuuccuuuugcaaugagcagcagugacugcacaaacucauacuugcugaaaugaugaaaauaaaugacugaacaacgcucagccuuaaauggaacaucuauauaacuuuuuccauggcuaggaagaaguuauauuuaaaaagaguucaaaaaaauguaaaugcuggaugagaaauaauagagcauuaugaaacucuuauuccucaagcaugacaugacuauuggccagaaaagaaaaaaaggaaacagaaaagaaacuucaguggaguaaagcaacagauagcugaguccugagaagaguacaaugcauuuagucauuuggaugggaaggaagucuuaggcaugggaguacugagcuuagaguuuagaucuaagaacaccucccuaauggcagccuguaaaauccguaaguauacugucgaagcuguggguagauaaaggcuaaaacuugcaaacaguaguauguaaucauggaacugaugucugcccagagagcccugcauucacuaaaagacgguaaagggaggaacauaaauacaugcuucuccuccagccuccccuacacccccagccuagacuucccguggaacccuuacauguuaucuacuuaaucuugcgaguagcaguuuuuggacagugguguuucacucucacuccaaggguaucuccugcaucagcucuaguucuauaacuuccagggcuugggaaucuacccugcccaggacuuaaaguguuauaaaagaaguuauuuuuacaauauaaaggguuuugguuuugucuuuuguuuuuuguuuuuuaagagguaccauuuucaaguagaaagcacacauguagauccagagauuuuuuuuaaccugccaacuaaucuuucauguaaccaguguacacuguagauagccaguuugucugggucuaguuacuauuucuacuuuuucucuuuucuagguguaaagucaaggcaggguuagauggccuauaugcuuugagccugaaucuaagguugauuuaaagguucaagcccccaagcugaaauaucucgagguagaagguagaaggaagcagaacagaaagaaagcaguugagcagaaaccaggaauguuaaacuagagcaagaggguucaagaagaaaaauguagaguacugagauaaggcccaagggcuggaagcucccgaguugguuuaugugccaccaccaucauucgcucgccauacucuccuaaacauguacagacaggcucccaagcuuccagagaaccaacucauuuggcugauaggaccccuuacugcaacagauuuauguuagacauugcuucuuaguucucaugccaacuuugcaagaucaguacauuucuguuauauacauuauccaaggcuuauauaucuacauuuguccucugguaguugaaagugaauauaaaaugucagagaaaaaagaaauucaguacauagcaaacauugugcaauuaauauucaguacuuucugucucuuaaacagcuuuguuuugugagauagccauuucucugacuucacucucugacauuacagcaucaggcaggaaauuuuuguuguuguuguuuuuaagacaggauauacugaucaacuuauauaguucaaccuagucuuaaaauugaaauccucuugccuuggccuccugacagcuggaauuacagguauauuucacuacauggcuacuauaauaguuaacagaggggaaaacaacaagacauaggggaaucugaaaauaauguaauuauuuuauauaagaaacugauuuuucuuuacuauaggaagaauacucauuaauuuguuguauuaauuuauuauaaucuuaauacaaaaauguaaugagaaagauaauuuaaugagaggcaaggauacguuaaguccauccucaaucuuguauauaaguacaauuuuuguuuguuuuuguuuuuuaagauaggguuucucuuuguagcagcccugacucuccuagaauuagcucuguaguccaggcugaccaggcuggccucaaacuucuagagaucggcuugccucugccuccccagugcugggauuaaagguaugugcuaccaccuaacuuuagcaguguguaaauaauuuacauuuuaccuaaacaaccauuucagaauagaacauuaguuuucuagcauuuacuccauuaaaacucucuggaaacaagggaaggaaagaaacaauauuuucugcaaaggcaugugaauuucugaguucgaggccagucuggucuacagagugaguuccaggacagccagggccacacagagaaacccugucucgaaaaaaaaccaaaacaaacaaacaaacaaaaaaacgaaaacaacaacaacaaaaaauuuauuucauuuuauguguaugagugucuugucugcauguaugacugugcaccacaugagugcuugguuucagauccacuggcacugauauuacaggcaguuguguugucgucgugagugcugggguugaacccugcuucccugggauugagagaacauuuugugcucucagccucagagccaucucuucagcacccagacuuuuaauuuaugaggaauacauuuuaauuuuuuuuuuauggaaaaaguuauccuugaaaagauugcuauccauuagauauuguaguguaugcucguaauccucguauuugccaaguggcaaccaaccuggacuaccaagcaacacuguaccugagagggaaagaaaagccaucacucuuaaaaccaggcgcuuguuugguaguaaucuaugucagagccuugguaaaucgagaaaauauaaugagcucauaaguaucaguaauagagauuuaagaacuauaguagaguugcuacauaguuuucagaagggaaaaacuuacucuagaaugaauacguagacuccaggauuuuaguugcucacgguugguuucuaggcucacugcuauucauuagcauucuacgcgucucauugguuucauuaaaccaucaauucaucuaaauaauacaaaucucuggggugcucauacuuauaccuccaaauugaugauaguauuuuuaauuccugguccauggggugaauucagggccuuauacacacuaagcaagcacucuguuacugugcugcgacuccagcccuugcucuguuucugguacaguuugggaaacagacauuuauggcgcacgccucuaaucccagcacucgggaggcagaggcaggcggauuucugaguucgaggccagccuggucuacaaagugaguuccaggucagcuagagcuauauagagaaacccugucuuggaaaaaaaagaaaaaaaagaaaaaaggaaaggaaaggaaaggaaaggaaaggaaaggaaaggaaaggaaaggaaaaaaaaaaaaaacugaaccggauuguuccagagcuagugccggugccgugcggugccgugccggcauguucucaccaagcuacucuccccagcuagcccccacuaugcccgaucacugcacucccagcccuuguucgcuugucccuggagccgcuaguucuuccucagccagaaacccguguagucagcgaucccacauuccaguaacuaaauggaaccgccaaccucgugguugcauaucacaauacccaauaaccagguaaaaucaagauccuuaaagcuuaacuaaccaauccaaucagauuuauguaucaauaauaucacaauuugcaagaagccaguacaauaauuucagaaccaauugauaaugauaaagcuuuaccccaacuauucuauacucacaacuacuuguggcugguaaacgccauguggguucacaucuaccgccaucuuagaugcuuccugucucugcaacucuuagcuccgccucccuuuucccuguccaaucacaggccuccucugcacuaauauaauuggacagggaaaauccugauacauguguccaaagacuuccuaagauauauauacauuugaagacuaccuuccuuuugaaaaagucauagcucagaaacgucaggaaagaaaagcaaaagagcugugaaguguaaacacaguuuacuuguuuugucaucaugggaucaugugugugugugugugugugugugugugugugugugugugugugugugcgcgcgcgcgcgcuuacauguaaguuccaggauaagcacagucauuuggaaagcaacugggaagugagaagcucuguucccuaccuuuggcaccucuguucucugcaccucauuaccuaccucauccucacaaccuaaaguuguaacucauuaguuguuaaauguacacguccuuguaggcuggugaaauaaucaguacagcgauuguucuacaaguaugaaaaccugaguucgauugcuagcgccuuuauaaacccaaggcguuggcguccagcauuguaaaagugaagacagaucucuggaccuugauggccaacguaaggcacuaugagaaacucuggcucagucagugagcaugggagaucuuuuuuaauccuggugucuuucucaauuucuuuuuaaacuauuuuuaaguuuucauuauagaaauguuucauauccaugguuuaguccacagguuuggaguuuuuauuggggugggggcugucccugguugguuuuagacaauggaaauguuucucagauuuuuggggggcguggggggggguguuauuaguauguugaaaggcuguuggguuuggauuuuggugguuguuuguuuguuuucuuuuuuaaugcguuaauuuuguauucugcuacuuugcugaaaauguuuuaucagcgcuaagaguuuacuuguagagucuuuagggucucauauauagaaagagucaugucaucugcagauacacguuggcuucuuccuuuccuauuuauauccuuuuuauuugcuucucguaucuuguuuuucauuuuaguggaaaugcuuugucuuuccccauguaauauaauauggguuguaggugcuucauauaaauauucuuaugguuuugugauauauguuucuuuuaaguuucuucaggacuuuuaacacgagcagauuggauuuugucaaaagucuuuucugcaucuauugauauagcaauggaauuucaauucuugagucuacucauguaauauaaaauuuauugauuuguauauauugaaccauugcugcaucuccagaauaaaauuucucaaacuugacauggucucuucuuuuguuguuguuguuguuuuuuuaauccaauuuccaagcauuuuugcugaggauuuucuguuuuacagaauggcuugagaagcauugggcauuaguuaauuacauugaaggucugauacaguucaccaguaaauccaucuuggccaggacucuuuuuuuuuuuuuuuaaggguuuuaauugcuauuuaaacccuacugcuuauuauagaucuguuccagcuagguuuaacuuuguaaggucauauuuaucuaggaaugcauucuuuuaauauuuccaauuuaguggaaguuuaguuuucaaggaacaaucuaauguuuuucugaauuucuuugguaucuguuguaauggcucccucuuucaucucuacuuuuauuaauuuggguucuuucucaguccuuuggcuaagauuuugucagucuuguuagucuuuugaaagaauaauauuuuuuuguuauggauuccuuauucuugaaaacuucacauauuucauacaauaaacuaugauuuuauauaucccauuuuccucuuccaacaaucccucucuucauguuccuacauacauacguccuuccuuccucccucccuuccuuccuuccucucuuuuucucuuuucugauaacccacuaagucuuuccaguacugcugugugcauaugucuggcaccauccacugggucauaggaaaccugucaauaacuauauccugaauuaagauuacauucuucuuccuucagcaacuauccacagcugauagcuccucacuaugggcagaggcuggaccuggagaucuuugcugacugaaucuuguacaagucuucacagcugcugugaguucaugauuguuacagccauaucuuuuccagaagacuaaauuucucaggauuuaucucaguccuccaucacuuaaauuuugucugcuucugagcucccaguuuauuugaucuucuuucucagucugagaucccagcccauaaaaugguacucuucacauuuagggcggguuuuccugccucuggguaaccuagccucaguugauucuacaagcauuugguggugaugagagccccuucuaaaaaucagcuaugacucuccacuaguuuuguucucuauuuuaguaguauauccguagucaguuuuucuucuuuuuuucucugugcucccuugaguugaggacugaaaaauauugaagauugaucauagcugcuuuagauauacaaacaauuuuaguggcucucugacuugguaggcauuuccuuccaugacuuaagugggucagugcccuucugaagccauaugucccaguggaugcccaguguucuucuauuauaacucuuguuccacuuugucuucauauuggugguguuccaaaagauucccccauugcuuguuucauaccacuacacuauuaacuuuauuugucauugugauuugaauucucagugagaacugaguuuuacgugagccaugaacuauaaacagaaauaauagguuuguaauaugaaaggauuauuaucauuugguugaacugcuucaggggcucaaaaccuuguuucugugugaaugugacaaugauuagugucuuaccguggcucacuugugcaaauuucuuuucucaaacugauguguaagguguuuuugaguaucaggagauuaauaugaaaauacacacacacacacacacacacacacacacaacaccacauugcuaaccaguaguugucuccaaaugcucuuguuuauuuaccuuuccuuaggauucugaguuuccaucaaguuacacaaaaauuaccaacaaaccuaaacacacauucuaucuugauuguggauagccuuaaaugguuuuauuaaauaggaugaucacugcuuuggggaauauacaauacuugagucuguuuccagaaaucuuugcuucacuccaggauuuaaaguguuuccagagcaaugucauuaaaccuauuugggaggguucuugaaauuauaguuaauaguccuugacuaccaauaauacuuacauaugucuuuguuauuguaggagagugcaauguccacauuaagcuauuaaaauauuugaugucucuucuucuuuuucagaagaugaauaaucugucauuuagugagcuauguugccucuucugcuguccaccuugcccagggaaaauugcuucaaaacuagcauucuugccaccugauccaacuuacacacugaugugugaugaaaguggaagccgcuggaccuuacaccugucagagcgagcagacuggcaguacucgucccgagaaaaagaugcuauugaguguuucaugacaagaaccaguaaaggcaacagaauugcuuguauguuugugcguuguucaccaaaugcuaaguauaccuuacucuucucacauggaaaugcuguugaucuuggucagaugagcaguuuuuauauaggucuggguucccgcauuaauuguaacauauucuccuaugacuacuccggauauggugcuaguucuggaaagccaacagagaagaaccuguaugcagauguggaagcugccuggcuggcucuucggacaagguaaugguuuuuacccuuaugcugcauaaguuauacuguggaacagcgaaacagaaagcauuuuuaacacggaugcuuugaaaugcagugugaagauauuugcauaauuguauuacauuaagauaguaaaauuuuauauaauagccaaaguagucuugacaaacagcucgcauuguguguguaaaugccugugugggcguguguuucaggaucuuuuuuauuuaaaucuaggaauauuuaaaguuucucucucaagcuuucuuauuaggauauaauacacacauccuuauucugugauuucacuauuuguuugcucuggcauugauaauguaagaagccuuuuguuugacuuuuauuaaauaagacauguuggcauuuuacuuuacaucuuagucuacuaaaauuuggaaagaucaucuuaauuuucuuugaaguaauaugacaaaauuaaugaagaugugucucacuuaugucauucuuuaacgaggacagauuguauuugggaaguagaaacccauuaacuuuucugggugcaaguuuuauagauuccugagugguguucuucauaauucagauuaguauacaauaaauaguagauaccuuaauauaaaugguuucucauuacauauugauaaccugccuuuuccacaguguuuaaacugaagcuguaggcuguaaagaacccacuuuuccuggucagugccaaugcugaggaugucagggagacccuucauuucaugacuuugugcagcuaccuugggggaugagugcuggauuaaaggcaugagcuaccacagcccagcaguauaaccacuuuuauaagaugucuuuuaaaauauuuccguuccaauaaaguuauguccucauagcaaaauucuguguggagggaacucugaaaucaguugcaguaauaugaaagcauuaauuugaaaaguaagaaaaaguaaauguaagugguaaauuauuaacagagugauaaaauuaacuuuuggggcugggcaugggggugaaugcuuuugggaggcagagacagauggaucucuaugaguucaaggccagccuggccuauagagugagguccaggacaacagggagaaaccugucuucaaaaaaauaaauuacuguacagggaaggaaggaaauuguguuugguucucaauuuuuuauauaaaaauuuauauuaaaauuuuuacauuuauauaacagucaucuuuaaggacguuaucaccauuuaacagaauaaucaccacuuauuagaaucucccauucaaaucuaauacaacugucagauauuauaauauuuuuaaauugagcagcugaauaguccgugcauuuaaggccagccugggcuacauagugaacugaagcugaagcugggauguacugcauaauaaaacagucucaagagaagagggcaggcaauaugcuuggcauggugggacacaccuuugauccuagcacuuuggaaguaaacucgggcagaguuccaaguucgagacugccuuagucuaaagagcaaguuccaguacagucuggacuacacauagaaaccuugucucaaaauaaaauaaaggagguaaauguuaauaaucauacaauaauuuaguuauuaagguacaaguuggguguuguaacucacagcugcaauacucauaacacuaaaggauguuuugguuguugaugcuucaugacaguuucucuguguagcccuggcuguccuggaacucacucuguaggccaggcuggccucgaacucagagaucugccugccucugccucccaaguguuaggaucaaaggcguauaccaccacugccuaguuucauaaaauugaaguuuuaagacuuuggcaauuacuuuucuaaaagauuagaagugagcaugaaauaauugaguagagagcuuauuguaacauuagaaauuaugauggcuaaguaauuuuaguuuuuaaauauaaauugccaucuuaugagauauuuuguaccaaaucuuuaaaacaauggacuauuuacuuccaacuguuuuuugaacuugugaauuucucagauacggcauucguccugaaaaugugauuauauauggccagagcauagggacagugccaucuguggaccuggcugcucgcuaugagagugcugcuguuauucuucauucuccucucaccucaggaaugcgaguugcuuucccugauacuaagaagaccuacuguuuugaugcauucccaaaguaaguucaauauucagaaucauugcgcaccaaggugucccggagcuucugcuucauguaacggaugacgucagaauguggcagagacuguccgcgugugacugagaaaaagacugaaguguuugagcaugagaugagggcguuuuccuaacuaagcaguguacuaguccuuacacaaaagaacagaccugugaauguaaauuaacagaucaaagcagcagguuggaugugggagguucuacaaagaacaacuugaggaaggccgcagacuugcuguaggugccaaaacaauaugaaguuuagugagaggcacagcaugagagaagugggcgaaggugaguaaugguaccugccaguuguaugugccaagaaagucaacucuugaauggcuggaauaagguuagcugucauacaucguauggauguauuugaaaggagaagggcuguuucuugcuuuccauggugaagagugguugccaccugacaucuuccuaguuggaaaaaguuaguggccuauuuuucucaaggacaaagagaaggcaagaaggaaaagcuggcgguuucauuuggucuucuuuccucuguuggcagaaauacaaagauaguuuugugaauggcaggccagaagccaaggugucauuugcuucuuuaacaggaaagcaaacguuauucagaaacaguauuuauucugcauuaggcuagaggugacuuagcugggaacgugaagaccugagcucaauccuuaagacccauuuuguuuuaaaguaggcauaaugauacuuguaaauaccuggcuggugaggggucagagaaacagguaguucucgggagcucccuggccacugaaccuaguuuguuuaacugaauuacagagaguuggugagguggugcucugccaacuuauucucugaacuuuuuucauguuugacauacuuagauauuucucaggaauaagcuaguugaaaaagaaaauacacuauuugucuuagucaggguuucuauuccuacacaaacaugaccaagaagcaaguuggggaggaaaggguuuauucggcuuacacuuccauauggcuguucaucaccaaaggaagucaggacuggaacucaagcaggucaggaagcaggagcugaugcagaggccauggaggaauguucuuuacuggcuugcuuccccuggcuugcucagccugcucucuuauagaaccaagacuaccaacccagagacggucccacccacaaggggccuuuccccuugaucacuaauugaggaaaugccuuacaguuggaucucauggaggcaucuccucaacugaagcuccuuucucugugauaacuccagcugugccacguugacacagaacuagccaguacaguauuuucaccuugaauuccucuaaguaaacauuucugcguuauuuauuuauuaggauauagagccuugagagugccaagauuguucaucaguuucacuacguaacuuauuccuuuauaagauuccaucuuauuuguaauuaaaguguguucucuguccagaggggggaaaugcagaaagcauguuuguaagauuucuuugcauaguuucuuguugcgggaaaucaaaaagaaccaacaaguucccgugcuccauccagcuacucucugccagccaacuccccagcagggccagagcuccugaguucccuucccugccacaccagccccacguaaccaccguccacccugcggucagccuccacaacacccagcaacccuguagaaacaaaacucuagaugcuuauaauuaacaagucagauaaauucucaauucauacaauacccacacaauaauuucaaagccaauugauaaugauacaagcugcccaccuagaucagacaaguuauaucccuauauuauauucguaacuaccuguggcuauuaaagccacacuaguucaggaucuucuuccagccgccuccaucuuggcuuccuccucuccugcgaugcucugugucucugcaacucuuagcuccaccucccuuucccugcccaaucacaggccuucugcugcacuaauauuuuaauguaauuggacagggaaaauccugucaguuucuuuuuccaaguugccuuucuaaaagucuguuuugaucucuaucuuacauuugaaguguucucuucaauaucugaucacucaguaucugaauauucuuauguuaagaguagagaaccaaagagccacuuggauacacuaugcaaauaaaacucaaacucugccuuggaugaugaagccugccauuagagcauuuucagaacccaaacagaccucacugagccagccuguugugugcugugugacuguaguaccuuucacguaaacuggaguccuacaucuacagaccuagaguugaagaaaguuacucagcuuuuccaggaagucugagaaagaaggaccuuacuguguuguaaacagaguuugaaggauuccaucauguuucagcccccaccuucaucuccguggcaaugucuuggccagagcuaggguauuccauuguagccuggaggcugcuucacuuuaccuucuaguugauuggcauuguguuuuuaccugucuuacuaauauaauagcuauuucauagacucauccgauuuguagcuucaaacuauuuuuuauguuuuccucucuguuuuuaaccuuaaaccagaacaaacccaaaggauuuugcuugaguuuuaauaacugauagaauaaaauaagugcaguagggaaugaaguuagcccaggcaggcaugguccuuggguuaagaagccuaggggaaauucagcaucgaggcagcgcuuccauguaaggguggcaguguccaagcagagcaacugugcagagguaacuuccugcagcaccguagaggucauggaaaggauggacggccuuuggaucuuacugaaguugacuuccaucccuaaagcugaguuacuguacaguucuaauguuugaauuuucuguucuaacacaggaaacuuccuuuuuucuacaguucauugagcuuuuuuccuuucucuuauucucucuagcauugacaaaaucucuaagauaaccucuccaguauuaauaauucacgggacugaagaugaagucauugacuuuucccauggccucgcauuguuugagcgcugccaaagaccuguggagccccuguggguugaaggggcaggacacaaugacguggagcuuuauggacaauaccuugagagguuaaaacaguucgugucacaggaacugguaaauuuguaaacuacucuguaaauuugcagacuggguuuucuuuucuugcugaacugcacuccuugguaaauaacauaaaaccugaagguuuuguuuacaaaucauguaaguugccuucauaacuguacagguaaugauuuguuaacagacuuaaugaagguuuuaauuaccauaacuugaaacuggaaauagcaguaucaugcagucaggcuguguaauuuauauuuuuucugugaauuuuuuuuaaacaucaagaugaguacuguaugaaauuuuaauucuauaaaaucaaaugcuguaaaaguauugucaaaugcuuuugcauaucaaaagcaaauuuauaaauauuuuuaaacaucucaauguacuaaauauccugguauacaaauguaauauucuuucaaaaagcuguauaucuaaagcaauucaaguacucagaauaaacuguaaaaaacaaaacgguuugaaaacauccaaauugaguugauauauacuccacuguacagggauagaggcuuaaaugguuauuuuauuguuaaaaaaaaugcauugacuuuucuguauucuccaauuauaguacauuuauccuuuaaaaaaaugaagucuuaauuuuuaugccaucuguuaacuuagcagcucuucauccugucacugagaaguccugauggcgcuggauuuuaacuaguucugacuuauguuugguacugugagacaacuacuuaacauuuucauucaguuauuuaaaggacaguuagggcuucaagaaugauuuuguaugcaauguuguuuuaaauuugacuaauuauuagaacuguaguagucuuccuuauaugaauacuugaaacuccguuaguugaucuucaagaccacagagagacuggcuguuugguuccuuuccaccucugcuguuuuuaagaguagggccuguucuuuuggaguaguaucugagaaugucauggguucccuccugaaugcaggggauaagaaaacaugccauacauuuuauauuaaccaguauaguaaaaaaaauaaaauaaauaaauaaagcucacacacaaaaacuaaguugccuuuccuugaaugaauccugccugaaaaaugaaagaaaaauaaaaaauaaacuaaugguauauagucuuaauuuguaaugaaugagaaucaaaauaauacacacuguggauauguuuuuaaggccuuauguaauuuuaauuguucugcuuguucugugguuaugucuaagauuauaguacacgaucuucaaaguauaucaaauauugugaauccuuugguucagcuaugucaaauucacaguaaaacaacaaauguaccacuc

SEQ ID NO: 9209 - RNA, 1623 nt, Mus musculus
gucuuucaaucccaucuucuguccaugguggcgcauagguuuccgaacucagaggguacuucccggcagaauucaggcaucagggucugaaauagauuguguaagcagccagcaacucuccgucuguaaugagauacccggaccucagcaaauuacugggguuuucuugauuaguuacuaaucaauaguauggagacagugcugucgaucuuauguauuucccaaggaaguuaaaggauccaaaaauucccaggcugggauggugauggcucaguggguaaagggcuugcugagcacagugaggaccaaaguuaggauucauccauggcuucccacagcaaacccacugcagucaauaagaggcuuaucacgucuucugagucuuuccauucacccucagugccccacccuggaucuacugaguccuagcccuuuccucugcugcugaugcccuuuaauucaucucuuagucuagacucaaauggauucuuuuuuaaacuucucucucucucucucucucucucucucucucuguguguguguguguguguguguguuugugugugugugaguguguguguacacauccugcagcauacauguaguuaggggacaacuuguagauaccuugcuacaagaucaaggccaauuuggucaacuuagugaguucugggccuacauagaaagaccuuaucuagaauaaacaaacaaaacaagaaagaaagaaaaaaaaaagauacagugaagaaaugacagacagaacugggugacggacacaugaguguuuacuacguuauauuuucuauagcucaccugcaucuuauacauauuuuauauuuauuaauaagaugaacaaaugacuuuucaucuauaaaacaucuauuaagaauauuaagagcuuauuuucuauuuauuauaaauugucuuggccauaggccaccauuucuguuuggcggauucaaggugccagugggccuauggugcucucaaggcuaccacuuaggccucaauuuuaagggcucagucuaccccuacucuaaaucuaguauuacacguucagcaaaaaauggaaaguaacaaaaauccugacuuugauacuuaccagcuauucagucuuaaaaggguuggucucauuuuucuuauucacaaaaugggacuaacgacuccaaccuuacaggauugcuguaauuacuaaacgagacaaacuugcaccaaguguuugggccucguuaccaaguuuccaagguguuaacuuccuuccccacaaugaaauacaaguuaguaugcaacuauggcuaucaauaacaagaacuguaaccaguacauuauuucaguuaacuacuauccagauguuuacugaguggcuacucucugucuuaauauuuugauaaugggugaguagcuucacccucacagagaaagccucaaagccaagccccuggagagauuucugguccacaccaugaaugaagcuauagaagcuaggaagauggcuuaguggagaagagugcuugcugcauacacaugaagaccagaguuugugucuuuagcacuuacauaaaaugaucagcaaguauggccauuugugcuugcaaccccagagcuggguuguuggaggggugg

SEQ ID NO: 9210 - RNA, 81209 nt, Mus musculus
uggggcugcuccaagcuccuaaccagaacuggacaacggucugaagucaagaacacacugacucugcugagagggcuacgaauccagcuuccuuguuggccaggugggggcagucgaggcgccaggacccgaggcucagaaaguuuugagugagguggggggcuugcgggauauuauugggggaauauacugcuaugccgagucagcuucauuccggagcgauaaaagaugucgaacucagcuauuggaugauaaaggaagagaaaagaguucaacccugugugugugugucucagggguggugguggugguggugguggugguggugugugugugugugugggugguggugguggugguggugguggugguggugguguguguguguguguguggggugguggugguggugguaauagggguucagcagccuggcuagacccgagaagaugcagguucaguuucgagugaugaggggugcaggcucaggucgacuuugucaagaggugacaaaaaaagcaguaucagacucagcugggaugaugagguacacagacucagguucaggcccgcugcuuuuccugaacucccagguagucaucuguagccgaaggucaaggagccgcugggaaacccuggccgccgacgguguuggcgggcguccuuccugcugaaggcagcuggaggcgcugagccuucgucugcagcuuguggugggcggagccuccgcaggucucgucccucugacaacaggccccgcccaccccgccuuugacccgccucccuagcucggggccgccugcccaauccgcagcacucucggcccagccgagccggcgcuuguguggccggaggcugauuagagggacccuagcgagccgcggcgcccgccgaaccggggaccugcgcggcucgggaacgcgcccugccugccgcuauugucucggagccgcacaggcucgcgccgcccggacggcgauuccccuccucuuccuccgggagggaaggauccaagagcgccaagccgggcuggcuggaggagguggccgcgaaggcggagggaggagcguuacuccccggccccgacugcuucuccuccggcguagguugccgcugaauucagagcggcagcgggacgcggguuccuggccauggagaggagaucugcacgcggggacuccaggagcucugcucccgcuccugcuccucuggccaucgcguagacaccugaguagaccgacgccaggagggggaggggaagguaaggcuccucuagucccgggugcccagccccgccuccuuggcggucccaagggcccggagggcgcagacccgacuugcgcaccuuggcguccuggaggccuggcugucccugugcuggcguuuuuuugccgagaagcacaacauccuguggguuccagcguccgccuuugccggcgccuucccgccggaguucucccauacauagcgccccgagacucaaccuucuuccaugaaaagggguccuuaggaauagagguuugauccccuuuucauccacuuuguguucccggggagguuaacaaugggucuuuuaaagucggugugaacagcccuaaaguuucuggaaaggcugcgugggggacgcggaccgcagugaaagauugauggaaugugcauuguggagccuuggcgucuacaagagcacgcuuguguaaaguuugggggggaguguggaucuuugucuccuacuguuccccugaguuggugugacccugcuccgugugguaaggcgcaguuucagaaucugggcaucuuuaaagcuggggaccaguuuuuagcacaggaccucacucaccacaguuccuuggcagaguugggagguccuggcaaagaaugggguucucacugcgaguacccugaggugcuucacguaauacuacuuacugcccucuagcaauaaaaccaaggucucugcuggggggcugguguuugucaccagacccccuguggagcagaaacacuccccuuaaauucuccgccgaagguuaggagaacagacuuuugacacaucuccuuucuucugcaguugggguuaaagguagagugccugucuuuuaggaacuuccaucugcuccugaaccacacaguguguuggacugacucccuugugcuggugacuagucugaugcuacacaguugcacauguugaagggcugcagaagucuuaagggcucuuaccaguaaaaagaaaauuuagaggaagaggaggcaggagaagaguuucaucaaagcuuaagggaagccugaauucccauugcaaccaggcuuaucuguuggaaauggccacuaaacccaaauacaaacaaauuauauauaucccuaaagauuaagaaaacuugacccauuagcacuggucuggucuccauauccuacucuggugugucccuuauugucuuucccuuugaguuugcauuucugggcaaagcaaaaugugcaccaggcaugcuguucauuuaguuaacaugggacagcucgugauagugucuucugccuuuaaaauaacauucuuuauuuauguguaggguggugagucggggcuggaaauuuaucucagacuuuaagcucacucuaucccauacugugucugauuuuuguccucacagaacggaaaguuaagguuagacgagaacucugagccgucaccuguucucugucagccuguggaugagaguaagcugaggcguggugagugugcaucucucuguguguguguuaaugugugcgcaagacauuagcaucuaaauucuucucuggucuccuaggaaguucuguguaguugggauagcggguccauggcuaauuguuugagguaggucuccucucuucgucuagccaauagccgggggauuuccugcaguguuauaaucacaggaaaguugaggugacagcaccgcaguuaugcuguaggggauguaauuaagccuguuguuacagauaccaagaaaaugggcauagagcaggcuuguggaccauuaugaaaucggaaggauaccacuuaguagcuaugugugcuucugaaauugagauaaaugagccauauuucagaaagaaaaucauaaucacuauugaacggaucacaucugaaaauggcuauacgcuauaaagugcucuggaguauuuauuaguaaugcacccaucucucuaucugccauggacccauuaacugaauucuuaauaaaaccacucgugacaugccagacauucuuggaaggacucucagcaguacucuguggcacuuucugucagcuggagagggaagggaaggaguggcugcaguuggggaagccagagggcgggagaucccuguguguuuccauugacaaagaugaguaagacugcagccaaggaaacgaguguugcuggggacccaagcaaacuaacaauacuaagaucuuaucagcgugugaaugggagacccacuguacccggcuucuuuaugagggcggagggagggcucacuggagggugggcugcagaaucgauucugacauuauuugcuaaaucaggcaaaauagagacuggaaauuggcguaagaaguaucauguuuauuuuucuuuauuuuauuuuauuuuauuuuauuuuauuuuuuugagacagggucucacuguguagccaaggcugcucccacacugcuaagccagcauggcucucccuguuacuggccugccauuccacccagcaaaacugaaggcgggaagccaggcauggauuugaaagaaguuggcuuuggcuguugaaaacagucugcugcugggcuaauugcuaaguuuuuucauccgugagauaagguuuaaaaugcuugaugaauauacuggagucaacuacguuuccaacugauaggcaaauuacugaauuaacacugccaacccaaagguauuuuauacuguaguuugaaacaagcuguaacuagauauaaauuauagcuuagucaagcuggcuuccgccauagauuuccauuuauuggcucuugucagaauggaagcaggugugugggccuguagacugccugcugcucugugauacacgguccuugucaaggcaucugccccucccccucaaagggaaucuuuucacuggcuuuggcuugugacuagagggaugagcugucugguacagggcaucacucaagauggccuugucugagauucucucucaagccagcuucccuuuuacucugcugucccaacaaggucaaccuaggaaucggguggggguggggcauccgcaucucugagacuaugaaaagucgcucuuacugucuccauuuguagagagguauaauuuucaaaugagacuguugaaugcucccucuccuaacagcagcuguuguggggugaaaccugaaacuguaagcggcccucgcuuuagcucccccacuagaaaugcacauaaggucaggugauguuuuauaaaucucuguugaugggaaucuagacucagcuauuuaaagcuauaaagcuaaacguggcuuugguggguaaggugaaugugagccaggguguuggacacugcuguccaugcugaguccugcccuuuaguuccgagggguccuaaaaauacugauaaagugaggaaguggggacccugaggggcucacuaauuagguaaggccauguaguaaauuaauggcugagcagggacaagaaccccuuuguccuuauuuccagacggcgauuucccgcuccuucccuauuuacgcguuuauuccacuuugcuuuccuuggcaguuguuuaguuuucacuugagcugagaaacccauuguccuuaaguuuaaaaggcagacagacccaugucuuuucaucucccauauuuauuguccaugauauggagcacguaguagggugauauuucugggagauuucugucaaauaaggaacucugggggggaaauguuagcccuacuugcauuuucuggaaacaggaugcaaacuugcaauauuguagaagugcaauuuuuuuuccccuaagaagcgaguuccuggaaacaugcagacuucuuuuucccccuuucuuugugaaucauugggauaaaaucauggagauacuuuguguguucuuuguuuucucuuugcuccuuuugagaaaccuuuaaugcuggucgucgagaacuaugcucagcaaguauuuuauugcacuucuagaccagaccaggcaaggcacucggagucaguuagauagaugaggcauggagucuuuaguaaaaugccucuagaaaaaaguaaaacagacccagaaaauguacuuacugucuccuuacaaaugagaucuuuguccuaugugacaaaucuguuuugacauuauuaguagguucccucuguagacagauuuguaauaagacauucuuuucacaagguggaaaaauggaccuuuuuguaugaggcaaaccaggacugcuauuuacuuaguguacacaguagguaaaaguuaaguuguauuuaauaagaauucuuguugcuguuugcuguuguucccuugguugauguggugucccauggagcucaggcuggccuugaacuuguaauauagccagggaugaccuugaacuccagcccugccuccuuccuucuggcuaugggaguuuuaugauaaauagauggcugcugaggagauaguguagucuuaaccuuacuguguuaaacgguuuuagcacuguguagaaaugcuguugggauauuauugcugcaaagacuugcaauuugagacaaucuagauugagccaccaagaaaggaguugucccuguugccucugaguuggaugaaggaucuuaagacacacaaccuaccucaucacaaaucaggagucuucuugguggggucuggagacugagccccuugagugaaccaguuauugaucuagaagcuuuuaucuaauuacaggcuuucguuuuggagacugcaaacuuuuacauuaugaugguuucagcuauggauucucuauugcuacucuuucccgaggaauaaauaaauaguuuugcaaguuugauaaguagaaaaaaacaaaacaaaacaaaacaaaacaaaacaaaacaaaaaaaccccaccaccacuaccaaaaccugcauuccauuucagaagaaaugagaaaaaaaaaaucauugugauuuguauguguguguuauuguugauuuuuuuguuuuuguuuugaaugaaaaagccaaugcuuuuuuguuguuguuguuguuuguuguacuauguacugcaguuccugguugacucacauuaucucccugcugcccuuagcacugaacuuagagcuucuugacuggagggucaucuguguaugggugugcccugugcauguguguguguuuguguguauuuuuacuaccaugucaauauugacuacgaugucaauauugacugccaugucucaauucugaggcagaacccuuguguuaagaggugguguuguacaccuuuaaucccaggaaagagacagguggaauucgaggucaccuggucuccauaguuaaauucuaagcuagccaaacuauauaaaaaagaccccgugucaaagaacaaacacaaacaaacuggacuuuguucuuguguucucagauuagaaaguuucuuguugaggggaaaggugguaguauacguggguccuggcccugugauugaauagccuaaaucauuucaucuuguucgucuuugcuaaucuuucuuaguuugaaaaguguccagaacauagucuuuauucugugagucauggcauuucaauguuaguauaucacuagauuaugaccuugugauauaucugugccugguagucaaacacuccuguuucagccuuucccccaaccuuugacuucuccccacauagcuuccuggugcuuucuccuugagcaacauuuuaaaaggguugucccuggcagugugcagagaaggcagccaaccagugcaggcugcuggcagcccugcccuuuccuggguuaauuaaaucagccuccuucaggucagagcccggcuuugggucuuucuuuggaaggucagcugcaaggguaugacaggcaggagccuccauugugugccucugcacugccaucugucacugucagcagguuggaagccucucuugugucuuucuagccaauggggaaaaaggguuuggggugggggauggccuggagucuuggaagggguuggggaggagcuuucuaagagacugcaugaggggagaggggugggauugaggaagaauuuugggguaaaaaacagcagcggagggccgagaugcaaauggcccuucccucucuuugucugcuucuucaaauugaggagccuuucaggucucucaggauuccugaaugggggcagcucucacucugcagaaaggcacuagcaggccagugggcuuuguuagguaggaacacgaaacggaacagaaaugggacaguccauaaaagcugacugguuagccaccugccugaggcaggugacucuuuucugugugcggcggcagcagaaggcccuuccuuauucuaagggcuccgauagacugccauccccuguauuuaggggauauuuuuuuguuuugagaucuuuuucuuuguuuuauuuacaguuugguuauguggcagugagcaccagggacugaauccaguuuggucuggucuggucucuuggucugauucauucuagaagcucacucuagaagaaagccauucguaauugacaguuccacaguccccgcccccacccccccacccccccaggccuguggccacugcuuccuuuugcuuuuauuucugcuugggccagagagguguuagcuagagucuuugcugccucagccccucaggcuauauagcuaggcaguguuuuuccuaacucugauggauuccuuucagcucugauggguuucuuucagcuauugaggacuuuagcgucugccacccacugcuucuuguggacuugguuagcagaguugaaagggaagcacucuucagaauauuuacugccagccauaugccuccuacaaugugaaaagcaggaaggaacauaacaauuaauucaauaauaauuacauacaauaguagaaauauucacuugacuggcuuuuggucucagacauuuguaaauaucccaauuuugguuuuugagagacaggguuucucuguguagcccuggcuguccugaaacucacucuguagaccaggcuggccucgaacucaggucugccugccucugccuucccagagcugggaguuaaaggccugugacaccucugccuggcuaaucauucauuucuuaaucccuguccuuuccuaugucggaggaagcuugcgcuuagggcuucucuguucuugcccccgggaacaucggcuuggguacauggugcugcgucaugaaagugaaacggauucaauguagauaaagugguggcagugaaaugugacaaagccagccgguugcaggggaugugacauccccugaugaugagaccgaaaggaaaaagaggcuugguguccugauggagggugugcccuguagcaacagggcacauggacuggugugcuuauucaaaucucagcucugagugaaagggccuggugcucucaaccugcugucugcuccuguagccauuauauguacagacaucggauucaugcugaauucugcacagugguuauuuuaggaaaacacauguuauauuauaggaauacaguguguaguauucuauuuuucccugaaacacacacacacacacacacacacacacacacacacacacacacacacaaaacuucccaaccucucuuugucccacagaaaucuauauauguuuaaguacacaauuuacuugacacugaucauauuuaaauauauacuuggaaguuugaggucuuuaagggccucaggugcuaagguuguuucucauugagcaguuuuguguguuccagccccuacccauucuuuagcagcagauacaaucuuauguaaagaagaccugugagacaccuaacauuaucucuuuaagccaaaccaaacuaccaaccuggaagucacuuuucuauuauucucucuugggucucucuagagucuuaaucgacaauucaaagcagcuaggagcuaaugguuugauugggucagaaauucagauuuauuauauuuuguauucuguguuuucauagcuuguguacccccuuuuuuucuggaauaguuuacuuuuuauugcauguuuuuacuuuuuuagauauaauaaugaucacauuguaaagauuuucuaagaucauaacaggacagaauguuagcuuagccaaauuuuaaccaguuggacagaaauucuuagaagcaaacauuguugacuauuccguugauucuuucaaaaauuaucaccuugcuaagaagccuuugauuggauuaugcugguaucuuggcuguuucuacuagccugaauuugucauuuaaaaauagauccucauaugaaaguguauaagcaaaacacucuuacugaguguuccguaugauugggagcugugugugucugaugcagcacagugggggcucugcaguggguggcggggcuggcucauuuggagaacugaugcuucagaagaggaccgaguguccuccaucacucucugaguaauaagcaccugcggugugcaucuggcggcuccauaugcaggggacucucccucucauccggcccaucauuuucugucagaaguauagagggaaaaguuucccauuauacugugugguugaaaccauuauagcacacugugaaaggguaagguacagccaguuugccacccucucuguaggauuccugcuuacagaugugacucagccucuuugucagaaugcaggcuagaacuguauuguguaauaggaugagaguucaauucccagcacccacaucugccugaaccuccaguuccaggggaccugauggccucacacagauguacagacaggcaaaacaccaaugaacaucaaauaaaaauaaaauugaaagcuauugcaggcauacaugggaaauuccugugggaguggguagggagaaagggcguggagaagagcagcuuggcucgagagaggagcgaugaggagagaaacccagaaaucuguagcuuaacagauucuucaggacuauaacacaaaauuagacagauuuucacccauucuguuuuccuuccacuaugugugugugcauguguauauauauaaauacauguccuauuauacuuugagcacacacacacacacacacacacacacacacacacacaccccaccucuccuagcauuuaugaugaacucuuuugcaggaauuuguagacuacaacaaccacuuauugagcaccuacugucuaugagguccugugaaaacaccaaggggaaagagauggauaauuacauaaauuaaucaaaggauaagggucaaagcaagacucuaaacaguauaggaagagcaaacacaaugggagcuuagaggcucuugaguuggccucuuagacaaggcaguuuucaauucuuuaaaaccccaaaccaguccuuuucuaagccccagcccuucuuaaagguuaagacucacaacucccuuuaacauuaucaucauuagaagaaaauaauugcuuucugcgauagcuggcugcacauauaccacacacauuaaucuguggcucuucagcugucuguauuccccagccuugcuguuauuuggggcaugcacauggcuguuucccaagaaaaauauuuuauuuaaauuauagugagguuuuaggguuguauuuuugggggaggggggaugggugaggagggacugaaaauugaaaaaaaaauuacacauugcauacuucuuugaaugcuuauuuuuccuaacguuuaucagcauuuguaagucaggcuuuuauagucuuagaaauugcuuuaguuaucugccuuaaauauuuacuuauauugcucauguaaguauuccuaauuauuugcuuguugguuuauaaccaagucuguugagcuaauauuuuuaugucaucagguauauauucauaagauaauuguuucaggaggcugggcaagacggcucaguguuuuaagagcacugacuacucuuccaggggacccagguucaauucccagcacccauaugguagcucacaacugucuguaacuccaggaugugacaucuucucauagccauacaugcagacaaaauaccaguuggacauaaaaauaaguaaauuaaaaaaaaaaagauaauuguuucaaggguuucugaaauaguaucaaagacccaaaacugcuuuaaaaacuguggaaugcuuuucuggucucuacacgaacaacuuggacauucccauuguggcuggcuuauguuuauuccaaggggcagugccaugccauaucagucauuaaaguauauauaaaauauggaugaguccauucuuuguaaucugauuuucacuacaagagugaccuuuaaguacugacuggugaugccagcucacaccauuacagugaaacaugaacccccgguaaaacccagacggugccugcugcuuacacugaagcugggacaccggaggagacaccagugcccuucccugcuacuggaguuccgggcuuaagcagcuauuguugagagcucaggagggaggcugaacaacacauuggcgguauuuccugggugaagguuaucuuuuccuccaaacaaaggauuuaaagugaguucggaagccagaugucuugaggaugccaccucucuuuugucugacccucaugguuucugccacagcccucuaaugacccacucuaauggcgugagcgcugcagcuuucugaauuugugacacaucuuuuuuucaugaauaauuuaaaucucuaaguggcaauugauuuuuuuuuuuaaaguaauguauucguagugcggucucuaaagucaauguuaaauguuacaugaaaucugaaggaggcaugugucuguuuuacaauuuuaacgguuuucaugcacugaaaauaaguuguuuuuuguauugcuuauccuaaaauaugguggaaguacuauuuuacuuucaaggacaggaacaguggcuugcagaguguguaguuuucagccaggagucuaauggauucaggaggacucauuuauggcagaugccuucuaaauuuucauguuaaguugccauuuugugacaucgaggacacguuuguuauuuccaauggauuggugacucccuggagccucucugcgucucaguuuucuguguguggcuacaucuggugugauacauuauccccuucagucugaugaauaauaccagcccuucucacccugagacaaugaagcagacagauugcagcucaaggggcauuccccaacccccuuccacagcugaucaugacaguugugucccccucccagcgaggcuggccccaggaacauccccucuaccccuuucucugccaauggacagcuuuccuuugucgcacugcuuggcugugcccauuguuugggccugcugcuugguacacggggcagcuuuccucaauagcaccuuggauggugguguuuuuuucuuugucugaaguguaagcuucauuuaaauuacgaccucaaguuucaucuaaacaacggcuuuuauuaacaucaagccucauggaucuagucauuuugacagacacacuaacucaagacaauggucuuugccucauguaaacucaugaccaauuccugcuuagacuuucucuuccguccccauucauuuccuugucauuuggguccuggaaguacuuauuugugggccaguuuauguuuaauggguuugcugauuguuuagagcaauuuggaagcucacuggaccacuagauucuuguucuuuauuuuguagcagauggggaauuuacuggggggcuauuaguuaaagucaggugaccuggggugcucugguuguuaagggagggauauaaugggugucacuuuuuucugaaacuguugagugcaucguaguuaucaauagucacuguaguaaggcauuaugguggagcuagccgccgccucccucccugccuucuuuauucuuucccuauucucucucuacuaaaucaacagcuucauucaaaacuuguucuuccuagggcuggcuaugaugagcaccaagaggaggagggccuucauguguaucaguuuuucuuagcucaaaaugaaucacgcaucgguaguccagugaacuuauuuaugggaaauuccagaaguuaacauacugucugaggccagucggguucuguuaugcccuugcaaacuguuaagagcucgaauguuaguguaaaagaaucauuggaacuuugacuauuuuaggauuuaagaaaagaaaaaaaaucuuuagauucuuuuuuaccuucauguuugguugauguugaugauggaugggaagacauggccuaguguaguucguguugacuuugaacuugcuauguggcugugguuagcacuggaguccugauccucuggccuccaccuuccaaaugcuggauuauaggcacauguugaaagaaccuaguggggaaacccccacucagcucccgauucggcgugcacccaagaaucacgaauagaacacaacaccuugauguaacaacacgagguauuuuaauggcggagcuccgggucgaaacguaucucacacaggagacaguggauucgaccacgaggcuuggaagcuagggguuuuuauagaaaaggaguggggcuggggaggaauuggcgcgguuucacaugauugguccauuuaaacaucagcagccuguaacauuuaacuuaggucagaggggugggagauagggaggcgaugggccugcccgggcauguccuggucuguucugcuauguucucagccccagguuucaaagcucacaaacaagucuuugggcuauuugacauacauuacaugaaucacaggucucaaguuuuauuuccuuucaaugucaccacaccaggcuaaacauucauacugagugcauucagagucuguauguaaguaagguuaugggaagaaaugguuaaacugcuuaaccacgagauagccccauccggggaauugaacauccagacuugaaugccugucuguuggaacuuccuagggcaucuguuggguucucaugggauacacggacuuguaauuucaguuuaaagaguuuaggguugugaggcuccaaguguggucaccagaguguguuuuauagacacacauuuuucuuuucuuuuugagauuauaauguaauacgccauuugccucuuccuuucaaaguguguguuuuaaauauguaaauccagaguccucuuugcaguaguugggccugaaucacauaaaaaagaguccagggaucuccauuucucucagguuuguuuuuuuuuuuuuuuaaugcuuauuuuccauucugaaaacccugaacaguuggcaugagcagguggcuccaggugcucuuuagagucccuugggaauguuaauuuuccagcagcuuugacccagccucaccacccuaacugaauuguucuagagcgcagccagggagcccugggaggcuguaggaugcgauuaugugcucugcaguggaguggaguggagaggcaguguccuuagaacuagacaaccuaacacugaagguggcggcacccaguuaacugaaucggggauguaauugacuugguauuuucugucagugucaggcugaggugggaguggagaagugugcuaaugguguggagcugcugcucagggcacugaagaauuccugaaaaaggauggugcugauggucauacaacuuuacgaauauaauuaaugucacuggauaaaaaaaaaaaaaaaaagagauuuaugcuugucuuagcacauuacguguuugagagcugggguguggccuaaggguagagugugugccucgaguauaccagguacuugauccccagcacugaaaauguuuuucagggaucaugccucuaaucucaguauuugggaggcugaggcaggagcauugucaugcuuuugaggcuagacccugucucaaaacaaagucuuaaugcuauuacauuguacacguucaaaaccuucuuucccuuuucacagugacaggguaucauguaugccgcugguuccaggggccacuccccugcuuuccugcaaccucaaaacggaaacggccaccgcucaccugguuauguucccgggaaggugguucccuuacgucccgcgccuccuccaaagaaccacgccuccgccaaacugaccuccaggagccaagacgccccagcgaccuuugcuuucucccccgaggagcagcggacuccgagcgagagccgaaagcggaagaggcacaagaacaccuucaucugcuucgccauaaccagcuucucguucuuuguggcgcuugcggucauuuugggaauauccucaaaauacgcuccagaugguaugugcuccugcgugugaaugggaaugaaguaugugugcugugcgcacauauguagagaaagcauaguccaaaagaagagcuagggggagaauguagaaagcacacuuuaaagaaaaaggccuugguugcugagccuggcuguagcuaccuaaugcacagguaggaugaggugugacugcuuacaaaugacagcaguuguuugaggagucugugggaaauuguaaaugagaaggcuugucuuucuguuuuuuuuuuuuuuuuuuucuuuuucccuccuccacugugucucagggcucaagucuuucuuggagcaucucuguaaauguucuuuacaaauccccaugggagugcaggauggugcuuguugggagcugggagucuuggaucacaaaaacuuuacuuaguuauccauauagcgauaaaauggaugcgacuaaagaucuuguuuagugcuuugaaacaggcgugauaaacaguacaaaaaaaguuguuaauacuuuugagcuauggaaugcauccuuaaacuugcccccaggugugugaguugauacauuuguccagucuaaccauucuguucauugaugaagaccacggagggaccuuuaauuccuuaaaugauauuugcuuaucaagaaaccaggccagaaacuuaaugaucaaugcugaggagacaauucaguuggugaggauccgaguuuaguucccacaaccugugugggguacaucacggccaccaggaacucuaggggcuccaacacccucuucugcuucccuuagacacaccugccaugcauuuacaaacagaucugaguaaaaauuuaaagaaaagaucuuuaaaaagaagacaaaacccaaacugcgugugguggcguaugcuuuguaaucccagggcuggacagguggcaccaggaggacuccugagucugacugggggcugacugacucuggguugcuggcuugucuccacacgcaugggucccucacucuccacuccucaaacacacacacacacacacacacacacacacacauacauaugcacacacacacacagagagagacagacagagagugagggaagaagggaggagggaggaagagaguaaauauaugugugugugugugugugugugugugugugugugugugugugcgcgcgcguuuauuuuggagaaacuuguugccugucagauucaauauguuuucagccaacaguggcuucauagaagugccuauggaacauucuaaaacucacagucccuggggcuaugagguagaggaccgucugguccauuauuacaagagaguugagcaccucuuugucuuugucuuuuuuucacaaagucuaugacagauuucugaguagacaccuccguaacuggauauaacagugaagcaauugaggccccuuuggccuuuuauaaaacuuucaaguacuauuuuauuuugguuuucaggguacuuuuaaggauuuuguaaauuuuaaagucccggaggaaguaguuacugacauuucuaagaguauacacaggagaaagagagaugagccuucccacuucuuuguugacugagccaguuggccacaccaugaauuuauuugauuucccuuacauggagggcugaauuucuacucccaguuccaaacauaauaaccaaguucugauucacauuuuccaaauaaucuucaggagagggaagccaggcuaaugggaaaccagaacugaagucugcggcuuuccuuggaauuuucuuaguccaucugaaccacugggcugcagaggugguuccuugaguugguguucuucaguuucacuuguuggccauacaagggcaaaugauugcuggaagccucucgcgugcugaaagguuuuauggucagccucaugugguuuuugcuguuauaaaugugcuuacuccacaauugggcuagccuggaagaugggguuggcugaguugauuuuuuuuuaaaucaacaucauacauuuucugcucaucauacaguuucucauauaaguauauuuuauuggaauuccuuccaauaaaaaaauuauauuuauauuuggggaugaugguucuaaugaaguaugcucucuaggaauugauuucaagcaauuaagagaauacacauaaccauuacaguggacuuugugucuccacagacuggaauuccuucucaguagcuugugacauggugggacacacacuaucuaacguuauggagaauucccgcuguauguuuaugaaagaacugggagcuggaagaaaaguuguuuuauuuuuuuuugguaguacuagcgagcaauccugggcuuuauguuaagcgagauucugccagugaggagcaccaucagccccgaggauacugccuuuaguauaauaaugaucacugaauaaugugaagaguuaaagauucuuuaugaaucugguaugagaagaacaaucacauuaaacagaugccaaggccuuagugauacugauuuaauucuaguugcucccacuucagagugauaacauuagugauaauauaaggugcuuaaaaacaggaaggugacaacauugggggaaccgguucagaaugcacguuuagaaugcucuucuauuuaccaguguucuccuuucacacaggcgccuaaacacuucuucucauuggccuaagcauaugucacucaucccuuaauuuaaauacaggagccuaauuuaaacauaggcgaagugaguaacaauuggaccaggauaggggagauacauauauuucuucuauucuuuuaaaaauaggugcuuuuauuauuuuuaugaauauguguguucguguaucugugugagugcaugucaccugugugaucacagagaccaguagaggauauuggauccuuuggaacugucguuacaggcacuugagagcuagaagugggguugggaaccacacucagguccuuuguaagagcucuuauuacucuuaagcauuguucauuguucugucuccagccccaucauuucuuguauucuuaucuccucuucaugcuucucugauuuacauauugucauccuuugggcucugagucugugacacugccucaggaacuccagcuuucucuuccuuuguccgaggauacuugcaccuaaauuaagggccacauaauuuaucacuuaguuauuucauacaugauggcuuccccccccaagcuaauuuauagacuugaaggaauaugucccauccaccccccugaccuccccuuguccccugucccgucuauacuuuacaaaaauucauaguaucuuuuacagaguguagaaaugaccuuugacaaauuugaguuauuaguagaucaaaagugaagcugugauuuuuuuuccuuuccccuauaaguauuuccuacccaaacagcugucauuuuauucucuacuauuugagaggcaaguuacaauucuguuaaaggaagauuacaaguaacggaccucauuucuucauguggcacuuccaugacacucagcuugcuaaguaacguuugugguggcuucucuacucuucauuuccucaucucugaaagacgagaagucauggcuugggccgccucugcaguuguguugggaaagugugcaugugguaaaagaggugcuguggccgccuccuuccugacucagugcauuuaggaaggaacuugugaauauauaaagugcauguuagaaauuucuacaauuuccauuagucaaaauguugagagagagagagacagagacagagacaaagggagagagaaagagagaccggcagacagacagagaugagagacagaagggguagggaugggaaucaaacccaggaccucaggcaugacaaagcuaguacuauaccagugagcuacauugccagccuauuauuuucuucuuuaaaaauucuuuauagugugguuccaagagaaacugauaauuacuguuguguauuuccaaaguggguagucaggggaacuucauuuuuaucuugugaaguuugaccugaacuaggugcuggugauuuaauuuuuuuuugcuaauauuuauuuucaauuuuagaauauuuaaaaaauauuuuaauauuuaaaauauuuaacgucugauauaauuaauauuuaauauaaauauuaaauauauucaguauguuuauuuuaaagaauguugaaguaaaaaauugauaccucuuguguuugggaaggggcgccauucccggugcaggaagucccugucugugcgccuuccaugcagaucuauguucugggacagggcuucuuggacguggcuggucuccugguucucuugcacuucguucauuggcuuguguucuauaucugggcugugcuguuuuguagagaauuguccagaucaaaacccucgucucaggaacugggauccaggacaagauucugcgaagcacauuguuaucaaggagggggauuuguuccgccugaccucagaugcaacaguggacucuauagucauucaggauggagguagguagcagucccugucugugggugccacauggaugcucuguaauguggggggcauugcuguuccccauguagaguaucuguaguaugcuuaagaaagacauagacaaagaaaggggugucuauucuuuucucauugcugggauucagugcuuuacugaaaggagcacuuuauuuugaucagaguuccagagggaucaguccacaauggcagaggaagcauggagacuggugugucuuccucugaggggcuugcagcugggcacaucauggggacagccaggaagcagcugggauuggaaccagggggccugucacccugauggaccauccccagggacccacaucugcuagcuagaacacaguuccaaagguuuaaggaguuguuguuccuugcaggacugcuuguguuuggggaugauaaagauggauccaagaauauaacuuugaggacucgauacauccugauccaggaugguggggcgcuucauauuggagcagaaaaaugccgcuauagauccaaagcgacaauuaccuuguauggcaagucagaugaacgugaaaguaugccaauauuuggcaagaaguuuauuggcguggaggcuggcgggacacuggaguuacacggggcacagaggacaucauggacgaugcuggcgaggacucugcauucuucaggcuugcccuuugggucuuaugccuucgagaaggacuuuucccggggccuuaaugugagggucauugaucaagacacagccagaguuuuagaaaacgagaaguucgauacccacgaguaccacaaugagagcaggaggcugcaggaguuuuugagagcucaggagcccggccggauuguggcuauugcuguuggagacucagcagucaagagccuguuacagggaacaauccagaugauccaggaucgguuggggaguaaacugauccaaggucugggcuacagguagguagaccuuguucuucaccucccagcucuguguuagagccuguauccugugacugcagagguggugaaccaagaaccacaggcagccgaugcuguuuuagccagcuucaugaccaccccacuaaaggucuuuuacauuggugcaucagauagccucuugucugaacccugggucuaacuacuagauguacacagaacaucuuggcuuggguugaugaagcccguugugaauugucucuaaagcuaggggaaagcacagagaugccguucugcaaaagaaugggcagagugaagauaacuuucgucugaagagccuuccucucaccauuaucuucugagcauaaugaacuagaacauuacugaaggcuaggcuaauggagcccgcugaggagcugaaagguuagggcagugugccauggaaagccugucauaaaagcccugagggguaggcuugcauggguuuccuuuuuccuuuuggaaucucuagcgugcuaauuccauuggaauccuuuacaugguaguuugauuccacuugcuuuauuggcucaggucuguugaauucuggcacaggagaggcagccaaaaguuggagagcuaagcuaauuguucuuacagaagucacuucugcuucuaguuucucugcuaaucagccuugauuuccuaaugcugucugcaggcugagggacguuccuggcucaccauuuaauuaaaacaaacaaacaaacaaagaaaugaaaguuccugccucaccauuuaauuaaaacaaacaaaauaaaacagaagaaaggaagacgaaaauagaaacccaacauuguaauucuggcgaauauucccagaaucacugagaaaugucugucauaacagaacaaaacuuuacugcacacugaaaugacacacuaagauuuuccuuuggggcacaauauuauauauaaacauuccugaagauaauguuagugaagaaaagaaguauauuaugaucuuggauugccauuuauuuuuaugucaaaauucaagaagagaaagcaacagccaaaaaccgacauggggaaauaagaggcaggcauccccgagacaagaggccuacagggacuugaggacugugcuguaucgguagcaaagauacacacaggaugccacgagugagcgagggugcccacagaggccagaagagggugucagaucccauggaacuagguacugagccaccucacuuaggugcaggggccugaaaacguguccucuggaagagcagccagugcuauuaaccucucagcccuuaacuggcugccccaacccaucucuccuuaccaacucuuacagguucuagugcuguucaguacaccguaggcugggaagcaagccuucgaugcgugggccuuuguggggacauugugagcaucuccuugguuucuaaauucucuucaaaauaucaccacccaguuacuggagacguuagaggaguguucacuggccccucacauuaucuccagugcucauacacagucacccuuugaggacuguucgggugcauugaaauuucuugcaaguggaggcuggaagugggaguguucuugacauguuaauagaacaggacauuguuucauaguugcugaggcagcuguggucaguaaaggggccucugaccgucuuccuguccucucuacugggagauaaugguugaggcacucuguuugauccuuucugcugcaucaagggauauaaacagcccugacugguucucagccucuaauccucacaggggcagcugcgagacuuggaaggcuguauggaggcuugcuuuagugaacuuuuaucucugagcaucaagccaucugucuggcagagauuauguuuaguguuuuuccaccccccagaguaggaaguucacauuuuucuuuucauguuuugaaccaagaggcuuaaggcaaauuuccuggcuuuuuguugcuauauuuuuuucuuugacuaacuuuggauacaagcuuggacaaguccauuggguauuuguuauuguagaagucagaugauauuuuaaaacacauugcuuucugcagguaaguguuuguaaaauugaaaaucuguuggaauguaauucuguggcuuuaaggauauuuagaaacuuguaagugagugauuuuuuuucaaccuugccaaguacacagacauuaaaaacugcuaaugucuguggucuuagauuggguuuucaaaggguagaaccccagucagaagcaugguaauuacuacugcaaauugugauuucuaaauuagaggugugugugucuauguaguaugugugucuguguuauguguaugugugugcuuguuuguguguguauguaugugugugcgcuuguguguuuguguguguguguguguguguguguguguguguguguaggcccuuagaaaaccuuuagugucucccucaauuguucuccaucucaucuuuuuuugggacagcaucuuccauugaaccuggagcucauagauuugccuaagcuaccuagccaguaagcucuagugaucugcccauugucugcugcucgacaccagcaucacaguugugugccgcuggacugugccuuuaugcugggaaucuguccucaggucuuuauaauuguccaaaucucgcccucccccuaaaccuuaaggguucucauaguaugcuuaguagcaucauuuagcaucacuggagaaugugcuagacaugcagaaguuugauccuccgauucccaagcugugguggcaagggaguggggaagaggucugguuuaacaguucuucccuccagucuuucuggugcuaagguuugagagccaccguucagcucagugcugaguuaucuaccugcacauucagguauagaaugaguucuucuaguuuucaggcugugaguucuaucccuaguaauacaaugaaagcaaccaaacaaauggagaaccuaggugugaugacagucccagcagcguggcuccagaggcaagagggucaggaauguaaggucauacucucaacgacguaaugcguucagggcuagccuggguugcccaagauccccucucaaccacaaccaccagacccuauaccagacccuacaagagagcacaugacagccauuguaagggacacaaggauuuauaacuagauuggccuauguucgugugugugucuaggaaguccaugacuaacggaaaccauaguugucacugucucgccugugagaaagcuggaaaaucaaguuucugaaagccagguguauuugcuucugugcggucagcuacuuuagcaaaagcuuaggagugcagccucaugggaaaagugaaagaugaaauacagauguucaacaccagccucccaccauauucgcgucugggguuugggucauuucuaugacaaaugaccagcugugcuugcuguuucuuccuuauaggcaagcuugggccuuaguuggugucaucgaugguggaaguucuuccugcaaugaaucugugagaaacuaugaaaaccauagcacuggggggaaggcccuggcucaaggagaauucuacacccuggacggucagaaguucucugugacagccuacagugaauggagucaagguaggccaagguuguuuaaacccugugagacacguggaaguacugugacaagugguugugugguuucacucugcccaaacgucaguuugucugucucgguggauuugucagcuaguugaaguugaaacugauuucccuacuauacuuaagucuuguagacucaagaagucuagacgagcuacugaucuauuuuaguugacacagugauacuuggacugugugcucaacccugagucguaauguuuaauuaaguaggaugcugggcggucuugguuaccagcuugauacagucaccugucuucggggcauucgggagggugagggguuagcucacaagguuaacugaggugggaagaccuacccacugugggcggcaccuucccuguccagaauagaagggaaaagguaaacugaggccaggauucaucccucucuccuuucugcuugugggcacaguguggccagcugucccaagcuccugcugccuuguguuccccaccaugauagacuguacccucaaccuaugaugggggggaaaaucccuuuccuuaggguauuuuauuauagcaauagaaaaguaauuuacacaaguaauagaaaugguuucuuuuuugccauugaccagcagagcugaucugcauggugugcaguggcuuagcaugaugguaugcuuagacucucacgggaggcgugacagcaaaugcugccuucggccacaugcagagggaaaauaauccccuaccuuguuacuucguugugacucaugucaucaugcagccaugucccaauaaucuaccuaacuguuucuuauggacaaaugggaaauacaaaaacaauauaaaauaaaacuuaauuuuagccauauuauucagagauuucuuuucagcuuacaauauuaucggauuuuaacauuugaccuuucuauuuuuugacccgguuuccuaagucaguuauuuuuagaaacaaagcgauuuguuucuauuguguguguaugugugugaaugcugauguguguauguguaccacaugugugccuagugcuugagaaggccagagagggcaucagauccgcugggacuagaguuacaggugguugugagccuccaugagggugcuggaaacugagcccaggcuuuauauaaaucaacaagugcuuuuaacugcugagccaucucucaagcuccuaaaacagguaucuuaauucuuuaaucucuccguccguuugucugucugucugucugucucucuguuucucucucuuucauuuagcauugugucccuguaugugcagaagaguuaguuuuccuaccaugugggacccagggaucaaacucagguuaucagcuuugauggcgagugccuuuuuccuucuaagcugucuuucuagccccugagucuuuaaauuuucuucaguauaaguuuuuauuguaaugcaauccuaacaaauauuuguuuuucuuuaaguagacucucacucuguagcccaggcuugccuguaacucauuguguagcccuggcugcucugauuuauuugacuagugcuuagcauuggguauucaaggagugucugacucugggauuucuuaauuuaccuauuuguugccagggcuuccccgcccccccccaugaguugugggucggcuccuuccuauuuauguuuguucagcaacugucuuuuccaagcaagucugauacccacauuaaugugaucugagcaaaauuaagggcuuuccugcaucugcaguuacccaggacugcucaucaguguagcaaaccaauuguuuguuaauuuggauuguugacagaaugccugggaugccacccugguucuuuuacuuccucuuugaucauaggcuucgauucacuuccuaaaccucagucuucucaucugaagauugaggacaagaagagaagcgcuacguagggcaugucacauugaucaacaauguaucaaaugugucacaccuaucaacaauguaucaacugugucacauguaucaacaauguaucaaaugugucacacguaucaacaauguaucaaaugugagguuuucaguguagucguguauguagacacugaugauaggcuaaugcugcacaaacaugauuuggguuauaaaaagucuuguguaugguugugauuaaacacaauguucuucuuuaaaacaaaucagagaggggcuggagagauggcucagugaugaaagcacuggugcuuuuccagaggacccuggcucaguucccggcacccacauggcaagguacaacuguccguaacuccgguuccagaggaucuggugcucucucugaccugugugggcacugcaugccuacgucacauagucagaccugcaggcagaacacccauacacaugaaauaaagauaaguaaaauaucaaaaaccaaaacccaaggaaaaggaaucucugaggugugacaggaagguuccguguaucguuucuaagcagcuugggaggcaaaggagaggaagcgaugucugugauggauggagaagcuggccaagcccugcuuccggcucccauagccccgacaggcacaggugcucagcccaggcccucgcugcaguuugguccagaguguguucaaugguccugucuccaggaaaguuccaggcuggagucgacgacagcugggcuuugagucagcuuuuccugugugagagaggaccacucacacuggcugcucccuucuggaagaggggaaccccugccuucugccaugggcuuccugcuuccuggaaggggugggaauucucagcuggaagcaggagacugaacuuccuccuuuucuuacuugagugaaaggcgucaggagauuaucgaaguaagcaggaauuucuccuaaaccuagaaaaaaaaaaacugagaaguuauuaaacucuaaaacagucccaaggccuuucugacuuuuuuuuuuuuuuuuuuuuuugagaaauaaauucuaguguccuuucaaaucaaaauuuacuuauuuaguaucauaucuugggauaaaaguguuaaaauuuagugugaaaaaaauugaauaucuucucauugcucccuuuuacggaguguuauauguuuauaaaaccucagauuuaggguagugauuuuuuuggucuaggauuucugaugaccuuuguucuuaaauugccugcuucuguuuuuuuggaaggagguuuacaauuucacuguaaacaaucaaaauauguuuuaaacaaaaaaucuauucuaguuacuggaguuauuuaugguaguaaguaugacuccaagaaacauacugagacuauacauaaagcuuacuuuuauguguggauguguuugcauaugugcauacacgugcauucugugcagaaaagacacaggcaggacacccuagucuccaggagcagacuccaugacuuggccagguuagguuuuaccuggcaauugaccaagucugugagucauccauguuacuccugcucuuuacccacccacauguuccgucuguuuaccuucccagcccaaguagauguauucuucucuucaguugagucagcggcaucuugggaaguaggauggugcuggagaaggauuuauuccacacagaucuuucaagaggagggcuucccaugucugcuacuuuuguaaagcugucuucuguucucuucacauuucccugacaucagcuuuuuuguugcugacuucuuuuagccacaaauacugugggaacaguauguauuucaacccugauucaaaugcaaaaaaaacccaaaaguguaagccagagagaagcuggauuauugauccaguucucaugcugauuacgaaccagccgugacugucacaggcgauauuugagagaccaccugccuucgucacuuuuuuacuguuacgaugauaaaacgcuguggcaaggcaacuuauaaaagugaagcacuuacucugggguucccuguuucagaggguuagauagagcccaugaccaucauggugggcaggcaggcaggcuggagcaggagcugagagcucccaucuugauauaaccccaaggcagagagaguuaacuggucauagcauaggcuuuugaacccucaaagucugugacacaucuccacaccuaauccuucccaaacaguuccaccgacuaggauaggaaccgaguagucagaugugggagcacacaggggccauucgccuucaaaccacucuaccacccaucagcagucagaacuuuucguaauuuauaacacaucagcccccaaggagcuaagguagacagaucacagucaugcacagagcaucaaaaugguuaauuauccacucagcagacaccagucaccugcaccgugaagaagagaaguggaauacacaagggguagguaggaugcugcugccuucguuguuaacccuugcaagggugaggaagguauaaauccuuccagccuuugcgcgggcccagagcggagguuacuuacuuccagcaaggaugcuguggagggucucuaaagacuucuugugaccucggauugaggugcuggggggaauaaauccaggcacugucauguguuagggugguguucuacccacugagcuuuccccccaacagucucucauuuuauaaacacauggucauuuguuaacaagagcggaaacgcaccccaaguaaagagcacaaacguuugcccuuccacuguguggaaccgagagagaagagggaagguggcaugcacgagaaggccagcucguagugaguuugcuggugccuccaccuugcuccuuccagucuccagaacucugaaaaauagauuuccauuauuuauaaauucaaagaggaaaugaauaaggcaugcacagaggcacagggaugaggcacuggacuuucauuccugguacagaaauggucggugcaccaaaguccugucacuucugaugacucgggccaaauaaagccacuggacauuucuuucaaaccuguucugugucugguuacuucuguucaagugugacguguuccuggcacacgugaauauggggaagggcacgguuuuugaguuuuucgacugagaagaggaugcccacacugcgaaucuucagaauucuaaggaauaguucacugauguuacaauuuguaucgugaauggccucucuuucuuuaggggccagaaucccuauuuuaucauuuuuaucauucagagaccacugaccagcacguggcuggcguuaggaaaagaauuuccgaguggaauuuauuuuagcauuugcuuuguacaucagguaaugugcacguauaguugauguacggaaacccucguguucaugccugcucguuuguuugugcaggaaucucccucucaggcuuccggguggacauugcggauggagugaagcuucaccuguuggacgacgucagcacuugggaagcuggagaccgaauugugguggccagcaccgacuauuccauguaccaagcagaggagcuaacucuucuccgcugccccgagugcagccguucucaggucaaagucaaagguagaggacuccucacugaccuugggaaacacgcuuuucuuggcaucuguuuccugucgucuuuucucccaucaccccgugucaguguggauacuacugacggucuuaguggugagggcgccaaucgcuagauuccagggguggcgcagagaaugccacccuuacacgcagcgauugugccacugcugcgcuguagcagguaaagacgaggaccaggcaaacugguuuccuaaaauccauucuagauuuugacuaauuuuuuacugucagauaauaguaaacuggccuaacaacuaaucuuuuaauauuagucuuucauaaguaaaguauuuuuugaguuccuacuugcuuagcuaaaaaaaaaaaaaaaaaaggaaucuuuagucauauagaacuuuuucauuaggcuuuaucuccuacuguaauggugaauuauacaguuuuugcaagagagcaguucacaaagacauucuuacuaggagcuaugagggaaugaguucugccagguucucauuucuacuccuauaccuguuacaucgguccuguccaaagccgccugggacagguuuggcuugugggcuucggcacacauuauguguuuucuggcuucuucgcacguauacugugccgcuaagaaucaaaaacuaccgacagucuucaaaaaguacuugcuuguuuugaggaaagaaccuugaagcuugaaauuuuuguguuuuaguuaaguggaaugcugaguuuacaguuggcauuugcuuucccucuauguauuauucaguuuuccaguuuucuuucuuuugauaauccccggcaccugccaaaaaauaagaggaaaaucccgaguuacaaugauaccauaccauccaucaguauugucuguggaaagucccucucuucuuccugaguuuaagagaaaaacaucagagggagaaaacaaacuuccuuuaaauugcuuauaaacuuccaggaaagguagauauuuaaaagacaguaaguaguaacccgguggugguggcccacaccuuuaaucccagcacuggggaggcagaggcaggcggaucucugugaguucacggucagucugcuuacagagugaguuucagugcacccaggacuccacagagaaaacccugucuugaaaaauaaacauacacacacacacacacacacacacacacacacacacacacuuaaacagacacacacacacgcacgcacacaugcacacaaacaacaacaaaaugacagucaguaggaaggaaaagaugggcuuuccaucgauuggugugcagauguugaucacuuaguguggaguagaagcucaaagugacacaccguagcaggagcugcaacagcgauuguuucuaagaccccuggcaucuggcucuuccugcguccuugagguggcugcaggaugauggcaggaaguagggaaaaagugugagaccggucccagaucuuuaguccuaacuacugagggaugcugcagagggcagagcaaggucucugaccccgccuggggaugagagcagcagccugagguucaggcuuuggguaggcaguuggaauagacugucuucaagaucccugcuucugggaggcugucauccugagguguuagagguguuagguaaugcguggagcuugcugaaugaggaagaacgcccuuuggcaugggguuuuccuuuauuuguucucacauuguccuuuauccgcaucaccagagaucccccaguaccugcacgucggugagaucauagacgggauagacaugagagcugagguuggacuucucacccgcaacauugugauccaaggagagauggaggauucaugcuaugcagaaaaucacugccaguucuucgauuaugacaccuuugggggacacgucaugguggguaaaaggauuugauggcuucucugaaaccucauuggaaauaguuaaggugcugaggaacuuuggagugguggaauuaggcagggugagauaaaaaagaagacguacauuuagcuaaacuaaaagauagccagguguaaugguauauaucuauaauccaagcauuugggaggcugaaccuagagaaucaaggaguucaaggcuaacuuugacuacuauauuaggcugggcuaugugaggcccugucuuucacacacacacacacacacacacacacacacacacacacacacacacacaaauaaauaagaaguaaguugugccuggacuguaguucauucacuuaugaauuauucugugaacaauuauuaacucacuguaguggaaagagcccagucgcacagagcaccacgaagagcuugauagccaugcccgccacuucucuggagcucugggcuucuuaagaaccugauauuacagccgggcgugguggcacaugccuuuaaucccagcacucgggaggcagaggcaggcggauuucugaguucaaggccaaccugguuuacaaaguaaguuccaggacagccagggcuacacagagaaacccugucuggaaaaaucaaacaaaaaaacaaaacaaaauaaaacaacaaaaaagaacuugauauuacuaaagcauagacaguacuaauaugcacaguccaaaucugguccuguaaaaauuacugugugcagaauucuauuccuuaaaaugacaaacacucaccaugcaguaggcuguacucuguauccgguuauugggucuggucugcagacugucugagaucccuuucuguguugggugaucuuugcauauucgcuucugaaucgcuggcuucagaaaugcugagccagcaucccugcauuauuuucaauuauaugauugaaaaauccaguguuugaaguaccgagagcgcuucaacuuuguaucauaggggauuuuuuuuuucccccuguaggggaauuuuuaaagagaguuuccacaaacuaaacacugguaaagaguuagaaguaaguagcuaucuagcugugguggaggauauaaagaugaaagaagacucucaaugaccaaaauauagccagccucugcucugauuuauuaauuauccuggcuucauggugguucaaaaguagugugcauugagaagucaccuucuacuaaaguuaggauuuuggucuuuuucgcuguggaugauggccugugguuaugggcuaaaguguauccuuggauucugauaguuucaguucagcagugacuuuauaaugcuguagccuuguuuacauuguugagucuugcccaguuucagcaaaaacauagccagguguaguggcacauaccugucgucccaggacuugcaaugcugaggaagguggguuccuguaaggacgaccaugaggccagccugagcuacauagugacuaccaggccaggccagguugcacggcaaggcuuucuuggagaaacggaaaggaaacgaacccaacucuaccccguagcuccuguccucuccugucguucccccuccgggaaauccaguuugugauuuuccugaucucauuuuuacuucugauuagaaguuagucccauggcucuuugaaacaaguaccuauauaaagaauuauuuccuguuauuuuuccuguuuucauagcugggaauccaacuggggggccucacacaagccaaccaaacagcacugcugaguuacaucucuagcccccaaagugcuucauuguuaagugaggcucugguaaaagacaaaggaggagauguuauuauuuuauugauacauuuguguaggaguguaugauguuuguguggggcugcggguacacuuguguguauguguguguguguguguguguguguguguuguguguguguuuguguguguguguguguugcauaugugcaggggcagaagacaucccucaggaguuguccaccuauguguccuaugcucaagcugggucucauugagaccuaggacucagagguuaggcuagaccauggccaucaggccccaugagucugccugugucugccuucucaguucagggaucacagacccuuaccucccucccuuaucucuuuacacagggauggacacagggaugaacacagggauggagauugggcucagauccuuauaucugcacggcagacauuuuaccaacuugacccccaaaccgucauacuuucuccauggauaccuucuguuuaaaugcuacaugugcccccuccuugcuucuuuccugcccugaaaaggauucauuuugucuugcagauagagaagaauuuuacuucaguccaucuuucuuauguggaauugaaacacaugggccagcagcauaugggccgguauccugugcauuuucaccuguguggagauguagauucuaaaggaggguacagccagccagcgucuguggauggccugucuguucaucacagcuuuucaaggugcaucaccgugcacgggaccaguggcuugcuaguaaguagccucaccuuguguugacaugcagcaguuuucauugaaguguuugcucuccuugaugcucgugacugaccacaugccauuuuguagccuucucuuaccaaagauauccuuuuccuuucuguagaagcccagucuuuuuaaaaucaccuaaauuaucuuauaaucacuuaucccggaaaccccaaguggccuugugucuagugacuuuaugccccuacauuucugcagaucaaagacaccauuggcuucgacacacuaggucauugcuucuuuuuggaagaugguguugaacagcgaaauauuuuguaucauaacuuggggcuucuuaccaagccgggcacucuccucccaacggacaggaacagcuccaugugcaccgucaugcgugauggaguguuuggaaacuacgucccugugccuaccacagacugcaugugaguaauuaguggacaggguauugugugguggucaaggccuuaggcuauuuggaaaguucuugcuggggagauuuuaacagacagggguuuugugaagaauguuuuaagucacccucaacaaugucuugcagggcuguuucaacuuucuggauugcccaccccaacaaccaccugaucaauaacgcagcugcaggcucacagguaaaucacacuguuuugguucucuucgcacuugcgacagcucuggcuuauccagguaugauguccuagaugcucgcaaacccaggcucgauccuguuuucugguucugucucauugagagcaggagguaauugagaugauucuugccuuccuucuaaguccuggcugguuaggagcuauggaucuagagacaggcagcaaacgcaggaacagaggugagcagucuccaggauaauggcauccccgagauggagugguggacaggcagcacgucacuuccaccuuuccauggcuuuguggaaauccgucagcguguagaauacugugucacucuggccagggaacacaucuuuuugcaggaauuaguuacauuuagggacaucuugauaaagcaggcugaaaccucagcugugauuuguuuaaggcagacaaauaauaggcucauacacacgcaggagaaugauuuccaagagaaccaaauauuauuuuuaaaugguaaagauuguccaugggguaauuuauccuuaccguuaaguguaguucaaaauuacugauuuauauaaaugaauuuuuaaugacaucaucuagauuguaacugggcugaaaaauuacagugccggucucugaacaugcaguaacuuaaaauaguuacuguuuguaacguauguacacaucacggucauuugcucuguuaauguggaacaucauuucugagaaauaaguaagaggcgaccugccuugaguaaaccaggaacaggcaucacgguguagccgcugaaccgacaccagcgauuguccuuacacaugaaggauuccacguuugaagauugccguuugacugggcaggcacuggacagugggugauuuagauuuuucaguuauuggcuccaaggagcuuguguggguuuguucucaccguuucuuacuggaaaguuaggcugucagaacacuacuuccuccuagcuuugcuaggagcuaggaccacagaggagaacagaugcaaacagucccuaaaagccuggggcaaagcugugagaaguccuccgaucuugagcaagaauacugaauaugucucgugccuggucauucuugaaguugucucucuagaaaaacggcuucaguaaagccagcauuuggcagggguucuaccagagccgacgaagccauuucgucacaccucgacacugccuuucauaaagcugccguuaccuguuuagacaggacggagccuaacagcagacagcugccgugcgccucuacgcccucaucccccaaggccucggcaucuuuggaagccuggcucugcccucucuuugcagggauguguucucaagcccuuucuucauguuuccuuuugcugucugaauugcauccaaaauguugagguggccaaugguuuuuucaaaacaguuuauuuuuauuaagacccauucguaaacucugaucauggaaaaauguugacauuacagucauuuggguguguaguuauguauaccucucacacuucaugucuccucugugucccuaaagggcuuuaguaacaacuaacaggauacuacauauguuuuucuuuaaugaucuuuccccccacuacauugugagauacuuuacaauagucuuauuacacaugaguauauaguaaaugaagauaugcugaauucauaccaauguaucuuuuuauacuauauauuuaaguuuaaaagcugccuugucuauguucuagaguguguuguccuucacagagcuaauuauuaauucaguuacaaauaaaaaauaagacugaguuaagaacuuuuauuucugcuuucaugucucacuuuuuaaugucagaaacuucuaagcuguucugcuccuguuagggccaguaguccugcaguggagcagacaggguccacucugagagacagcacccugauucauacauguggcgucccccgcaccccgccucccuuuggcacaagcuugcccgagaacaggaagggcauuggaguuguuugaaagaagccagugagcucugucugccagcagacaguuguuuaauagacaugacucaucuauugaucagguucagagguaaacaugaaaaaccacauugcuuaagggcugugccguccuggucauacagaaggcaagcagggcucuccucugcauaacauuucagacuucauagugaugggaaaguucagcuuggguauuugccaacuaugucuuuugucccauccugcaggcaaaaucuuauuuguuuugaaacacaaccagauauaaccgcucggggagguuauauaaugugggcaacuuuuugcauucaguuccgaaccuccaacaaugaaaaacauuuguugcagcuuaggaggguguuucacauggaggccucauaaaaacugaggcuuuacauauauggaaggucaauguugcauauuuucucucauauucagaaucuggauauaauauaaacauauguauauaugacauaaaaguugcaggaggggacuccaaggaguuggaaagagggagucuauuaugggaggaaggaaggugggacaaggaauggaaacggggaagacaaaugugugucuguguagauaauauccaaccagaggagaacuguuuaugggggagauggggaagaggaggagcuuggaggugggccagagguauccgauagaauggaugugagcgaggcauauauauguguguguauguauauauauguauauacauauaaaugucauaaugaagcccacuuuuuuguacauaaauuuuucuuuuuuuaaauaauguuuuuaauggccuuuccuuuucauuuguaggaugcuggaauaugguauuuauuccacaaggaaccaacuggggaguccagugggcugcagcuccuggagaagccagaacucacuccgcuggggauauuuuauaacaacaggguucauucaaauuuuaagguaggccucugaauugaagugcguguuuccacaggguggauuucgcuuccacgaucccuucguccucuuggugcagcagugacagaguagcaauuuauaaugagcagaucuucaccuggcucaggguucugguggccgguucuucagaucuucagcccacaucugucaagggccgguauagucacagcaucccaaggcaguguaugcacuugcaugugugaucuguuuaaaucucucguaggcuugauggucaguccucaccuucucucuuguccuugcugcccacccgcccaccugccugccuuccuuuucugcccuccuucccgucuucagugucaaguuuccaggauugugccuguuacaggacacauaucugggacuuagggcuuuucuuccuucuucacuuaccugcuucucuccacagugcuggcugaguguccuuuggccauuuacugcuaccacuaaguauuucaguggugaaauacuauuuaagaacauuauacuuaauuuaggucacauaaaggcccuucagaaccuccaguuucugugauguuugcuacuccuccucccuuccaucaugaugaguauccaugguccauuuccuguucuuaagucacuucagucucuuuauuguauauggaucauuaaauccuuucccgugaucugacucaaaucagacuccagcuaccauaucuauggaugaucguuaaagggcagaguguuggaguuagagugaugauuuagucggcaaggugcuugugcaagcaggagcaccugagcaggcagcuguguguacuacuguggcugugugcaccuguggcugugugcaccuguggcugugugcaccuguggcugugugcaccuguggcugugcaccuguugcuguguguaccuguggcugugugcaccuguggcugugugccccugugguugugggcaccacuguggcugugugccuguggcugugugcaccuguggcugugugcaccgcuguggcuguguucacuuguaaccauagagcaggugcaggcagagucaggaauggccggugcuugcuggcuaccagccuaguuccagguucagggagagacacugucucaaaagaauauggugagggugauagacaagauagcuggugcucugcucugaccuuuguaauugugcguacagauucauucucccccgcaccccccacacaaugugcauauacagcauuugaaucuaaguguuacaagaaacugaauuccuugaacugagacaagaaaaaccugcuguuauugcugugagcugaguaauugacuaagacuaauauuuagaaaguagcaucucaaagggaaaaaaaaucuuuaauuuuucaaaauuauauuugugauguggaaacuaucucuaauuaauucuuggugucaugugcccugacaacacacucacuuaucucacuaauuguaagaguauuaaaucugaggguauaauuagguuuuaauuuguuaaauuugggaacgauuauacggaauauuuuauaaccaaaggaaauugaaccuuuggagucguaaaaagaagcaugcuaugucgggaucaaucaucaugcacgugugcacuuagaccagccccuguggcuuugcaugcaaggcuugcugaaucuucaccuagcccaggucagcuaccauguugagauggcuguuuacaggguuauaccuuaguguuuuaugaaugcauuaaaacauucaaaauggaaauccuugccugauuucuccauuucuauuucagcgaauucaacaacuaguucauuccguguuugaccuaaucaaggcuaucuaagcuucuuuucuuggccccagagagcucaucaguuacacugagcugucaccucucugcuugggagggaccugggucauuucauuuuccuccugaaugacggauggcguuucuccguuccucccugccucgagaauuuuggcaucauguagucugacguccucucccagccccgaggaagcugcaucuaggucucauuuugccagggaaugaauaugugugugucuguauauauguauguauauauauauauguauguauauauauauguguguguguguguguauauauauauauauauauauauauauauauuuuggcuaaucaccauguaaaacauuaaguguacacuaaaugguuguugaauggccagauggauaagcuaaaaauaucacuuuucauggccccuuugcuccccugccacuguuuccccccagccccccauuuccaggucugggugaaaugagaagccgagauguauucucccagcuccuuaugcauguggauguaccuucggauccauuuucacuuuagccccuuguguauuucaggcugguuuauuuguggacaaaggugucaaaacgaccaacgccagugcaucugacccaagggaguaccucugccuggauaacagugcaagguagggucuguuuucuccucauuguacaccuaggcuuaaccuucagggggagaucauuugcauucgagcaccuggggugcuuuuugauggcagcauauguagaugaaguuuuguaagcucacauaaaggcauuuaucuuucugaaaugccgaggaaguugauggcuuccuuguuccucuuucacaguggagaugguugugagagcgaguuacagagagaaacagaaagagaaaggguaacaacgguuucagauuugagaacaaagacucacucccugaaaaacaagucauuccccgaaaccuaagcguauagaauuacagugaacgcgcagaugugguagagcacuggguuuuguuucaagggaaugaucccagauuaagcuggcucuaguucuccuugguagccucagguuaaccuccuggcgggcuggguuacucucccauguaaccacauaacguguuuggaaugugggccaguguuacggcgcucucucuuucucucucucuuucucagccaaaguacacaaagcaucucaggugcauagaaaguguucuggucaauguugcaaccugaagucacacucaguagcaaccaggaacauacuguuuuucuguacuucacguuuauugacuggaucaugaaguugaaaggagauacauugcaaaggcuuuugcuagauguaggaaagacacaugaccggcccaguuguuaagggaauaaagcaggagccagacuaaagguggcuggaucggaucuaaugugcaaggcaggacucgccuuacacuguugagagaugagguuaggagaagccggacaaagcccacauagugaauugugcacaggaccccgaaggucaaguuaagcaugaaaccuucgagagcagugagcagugaucagggaacauuuaaggccccaaggugaugaaccugggaugccaaaaaaaugggccaaaacuuaaggaggaccacuuagaugagaauaaaauuaugaagcaagaauauuggauguccuacuuugcuuccuguugcugugaugaaaaacgccauguaauaaaaagcaacuuggggaggagagggccuauuucaacucacaggcuacauccuaacugagggaggcaguggcaggggcucacagcaggauucugaugcagagacccuguggggaugcuauugcuuacuggaucucucccuugcuuucuaccugccuagggauagugcuacccacaguaggcugggcccuccuguuucauuuagcaaucaagaacaugccccacagacaagccaauggacuagucugaucuagaaaauuucucaguugagguuacuuguuucuaguugacucuacuuuauaucaaguauaucaaguuagcacuaaauaaaauuagcauauuggccuaaucuccccgcccuccccgccaaaaaaaacaaacaaacaaacaaacaaaaaaaaccccuacaaaguugcuauuggaaaguugcccguguauuuuuuauuauguuuguuaugagacuagacucaagauggaauucagucuggucuagaacucacagggccugccugccucugcauccaaguguugggauuacuggaaggagcuaccaaaucuggucacaccugcuuuuaaaaagguuuuuuauaguugguaguuucaaugaguucgugccagaaaaacuguuaaacaguuggcuucuuuuucugccuugaaagaacuuaucuaagccugcuggcugagcuggcucagggcuugcgucacaagugugagaugucagugcaaccucccuacaaggcaggcgaggugccaggagagguaaggggaguccugggauugcugaacagaguccagcugaaucaugcagcaccggguccacugagagacccugucaugaaacuaaugugagucgugagugaggaaaccagcugacaggagcauccugccuccacacauguuuguucccucauguuuguaugcauguaugcaaaggccacgcuauguacuuuauauguuuguauauaguauguacauggauggaggaauaaguauauuaagaggcuguggacauuguaacuggacuccucauuauggcuucagaaguuuguuacuagauaaaccuguacguauuaugaaaaugguaauuauuccuucauacucugaguucucuuaccaguuuucaaaugcagacauacuaaggaacuagacuccauuaguaagcuguaaccucagagcuaauuauagaaggggaaugacuagauaguuggcagcuguauguauguguggagcagugugcagacuauguccacguguguucaugcaacccagacaugaguaaaaaugacaggacacaaaugaguaauaaauaaaucaggcugugagcugaacaccgggcuccugggaucuagcagauacacucaucccguuccucagagaggaagcugacucaccaauuaucagaguccucaagaugggaaacagugggaauuugaagauugggaaacuucauuagaaguuggggaauuucauaaagaaguuuuuaaaagggguagggugaggcaugguagccaaucagugcauuauaacuaauuaguacauucaaaucaggggaggugauuguauuaguuauuuuugucauugcuaugaccaaauauuuuacaggaagcaacuggagaggggggaggguuuuuuuuuuuguuuauacuuugagaagggauaucacggcagggaaggaaggcucagugaguggccagguugugaggcagcugagcacagagaauccacaguuaucagucagagggagaggaacacugguguuggcugacucuuucacagacuggugccacuugcauuuagggugggccauccuaccucaguuuacccagucuggaaauuuccucacagacaugccuagggaugucucucuauagugauuuaaaucccacuaaguugucagcaguauuaacaaccgagagacuggagagauggcuuaaccauuaggagcgcuugcagcucucggaggacaggaguuuuguucacagccuagguuggguggcucacaaccaccuguaccuccagcaucuagccucuaugggcacuuguuuuguguauauauauacacagagacacaggaccacacauacacuuaaauaaaaauaaaauaaaucuuaaagaaauuaaccaucaugauguuuugucuauauguguguuaguguaccaccuucauaacccaaaagagguuaucagauccccuugaacuggaguuauagaugguugugagccaucauguggggguugggaauugaacccagguccucuggaagaauagacagugcuuuuaaccacugagccaucuugcuagccccuaacugcauuuucuaaauaccagugaaaaagcugaaauugaggacccagcuuugguguaaaugaucagucauugggcuauauagagaugcucagaagagaugagggggcugcagcagggggucacauguugcauuauaauaucugugugucuuuauuuagaguagugguucucagccugugggucaugaccccuuuggugaggugggggucacauagcugauacucuacauaucagauauuuacauuaaaauuuauaacaguaacaaaauuacaguugugaaguagcagugaaauaauuuuaugguugugggucagcacaacaugaggaacugcauuaaaaugccgcagcagaaggaagguuggggaucccgcuaauuuagaacauuacagagcuccuucccguggcucuccuuguuugacuugcuguaacaacuuugugcaaggcuuuuuaccucuucagucugagcuaguuagggcacugggcuuggguagacaucauccucuucaucccugaugcucccauuccagucugugccaucagcaucuaucagaaacccacaaggagccucccuucuaguccauucagcaaaugucauccugggauaugcugggaggggugggagguugguggauagcggagaucggaucacacgguuuccugcuuuugcugaccucccaugcuuauugagccaaggggcaugugugugccuuggaccuguuccauuucccuccuucucaccucacuucuuguucuccagugacuugcuugguacagaguguagugcuugauauagaaugugcagcucacaggccugaggccccccgggcuggguucucauuuuacaaagauacuucucucauggcggcuaguuugagcacugggcucacagcaucguacaaaggauccuuaauguguuauugaaaaacucagugcaaugaauugauuuuugaaacucuuaguuaucauuuuuaaaaauuuggcucuuuaucuuuucuccugucuuuguggggucgaguuaucaugugaccaguuuuuuacuuuuucaccaagguccuuauaaauguuaaaugaagaaugugagaaauucugucuuuguaauaaauaauuuaguuagucuuuucagguuuaggcauuuccaagcuaucuacugaacuuagauucgucucucuagcuaaaaacaucgaaacagcauauaauucaacaacauaauucguauagauuuauguugaaauauaugguuaauuuucauagugaauuuauauuaggaauauguaacaagaauuggagaagaugcauugaaguaccugguauacauaugguuaucuuucugugugccuguuuuuacagaagccuucugcacucuugacuuuuuucuccauuaauuaauuaauuaauuuacuuuacauccuaaucccaguccccccucaccccccacagagccucuucccaccuucccuuuaccccugagaagggggaggccccccuggguaccaauccaccccgguaccucaaauuacugcaggacuaggcacaaccucucccacugaggccagacaaggcagcacagcuaggggaacaggauccacaggcaaggaacagaguuagaguaugcccccacuccaguuauggguggaccaacaugaagaccaagcugcauuucugcugcauauguguauauauguggguguguguggggggugcgggacccagcuuguccauguucuuugguuguugguucagucucugagagcucucaagaguucagguuaguugacucuauuggucuuccuguagaguccuuaaccucuuugggucccucgauccuuucccccaacucuuuuacaagaccucgugagcuccaucuaaaguuucacugugggucucagcaucugucuuggucaguugcuggguggagccucucagaggacaguuaugguaggguccugucucugcuggcugugccucagguagaccuacucuauacauugacuuuuuaagaauacacaaaaggauuuuuuuccuggaaauuuacauguaaauaaauguaauuguuuugaguaugugaacuauaacuaauuaaauuauaucuuaauuuuuuugauuuguuuauguuggcccaacuugaaucuuuccucuugaccauagcauguauauacauagauaguuucuauuucuuuugcuaauuucaguucuuuuuuuuuuuuuuuuuuuaaagauuuauuauauguaaguacacuguaguugucuucagauacaccagaagagggcaucagaucucauuucgggugguugugagccaccaugugguugcugggauuugaacuucggacuuucggaagagcagucaggugcccuuacccacugagccaucucaccagcccuaguuucaguucuuaacagaguacuuuuguaucccacagguuucggccccaucaggaugcagacccugagaagccacgcguugcagccaucaucgacaggcucauugcuuuuaagaacaaugacaacggagccugggucagaggaggagauauuauuguucagaauucagcgugagugucaucuacagagauaauaaucugccgacacugcuggcuauuuuuaaguuuuuuauuuuuagauuuuugaagacagggccugaggugucccaggcuggccuugaacuugauguguaacaagaccuugaacagaucuuuauaaguauugucagcagugagggccaccacaaccaguuggauuuuuuuuuuuaacugaguagaacgaagauacaguuguagucucuggaauuacuuuauuaguauuaacggacuggaugggcucugaggaugaacguuacugcagagguuuggaucucucuuauucuggagcuuuugauggaaaugaacuugucuagugaccugagaggccuucuguaggucgaccagaaagccagaauuuagccuuuuucuaaccaaacacuguuuaugccagagggcuaaauagagacuuugaaacugccucaggguuuugauuuuuauuguuguucuuuuuggaaacacuguaaaguuuguccugucuucuuuccacuccucucaaaaugaaaguugucuaauucugucuuaauacgccugccgacuuguguguuacuggaggcaggaagcaucuugcuuguuuuuuuuccacuugaaugauuuuaagagagaggccuguugcauucugaguucaguuuuacuguucaaaggucuagcaaaaaaaguuuugauuuuucucugaccauguucacccccaaauuuaacguuguauuaaaucuguagggaaggcauaccucucagacugagaaguugugaagcaaagaguaugauauaauucuuucuaaaaauaaagauuaaaaacacauuuuagcuaguaccuuuauaugguaaguuccagauacuauucaaauaccugcaauuguuuaguauauuuaauucucucgagaaucauauaagaaauguaucauuauuucaaucuauggaugagaaaacugaggugaagggccugagaaccaggucacaguuggcaaugucaguauuugaacuuggcacuuucauggagaugguacuuuguugacgggagguuggacugcugugugguugcagaguugagcaucaggaauccgggauuucauggucacacaccgagggacuugccucucccauguuuccugaucacuuagacaaauucucaccuuuucccucuuacagauuugcagauaacggaaaggggcugaccuuugccagguuuguaacggcuuuaauuugauuauuuuaaagcuuuaagguaaaaccauccuuaguauuuuugccuguguguuuuggaauggggguggggaguuauuaacccagagagguuuuauaauuuauuagcauaaaaaaauuaauagaaagacaaaaaaaaaaaaaaagauccacacucuucuugguaccacuagagggccaaaacacacacauuuuaaaaaacagacuaauugcauuuaugccaaaguuguagaugaauuuagcugaaauuccacagaaggguaggguagucauuaacugugccuagaagaaaacucuugaacuuugggcuaaaggucuuuaaauauaaaggaugaaagaagauaaaugggugaagaucaaaaauucuaaacucugcucucagauuuaacuuacaaagaagauaagcuuugagaacuaaaccccugugugugugugugugugggggggguggucucugagcuuuuugaguauuuucccacauugcugggggucaaaugaguccacacugccuguguacucuguggcugaccugcgccucuagacuuuuauguaacucgcuuuuucuguagacaaugauuauucuacuggccacauuacacaagcuugucacuuaauugcuguauccugggcaaauccaucguugcuugaggcuaaucagcuguugcuaauaaauuaaaacucuagcauuuauauguaauuuucaaauuacucacuaauuuauaagaggacuuuucauagcauaaaagcaauuucugaggguuuuauaauauauaucagaaaaaagauauuagcuuaaguuuuuaugguuuagcuuuuuaaauuacagcuucacuucuuuugggggggggguuguuuaaacuucccggacaauguaaccauucuucucuuuucuccagugaugggagcuucccaagcgaugaaggguccagucaggaggugacagagucccucuuugucggggagaguaggaauuacggcuuucaagguggccaaaacaaguacaugggcacagggggaaucgaucagaagccucggacgcuacccaggaacaggugaguuggacuugggcaguggggaauuaaacagcgagacagucuuuucuguaaugagccuggaugcauugccucacuuuggcucuuucccgucuggguaccagcacucacuguuaccguuauuaucagugucuuauuauccucaugggauauuagaacauuaauaauuauccaugucauagguuuuauuaccaguuuugugaaggaguuguucuuguuucuuaucccuuacauaagaccuauuauauaaguggauucuccccaccccccuuaauguguuuucuuuccugagacauagaaaguugccaaaccauaaacuaugacauuaggucaguuuccugcaauccaugaugcuggguuuucagaaauagccacuggaaaagggaaauuaccucugaaaagagccuuagaaaaugagaguugguggaugccaaagccgccacagagcccagccgaggccauguaauuagaugugucugagauggugaggggguugggggaaaaugggcagguguucuucauuacaaucagaauccuucucucucucucucucucucucucucucucucucucucuguguguguguguguuuguuugugaacuguuuuuuuuuuugaaaauagauucuucucccguacaguacaucccaaccauaguauccccucccuccccuccuccgugcuccccucugcuccuccaugcuccccuuccccuccccucucccccagauccacuccaucuccacuuccucuuuagaaaggagcaggucuccaagagaugacagccagacaggacauaacaagaugcaguaagacaguauggaagccuccugucgaggcuggacaaggcaacccaaagggaggagaagagucuagagagcaggccaaagaguuagagguacacccgcucccacuguuaggaagucguuccuccugcuuuucugagggguucccugacgucccaggggagcgacccgauggagaccuccacuuuagacucuguaugucucuagcuuugggucuaugcacccauuucuaacugccagaggaaaacugacgaugaccagaccagguauugaccuauaagcauagcagaguaccauuagggaucauuucauugauccuucccuccccuccgacaguuguguucaguuccacccugggucccugagcugagucucugguuccuggcuagccaggcaguguacggcauggauucccucuugagaaguaggucucacguuaacuaaacaacuuucucuuccuauacuuucucccuccaucccuccugacaacucccaacuucccauuccugucucuacccacccccagccacccgaaaaaucuauucucuuuccccuucucaggaagacccauguguccccuaaagucccccucuuuaccugcccuuacugagucuguggacuguagcuaaucuugauuuacuaguaaauagccauauuugucuuucugggucuggacccauuugccugcaaauuucaugauguuauuauuauuauuuuuuuaaaccucugagcaguacuucauuguguagauguaccacaauuucuuuacccauucgucaguugugggacaccuaggcuguuucuaguuuucugacuuuuaugaauaaagcugcugugaacauaucugagcaaguguccuugggauaggauggaguguccuuuggguauaugcccaagaguggucuuagguguauuuauucucagugugcugaggaacugcccuauugaccaucagaguucuuaaaguagcauuuggaugagagccaccguuaaagcuaguuaacccagcacccauguccgagguuuggagcuaucuuuauuacaugugugggaaaaccagguagagaauaaucucaggggaauucucaggaccucaguuccaagguaacgcccacugugacccauggagagucaucuuauugugggaaugcucccucugggugugcgucaggaugaggcaggggagcaggacagacagaccgucgguuuuccugguguccugugcuggaucccugaaguagcgagcacaccauacuguguagcuuucgcguugaaucacgaguacugcuagaaaacgaacuuccuguuguguaugcugugaugcugaagccugagcccaaacccgcggacggacguuugaggcgcgugcucugugugccuaaauguauccccagccaugcuuaagaaucucccgucacuaacguuuaucaaaugcucgccuaggccuguucuccguagcucaccuucacuugacccucucaaaaugcaggcagguccguccugcaagcuccugcuuuauaaaugagaguuuguuaaguaagggaggugggauuugaacccacugaguuuggcuucagcucugccugcuuccugauuaugcuguaacugugcauuuuacagaaacgcagguugucagccuuaggggccguagugaggcucugagcagcauauuucuggguuuuguuuuuguuuuauaaauuuugacagcuaguuuuauuucaaaaaugcuuuuuguaucuucgcuaaggaagauuaaagaaacaacaaaaacucgccccugaauucaugagcucagguuuuauuugacuguguuuauagucucgucugguuuauguuagagucuuauugguuuaugugcccagagucuauguauaaaguauaguuuuaaucagacaguucauuuuucuugcuagucuaaacauuuuuguugucaaacucugccaaggugcgggucagcugcucuuagaaauccuccgaauuacccuuaauaaacacuuuaaaagcuuuaauagaugaagaaaccuauuaaauaggugaagaaauccaaggaauuugcaguauuauauauuauggcuuaaauaaaguugcuuuacugcaaugaagccacagauuaaaacauuucuuuuauccguuaauucuggcuagugauuaggaggauaagaaaggaagaacgacacacugaaaauuuuaauucagcagucugacaguccagaccccaggcuuucacaucuucaugaacuuuuagguuuugccuuuuuacuuuuguucuguggcuggacaggagaacuucucugcucaugaauuuaucuuuuagaacagaaucacaaugaguuaccaaauaaaaccucuuccucccauauccccaucuccuccuccuccuuccuucucuuccucuuuguccucaauuuuuuauuuuauuuuuuugcgguauccgggaucuuggucacgugaggcaaacacugagcuacaucgccagcgcugaacaaagcaucacugcugaguugauucagggaaauucaagucaguucuuuagagagaccucugcagugcucagaucaguaggucucuccugacccagucugcuguagcuuauuguuucuagagcacuaauuaccugcaauuuuuuaaagucucuccuaagaucuuguauuuucacgacauuagggcucgucucucgcuuaccacugugucuugagauuuuauuugcugcuuacuggagacucagcaguauucaaagaccauaaauguuaugaaagagacaggcccgcauuuauuaaacauuaucuuguauuuuuauaggacauucccaauccgaggcuuucagauuuacgaugggccuauucaucucacaaagaguacuuucaaaaaguaugugccaacuccagacagguacagcagugcaauuggcuuccucaugaagaauuccuggcagacaacacccaggaauaacguuucccuugugaaguuugguccacagguaagcauguucucauggcuccuccacagggacuggggcgagggaaggcagucacaccuucccaaggacaaggugccaauaaaggaugugcccugagucugaaugacaggaagaaaagugugguaguagccauucuucacucucacacacuggaucccacuggguccagguggaaacacaagucugugacucggacuguuuugugacaugagaugaugucuucaacaggauaaugacuuagaguggagcuauggggagauuggccagauucacaggaauaagauggcucaugagauuugggacagugaguaauaagcuggacaguaaacccgucaacacuaagagguuugguuucuuccaagugauacguguuucuguggcuuauaaggacaaaaaguugaucugaggaggcauacuggggcaauguggaagaaauuggguuuggaaagaagacucuaaagaagacuuagaauuuguauuuuguauuuauguugcaguugcccccagaauaguuuucuuagccauuucacuguuacccacaauccauaggacauucuucauuacccacaauccaccggacaguauuccagaaccuccaaccuucuccaucuugcugguuccccgauagcuguggcaugagagagucugagccuccagcucucugacucacacacagccaaaacuagaacaaaacucacuguuuucuccccacauccacacgaaacucagagcggcuugguuuaaaguagggcuugagauggguuuuucaaaagccauagcauaagagaauccguagcgaucucauccguccucgcuauggugaggaugccgugggaacaguuugugaaagcaagagauaaagcaacggugggaccgggaaccuagagccacucaacuccacgcaaugcuguuucccuuugaggggcuuauccuuuagaugugcuguugaugcacaagcaucccugggcgacgagugcagaguguuuacaagugcuuuugugugccuugaaaaguguuaguggcuuucuccuaacaggaaauagaaauaaaaguagaaaugaaaagaaagucuaaauagaaagcuccccucccuuucuucccccuagcuggaugcuauauguuuagugaaggauuuguuucaacuuuaccugcuguucuagggauuuagaccagggccuugcauacucuggccagaguuccacuaacugagcuacauccccagccuccuaggaaaggcugugcaguaaaugccugacacagaaguuacggagccaggcauguuuuaucuucagaugagaugugacaacacuuguuuuccagcauagucaagugaguucagcagaacuuggccaucuuaagccgcaucaacacugugugucgguuuuggacuguacugauuuuuuuuggcuggguacgagugauauauaaagcuaaguaaaucaucuagcaugaaguaaaaugauuacuggaauaguuugaauagauuuuuauuuaguucagguuugaugugcauacagggaaacgcacagaaucuuacauguggguuuuauuuauuuauuucauuuuuuugagacaggguuuuuguguauguaagcccuggccauccuggaauuugguuccuagaccaggcuggccuagaacucacagagauuugccugccucugccugacaagugcugggauuaauaggugugugcguccaagcccggcugcauauggaguuaauaauaauaguuuuccaaacacuauggcugguucugcuuuacuccucccccagcuuaucauuuaguggaaagaaaaaaagaauauaaauauauuaauauaaaaaugaaguuguaguuuaaugcugcccaguugggcuuuagaaauguuuuuugcucaagggugucgcuuuguagcgcucagaucagcuaccaugguugacaucaugacguguaacuuccgugccucagcaggaaagcuguaguacaacccuggggcucuguggcaggugcuaugugagccuguaggagccucauucuguaaugguucuggucuucuccauugccaggucucucugaacgucuucuuuggaaagccuggccccugguuugaggauugugagcuggacggcgauaagaacuccaucuuccaugacauugauggcucugugacaggauacaaggacaccuaugugggaaggauggacaacuaccugauccgccauccaaacugugucaauguuacuaaguggaaugcagugaucuguagcgggaccuacgcccagguaggcagggcaggugguccaggcccucagcuccuggugacagcagggugacuugggggaggggagggucccaagcacaguauuuauagaggacgggaggaaagcaaguggccauggaagagaaagggagaauguuuuacuaaaaucucccugaaaccaguuaaaucaaagaagcaaaccagcaguggaacuuagugauacaaccaagacaagagaagucacauucccuuuuuugagucaagguuuccccaugcaguccaggcugacuuggaauuuguggcaguccuccuggcucugccuccacuuccuguggccugcgacagauagguaggucugauguuucuugacccuuaggguuuucuuaccgcaguucaaguguguucccuuaagggaguuuuacccucugcuuccacgguccuuaucucugugacaucugacuuugagauagaauauuagcaagugacccagaaagaaugaguuuccaaggaaggaaccugagguuuggaaauaaauagacaagaaggaauccagggaaauccgaauuauauuaugauaguaggaaggaaccugagguuuggaaauaaauagacaagaaggaauccagggaaauccgaauuauauuacgauagucugcggagauaugaaagggauagcacagauagauggggaaauacgucuuugaaaucauuaagcuaguauguauuugagcagaggagaggcucauuuguaaaguaugcauaguuaggagcauaggcucuggagucagacugccuggauucuguuaugugcugaagugugaggugggcaaauuaaaagguauucgguggccuugcauaauaggacagugagaggacaggauacuccaugguacacauuuagcguggggucuggcugcugcuggggaaccugcugccauuugaagaagcagggcuguaaguuccaaagcugguuuuaacagggagaggauggaggaagaucuuacggagcugaggcuucaauuauccagaaauuuggaggaggaggaggaggcagaaucuuuagccccauauuuagggcaguaaaagugagggguuuaauaacagacugcuaggcuaggcgugguggugcauggcugcgauuucagcauucaagaggccaaugcagauagagccccacuucaugguuaaauugggcuacauaguaagacaguagcucaagaagaaaaaucagaggggaacaaagaauaaaggaagggguugaucugagcaccaggaaggaaauuggaggaagaacaaggaauacucuuaagucacacuggcuugcaauagccgauaccagaugccucuuuuauugugcgguuucgccacugaccuugccuuagcagccaagcguacguguuuguggguuccugccucggugcuucuccaaguacgccgugucugaugugguuuuccuucucuuagccuucuguagcuggcauuccuuacaacagaauucuucaucauucuucugacuuugaaaugauuguaaaagacauuguuacucuuaaauuaagggaaaaaaaugucucagcuugcucucuguagacaagaaaaagcaugaggaaggauggagacuggacagcguuuccuguuuauuuuauuagugucuuuguugugggaauucucauuccucugaacagauggggaaaagaacagucauagaggaaggagcaggucguggaagggucaagacguggacggagaguuaccuacagcaucacaagaauggggcuuuaaagugggaucccugucuuucauuuuguucuuacucagaauugccccugguccacauugaaugucccuaucaguacuuagacucuucagaugcuguaaaauuaaagccagaacaaaaauaaggaaccucaacucuuuuuuuaguagcugcuguuuuuauuauuuuuuugcuaucugugugucuguguacguguguguauguguguguaugugugcauauauauguguguguguguguuuguauauguuuguguauaugugugauugcauguguguauauguaugugugcgugccagacuaugacugaagauugugaauguucacuaaugaagauguuauaugucuauaaaguaugugguauaugguuauaauaaguucauaauuuucauaaguucuaguuuuuaacuaaauacuaauauguucucauuuauaccuccgucagccuuuugacucuuuggguugguaaugcuauuugaaauaggaaacuagucaugcccuuuuaggaagcaggguaauaauuuauaucugcuucaagcugagggaaggcuugagucauuuaugcuuccugggagacucuaggagugugagaaucaugggucaggaaaucuuuccugaagauuugaaguuuggggagaagcccggacgcauagcucuuugcuuuucuuuaggagugaauauggugugcacuuguggcagaagggggaagaaagaggaggccaagacagaauccucauguuuguuuccagcaugaacaaggcuguagcuuuggcuggauacugaucuguuuuaggaaauuguucagagccugggcuguggaggaugccuugguggaaggcuuuaguguggccuggaccucgguucaaaugcuacuggaaaaaauucaggacuuuccaguuuaucuaaauuuaacauguuuuuccagaugcuguagagagcuuuuuuuuaacuguuauuuuugaagaggugaaaaaugacuucuugggcaaauggcggucaugcaggaggaaugccagccagaguucucagauaugaauuuuccaucccguggaucagagggaagucuuagauucgccuggaauguaucaguuuuccccuguguuugcugauuugugagcucuugagauggagggguuucucugacaagccacagaagugcucuauucugaugaauaagcuggucuguggugguggaagugaugauguuggcuagcagagugagggucugguuuuagccaugucuagcuuaagcaggcugcgucguaagcauggcuuacacgacuuggccacugcuaauuuggucuggcacuuagcacagaaucucucucuucaaaauugagaggccuucgauguauacugguaaguucuuggagcaguuuaaucuuuuacucacuuccuuucaauucuucucuuugucuuaaagguguauguucagaccuggaacacuccgaaucuuagcaugaucaucacacgggaugaauacccaucccacccaauggugcuucgggguaucaaccagagggccaucucuccacaguaccagccuguugucaugcuggagaagggcuacaccauccacuggaaugguccagcgccacgaaccacuuucuuguaccucgugaacuucaacaaguaaugcuuuuuuuucuuucuguccuugcaagcaguugaacaggcauucacaccagagggggaaaaauaacauaacgucaagccauuucaugcccuuuccucuuguggaaaagcugucuaggcuguguagauggaagugugauugugcauauugauuauggaaaucaauuuggcuuuuuaauugguuuccuuuucuccaucaucaggguguuguguauggaaaggcugucccucagugcagucuucuuugcuuuguucuuugucuucugagguaguugggauccaggaccucaagcauguuagcaagaguuuuuacucuuuaagccaugucaucugcucaaaagauagguuuuaauaccaucugcugagugcugcaguuucuaaaggcuggccccaguuuuauguggucuucugaguaagcuuguggaaaauugaauuaaauuaaaaggcuggcuuuuuuucccccucuuuucuuucacugccuguccccuugcaauccccccuucccugcccccaacaccagaggggaagaggaacaacgcaaccuugcuauauaguucacaguggccuuggaguugugacaguccuugugccacagcuucacaagugcugggauuaugguaugaauccuaauagcugacaaaacugaaagaauuuugacuccaagcagagacuggacagaagaaggugacaugauagcuugguaauggcugcuagggcagggggaaggaguggugggugugaauaccagguauuuccuacgccugccuugaagcagacagucuguucuauuuaaguaugucuguaauaaucugagucccuaaacuguguagguguuacacuaaggagaagaaaucaaagcaccuuuccuucuaguagguuuaccaagcccugauguggauucucucguccucucguucccugucuacugucaguaaucuauccauuguaugagucuggucugccucccugaaugcugucugucugucugucucugugucugcaucugugucuguguccuuaacaaagggcuucacucuuauuguugaacggcauagaaagcaucacauggggaggggaugaaggacacuuuacagaaguguucgaguuucacaaggaaugacgcuuuccugacucauuaaguccagcugucccaaauaacagacuacugcaagcauuuaugguggacauuuguuuuauaagguugcuuucaaccuauuauuuauuuucaacauuuauuaccaugaacuaaauacauacucugggucagaacaagggagaguacauaauuuaagguuacaacuauguauuagcuuaguuugucuugcgagcgcugaacuggccagcaguaacgacgcugcaacaggauccuucugcacacguuuauugggagagcuugauugcagagucgaagagacccugagcccagaacuggugcugcuuauauaggccuaggagaggagugucucacacccggauugguuaugcacuaagccucauuugcauguuccucaucugauuggcuacucucucucucucucucucucucucucucucucuguaccucacagagccucauuaucauaccucauuugcaugucucacaucugauugguuauacucucaaagccucauuaucaugccugggccaggcagugucuuugcaaaaaacuuuacugcauauguacacauugguuguuuguccaaacuuaugcgugguggccagcaguagucagugccacucugcaauggcacauguggcuucccacaguuuguagaagcuuggauagaaaaauccaaggaagguugauuguguauuguccucuuaaagguagguugaucaggcaggcugaguacauagucccauagaagccuucagccuuaagugaccucaauucuuaacuuggccgugagguucagccaaaguuccagucucacuaaggaucaagucaggauucuugguccagagagaauggcccugguaagauggagccugcagccuugagaucaggaguaacuggaaugagacuguggacagcuuugaugacaugaaucucucagaaucccucuuauguggauuuaugccuaagguuuugagaagcccucugccauccagagggaagccauucuucauugugucaagggggucugaguggauuucugaagcccagucuaggguugggaaaacagcuaauuugccauaucauucuucagcagauugaccuagauccaggggccauucagugccuugguucuggcccuaacucaugaguuggcucagcauuaggagacugcaugggugccucuugucuugcacauuuggugguggugggggcaccaaugugcaugcucaggugcagaaacugcagauugaagcuccccgauaucauccugagucccccuggccagguguacaagcuuaacuggagauacccccaaguacaacaagguguuuguacuggaugaagcugaugaaauguuaagcuguggggucaaggaccacaucuaugguauauucuaaaagcucagcaguaucagguaguauugucguccucuacaaugccuucugauguccucaaggucacugagaaguucagauucuugucaagaaggaagaagaauugacccuggagggcaucugccaauauauaucaauguggagcaggaggaauggaaacuugucacacuaugacuucuaugaaacacuaccacccaggcagucaucuuuaucaauaccagaaggaagguggauugcucauugagaagaugcaugccugggaguucauggguucugccauggauggagauauggaccaaaaggcacaagacgugaccaugagagaguucuagucuaguucaugaagaguauuaauuacuacugaccuacugaccagaagcuaucaauucugacuaucucacuaacagggcaagcuauauccacagaauuguuucuggugguacguuuuaccauaaggggauggcuacuaacauggugacaacagaagacaggaagacccuugaaggcauugagacccucuacugcaccuccauugaagagaugccccucaggguugcggacaucauuugaguggcuguccugccugucccuagcuaggguucaguccugggggagccgaaaacaucuggaguggggagggaaaggagccaagggaugaacgcuuguuuuucuuuuucucucuaugaauaaaugucacuuucucagggaaaaaaaaauucagucucuuagagcauuagaauguaagagagauuuuucauaauaaugucucgccauacugaacuaaccaguugucuguccccauaaugucacauucaauccagggcugcauguuuuacuaauuuauucguuuacugugugucaauugauauaaagaugaaugaguggggaaaauagugaguaaauagauuaccugucuccuuuccucccccuccuccucucccuccuccuccucuuccucuucccccucuucuucuucccccuuuuccucuucccccucuucuucuuccucuuccuccucccccuuccucuucccccucuuccuccuccucuuccuccucccccucuaccucuuccuccuccucuuccuccuccucuuccucuucccccucuuccucuucuuccucuuccuccuccucuuccuccuccucuucuuccuccucuuccuccuccuccuuuuccucuuccucuucuuccuccuccucuuccuccuccucuuccuccuccucuucuuccuccucuuccuccuccuccuuuuccucuuccucuucuuccuccuccucuuccucuuccccucuuccuccuccucuuccuucucauuuuucaaguggacauuagauaaaaauacuaaucccauauucuggcuaggaaaguagagccaggacagagugaggaguuguuauccucacucuguaucagucuuguucaaagaccagaguggagaaagggccucuucggcucagaaugguagauuuggugaauaggauuuggggaacaucagagaaagggaaaacuuuagacuagaaaggugugugugugugugugugugugugugugugugugugugugugugugagaucuucccuccaugucucuggggagcuggugugaggauaccuugcaaauauuaaacucuguagacauucacauccaugauguuugcacguaauucacauuuaaacaccucugcauucuuugaucaucugauuacuuuccauguuaaggcauuguaaauaguuguuacaaaacgguggcaagggaaaaguauauauuuucagaacaguuauacuguuuuuuuuuuuuuuuuuuuuuuuuuuuuaaucagaguuaguuggcucugauuuuguggaaggcucaggguaaaauagucuggaauugugcgguagccagcucaugggauuccaugcaguuguucaaaccuauaccugaaaauugauugccuuguuuauuuuuuuuggucaugaagcuuugacuuguugggauuugcuuaguaagcaguugaaauaaagagagggcugggauuugcaguauagcucacuuaucacaaugguggaugcccuuccugugggugguccaaaugaaccauuggguguuuuuuuuguuuuuuuuuuuuuucuaacuuuguuguuugccuguguucaacugaugucacccagccccaaacaccuggcacucucuccuuaugcugacccuucucuuuucaucccauuguggcaaacucucauuucuggcucccuaaugucauucggauauuuccaguccugccuucauagguuauggcugaaugugggcuaccgacaucuuugcccagauccucacagcagccccucgcuuggucuccccaccuucgguccuuuguucacauaguguuucugguaagauuucuucaggccuagccugauguucccagugagucagagaagccagugagaaaagaacaauaggggucuggggagaagugcagaagaguagacaguguuccugguccuguaaguuauauugaguugaaucagggguuugaggugagguauuccagugacaugaugggcagguucuagaaaguacaaugcaaacauuucauucaauucugaauuuaaaaaaaaaaggaaaaaaauaaaagaaaaggaaaaagggugagcccagaguuugaaaaaucaacaugagcgugaaauaaagucaucuuuuccuagccuaauuagcugaaaguucauaaaaauuauaugaugggcagaggcaagaggaagagaugaauaauuuuucugaauuuaguguaauuauagagcggucauagcgcuacuucugcaaauaacacuuuaaaccuguaaaugcuguacuuauuaaguaaagugaggaaaauucagacaagaagaaaauggagauaauccuaaccccgacuaaagcaaggcacacaagcaccaugguugccauucccuucacccgcagguuuuucugagcucuggauagccuguagcuguuuaaacaaccacgaacuuugagguuuuccaaccucgucugcuguuacugacaauacuucguaagacacuuugcuuugaaaacuuuuugucugcauuccucuuuacuccuuagugagacuauuugguaaaauguaugaaccauugcuaaauucucacuccauauuaaagcucuuuagaaugauggagaaagguugugacguggccagugguggugugcuggcugcacagccuuggguauauaguuagugcacugcacuguccaagccaaaaugcuuaaaaugacuuagggcauauuuauauuaucacaauaagaaaaagucauaaaggaaaaauacucaaacaaggaaaauauuuuaauuuuuuuaaaagaaauaauucuacaucuaaggacacucaagaagaauauuauaguaguuugauaguauggauaaauggcauauaccuucauuuuucucauuugugcaauuggaaaaucacuuaacugcaguuuuaaaagacauuugugugcacguguguaugugcaagagugugugugugugugugugugugugugugugugugcgcguguguguauguucaaacauucucucaaaugguuuuccuagcuggcaaauacucaggauguuaaugguuucauguuaguguccccauauccaacuugaacuuucucuguugagagcauauguuaccuaauuuuaauucacaaauaaauuccaacuacucuuggaaccaaguuuugguguucauauuuuuguuagaucauauuucucuuguauacacauugguaaaggauauuuggagacuaaagaaguguauuaggcucgggacucaaaaggcagagagaaaccauuguguauguuuuguaugcugcaguguucaaaagauaacagcucaagugugaaucuuuuucucucucuuuuaaagggaugacuggauccggguuggccucuguuacccagccaacacgagcuuucagguuaccguuggcuuucugcagcggcagaacggcucauuaucuagaauugaggacuaugagccugcgcggucgauggaggaacugcagaagaagccgucugagagaaaauucuauuuugacucuggcacaggguaauucauggaagcagugaaugggaaccaaugcucuucuucuuuaaggaugcaauugcuggcucucuagcauagcuuagaacccugggaugcugauguguucaguggggcgcugguguggacauuucugcacaucacuauuagggguuaggagcaaaguucaaaugaccaguuuuguagcuggcaguaggacucaagugaagauauuugcuguuuacuuauuaaggcaauuucggggaagagauuaucacggucaagagccaucucuaggcccaaccgaaaguaagaaugaauaauuuguucuuccacaacaacucugugauaguuauuuauauaagauagugauuguauuucacugaaaucccauucccaccuucuaaccuaaaguuacuucucaagcugaccaugaguuuuuagacaucacuguguaaccauggcauauuugcuuccaacuuucucuaggcugcgugcgucuucccacuuuuuaauucuuauccugcucuccugggguccugguggcuuugucugcuuuuguccaguuacagucucucagccugugggcuaugguaggcuugaucuccucuucucuccagcaaguagcaugcuccuucugacccuguccuaggccaacagucuacuaucuagguauaaagacaccaaagaagaugggguucauuucucggguaaauuuacagucccugaagcaagguauuauuagacagcgaaaagcuuaaaugcuguaaguccgacagugguguaguuacugugccuuaguggguaacuaacagguuuuuaccuagaguaaccagggacauccuggaaggagagccacgcuagcuaauucuugggcaauugggggaagguagagacagcugggugcggagucucaggcagaggaaacuccacaguugcauggaggcaugagcuaacaucggcauggcaugcgugggaaagacaagguucggagugggaagaaauucgagcuagguugcucgggggaagaaagcucgggguucauuuguuaauuaucugguuaaccucuguuggggaagcaacucauuugcccucugguacccucuuccccaacagccagcguggucaucuucagaguuuccaaguuucaaucucuaauuaaauauaaauagucuuaaauggaccuuaauuuuguuagugacagaauuuccacauucaguggaauuuucacaaaaauuaaugggacagccaaauuugaaagggcguuccaguggccacaaaauagugauuacgcauaugcaaagaugggacauuauuuucugguuuggguauuuaaaaaacaauccaguuucugaagaccuauuucuuuuuaauucuauucauuuugacaauuuaaauuauauauuaaaaggcucuugccuauuuagcaauuuaacucuguuauucuuuaacuauuugugcuaaaauuacuagauguugggacagucaccaauuuucuuaacuuuuggagguugggggaaaaauaggauaucauuuugaacucuggcuggccuggaacuuucucuguguagacaaggcuaccuuugaacucacagagaccuaccuguccugccuccugagugcuggaauuaaaggcaugcuuuguuucuucuuugagaauuuuguacuguccacuucuauuguauucuugccuuuuucaguuguaacuuuuccuugucaauugaccucaucuuagaaugugaccucuugguuuuugguaaucagucacauuuuaucaaguccuuugaaucuugcuagacuucucugguuuggaaacacuagguuuuccgauaacaccacagcaugucuuaacuuggguuuucucuucgucucaguagggagacuauaauugaggacuggugaaacuguucccuuagccugguuuugguccuauagagaaggacagaccacaggcccaugugcucuuggcaagcuuagccuuuguuaaauaagcuacaguggcuguuauauuauuccuguucccacaguguuuuaugagcaauaacuacaaagggaacagccgauauuaaugcccuauagucuaagcucaauauaaauacaguuuucaaggagguuuugagacaagcuaaauuccauccucucagaugaucucuugaacuaauuuaaacaagaaaucaacccugaugucuuucaggacagcugaaugaaaccaucagcauacuccccaagguagucaugaauuugacuuguugcacuagggggaugaagaggaaagcgagacacuuuauuagcuuugcaauuuaucuuucuuuuaaggaagaguuacuuuauuggcgaaauauccccuuggccaugaaucaaguugagaaauguuacgcuucugagaggaacuaacaucaguuggcuugguuucuauuuuacagguuauuguuucuguaucucagagcccacagccacagagauggccacaguuacuguucaucucagggaugugaaagagucaagauucaggcagcaacagacuccaaagauaucaguaacugcauggccaaagcguacccgcaguauuacaagaagcccucggcggucaagcgcaugccggccaugcucacggggcucugucaaggcuguggaacccaccagguaagcagagaagaggaggcgggucuuugggaaagucagagauucuugucuugguagcaggagcacauggcuuugaaacaucuauccaugcugacaccucuugaauuuggguuuguuauagaauguguugcucauaagaagcagagcaguccccauuuguagcaaaaguaucuuuucucuugauuaauuuaccgugaugaugaguugauuauagauuauugcgcugauuaaaauuauuuauuuagaauccuguuccuauaguacuguuggguuuauaugucuaaaaguauucugaaaccguuuugcuuauucauguauguauugaauggguuuuggagauauacggucucuucaagugaaggaaggccuugaacuuacaguacagcuuaggaugaccugaacuccugcucuuucugccucuuucucacaagugcugagauuauaggcacauaugccuccaugccccauaauuccuuguuuuauuaguagugugaaauuccagcucaugucagaacuuguuuccuucucuuaaggcauaaggccacacuauuuugaagccuaugcuauuauauuuuuuucuaacugaaaaugcagacugacuuuaguuagaaguaaaaaugcuucucuugauaugcucuugcuuagaagauacccuaguuagcuugggaaaaauggcaguugaagcaaauugcuagaauugcacacagauggggucccaaggaaaguccgaccaguuccaagggaaaacgaaauggagaacuaauaacgaccugacacacuuaauauagaaacaaauauaggugaaggaagacaugguuccgacgcugugcuucugggccagcuuccccugggagccugugugucacuggaaauuccugcucuacugcaacgcuacugaguuagugcuccagcccgagcccagcaaccuccacagccuagaggaugcugaugccgugcgcaucgagcacacaccacaccaaaaaagagagcuggaaucucagugguagaguauguauuguggaauaguauauguuuagcauauucaaggcccuacauucuggccaaagcaugacauagaaaauaaaaauuuauaugagccagguaagacccuuaucuacacacaugcacacacauugcagguacucuucaugcacacagggcuuggcauuuguuggcaggcuuccgggagaacaaagaucauuaacaaauaugagaaagugagguggugacaguaaauugccaauaaaaacccugcugggugucaauuucaaagccagccugggcuauagagacccaugcaguauuuuugccuuuagguaauauuucgggacacugaauucucuagcccaguguucaguauguccuuccuuauuaaauagacuugauaacuuuucaaaauaacuugaucaucacugguguccuguccucccccccaguggcuuccuuuagucuuaguugcuauuucauagacaaauagaagaauucauuuugagaauauugaugccagauguggugauauaugcccauaacuguaaauacuugaaaacugaggcaagaggauuucaaguuaaggccagccuggguggcugacaguagagagcccucaucucagaaagaaaacaggaagacagaagcaucggugcaggcuggcaguacagcugccgugcauuugaagaguuugggagcaucguguuuacuuggaaauuugagaaaaguguuuguaucucagagccaaacacauguguauuagaagucauuagaaaaagucacagaacucugccucaaauuaagacucaaaagaaauacccaacuuccaaaugucgcuuggugaaacuguugguggugguuuauccggaccaucugcugguccucugccugggaauugugaaugagucagguuggucagggugguggaucuuaagggccagcaggagugaauuggaggagugaaagggaaaggagaagguggaagggacagcagcagaggaagcagggaggcaggaaagaacaggaagugcugcugggaaguggaggaccacucggacuguuacaggugauggaacagagggaaaugggagccugcguguaaugauuggcuguuugagaggcggagaccuggcccuguucaggacacuagaagucgguuaacaguauagcccuccuuauguagagacuuuccuugguccuagaucaaugaaccucauuucaggauaauugcucugacaaagagcucuuaaaaagacaugcuccagggcuggagagauggcucagagguuaagaguacugacugcucuuccagagguccggaguucgauucccagcaaccacaugguggcucacaaccaucuauagugggaucugaugugugucagaagacagaagacacaccucuucuggugugucugaagacagcuacaguguacucauaaaugaaaugaauacuuaaaaaaauaagacaugcuucaggacugaagagauggcucggcuguuaagagcacuugcuguucuugcaaaagauaggaguuugguuccuaguacuguuuugaggguagcuugguucacaacaaccgauagcuccuccuccaggggauuugaugcuuucucuaagccuccauggacaccuguccauuugaacauacauauacauguauacacacacaaacugcauacauaggcagggagagacaaauauaaauaaauacauaaaaauuaaaaauaaauacauuuuuaaaaagagguauaccugaguuuccaugaaauaguuacaauaguuuauacugagcacauauuacugaguuaauucuauugacuugacugugugugggagugcauucuaagcaugugauggaccacugagcuagacauauccccccagccccaucgauuccaugaacaagguuacauuugcuuaaaacugugaguuuuccaaaaaccaagaagcaugcauacacaaccuauauuacaugaaugagacagaauuccaggucaugaaguagguguaaaaaguucagauaaaggaauggucacuugguauguuuucagugaccugugggcauggauacaguugccuucaaaguugcaauguguucuugucuagaugguguuuaccagugacccucacaaaagcuaccucccuguacgauuccagucaccugggaaagcagaaauucagcgaggagauccauccauuauuuccguaaguacagucugguguggccccagucuuuugggggcugcuguaagagaaauugccacaguuuagaagugacagaaaccuacugcucacaguuuuagagccgggaaauccuaggucaaggcaguauuagaaguaaugucuagggagggcugguuugcuggcucuucgguugucuucucugugucccauccucucuugguuguaguuuggaagacucauucauaaggacuuccccccucauuccgcaaaugcucagucuaccuccuaaugccuucacauugggggcuagagucucaagguaggaauuuguaggcgcacagauaucgaaccauaguguugcuucuuagccuuuuggccagguacagaccacacaccuguguacugcugugacuucuggcuuugaucuuuaauccuagugacauacauuacuucugggaccagucacagguuugucacccccuuugauuuacuggugaaacugagguagaaauaccuaaggagguauuaaggaaugguuguauuuaaagguuucuguuuuguuuucuuguuuuucaaguggauuguuauuaauuauuuuagguuaauguuaagcaacgaauaagauagucacaaauccaaguauauguggacagaauuagguuuauaucugcccauuuuuuaagguaauaagauauauguaacaugaaauuucccaucuuauccagucuuaugcccaguuauaugaaguauauucauaauggguuacugucagcuaccaccuagcucugauuuccacagucgugaccaacaguugcccggcuucucuuugcgcaucuaucucuagaacuuucacauugugauccaacucugaggucuuggcaugguguuagucccuucugaaagcuucuuucucccuccauucauugacgcgugugggguguguguguguuugcagggggguggggugccuuuugcaagugcaguucgaauugcugagaaucuagauucucuugucuuccaugaaauguaaauauucugauauugauaaauaguggaucacguauaguuuuucacauauaagauuccguucgauggguagacaagaugguucaguggcucagcccuugccccuccugcucaacuacuugaguucaaucccugggacucucauaguggaaacaggaaacugacuccuguaaguuguucucugacgaccuguccacacacccggaccucacacacacacacguacacauaugcacacacacgagauaaaauguaauuaaaagagaaaauacuacuauagcagaacuauuuccugaguuacagcaauuuaaacagagcuaagcaaaucuuuuugucuuuucgugagcuaauucauggguuggaaauaguuccggaaggacaggcauagugaggagagccugugcaacccuuguuagcugucagugccgugugauuuccucuaaauagacagaggcaguguguggcuaguauguagucguuuuuguuuuguuucuucuuuugcugagaagacaguauuugguaauucuggcuuuccucuuuauucugaagucaagauuuucauaaguagcucaggcuguucuggauccuucugccuuuuguuuggagugcugagguaacaggcaugugccuucaugcccccauuggcauuucuccucuugagaagaucccagguugugacuuagggaaaaguuuuaugaaacugugugguaacccugccagcagaagggagagcaaggucaacauuaccacuggaggccucgugggccuucucuuaccaaagcuggagccucaacggccauagaacagaguaucaggauaggagccaacauuaggugacuuuaaguagaguguuaauuacuuuucuguugcugcaaagagauaccauggccaaagcaauuuauaggagagauuauuggggcucagcccaugguuucagagggugaggccaugaccaucauggcagggagcauggcaggaggcaggcagccauggaguggugguagcugagagcacacaucuggaggcaacaaucaaaaggaagagcuaacugguaacgccacaggcuuuuaaaaucucaagccuaccccaugugacacaccuccuccaucaacucugcauccccuaaccccuaucaaagaauucugccgacuggggaccaagcauucaacuagaugagaccaucgaggccacugucaaucaaacugccauauggagauagggaggggggaauuugugucuuagaugucagagugagcacaggaaagaaggcaagagagugagagcgugugcuggagggcagagggaacaaacuguaaaagagagugcacagcccaagacaaaagagaguuguguuuuggcuccuacagugggagguuuuuuuuguuuuuguuuuuuucaauucuguggcuuucuaacuuauaaauuucuuauuaaguguaaaauuggaaggaaacagacaaguuagcauucuuguuguaaguaagccugaaggugguuuugugagauauguuuagggauuuaguguuaguagggugcuaacaugguaaacaaggccauauacauucugaccacaaguacuuguggcuuguuuccuuuaacuucuuuaagauaucuuuaaggaagacaagugccgucuuagugggcaaauuugauuuaucgguugucuugcagugucuugcuucucagccagguuccagcgugagggugucuuucucuucccguguuuccucugcuccacgccauucucuuuuugccgcaguagcuuagagcuuaagcaucaguacaagucccacuuugccguuuugaugucagaagagacauuuguauuuguaggagaaagaaugcauucaguggauuuggucuucuggacuagaugccgauggggccuuccauggguuaugugggguggguggcagcaccugagaucugacuuccagaccucagugauguccuaaguguucaugcugagaucuggacacuuccgaguuacccucgaagcugagggggcugcccucucuugcuuagagaauguuaucuggccagcagggacucccuuccccaccgcccaggaucggccagcagagccucuuaaccuuuucccauccuuagcuuccuuucugcaaaggaauuuuuauaaaaauguggggauauaaauaugcaaacuaccuacacaaaucaaacagacaaaccauaaagaaaucuauuucaggagaauucauuggucugcaugucauuuuacuaaguauugucaaagaauaaagggaauuugaacagugagcuggauuucuuuguccauauccacaaaaagaauuaaauuuuggcuguaucucugauacuuuaagauacagagcaucuuucuugguuuuuuuuuuuuuuuuuuuuuuuuggaguuuauacauauuuugacauuauuaaucaccaaugcugagaauucuaucucacauaaauaaacacauaguacaaaaugucaaaaggauuuuuaaggucauuuaagaaauuauugggaauucuguccuaaccccaggccaaaauuuacugugugauuuuuuuuuuuuucaaugaaacacgagucagcaucuuaaacaaauuuuuaaaaaucaaacauucuaacacaguacauuccaguugguacuuagacgcacaagaaagacgguaggaaaagaggaaggguuuuguuuuccauaauucagccguucuuuuucuaccugagcaaaagacuuugugcacugaacacacugcaggcagcagggugcagucuccuugacucagcugggguguccgaagcaucauuugcugggcuauugguguuagcaugcacagugaacguacacgugcugugugcuuagaaucaaagcucugguaaagucacgugacgcaacgaggcugagcacagccagaaauacccugggugcauuauguguuuuauguuuuacauggaguuuuggguuuuaugcacgcagacccuuucagucauggcacucuacaugggguuauggucuacaguugaagaaaccgagauccagaggaacucgggagccacuguagacauuucagggagacaguguccaccaaacucaauaggguaacucgaauccuggguuuagaaggagcuugagagaauucgacccuccuggggauguuucugaaauggagaugacaccgugcggccuuuucguauccucaggucaaugguacugacuuuaccuuccggagugcgggugcccuccuccucauuguggaugccugcagugugcccuuccgggugaaggaaaagcggauguuccuuucugcagacgucagucacauggaagaauauuucaaggcuagcauccccccaagguaggccaagcuugcccugcaccagagaagaacuaccucaagauaugacuccuugcuaccauggcacaugcuuacuucugagcucugcuuacuccaugagcacuccaggcucccugagauaucccuucccaccucaggcugaucccugggccauuggcagaucccggaugcuagauuuuuuuuuuuuaaagauuuauuuauuuuauguauaugaguacauuguaacugucuucagacacaccagaagagggcaucagaucucauuauggaagguugugagccaccaugugguugcugggauuugaacucaggaccuucggaacagcagucagugcucuuaaccgcugagccaucucuucagcccccggaugcuagauuuugugacugauaggaaggcuccugggaagagaaaaauuucauugcucagcucuuacuaaugcuucuuuuaccaaccuacuucccacccaacuggcagggucugauuuuguuguuguuguuguccagaccaggcaggaggacaaggagaggaauuuccagacccuugcugcuuugugguggauguuaagugcagcuuuuaagguuaacauuuccuguuuccuguauagugagccucaccuggcuuucuagucauuuccauugaucugaugcuauauguagccugcagaacuaccuaccuccuaauaaggccuauacagucuuuggauuauuuugacauaaacucugugugcacguguucaugccauuuguguguaugcauguauguggggguuggugggggucugguguguguggagggggucauucgucaguaaucuucccucaguagccacagaagugugauuugaguuuucccuguagauacccaaaucugcagaugcccgugucccuugcuuaagaugguguaauauuugcauauaaucaugaucaucucucuauauaaugguaagacccacauagaugccauuuaaauacuugcuauauuguauuguuuggggacagugauaagggaagacgucuguuuauacucagaacacgugcagaccccaccccccuuuucauuaugcuuacucuguauauauaugauggaaugugggcccgugcaugccaaggugcacgcagagaugagagaauaucuugcaggacuguuuuucucugucuaccauguggguucugggaauugacgucaggcuaucgggcguggcacggcaggcagcuucgcccacugcaccguucggguggugcuuggugcuuuuucaugaauaguucugaugagccgcccguuaaauuuaugugugcagaccccguggauaagaggagcaacuguaggucugucucaugguucagauaguuuuagagaauuccuuucugagguuucugagcucuuuaaagauucuucucaauguuuaaaaaccuaucuacucacuuuucuucaaauaaccuaggauguaaaucuuaccguaaauauuagaaaacacaauuuugcaaggcacccuguacaccgaagauuuaaaaaccucuacccaaggagaggcuuuuuagaguaagcucuucucccucuggcugcuggcuauauugcucuuuuuuuuuuaaagauguaucuauuuauuguaugucuaugaguacacuguuacagucuucagacauacuagaagagggcaucagaccccauuacagaugguugugagccaccaugugguugcugggaauugaacucaggaucccuggaagaacagucagugcucuuaacuggugagccaucucuccagccccggcuauauggcucuuuagucuucauucugaagcuuguguguuggacccuaggauugcuguguauguauacugcauuguaacaguguugagaaguuauagggcaggaaccagggguacaggaacauguuuauaauguuuauaaucucagcagagacagagggucacuguaaggucuaccuagcaaguuccagccagacaggcuuucaaaaugaggcccuuucucaaaagcaaagaaacagaaguuauguuauagcauggguguauaugugaguguuaaggacuuuuccagauaagcuggauaauuccauccuaugaagaaguugagaucugcagggcugcuguggcuaguccucuguaguuauucugagucuagucaccacugcuuuaggaagacugcaaccaagagcccacagccucaccccagucuucagcacgugucaaaucccacaugaaggauuugcauugcuaaaggaaucacagccagaguucaaaagagggauucuuuuucugaauggaaaucaacacuauaagaugccccuaacuaaaguaaauuaugaaggucgcacauuuuucuauaacagggaguaaacagugugcuuuccuguuguacuuggcagcugguacugcaguccacuuccaagagugcuguuuuuuuuuuuuuuuuuaaagaaauuauaccaauacaauaagcuuguuggucagauacuaaaauaaaccuuggagccauagagucucuaccagcaaagaaagcaggaauccacaaacagcucuuaaguauuguguugauuuauuguacagugaagaugacaauuuuuuuuuuaaauuuuacuauuuuucauauguacgugugugccuggugccuucagagaccagaagagggcaucagauacauuagagcuggaguugcaagugguugugagcugccaaguaggugcuggauaucaaacccugguccucugguccagggacagcaacugcucucaacugcugagccuucucaguagcccuaaagauggcaauuaaaacaaagaaacaaauaaaaacaaguuuuaaaccaucgagagcaucguaauuuguuguuauuuauuuguuacuguuaugguagcucugggaagucuagggccccucucuaugcuagaccaacacuguacuggucggcacccccgcuuuuaucuuuccauuuugaguuccuguucaccuauucaucauagagguguugacacagauagcaguagagcacccaagagaaacugagaccacucuccacugaguacacuaacccuggaaggcuggcuuccagccugcccucaugccuacgugacucuuguggguuucccuguguuaucacccuuccaagaacaugagaaguaguucccuuugcagcagggaauugggacuugugucgggcugaaaggcaucucucuguuuuccuuuccaaauuugccuuuaucugguaugccaugcugugugacccgccuccgugcugauugucuaacuuggaccccacaggucaaucguucuguugagcacaagaggagaaauuaagcagcugaauaucucggauucauuagcaguucugggacuggccaagccagcacaucuguacagcaaagguuuguauuggcaguauccugggaugacccuaugaugcugcagugaauguaucuuuuuggugguguuugugugcuagacuauucucaugagcucugcccgcagugagcauuguaaaaauuguuucuugauaaaggacugugucaaagaaaguguguugggauauggcuugucauuugggaggcaggaguucauuguugauguaaggaagugcaggugugcagguguuuuuuuuuuuuuaaaucuauaucuguauuuauaauuauauauauauauacacacauauaaauauaaaaaauccugucuuuguuuuguucaacucugacucauuucccucguuaucuuguaggaaauagcuauacacuuuaacuuuucucucccucucuuuuuauagguagugucguauuuuugggauucagcggaaacuucgcaccgucauggacgaagcuguucaccagucccgaugagcagggccucggagugcuugagcaguuucucccguugcagauggaggaauaugggugcucccggaccggcaguguccacagaagagaccuugaccuguuacagcaggcuuugaaagugcuuuagagacuugguuguaauuuaagugcugggaaagaaaaaaaaaaugugaacuaacuuauuuaauuuauggcauuuuaagacaacacuguuaacccgauggaaccauuuuccuguuugauagaaaagggagagaaggaauccaagcaguuaccugagugucagcuugcaggccuuggcacugugcaggugguagagcccuuuugucuuccugaggcugcugcguucagagagcaguuggucucguggcccuugcuuugacaagcacaucgggggugcuuugcuuuuuguauaguggggugcagggaguccaagggcuccuugaacuugcuccuucgaggacuggcugcucuagcauuucagauacuugaaguccaaugcucaguccugcgcuaacuccagucgcugcccuguucagugaugucuggggcucauuucuguacagcccacgaggguuuuaugugaugcuagauaugguuuuaaguggcaacucaggcccagcacauguccuuuuugccuggucaugugcucuuuuuauucacuuguauacugauuacuuuugaggguucaccuuucaaagagggaaccuuauugggacaaaagggcuuuugaaauuuuuuagaucuguaaccauugaggaaaaaaaaagaaagaaagaaacaacaacauaaaccuauuacuugcauccagguggaacuuuuucugcagcuuuaauccuuaaccugucuugaccuuuaaaacgcagagcggaacugaauuaauuuucuuuaaaagcagcaagccacuuccuaaacuguaaaacucuugucauuugaacuugcaaaagaaagccaggugugguggugcacgccuuugaucacagcacuccaggagcagguggaucucugagaguuugaggcuagccuggucuacguagugauccaggacagccagggcuacguagagaaacccugucucaaaagaaacaaaacaaaacaaaacaaaacaaaaucacucugucaacaaaagcuaacuugcaaaagggaaaccuguccuugguuuuggucuuguaccugugcuuuguugucuuguuguguggauuuuuuuuuuuuccaagcggcucugcucauuguccuaccagaaaaucccagagaguuucccgcuugcuccuccauaaauauuguauucaaggaaagaaaggagaugccuucuuaggguggaaucauggaggcaauggacaugaucuucuuuguagccuuuaaaagagggagucucuuagugaauguagcuuucaaagacaagaagaaaggacucugggucucccagugcugcuucuacuggcccuuucuucagccaguggggacacauguggcaaaggaugcuggcucugcagccaagagggaagauggcaucagaaugcugcugugcugcccaaaggcggguggcugaauagccaggcugacgguagcaauugagugcagaaaaguucaucuuccuccguggagggccgaggcugaugccuguauguuguguccaggagacauucuaggacagcucugugacuuguguaacuuuacagaacaugcuaccucaaagugcugugacaaaccauuuggacuguagugcucacaggaugggcacgugucuuaaucaaaguuugguuacuuguuuauccggguuuuuuggaugugggguuuuuuguuuguauuuuuuuuucuuuuucuuucauucuuuuuuuuuuucuuuuuuuuuuguacagugagaucuuaccuauuaaauauauuuagugggucaugguuccugaaggugagugaauugauugugugugcagauguguguguguuaugacuuaaauauauuuguuuugugcuguuuuagaguuccuuuuuuauauauauuuggagaaaguaugcaaguuucaaggcacucaguguuucugauuuuuauguacuaauaauuagggccuaaguuaaauaaauaaaaacgugugugcauguauuuuauguauguguauuugugaaucucuguaauugcugaggucucagauucuagcuuuaaagaaguuaguggcaguaggaaagguugaccauucacacagcagauuuguaaggcagaguuaaaagggaauaaguuuuacgaugagggggagaccagguuucauugcauguuggauucaccugcagggucuaaaaaacccagcggucugaaucccacuggcuucucucagauuagaguucauugauuuuggguguagcugggacaugugauaucuuuuuuuuucauuuuaauuuuuuauuaauuuaaguuuaagcuccuugggugauuccaacaugcagccauguuggaaacacuguacguacaaccccacuguucagcuuucaucugaaaaaauuguugugauuaaaaaaca

SEQ ID NO: 9211 - RNA, 2308 nt, Mus musculus
aguuugaauagauuuuuauuuaguucagguuugaugugcauacagggaaacgcacagaaucuuacauguggguuuuauuuauuuauuucauuuuuuugagacaggguuuuuguguauguaagcccuggccauccuggaauuugguuccuagaccaggcuggccuagaacucacagagauuugccugccucugccugacaagugcugggauuaauaggugugugcguccaagcccggcugcauauggaguuaauaauaauaguuuuccaaacacuauggcugguucugcuuuacuccucccccagcuuaucauuuaguggaaagaaaaaaagaauauaaauauauuaauauaaaaaugaaguuguaguuuaaugcugcccaguugggcuuuagaaauguuuuuugcucaagggugucgcuuuguagcgcucagaucagcuaccaugguugacaucaugacguguaacuuccgugccucagcaggaaagcuguaguacaacccuggggcucuguggcaggugcuaugugagccuguaggagccucauucuguaaugguucuggucuucuccauugccaggucucucugaacgucuucuuuggaaagccuggccccugguuugaggauugugagcuggacggcgauaagaacuccaucuuccaugacauugauggcucugugacaggauacaaggacaccuaugugggaaggauggacaacuaccugauccgccauccaaacugugucaauguuacuaaguggaaugcagugaucuguagcgggaccuacgcccagguaggcagggcaggugguccaggcccucagcuccuggugacagcagggugacuugggggaggggagggucccaagcacaguauuuauagaggacgggaggaaagcaaguggccauggaagagaaagggagaauguuuuacuaaaaucucccugaaaccaguuaaaucaaagaagcaaaccagcaguggaacuuagugauacaaccaagacaagagaagucacauucccuuuuuugagucaagguuuccccaugcaguccaggcugacuuggaauuuguggcaguccuccuggcucugccuccacuuccuguggccugcgacagauagguaggucugauguuucuugacccuuaggguuuucuuaccgcaguucaaguguguucccuuaagggaguuuuacccucugcuuccacgguccuuaucucugugacaucugacuuugagauagaauauuagcaagugacccagaaagaaugaguuuccaaggaaggaaccugagguuuggaaauaaauagacaagaaggaauccagggaaauccgaauuauauuaugauaguaggaaggaaccugagguuuggaaauaaauagacaagaaggaauccagggaaauccgaauuauauuacgauagucugcggagauaugaaagggauagcacagauagauggggaaauacgucuuugaaaucauuaagcuaguauguauuugagcagaggagaggcucauuuguaaaguaugcauaguuaggagcauaggcucuggagucagacugccuggauucuguuaugugcugaagugugaggugggcaaauuaaaagguauucgguggccuugcauaauaggacagugagaggacaggauacuccaugguacacauuuagcguggggucuggcugcugcuggggaaccugcugccauuugaagaagcagggcuguaaguuccaaagcugguuuuaacagggagaggauggaggaagaucuuacggagcugaggcuucaauuauccagaaauuuggaggaggaggaggaggcagaaucuuuagccccauauuuagggcaguaaaagugagggguuuaauaacagacugcuaggcuaggcgugguggugcauggcugcgauuucagcauucaagaggccaaugcagauagagccccacuucaugguuaaauugggcuacauaguaagacaguagcucaagaagaaaaaucagaggggaacaaagaauaaaggaagggguugaucugagcaccaggaaggaaauuggaggaagaacaaggaauacucuuaagucacacuggcuugcaauagccgauaccagaugccucuuuuauugugcgguuucgccacugaccuugccuuagcagccaagcguacguguuuguggguuccugccucggugcuucuccaaguacgccgugucugaugugguuuuccuucucuuagccuucuguagcuggcauuccuuacaacagaauucuucaucauucuucugacuuugaaaugauuguaaaagaca

SEQ ID NO: 9212 - RNA, 1336 nt, Mus musculus
ggaggcagaggcaggcagguuucuuuuuuuuuuuuuuuuuuuuuuuuuuugcaauugcuaacuuuauuugaucaggagcuccuagugcaaacaucaaacaagccucggcuuugaucugugagcucauaucacaugucagggaagaagcaaacugugaccuacauacaagguugaagacuaaagguucacggucacauuggagguuuguguucuacagccuagagacuggcagucacaggucuuugaggucuuucuggaugucccacaggguguccgcacucuuccugagcugagcaaccucaucguccuucagcuucugauugaugacgcuggucagcccccgagcguugaggauacaugggagacugaggaagacuucguucucaaugccguacauucccuucaccaugguagacacggggugaauccgggagagguuuuucagcauggacucgaugaggucagccacgcucaggccgauggcccaguugguguagccuuugagcuugaugacuucauaggcacugaccaccaccaucuuaugcaccuccuuccaguucucacugucauugucuguccccauuucuggauucaguuccuggagggagacuccugccacauucaccccgcuccacacagccacacuggagucuccaugcucgcccaggauccauccauggcagcugcugggaugaaugccaagcuucucugccaugagguagcggaaucgagcagaauccagauugcauccgcuuccaaucacacggugcuuagguagcccucucaguuuccaggugacauaagucagaauauccacuggguuggaaaccacgaugauggugcagucagggcuguauuugacgaucugaggaaugaugaacuugaacacauugacauuucucugcaccagguugagccgacucucccccuccugcuggcgcacuccugcggacaccaccacaaucuuagaguuggcugucacagaguaaucuuuaucggccacaauuuucggagucuggaggaacaagcucccgugcugcagguccaucaucucuucuuugagcuugucuuccaacacauccaccagagcaaguucaucagccagagacuuucccagaaugcugauggcacacgccauacccacuuguccaacgcccacuacagugaucuuguuguucgggacggcagccucaucuucugcaacugaugcaaugagcuucuccuuaaggguugccaucuuguccagaaaagaggaggcucugcggcgcgcugagggaggagaaccacugcaaagucagcaggcugcugcucugcgaaccgcaaacucuggcucucg

SEQ ID NO: 9213 - RNA, 4109 nt, Mus musculus
gucauguuuuaaacuauuuguauuuuuuuuuauugcaaaacauuuguuacagaaauuccagaaaguucguugccuguagaaucugccaacuucugcuucaaauuauauaucuaaacagacaagcucaaagugcauugugaauccaguaagagaccuuuaaaaaagaacaguucuucucucuauauauauucauagugucaguagauaugcaaaccucugucuauccauacaugaaagaaggaaaagauguauauauaguuaguaaacccaauuucaaaaucauuguauuuauaggaauucauuuaaaaaugauaucugaauaacuucccccuuuauaaacuaugguuagagcauuuacagugugaaucuaagugcuagauuaugaaauggcuauggaguuguuuacugacuacacggacugucuuacacagcgguagcagcaauaagaacucaggucagaugcuccagugacaggaagcagguaagucuucgagugcuacgacaucuuuccucugaaucucccucacacugguccuguguuuggauccagaaaaacaugcuaaucaacauacauggaagugaucuaagagucaccccuaguagggcaaacugcuucuccccacuugaaauucuccaguguauuugauguguuugcuaacugugugaaaaaccaugaaucagacccugcuuggcuccaaaucagaggccuccaaauauggccguugggaauacugcaggcagacacaugugugugacuagcauaggaguuggaaacccaaauuugagucuuucugugagaugcguaugcucucacgccuaacaaauccugcucuugauuucuuucuagaucugggucuuggauugaguuggcaaucccuucauggagaguuaggcaacugguucugaccauguaugggaagcuggugaagguggagagagccuuucaggagucaggcgggcaguucagaauugcaugugacaugugccacaccagccacauuaagaacuugggugcaggagaagucagauggacaaccagaacugggucagaacaucuggcuucuuccauguaguugauguuuagcauuacuguguugggauccacagggaugugagguaaugggugagucuguuagucucacacucauacuggggagaaagagauggcuuugaacuaauaaaaaacaggaagaagggagaccaaaaaaaaaaaaaaaucccgugcccucaggcccaagacugaucucauccugugucucacauucuuuagcaaucugccuccccuggggauuagagucauggccggcacugaugccccuccgaguuggucaaguuuccaacaccaugaugcagggaucgugugcugccagcagaaguuggccaguuuuuccaggaaaauuaggaaaggaauuaucaucaucucuugaugaauccagaggauguggucaccucuauccccucuuagaugacacagagcaaucaguagaucuugauuuuacuagggaugaccaauguaaggaggucacaagggcaaagggcgccaucgacacucggugaaauuaauuagaaaaagaaaagaagaaguuguucuuuaguuagagccagaccccuuucuuauggacucucuccugagagacaggaugcuggacugguagauauagggcaaagcugaugcugagaaacgguuucccugcucauuuugggagcguuuuugacuaggcaacuuggauccauuccuuuccagauguugaagggcuuauaacaaccgagcggcaacuucuugaaagaacaagcucuucagagucaccugguguuucaucaaacgaucacccccacucccaccucugggccuggcucacccacggggugugaaagccacaggacaagaagggaggucucaugcauuaccacgggacugcucgcucacaguugaucugugcauuucugcucugucgccgugcaccuugacuuuuaucuccgcuuuagcaauuugcacccaggaagcccuaaagaauccaagaugugucuuuccuauauuacaguugcccccacaccuagaccuugggacuccagagcggugcugccuugucaucucuggguccccgagcuauugcaacuuguaguugauacuuuauuucauauuauuugcucagagcuuuaaaaaaauaaaaagagaaaagaaccccuugaugacuuguuuuuaguuugugagaacugaaaguaguccccaguuuaagaagcccaacaguucgagugacucgauaacugguuuaaggauugcagcagaccagaguaaaaccuuaagugccuuacgaaggcaaagagacacauauaaagcauagcgugcgugcauugugccgacacaaaacuaggacuggguuuggagagggauuacuucagucgagccacaucguuaugguaaagauuagcaaguuggaugcaacaucuaggccaaauauacagccacccaaacaacaccaacacuuuaucuauaacagacagugcuacugauugaauggauuuauaaaacacugcacacugcuuccuuauggggucaguagacguaaacaggcagcuaauucaacuggaguuuaaacucuuucaguucauuugcuagguagucuuuugcauagcaugccagcuugucagacacaaaaccacaccuugccucucccagcuugugggaccugguggcggaggcaccaucagcuuauauaaguaucucacgggggucugagagaugugaagaguguaagagagaucaggaacaaaaaugcccauuacuagaggcugcuaaaaacauggaaaaugggagcauaauuaauccuugccacaugugcuucuuuauugaauguuacagauuuauaaaugauuauaaagcuguccuguaacguucauuaauacaaccacaugcuacaacuaugcugguuaaacacagguuacaaauagguuuacauguguuuuuuuuuuuuuuuuuuuuuuuuuuuuuuuaauaauacagcauugcccaauaugucacauggcauagccuauagauauagcaugauggauaacuggauaaugcuuauuaucuuuaaagaaaucaaacagcccaaacauccaggaagauuagacuguacagcugcagaaaaaaaagaaaaaaaaaacguacuauccagugaucuaccauaauguuaucuauagaaaccagauuuuaaaauacaauuguaacauucagaagaaacacauuuuguguuuucacaaguacaacccccccauuucauuauucuuguauauguauauauuuauauauauuuuaaagggggaacuuucaaagugcuaaauaguaacuggcccuggaagcuucaacuuuaaagaaacauccaguccucuaaagugccacacucugacugcccuccuuuuggcuugcacacacacaaacugcccaugacaauuauccucuugcuuucuagcacuucauucaaaucuaucaguuucuaacuguaaauauaaaauauggcgguuaaucaggaaaccuucauggccauuuuuauaaaacauucuucauuucuuucccaaaaggaacaagcaagcaauuuagaacaaaucauuacacaucguaguauauaaaaauuggcaccuaugaaggggaugauuaaacaagcuaucucuuccuugagcccucuaugacuuuauuuauguauggucuucaaugacuggcuacucacaagcuguuuaauucacagaggcagguaauuaagguccccuccaucaggggaaugguggaacaaaugagcugaacacaagcugucugcacaaggcuagagaaucaaugccacacugguacacagagaacccagaaauggaaggaggugggauugaaaauaacacacacacacacacacacacacacacacacacacacacacacacacacgcacagggaagacauggcuugugagaccuacacaguuugugucugaaguuguuuacauuuggcuuauagacuucacacacuucaccaaagagguuagcacuuaauuuucaugcagaaugagagcucaggacuguaaaguguuuccuuucccaggucauguucguucucucaggugaucacaacaaacagagac

SEQ ID NO: 9214 - RNA, 2020 nt, Mus musculus
aucuguauuuuuauuuuuuauuuaaacuaguaacuucuuuuuuuuuucucaaguagcaaauaauugcucagaaagauaaacaguugacggagauuccucuggcccaagaauucuaccauguugcccagaaaagggaggccuggagacuauaucagguuaguacagauguaauuuaaggacagaagagcauguguauucauaucugaguccugggagccugggaagacagggagaugaagcugcucugagugauaggauuuauuacagaggacgacagcacuauuugcucacuucuguuaugagcucagcaaaaugugacaguucugagaaauaaaaauauauaucgcucuauuuauauguguguuugucucgggagacuuggcagugaguggugggaaggguuuccugaagauagagugggcagagcgaacugggcaaagugaagccuguccuaggccuguugaugccuagugauaaacacccaugacaggaacuaauauugauugaacacuuaaguacuaugucaggucccuggcucagcuccuuacacgcacaguuuaauuccacaugaauucaccugcuauguagcaauuggcucuucugcauaaccuugcauccuuuugucaucuuccugcaugcaguggacugcccuuaaacuuccugcagccuacauagaucucugauggaauacagaaacaauggaagcauucuguaucuuagccuggacaggaagaaaauguuugaggcuuuaccuguuacaaguggauacagggaagcaaacacucucagcccucucccaugcaacccaagcuaucuucugcaagccucuccaggaggcuuuguuugauucacaaccuugaaugaccccuuucccuuuauagucccucuccccagcuuuuuauccaccuuugcucagggauauguccugcccuuaugacuugccuuccuauguccucuccuucaaguuuguuuuuggauaaggccuuguuagcagaguccuuuuuuuacagccgaggagaacacacacacacacacacacacacacacacacaggucccuaucuaacucauccaucaucugagcuucccucucuuagacugacuuuccaugaccuuucccccacagccaaggucaggugucugucuuauuuucugaguaauccaggugauacaucucauauaacaugugauacauuguaucauacauauaguacugaguuugaaaugauucacaagaugccccacuuaacaacaauccuccccaaaccagauggcuggcuucaagaugggaagagccaugucuacuuuguccuuagcuguaccuccagcacccugccguggcuucauaaacauaguaauugcuuggucaauauuuaccagcacaagugauuugagguuccuucugcucacucacaggggcucacucaccugccaggaguuuugagcuacugcaagagcugugccaggaaugcauaaacuaaaggccccaugagcgacauaagccugucacacacugccauucuucagaauguauauagaagaaccauauucaggucaagaugacagaauugcuccaggggaccaaaguuuuagugccaacuguaggauugaaucuagaagcaggagaaaaugaggagaaaugugaacguuugaauaauguccugaauucacucaccuucagaguaagucuucaaucucaccgcuuugccucacguccucauugugaguuuauaaguauuuauacuucauucugcuacggaaauuucccaccuauauaacauuuucaaacugcgucagaagagucuguggagaaggguacugcagauguuuuugagauuauugaaaugcacaccaauguagaggcuucccaggcgcacucuccauagcuggauauuuuggcucugaacaaaguggaugaaucgucccaucugacaguugcauauauaagucaagaaguguguguuaauagucaccggcuuucugcugcuguucagugcuugucucuggcaauccuucaucug

SEQ ID NO: 9215 - RNA, 1257 nt, Mus musculus
ucuuuuuaagccggguggcugggucaucguaggaaagauguggcugcagucguggaaagcacgauuccugcaaagucaucuccacucgcacagccuggccggccagcccgccccgcccagggacagcaacaccagccaccccaccucucuuuuccucccccacccccgcgccuugcacgcagggcccagaguuggggugcgguauggacuauguuuagaagcugaugucaucgcgacacccuacucugcagucuucccagagggaccgcagggcagguuuuccugaucuucgaggauguggggguggaaaguggccugccuucucagcacaccucacacccaugguaccucagggauuaaaaaaaaaagaaagaaagaaacaucgcuagaguuacgaaacagggaggcgcgcucacguggagcgugcgagcccaguggcuagcgccccaggggccagcaacccucccucguggcuccaccuccaccucaggugugggggggcuaaugucaagguuagcucacgugggcgcgggcgcccggagcuccuugcacgaguuuggggcggauuccucgucccccaaucuagggcaguuuguucaacugcagcaaagagagcuugauguuccagcagggaagggauuucugagaacugggacuguccucaaaugaaccugccuccuccggcugcugcggcggcggccgccugcggaagacuuuuuaaaagggcgaugccaggcccagacgcucggcgcgcaaguggcugaaccgcccgccacucugcggccggagccgagcacccgccccgagcgccacgcggggcugcucugagcucagggggcugccggcuaaacuuauccuccugcauaugcaugaacggauggccuuuccgcuccgcaauggagaggccugggguuuugcgguaggcugcuuaguggagcaagaguaaaguagggcgucguggaaguuuucgcgccggagcuccccgcccccuccagacacuggguguuaacucaaccuggcuacaaucgguucgccagauccggcuuuaucggauuguuucaaauccagggacgucgcucuagugaagagcccaccccuucauuccugucucuauucuuccuaaacucaccaccuuucagcaaaacgaacacagcuuuccccaguaggcccuuuaugugcucugggugagauucccuaaagcugcugagcucaggccgggaaagggcgaggugaggaucuaucccaaugugaggucug

SEQ ID NO: 9216 - RNA, 2284 nt, Mus musculus
aguucugcggucgucuaccugauaagguagaccagucuuguucucuacaauugugaagcaagaggaaggaaaggcuugcccagcaggaacagggaggagucccuacaaagaaaaggauuuuuucaaguuaugcaaaugcaaugucuuauuggucucaguuuauggguuaagauagcuucaagacagagcgaauuuagagucaaaggcgcccaaggaaguaggagguuuagcaaaaugccaagauggcggugcuuuuguguaagaaccauuuaauacggaaccggaucuuuuguuagcugugaaaaauuuuagaugaauuucucuugguuaauguguggggugaaagaacuuuuaaacaucuaagugcugcauuccaaacaagaacgaauugaugcugucucauccgagucuguccuuggacaacguggccugccauaucgaggguuuaaaauuugacucacacuuaguuuauuaagcaccccguccuuccaucuauauuuuagaguuagcaccagcaacacaaauaugaaaagaucuguccgauucacuucugcuccgcagguuuacaagugucgggcgcuuccuuuuggaacgcccuucugauuggcugagccaaugccagugacaucaaccaacuuacuuuugauuggaagccugguugcugggacuguagcguuugcaggaagucacuuaacuguuugagggcugggaacccgaaguugaaguucuguuucgucccuagggaugggcguaacugccuaggggagaagcguucccaagccacgccagcuggcacgugggccgggaggcguaggcgcgcgcgcggucugggcggcaucugcggggaugcgcagccgcugguugccgggcuccgagcaguuucccuuuuaaaugucagcguucggggcuggaggggcagcacgcggcggcggaacggaacggucggauuggccgcgcgccguaguucuagacgcaccucuccaccgaagggcccuucugacuggcagggggagaaaguaaacagaguugaaucacccuccccacuggccaauuggagggggccuggauugugacgugaugggauucugcgaaauuguuacugagcuggagaaugccggagaggcgcggcgcggcaggaccaggggcucagcggccgucggcggacgcgggaagaagugucucguaggcgcggagccccacucagccccggccccccucguccgcguacucggcugaugccccggggcgucagcucggcggagaggcggucgaggacgugcgccuggcucgcaguuggcuuucucugggacuccgacacguuugcagucgaauaaacuugcgaccgccacguguggcaucucuccgaggagggcgcgcccaucgugggaucgcgcggggcgccgggcagggcggcggcgacagcggcggagccggccgcggcugcugcgugcggaggcgcugccgguuacguaaagaugaggggcugaggucgccucggcgcucccgcgagucgcaagcucccgcgcccccgcccccucggccgcgccgcaccgcgcucgucguccgaggccagggcagggcuagccgaagcuccgcagccaccuucaaguuuggccgcaccgcccgggcugccgucgcccgcaccauguccgcggccgccuacauggacuucguggcugcccagugucugguuuccaucuccaaccgcgccgccgugccggagcacgggggcgcuccggaagccgagcggcugcgacuaccugagcgcgaggugaccaaggaacacggugacccgggggacaccuggaaggauuauugcacgcuggucacuaucgccaagagcuuguuggaccucaacaaauaccgacccauccagacccccucggugugcagcgacagucuggagagucccgaugaggauauaggauccgacagcgacgugaccaccgaaucugggucgaguccuucccacagcccggaggagagacaggauucuggcagcgcgcccagcccacucucccuccuccacucuggaguggcuucgaaggggaaacacgccuccgaaaagaggcacaagugccccuacaguggcugugggaaagucuauggaaaauccucccaucuuaaagcccauuacagagugcauacagguuagcggcgucgccucucccccgcuucgggcuuuagcuaaccuuuggccggccagcauuccugggcgcccaggacaccgcacucggccuagaggcugcaaacauuuuggagaagaugcugcuuaacuccugca

SEQ ID NO: 9217 - RNA, 33732 nt, Mus musculus
cggaacucccgccggcggcugggcucugccggaggcgcgcccgaucgcggcggccgccaacauggccgagucgaacgaggagguggcggugcuggugcagaggguggugaaggacaucaccaacgccuuccgaaggaacccgcacaugugaguggcgcgcccugcgccgccggggucgucgggggcggcucggggccgcgcucuaguccacucgccggggccgcucggggcccacgcgcgcuuccgacaggcggagcgcggcugggacugucgcgccgagccggcuggccguuaccaagacgcguggcggggcagugccggggagcgaccuccgagagccacgucggagcguggaguuuucugcccugcgcgacgcgucccgggaguuguggcaacucuucuccccgccgcccuccgccgggaugcgcuugccccgcgggccacuaccgugggucucugugucuuggaggcgacucucgguugcauccagugcguggcuauagaggauuauccaccccaucauacucccuacagcccccuuucggguuaacuaaaggugauuggaagcugccuuugacuuuucgacucgcuugucacaaaauugcaaagcgagucggauguaacaauuuuugaaggugaccugaguggaucuuauaaagcuguugcaaacuggauacuuuuuuuuuauuaguagcgcguccgaaguuacagacgagcaucuuaaggcauucuuaccuagcauuguugccuucuaaaaguucacuccugaacugauacauauauuaucucuuucuccucccuuuccauuuuauuuguuacucucuaggaagauacucuuaagauuguauuuuucuuuuccugauacucucccuuuaacgaauggaaaggaagcuacuaaagaguuaccuacaucaguauacaaaagaauaagaagccagaauguagcccauuccuggggaaacaaacaugaaguccgguuuuguauuauuuucucauugguuauacaauuuauuuuuaauauuuuaauuuuuuuuacuaaaacacaugaauuauuuuuacgcauucuagccuccuuagcuuuuccacuaaaugaaaggccaaacacuuuaaucaaguguucuuuuccuccaagaugaucucagaaaagaauuuagaaguccucagauggccugcuuucuucucucaauuaaggacuuaaaacuguacuuccuucaagacaaaagacuacuggccucuaaacauaccugccagccccgacagccccuaagucguccuccuuuccucuuuugacugcugacuuuuuuccccaaugaguguuuggagugauuuccuggcaguagccauaguggcugcugggccuuuuaaggaaugcuuugaugucuugugugucugucuuugaggcccuuuuugagaauuccagcugcagagcaaguaaaagacacauccuuugggggggggggggaagcugggcaagugagaagguucauuuuuuaaucacuggugucauuuucuaaaacauuguaacaaagguuagacauuuaauaucgugaucacuccaguuucucaucuuugagguggacaaaaaauacuauauuuggcgaaauuaugauuaguuaguucuggagguugacccaguggaauguggaucaggucucuguuuuucuggaucaucaaaaacuccuaaagggcuucaacuccucucucuucaucauaauuuuauucugcggucucacuaauauauacucugucaacauagaauuuauggcuauuuguaaguauuugggucauuugaauuuauaaagguuugaaagaagugaaggcuugagagaaguugggcacuugaaguaaguuucguaagcuguaaacauugaaaucgcucaauucauuguuuaguauuugucagcagcuguauuuuaguacauauuccauacaguaggaguaucuucuauccaucuuuuaaaaugucuuuuguguuagacuuuucagaagugccaauaugucuuugcuuaaucuagccuuuuuagacucaagaaggcuguauuucuaguuuuaaaaacagauauuaucuaccuuuaaaguuacuaucuaauaacaguauuauaaaaguuuuucauuaauuaccuuuguuuccugucuucuccaaauuaagauagguugccaauuuauuuguuaccaucuacucucuugaauauauuaacuuuguuucuguagaaaugucugccugaagcagccaaaggcucugugcuauaggaacauaggaacgaugcuucugucggcuaugacugaguucccccaggcucaaggcugucuugaucuugaaaggccaaugagcauucagagcgccaguuaaccuaggucccuccacuccuugccagaacacuuugcaaaguggaaaacauaacauaaauauuguucacaugggugacugagaauccuuuuggguucucugcaacuaguggcuugacccaggaauauuuauuaccaggagguauagacugugccuuaauguggaaggcagcuaucuacuguauaaccuaauuaggucaucauguuaauauucucuuauccagaaaauuguucuuuuucaauugaauguuguuuuaguuagggcuuuacugcuaugaacagacacugugaccaaggcaacucuuauuauaaagaccaacauuuaauuggggcuggcuuacagguucagagguucaggccauuaucaucaaagugggagaauggcagcauccagcagacaugaucaggagaagcugagaguucuauaucuucaucugaaggcugcuagaagacuggcuuccaggcagcuaggaugagggucuuaagcccaugccuacagugacacacccacuccaaggccacaccuccuaauagugccacucccuggaccaagcauauacaaaccaucacaaauaucuacauugauuugaggugcauauucacuaugugagacaaaaaguacaaaauauaguuugugcugaagccagauuucuggugugguuaaauugugcaucugcuauacuagccauauguagcuauuggauacuugggacuguucuuaaugugaaugagagucgaacuuuugauuuuuaagcauaauuauaugagaaguaaguacuauguugccugguguggcuuuagugaagaccuaagacuuaaccugcaugaacaguaaauuaaccguacaguguaguucccagugacgauccguuagcugucuauuggaagagaagggaggcuggguguaucccaugggaggcaguguuuaacaugaacaccggagcagguucuugacucucuggccuaauuguugcauucauguguauagcaaaaacaaaacaaaacaaaacaaaaaaaccccacacauuugacaggccaaaugcucgucuaggguuaguccuaccaggagcugagcauguccaguagcgcauaguugagcaaagggcucuauccuuaaugcgauuucaaaccgauccacacauaacuggugaaaguaggcagaaagguaaggaagacaucaugaauagugauacccaggagacuuuauuugacuuacaaggccaagauaguucuuucagggaagcuagcauuugaauugagacacuuuuaauccauaggagggcuacuaaguaagggcauaauaaugaaacacaguuuaaaguugucugcagauugaugaauaugaaacuaagaauauaauggucuuacacguguaguuuacucauuuaaaugauaguauaguuuuuaaaguuuuuguuuagaauuugaguccuagauuugaaucuucauguuuuauuuuuaguccaauauacuuaaguaagauucucuuaucuguaaaauggggugaagauuuuuacuguagauuauuauugcucagaguaaauacagacuguggcauacaauaaacagcaauuucuguuuuuucuaaauaaugucaguaauauaguuucagcgguauacaaaguuauuuaucuuuaaaguuaaaaauuauuucagagaccuacuaggucucggaaauaucuucacuaccaguuagggguuuaaugauuaauauacaagcauuaguucuuauagauauuuuacuguguccuuuuuaaucauucuaaaaagaauuagaacuuauaagacagaaauagcuauucaauaaagauauugauacaguuuccugaaccugggcugucuuuuguucuguugugacacuuuacagaguucauguugaguauugucgaaagcuuaugcccaaugugaucucacauucuguaaaaauacuuaaggauggcaaaaagauguauaccaaauguuagugacaguagaaacgggcuuuuaguuuguauuuucccuuaacuucaauggacuucauccgcuaaaagcagacucaagaagaaugagcucuugucauuuuuaaaugauuuuggaaucuaaaaugccugaacaaauuagacagugaucuaaaggaauagauacagaaaucuaaauugaaacauucuguuauuugggagcuuaaagacaacauaucuuccuaaagaagaugcuguuaacuuuuuuggaaguaacaaacuaccauuuucuuuacuuuuuuuuuucuuucuuuuuuuauuauuuaaacaauuuuuuucuuuauuuacaguucaaaugcuaucccaaaagucccuuauacccucccucccuccccacccugcuccccaacccacccacucccacuuccuggcccuggcauuccccuguauuggggcauauaaucuuuucaagaccaagggccucuccucccaauaauggcggacuaggccauccucugcuacauaugcagcaagagacacgagcucaggggguacugauuaguucauauugcuguuucuccuauaggguuacagagccauucagcuccuuggguacuuucucuagcuccuccauuggggucccuguguuccaucccacugugagcauccacuucuguguuugccaggcacuggcauagccucacaagagacagcuauaucaggguccugucagcaaaaucuugcuggcauaugcaauagugucugcauuuggugguugauuauggucugaauggauuccuggauggggcagucucugcaugguccuuccuucugucucagcuccaaacuuugucccuguaacuccuuacguggguauuuuguuccccauccaaaauucaauuuucuuagggcaaaauaacuugacaaaggguugacauucuuuacuucuguugucuacugaccaagaaacuugacacugaccucaugcuguuaagugaacugcuuauccuugccuagcacuucauaguuugccacauucuucaccuuugguuuuccuaacagggaagauaccauuucuguauuucugaugagcaauccaguaguguaggacuuaacauaucacacuggccauuagugguaaagggagauuaauuaguucaggggcauuuaucaagagcuucugucucuauacaacccugcaucucuuuucauuugugauuuuuuuuccuuuaguucuucaaaaguuuacauucuuauggcucguucuuuuuacguggaaagcugcaugcaggcuaacccauuuccuuuacuggagauggaauacaguucgacccucuuacagaagggaaaagucugucaaagcuaaaggugcauucuagauggcccaugcaguacagcgcauuacaaagagcagagguacuauucucuuagaguaacuuuuggaagcugggugaaugucacugaggagcaaggaugaccaucauucagaugcacuuauugaacacaggcuguccaacuuucuuggaaggguagccggucacaggaguguuuuuuuuuuguuuguuuguuuguuuugguuuuguuuuuguuuuuuugauucugcaccuuguccuauaauuuagguaccaaauuagcacuuaaauauuuuauaucuaguacaacuauagugagugaauuaggguuacuagagucacagaacguauguaauaucuuucuauauggaggaaauuuauuaugaugguuuacagucuguagucugacucccuaacaaugaucagcugugaauuggaaguccaagaaucuaguugcucagucccacaaggcuaguuguuucagcuggucuucuguagaaugcuuuuauaugcaagcaucgaagaagaacaaaucuuccuucuguaggucuccagcagaagguguagcucaaauuagaggugugcaccaccaugccugcaucugugacuuguuuugucccagacugaccuugaacucagagaucuccuugccuuagucuccugggauuaaaggcguguacuaccuugccugggcauaagcuuuuccuagccauuaugccucaagaucucuuugccaagauccaggucaaaaacuugugucuuccagccucaagaucuugaacacaggugagcccuccaauucuggauuguaguucauuccagauauagucaagaugacaaccaggaauagccauuacagugagcaaaacuuguuuuuaacauugugaauuuaaauuuaaaaaaaaaaaaaaaaccuaccaccaaacagugugucuggaagcugggauucuuuuauucuugcuaauguagcauuuauguuuuuagcuccuggaguuccuuaaaguguuacaaguaguuauuaaaucucaaagagcagucuccugagugaguaaaucuggggguuguuuuuuucaguugguugugcuaauuuuagguuauucauguuuguuugagacagggucucacuguguaauccuggcuggccuguaaugcaguauguagaugagcuuaguuccauucuuaagagaauuaaauaugugagguuuuuuuaaaugcuuaguggaauuagaaaaaaagaauuaaaaggcaguaauaucuucaauuccuuuuuauaucuuccauauuuagagaugaaauuggccugaucccaugcccugaagcaagauauaaccggagucccauuguccugguugagaacaaacuugguguggagagcuggugugucaaguucuuauuaccauauguccacaacaagcuccuuuuguacagaacgagaaagcaauggcuaaacaaagauggugaguaugcgcagccaggcuucuuccucugggaggagaccuggcuugggguuggcauuccuggacucuaguuuuggcucucugcacugccugagcagguguuuguccucucugucaagugaggagcuuagacuugaucauuaguguuccuguuuguaaccacagugauuaaaauggaagugucucaggcaggagccaggccaccugcugucgccacagugauuuuauauguguuaauaugcugaggucauuuguaagauuuuaacaaacaaauaaaugaaaguuugagcauccauuaguuuaaaaacaaacaaauaaauggaaguuugagcaucaucaaagaguucuauagauccuauaaccugauuucugacuccuuagcagaacuuuuuuuaguaacaauucagagaucggcccagugcucccuugcuguagugacccccucuguggucuuugagucccaguugagaugaggccuucugagucuuaugugccaaaaagaaagcuugaaaauuaagaaagagaaaauguuggcuuuuacuucuuucauuguucugugacaacucuucaugucaccgauuaguaccacacgugaccucuuuuuccagaguucccucagaccaagccucugagugcacacauucuguaugaccacaggugucacuccugggccguguucauauacaaccgcguccucucuccuuuuguaaagcccuuccucuucucuuauacagcagcaucuacagaagugcccaaugugccgggaggaugguugugaauaagaauuuguuuuuuaaacaaguuuaauugucaguucaguagucauuacgaggagcugcucugaggacugaggguauacaagaugcguagugcauguuucuuuuuucuaagaaguuuugaguugagagccagacagccucuuuugggggaaagguauguugcacaugaaccccucugauuuaccugaauuuuucucaguacuauccuuaaaagacugucaaaauagauuaguagcucuuuuuccuuuguggaccaugaaguagcauuuuucaaugagaagugguuuugauuuucucugugacgaguuucauuugcuugguccucugacucauguuucuaagucacaagugcugucuuaaccuggugugaugguaucagaaugaccugaguuuaggcacacacuucagacaacuguaaggcauccagcuuuuguuagaccuucuuuauucugucaccauagcacggaguucaaagagccaugggacucgauaaaguuauguuuugccaaaugaagcuguauuguuuuaaccugggguaacugagccagugcacuaauggagcagaguaacugucucauacagaagaaacaguuuuugaagaucaaaucuaaguugucugcugauagcguuagacuuugcccauucauauggcuaagcuucacccaccuguguccuguggccauucaaauccuccuuuacauuucagguucuuaucuuauaagccccguacugcagacuuugcuaucuuauucacaagauuuccaucuugauagccccacuggacacuaucaggaggacagcggaggcgggauuugauuuaucuugggucuggagaagagcgaaucauaugguaaccuaaggcuuguguaggaagggaacguucagugcagugccacagcccacuuaggccaugcuuauguugcauuguuaguaaaagaaguggaccucugccuugaugucugaaaugcuaacaccaaaaaauugugccacguuaugaauuaaaauacuuagaacacagcugaaucuugcuaaaacuaaagaaagauacauucaaaaguuuuaaaaagcaugcuuuuucuuugaaucuccucccccguuuugaaaagaaguacaaagauagagaacugauacuuuaauaaguguuucaguaucuacuugguugggccagaauccugcaauagaguuauaacuuggugacuuuugucaucagaauagauuuuuuuucacccgaguuuauaucucaugcucaugaaugaucaaauaucaaagauauuugaaagaucucuuguuuaguuagugagugguauuuaaaagaccgauauaguaauagcuguguuugguuugguggaagaaugauauuccgauuggccuaccaaaaccacccacccacccaaccaaucaaacaaaaagaagacaagaaagaauggaccagcugucuagggucucugucacugggaugaacacaugaccaagagcagugggggguuggggggagguuagguuaguucugcuucgacuugcacaucacaguccaucuucaaaggaacucccaggaggaagcuggaggugggagcugaagaagaggccauggaggagugcuacuuacaggcuugcuccucauggcuugcucagccuacuuucuuauauacccaggaccaccugcccagggauggcuggcacugccuacagugaaccgggucuuccuacaucaaguacuaguuagcaaaguucacuacagacuuucccaaagguaaauuauggaaacauuuuuuccaaaugagauuccuucuucccaaaugacucuagcuuguguuaaauugacauauaauuaaccagcacaacagcaugaauagccucauaagggcagagcucuguccgaagcacucaaucuauuuaaguguaccuucuguguuuuucuuuucucccucauuuccuuuuuggacuagaccuauauuucucagcugggaaaaugcuaaugccccauagcugguugaucccauugcaaacucuucuguaauuuacauccuucauggcacugaccaacuccuucaaauaauacuuucuauuuccccagcucaauuuuuauuuuaaauuuaaaauauaauucuaucacuuccgguuuccuuuuccucccgucauccucucccauguccuucuuuugaguuucuucaugcccgcccuaaucuuucucaaacuuaauggccucuuucucugauuuuuauugugauauguacaugcaugaguauacuauaucuuuuuauauuauuaugcucauaccuuauuauuauuauucucucagagccaaugaacagagcaguauugaaauucuuuagauggauuuccaggccuuuaaccaaucuauucaaagccuaauugcuaauguugucuccguugcauuauuuggcauuagagauugcaccuucuuggccccuagucugauacuuaucuucagacccauuucauuuuggcuuauguuucaaaaacuguccuuaacuaguuguauaaguauuuaaaaucaggauagacauuugaauuucuguccuuacuugaaaaaacuggcuggccugaguguuuaagcuucuacagagcaacaguaaccuacuauuucuuaacugagcagagcuucugguguacuauaaucucuucgugccaguuagauucugggaauagugccacuugcugcuaaccauugcuuuguugcuguuuugacuccuauuugacccacagucggcacuacugcauccugacgucaccguguaccucucccuuguguugccacaccagccugguugcugcauuagcagcuggauucccccucaucccugagagcuuuucugccuccagcaggacacagccaucuccgaccucuaggggguccuucacacgggugaucucauagcugucacucaccaucaugcaucaucgugugugugguugaauuacuuuccccgcuggauugagggucacugagagcaaggaucauucucuuacucagcacugucacgugccagagugacccuugucagaugaguagcaagaagucuuagccuaguccacuguugagggucuguguaccgucauaaauagcuuuccuuaagcugcccuuuauaugguccuugaauguauuuuggaaagagauuaaccaguguaugaucuugaauuuauuuagcuuuagaugcauagaaaccauucucuguuagagauaguaguaaagccaggacuagugccagaacagagugcagcagacgauggguguggucuaaccucugaccucuggagcauccgauugugcuuuucuuguccaagcugugagucacugcuucccgggaaugaugugcccagguucacuuuccgccugcgcggcaaugcuggguuagucacgcagugcaauguguauaggaggcauguaguuauugccuucuguuuuguauuuguuugauuucaagagucuguaggacuuucaguagcucuugucuucuguguaaggcuguagaagaaauggucuguagccagugaaauuuaaagcguaaaaucauuacagucaacuguugcuugcacacguuuauguuucgaaccugguucauccauucuguacaggacagagcuuuugccaaaaguaugcucaaaucugcuuugcuggaagauagaccugcagucugaggucaaaucacuuaaucuccuucauccuuugucgugguuggcccguuccuauuucuuacauuauaugccacccccacuugccucggaacugaccugagaauuaggaaagaugagaaguucucgaggagcgguaaacccugguugcacuuaauuacuagacacuacugaugguugucaaggcuucugguguuuugaaucccaagauucuuggauguccuuagguaucccucugcacagcaaccgcugcuaagcuugacucuuucacuuccuccuaggcggccauucuuaguagcucuuguggaacuaagaguuugcaaacuuuguaaaugaaaaguaacauccagaacucaguguucacuguaugucaggcauuguccuuguuggcuuuuagucuaggcuccaccccacaguuaccuggcaacagccaggugugccugacucacuauaaaaggggcugcucgccccuccucucucucuugcucuuggucugucuucuugcuccugcucccuccucuccccauuccccuucccgcuccauguguucauggcuggccucuacccuuccuccccuccccuccccuccccuccccuccccuccccuccccuccccuccccuccccuccccucucucugccuuucucugucucacucuccuccccaugcccugaauaaacucuauucuauacuauaccaucguccuauggcucagcaugggcccacagaggcccccuuucccccacaccuuaccguagcagcaccugcaccaaacguaugacuuuauuuggguaagacacaauaguccaauccgucaugguuuuagucauuuaacacuucugugagguaguucuguugugagcuucauuuaugagaagauaaagcacagagagguuaagugauuugcuuauguguuuguuuugcucauaacccgcccugaggggugaagcaaggcugugguccuagcagcggcagucacuagcagaggaagcacugcauuuaggagccugcuuccaaaccucucgcugaagcauggggacuuugguguucacuuuaugguuucuggugacagcacagaccaugaacaugggcccagacgaggccuuuggaggcagaccacgaacauugccaaggcuucagguggcagcacaggccgcucagaucaguguggcccacagcugcagcauggcucccacugagugugaagagcaaggcugauacugaaagcuccauguucauuaugcucacuggcucugccuguugcgcagugcgggagcuccuuucucaaguguagggaguaggaguugcaugaaacacacacacacagguaacucuuguaccuucgcuguaauguagaaagaaugccagggacugagagccaguguauucagaguggaacagcuuuggaacacuuucagacaucagagaaacuccacagcuucccugucacauagaugccuuuccaugugccauagugcaugcugggaccggguacugauaacuguuuuuucaggcuaagguuuuagccaguuuagguguaacgagauuugccucuuucugcuguaguugucuguaguccuucggcuuucccauauuuucugagguccccagugcuuuuaccguugcauucauucauaguccccauggguacacuaggaagagcuagucagggcagaagccagccccucacccaccucuaccacugugacgaacaaauaugugauggagagaugggaaagauggaaaacugaacagugugugugcuccaucuccuaacguuagccccaaaguagcagccuaaacaggaagcaaucaaagaucucuuaaacagugugauaggggugcugacgagcagcccuucccaacugauggcuucugguaggugugggaggaagaacccagaucuauuuaaggggcuggccacucagaauggccaugcuccagugauuaaguauauagauaaugcaaaguagacuuguguucacuuguuuguuuucucucucucucucucucuuccuuucuuccuucuuucuuuuccuuuuuacuuuuuuaccuuuuauuuucuuuuauggggaaggucacaaggguagaggacagacauggaaagacuagaaaaugcgugugauaaggguacuugauaugaaauuuccaaagaaucaacaaaaauauuauguuaaaaaauagaauuagacauagcuuuuuuuggaaguccccaaauguaguauauguccuuugucuguccuucccagcaagaagauaaccuuaugaaggauaaaaucaggucuuauuagaauuacacccauuccucaaguggcucuguuuaaucuuuacucauuguugauacuuagaaugcuuguggagcugaguuaauagugauauagaacaucauauuaguuuccuugacacugagcuauugucaaaaacuauuaaaaaugaagaacauggagaugauuagguuguauuuguuuguccagcacgcuugcauguaggaacuugcaauggggaaugugggucacacgucacaguuccagcuucucaggguugaguguccagagugaucaguagccguagaaucacaggugccgaacaguuguagucauugacauuaugugggacuaaucaguaguuaauuagaccauuuuuaagugguugcaugagauacuuaaguauuugcucuuaugugugaagcacugagaacauuuuauuuaucuguuauagauaggcauuuuaauugcaguauaagugacaugccaaaagugucaggguuauuaaccuugucacaaaaugguugaugaaaacucuaaaucucagggcuggggggacgccucagugcauuaagagcacugguugcucuaacacaggacccggggucaauuccccgcaccuaaaugguggcucacaacugucuguaacuccaguuccagggcucccaauaaccucuacuggcaguaggcccacaugcaugcauacauucauagguaaaacauaauauagacaaagcauccauauacauaaaauaagcuuuaagaacuccguaaguuuccuguuucuucuguaaaguugagcagaaguagcuuggcucacgacuguaggcugcagugaacuaaugugauugauuauagcuuuagacugugcugcucccagcaggaccacagaaagaguaucagcgacuucuagauuguauacacuuggcguuuaauugcccuuaccuacucuagcguuaugucucuagauuaacaauaguaauucuaaagugaucuucaauuuuagaaacaacaaaauguccagaauuggccaauuuuguucuuuuaaaagcaggcuuauggaguuugcuuguguccaugaacaucuuguuaagaccaugaaaaauaugaauagcauguccucaaugaaccacaaauacuaaacaaaaagugaugugcagcuggagguuaaccguguaagaguaaaacacaguagaguguccuguuucuuuaaagccaucacauugauauuucaaaguauaauagguuagaauggggacaaaaauagucaccugacucucuagcaguauaaaauugucgcaguccauuuagaggacaaucugugacacagcaggagucacauugauuuguguauuguuuugccauugugauucucuuucaggaaauauauucaaagaaaauagaccguuaaaaguuuuuuuaaaaaugauuacuauuaucauugcuaugacuauguaaaauguguagaaggaaauuuuugcagcagaauguaaauuagauuguaggugguuuuuuuuuuuuuuuuuucccuuucucaccucucuuugaaaauuaguguuugagacauugguagaauuaaaggcauggugguuucaaaaucguuauuuaguguaaauuagauuauugccaguucuacuaaaagagcaaaagaugaaauauuccuuaugggcauauugugaacuuguuaacuuuuaaaagaauuauacacaucacaaauaaaagaaaaucuugaggcuagcagucaugcccgugaugucuuacaaaggucugucugcguuaaaguucguauggccugagauacagguuguaaugaaagagugacgaggaccaucaaaggcgccgggcucugcugagcagggccgugugcuuaugugcaucucuuuauuuuagaacuggcugacgucaccugcacccugcugcuucucaacccagacuucaccacugcauggaaugucagguagguuguuuccuucagggguaaaaugacgucuguccagauuucugaagacguagaacccugugaguuuuagcugcuugaaaaaugaaauaugaaccaauugcccauagcauccuguguuuacuucuuagacaaauucuuuguaauaucuccacgacaguucuaaugcauguucuaugccccuuguaacugucuauuuucuauaaguauauuuuaccuaaaauauagauuggucugcugaauuacaauguacuguuugaugcuuucuuguuuucuccccguguguguggauaauaggcacuuuguaugagcgauugggucaccaggcguggccugauaguuuagcugcacucgagugccaggagaauguaugggaagaacauuuaaggccacaggccuucagcauccauuuagccaucacaauugugauacugugagcacuugaaauaucugacagggcuggagagguggcucagcaguuaagagcacugacugcucuuccagagguccugaguucaaaucccagcaaccacaugguggcucacaaccaucuguaaugggaucugaugccuucuucuggagugacugaagacaguggcaguguacuuacauacaugaaauaaauaaauaaaucuuugggggcuggagagauggugcagugguuaagagcacugacuucucuuccagagguccugaguucaaaucccagcaaccacaugaugacucacaaccaucuguaaugauauuugacgcccucaucuggugugucugaagacagcuacaguguacauauauaaaauaaguaaaucuuuaaaaagaaaaaaaucugacauuuggggauuagaagagagaugacauucaauuaauucagacaaaaaccauuuuuauugaaguuuuguuuuucagcuaaaugacaaaaauguguacauggguuuaaaucaacugguuuuucauuagacuaaaggaaauuuucuuaaaagaaagcagaauaugaaugaugaguaaaaaugaagucuguugaauguucuucugaauuuuuauggacagagccauaaaaauaauaauucuuuaugauuagagauuacuuaaauuauauuuuacuuaacuuucuguuuauuuuaaacaaaaucacauaauacuggguuuuguauuuaugauugauuuuuaagaguuuaguaacaucuauuauugacauuucugaggugucugaauaggaagggugguucugccacuuugagcaaguuucugagccucuccacacuucagguuuuacaucuguaaaauaggauauuugguugauccauaugaaaccguuuucuagccuaucagaaccaguuggaucucgcacucaguaaaaggaacugggccuacuggagaaaugacugacucaaagaccaaggcaggaaguguaucuuagagccagaauguacaacaaaaugaacuaggaaaaauaaaauaaaauacaguaggggcugcuaaaggguggaggaagcagcugagagaacuucugggagcaaaagcuagaaggauuugaagagaagaauacauacagugguucccuccuuauccuaggaagauacguaccgaggccccuguaccuuccaaccuaccacauaacugcugacugaauacagcaugaacauacugggcagugaauuugcauccugaaucgugcaguaugagauuucaucaggugcucagggccaccuaccauugaaaauuuagggauuauuucuaaaauuuaucauuuaaaauguccaaaccauaguugaugccugucuuagucaaguuuuuauugcuguaguaaaacaucaugacccaaaucaacucagagagaaaaggguuuaucucagaagucucaggucucucucucucucucacacacacacacacacacacacacacgucagugaaggcagucagagcaggagcucacggaaggaaccuggaggcaggaacugaagcagaagaaguggaagagcacagcuagcuuccuggcugcuucccaugccugcucagcccauuuucauauauaacucagaaccaaggguaccacagcccacaggaggcugggccucccauaucaaucacuaaucaagaaacugccccacagacuugcccauagaccagcuuaaugcugacggguuuuucucacuugagguaccucuucccagaugauccuagcuuuugccauguugacaaaaugaagcaauaguuuuuaacuuuaauauggcucacucauaccauuccugguuuaguuucucugggaugagaccuagggguuugcagacagaugacgccuauguggugacuugagacagccccaaaucccccugccuccugcacuugagaucacaggcuccugccugcuguggccugaucucuauguagguucuggggaucacacucacacaggaagcacuuugcucacugagccguucaccucggccucucuguuugguugucuguucuuuaauacuucuuggugauucaccaugaauuuuacugagagccauaaggaacgcuugaauagagaagugacgguuuucuucucuguuacaggaaagagcucauccucucuggcacuuuaaguccaauuaaggaucugcaucugggaaaacuggccuuaacuaaguuuccuaagaguccagagacauggauucacagguguguugauaguguucuauuccuguucaguauguaagaucauagcuuacgauuauguguuuguucagaaucugaauucuagagucacauuguauauauacauuugauucuaagaauuaucacuugcuaccugagugccaugguagcaaguccuuccaagucugagucuucauauucacaaaacaugaccaauacuuauacuugucucauagaauucauaguucagugcucuuaaaauccugcauacaagcacugcuacaaugucuggcacauaguaagugcucacuaaugcuggcugcuuucagccaucuguaacaguuuuggagauugcauuuagauacuuagcuauaauacaugggcuuguguaaaugaauuauauauucuagcuaguucguaagacacaaaauccugguauuuuauuuauaagcuguaagccuagauuugguagauucuaugcuguucucaccuguagccaaaccacaggccucuugcuacuugcuguuugagucuaguccaggcugguuugcuccaucagccugugcuaagggggcauuucucucagccacaugcuccugguccaucccgucuaaugcagaccuccugcucuguccaucuucucuccccuucuccccauggucuuucccaggaccccucauuugguuucucaggcccugccucucucugcugcccagucacaggcuccagccuucuguucacagcggcuuuacauuucggagcaaggucuacauaacaaaggccacuggaugugaggaccugccugucuggauggcaaccagaucuuuagauuuuagaauuuaggauuuauauacccagcaacagaccaacucccuauaagcuugugguccugguaggcaugguggucuagugguugagaugauuaaagguaaauuuuaaagaagcuaaagguaacugauugauguuuggaguaagugaaaagcuauuaaaaacauaaaugcaaagagugucuuuagggugggaaucugagacagccagaauacaacuaaagacucugaaaauucuguuauuggaaaacaugcuuuucugaggucucauguaacuccucucccuucgcuaaacuacaccaguguggccugcuggucugaagaaguuauucuccgucacuuuguccuccuuacaccucaagcauuucugucaugaacacuguuggguuuuugagcagguuugaggcaucagggcuaaaaccuugggcuagcacugugagugggcucuuaucaaaccaguuaguuguauuuucuuccuuaccaaaauuggcaugguaugccucagagagucguaugcuaguguugggggagggaggugaagggucggccggugccagaaggaaacgaugaacacacaucucaguuacuggggaggagaucuguaauuuaaaaccaaaacuguucuguugugaaacuucauuguuuaacaaugaaaugaauuuucuuacucguuuuuuuguaccuacggguuugaaauuuuucagucugaaaguaugcuuccauaaaauuauaaagugguuugaaaccuuuucuauugcuuuugacugaaauguaugcugaugcaaaauauacauagacaagaggaaaaucuguggcugaggaaauugccaaccuugaugcuucaauauauuuuauguuuuccacauuuuaugcugauuuauagaaauuuugcuuaaugacagcuaucaaaacagagcccuuuguuugcaaacaaaugcaggagaggcgugcacacauagcuggcacaugaguuagcugccuccucccagugcccucagccaugugcccagccuaccacacacacacacacacacacacacacacacgcacgcacgcacgcacgcacaugcaggcacauauuucuuggucaaguagaguuuggaaguuggcauuuuggaacugaugacuucuuuuugauggauuuuaaguuuuagacaagcuucccuuuccugucuguaauucucaugucucccuucugacccacacugguuuuguuuguuuguuuguuuuaaguuuagaaacaauguauuuuuauagaaaaacaagaggcuauuguucuuacaaaaucaaaacaugagcaugaaacuuucuuuuuuuaauuuuauuuuuaauuuauuuuuuacacuccauauuccauucccugccccucccccauccacccuccaacugcuccacaucacacaccuccucccuaccccacccaguccccacguggauguccccaccccccacccuaccugaccucuaaacucccuggguccuccagucucuugaggguugggugcuucaucucugaaugaacacagaccuggaaguccucuacuauauguguguuaggggccucauaucagcugguaugugcugucuguuuugggauccagauuaauuaagacugcugguccuccugcaggaucacccuucucagcuucuuucagcuuuucccuaauucaacaacaggggucagcugcuucuguccauugguugacgcaaguaucugcaucugacucuuucagcugcuuguugggucuuuugcagggcagacugcuaggucccuuuuugugagugcuccauagccucaguaauggugucaggccuugguaccuccccuugagcuggaucccacuuugggccugucgcuggaccuucuuuuccucaggcuccucuccauuuccaucccuguaauucuuucagacaggaauaauuacgggucaaagaugugacugaauggcagccccaucccucacacacuguuaaguugacuuacauugcacaguagcagcagccccuugauagccccauaccugagcuuaucgauuauguuuguauuaccuguacauugaaacuagaaucaagggaaaugauuauuuuccucucucacccauguucuucccucuucuuuccccugugcuauauuaauaggcgcugggugcugcagcaguuaagucaggaaacguuccugcccuccucuguggccaaaggaagcuuaggugcaguuccugcagagaggacacagcggauaauacaggaagagauggaagucugcagugaagcagcagggagauaucccagcaacuacaaugccuggucccaucgcaucuggguuuuacagaacguggccaagcuggaucugaagguauucauucuccaucgccaaugcugcccauccacccuuuaaucucgguaguaauuuaccccucaaagugguguuccagcagccccagaggaccaaggcggccgugguuuccagagaaauccucauaauuacagaaggguuggcaucucccacugguacagcucgagacacugguaaaggaaauauguugguagacuaaaggcauaaagaacccaacauaaggggucaauacaacucacuaagauuauuaaauuacggagaauugaaauuauaucaugguggucucuggacaccugucaaggagcugaaauagcagauucauauucauauccuuggcucucaggaaggaaaggagagagcggggacagacuuggaaagaagccuauaagucacgugggugcccaaggccucugcaggccuguggugccaggaucagggggcaucuccccauacaggugcucuccagagguucagugcggcucucaccucucacagcauuguuuuuucccuuuagagauggggagauggaaguuucuggaguguuuugaggcuuagacuuagcuauccuugggucaucuagaacauuuaguacucaucagucagaaugaaagccccuuuguuccuuuuucuguuacagagucaucuccauuuuuccuuuguuguuuaugguauuaggauuccauaacaauauaugguucuuuucuaaaagccucccgggguuggggcaguugaaagaggugcaguugaaggucagugcgcuccaagagagcugccugucguugugguucaccagcucuggucucucuuccaaguucccuuuuccucaucuccuagucuuucaggguaaauauaguuuucacuuccaagggaauuuaagccaacagaggagaguagaccgcuccaucucuguucauggcugugaguuucaggagggagcuacccaaaggaacaggcagagcagacaagacacucuuagcauugcaucagccuggcucauauuguagggacaaggagaguaauccuuugagauuuuauuuuuaaaauaaagacugcugucuaucuugauguuagugugaggguugccugagcuaguguaccgaacauucuggguuucuuucacacagguuucuuucucacacagguccuccuaccaauaaaaagauuaggugagaugagcugcagcgggcuucaccggcuuaguuaucaauauaugguucuuuucuaaaagguuaucauucccagcugcuggcacuagacugguacuguccaccagaugaacucuacuggagagaguccaaccgacaguuagaaaguagcauaacucuuggagaguggggagcucugaguccauuuggaaacagcagaaaugguucacuagaaacagcagcuucgugggaguagagaugcacaggucacgugguuaaugucagggauacugauuacugcaguucuuuaucucugcucuauagcaugauagugggguggagccuggggggugaauugggacugaaaggucagugggaugaaacgugacgggagacuugccugcuaguccuggacccuuucagggcccauucucauaacaucagcagcaaugcaccaaggagaaauccuugcucauuugagaccaucuuacgguaaaugcauagcucacuguugagauuuugacccagcucccuggaucuacuucugugcugugcucacaucucguccacuuccuugucuucaggaggacuugcugugcuuccugucacuagccuugugugcucuuugcuuguuucaguaaaauguacugaauuguuuuuaaagacuguuccuguuguucuaagggucuggguuuugcgcuuuaucucugagaaguaguacuuaacaaaaguacccguugucuagagcagcugagaagugcguuucagucugaguguggugcacacuugggaucacagcuacucaaaugggaggcaggaggagcacaagcggaauggaaucagggcuacauagugagcucagccacuggggaugggcaacuuagugaagugucaucucagaauagacuuggguagauucgagaagacguaccugagucguacagcaccagauucaaacucucggacugcaaaccaaggguaaaaacauuuacaaacaaaggacauauacacgcgcuagcagcauugcaagaguagaaaguuaauaguaucuugccgugcuagauauccaguacuagugagaugaugagucagagcauuucuguucauggacuucgucucucuuaauuaaacgaugacagagacagucuaguuacagcauaguuaaacgugccucuuuguggcauacagaccuaauuuguauucuagcuguucuaccaauuugcucuguagccucaagaaagcuccccagcuucucguacccgcacuuuccugccccugaaaagagugugauguuaauuccucaacagcugucccacggacuacugauugucauagugguguuacuuaguacucagugcuggcuauuaaauacaagguuugauauauaaaaguagcauuuacaauuguaaaacauuagaaaggcaugcccucugaagugagggauucguuaacuuuacaguccaucacaaacuggaguguuuuagucuacuaaggaucauucuuuuuuaaaugacuuaaagaaaaauguuuauaguagguuauuggaauaaaacuaaauauaguguaaacuuuacauaguuuuaguacauuaguguuuuaaugaaacaacaaauucuuuugagugguuggacaguggcugggauguugucaccacguguuuauauagacauauagugcuguuaugguuugguuuguguguuuguuuuagucaugaagaaagacuagagaguaauggugacuaauggugcuguggaguagacacauggcauuuuauuuuauguuuuauguuucuauguuugguuucuguuuuauuuuguuuuguuuguuuuuucgagacaggauuucucuguguagcccugacuguccugaaacucacucuguaguccaggcuggcccugaacuuggaaaucugccugccucugccucucaaaagcuggaauuaaaggcgugcgccaccacugcccgucauguuucuauguuucaauaaacacauuuuuguaaauguuacagauuauuuuugagguuggggaguaugauauagauaagcaaaaucuauugugacuagcuaacuaaagauugacugucauuccauuugaaaaaaauagaaauguacaaaugucuaauaaagacaaaaaagacauugucaugauuaacagaagagagacauuaaaaucauaaccauagggagugaaacacugucucaaaccaucuagaauggcaauaguaauggcagacagcagcaacugucaguaaggauucagaaaggggguccuuauuauggcugguaggaauagaaucuggggucaucaacuauggaaaacagcuuaacauuaaaaagagagaaaacuguagaauugcuguauaugggagggaucagguauagcuaaaaccaggagauuguucucuugguagaaaaagaugguucuuuuaugccucuggaaaaccauagguguguucauacuaaaccacauaugaguaaggguguccauagccccagacuaaugacaacucaaaugcauauccagugagaaaaggaaagcucgggguaacacaucuuaguaaaauggacuguugaccauacuaaggaaugaauuacaggaacacugugauguaagugaaucugaaaaugugauuaaaaguaaccagauucaaaaucagaccaugggccaggcagugguggcgcacgccuuuaaucccagcacuugggaggcagaggcaggcggauuucugaguucgaggccagccuggucuacaaaaugaguuccaggacagccagggcuauauacagaggaacccugucucaaacaacaaaaaacaaacaaacaaacaaacaaaaaaaccaaacaaaaaaaaaucagaccaugugaucagugugugaugaauucagauagucaaagauugagugccugagacuaguugggggaugagaauuuauucccuugguauuggggggugggggggcgggggaggcuuuuucugcagguguguguauguaaaaauauuugaaaucagcaaauaauguuaacacuguucugaauaugcaaaaaauggauguuuauaacuucgauuagaaaagaaaagcuuaaaaaacagcuaaaaaauuaaacagacacuauggcauuugguauuuaauuauguuaaguaauuaaaagacaggacuuuuuuaaaaaguagacuagguaaugauaaaaauauguaaacuccagaaauaauucuuaguacauauaauuaugugaagauuccauuaauguuaaauaugacaugcuacauagaaaaaagaauauuuacucaguuugugacaacugguaauauuuggauugacuuuuuagaaaacaauuaaguuagauucuuuuuuuagguauaaacugaacuaaaauagauuuuuuaaaucugagaagaaaauagaggccuggaagauguaugcuagguaaaaauaagccauguaaauguauaaucucacuuuuauguggaaucuaaaaaaguuugaauucauuggaaaccaaguaaaacaauaguuagaaaaguagaggaagugauaaaggagaguuuacuuacauggaaugaauaagcccuaaagaccucauaccacuuaguguccagaauuauauuauauguagggcacgaagcgauugcuuagugaucgcucagggguuaagagcacucacugcucuaacagaggacuggaguuuguuucucaguacccauaugguggcucauaacugcuuuuaacacuaauuccuagagauuugacacccucuucugaccuccacaggcauaagauacauacaugcaaacaaaacacucagacacaaaaaucaauacauuuuaaaagaauaguaucucauguauauagccaaagcuuguggcaggaauaucuuaaauagucucaugauaaaaacaaugauaacucugagguaauuagcuugguuuuuauaaucucucaauguauacacacuuaugauuauauuguauaucacaaguguaugaauuuuuaaucaauuacuuguagacuuagauuuuucaaagccuacuuuaauuaugcuucuuuaacauuccauccucccuucuagccuaccaccuaccagacguagggggaaagaaagguucauaaaaaauggagguuguggaccguuuagaaauaauucuuuggggugauuccaaucuucuuugucaggaguccagcccacuagcaaaacaccaaacacaaaucagcagugcaguccaguguagucaccaaacacaaaucagcagugcaguccaguguagucaccaacacaaaucaguagcagcagcucauccagaagacacagggaggcucugcuggucagcaccggaguccuugguagccacacgaagcagcuggaauaccaccagauguucuuuggugucuuucucuauacaaagucacaacaaacaaagaucagcgaagaaagcaaggcaaaccaaugcaagaguguagucagcaaagacaaaacccaaagaagaccagcagaguugcaaggcgaaccaaugcaaaagcaucgucuacuggucuuagaaaaacaaagaguuguagacagaagaauugccaaagaacaucgcugcuuucgucaagguauuggugccaggcuggacuccggcaacaaagacaacuuuuuaagacugaugacagauacuauaacaugcccucuugaaaggcucuacaauuuaucuuccugaauaggagauuagauaugcacaugguuacucacaugugaguagaaauaaguaaauagucaaaugcucaucuugagggugaacugcugggugauagugaaaggugcugcugcagaauguucauugcgguagcaguguccucuugaucacucuuguuacugugacuaaacaccuacaagaagaaacaugugggagggggauuuugacuuacaguuuugaggcggcauguccaucauggcagaaggaacaugaggcagcuggccacauugaguucucagucagcaauagaaccaggugaaugccaccucucaggguugaggaugggucugccccuggcuaaucacuguagcaguacccacacagucguacccagaagucuauuccacacugauuguagagccagcuaaguugacagugaagauuagccaucacuaaugcacuuaaaauuuaagcagaauagaaucaguucaaaaguuaucucccaggggauuaaugugcgauguguuuuuuaaauuuuuccuuguauuacuguuucuauaaugaucauuuuuuuaaccacugucuuaguuuaaguuuaguuuauuucaucuuaaaacucucaggucauacucuaucaccaaaugaagucggggcaggaacucaggcagaugccgaggaggcacugcuacucagccuguuuucuuaaaccacccaggaccacuugcccaaagugguauugcuuccuaugggaugggaccuccaacgucagucauuaaccaagacaaguguuauggaggaauuuccuuaacuaagauucauucuucuuaaaugcucuaguuuguaucacauugacaaaaaccuaaccaguauaaucacuucuguaaucagaggaaaacuuucuagaaaaguguacaagcaguguacaagcgcuggcauggguguugucauacuuuguucuaggccaaucaacuccucuguucuauagccugcugcuauguuuauauauucuuuuuacauggaaguuagaaaagaguagggacacuuaagauauauucuacaaaggcacucaucuugucagcaccugacauugaagccauucuucaguguuuuuaaagucaucuaaaaguaauugcugucuuugcuuuuaaauaauugccuauguagcauuuuauucuaggaaaaaaaaaaagacccuaaaauaagaaaaugcucugaaauuucugguuuguuuuaugauuugcuauacauucuuaaacauaaagagaagaauagcauaggguuuguuuuccuuaaguuuccagcugggaaauauuugugcacauguguauauguagaggccagagguugauuugggggucuuucccccacccccucaauuccccccccccuuauuuuauaugcauguaugccuaugugcaccagagcaaacaggcaagcagcuuugucuauugcucuuucucuuaauuaccuuccuacaggaucucucacuggaccagaaacucacccuucuggcuagcuggccagccagugaguucuugguaucuaccuaguacaggcauaugcaggcaugccuggcuuucucuacagacacugggaguuugaacucaggucaucaugcucauggaacaaaugcuuuuccauuaagacaucuacccagcccccaccuuucugagauaagucucacacuggaccugaaguguccagucuuaacuggucagcaagccucugugcuccuccugccuuuaccccccuaaccgggagucuguccucagguccucaugcuuguguggcaagugcuccaccaaccgagccaucuccccagcccacugaagaaugguuuaaaauaacuaaauugguuuuauugaaaaacuuucaucuauguacuguacuugccucaaaauuaaacaguaaauuaaaucuuuuuuaaaauagaaaaauaucuagucauaaauaaucuuaaaguuuuucauguuauauacauugaguuuagauagccaugguacuaucauucuauauugagaagccacacuaaaggaaaaaagcuucuaaagacgacuuccuguccugucgacagugggcugagucuuacaaaucauaguagccuuaugauauuuuucagauagaggcucaaguagaaauggcuguagguuugccaaauguuuuucuuggagacuugucagcuguagcuuuguaaaugaauguaguggcuaugauugaacccaucagaacuuaaggauccagcccucaaaagccuaaagcagaaagauuguguuuuaggccagccugaacucugacaccagacugguccuguguuaacaaagguaaaauuuaaaaaaaaaaccaaccaaacaaaaaaaaauaccuuaaagaagauaugaaaaacauuuaacuguauacuuugcccauauaggucaguaaucuuaguccuuucuacuugccccuggcuucauuaaauuucucauucauucaucaaguguuuguaaucuacucugaugcuaaugaacagaagagaauggaaacaucaauuggacuggauaaauacccucuaccaauuuguuguuauauuaaaaaugaaacguccuuacaauucagugauaaugaagacaccugcaacuguuguuuaugugaaaguguacaaguacuguggagguuccgagggaaagauuacuucugcaaaggaaaagauaagugagauguggggagagaucagucaguaccggaaaaccgucgccucgaaccaggaaugaagcaggucaaguuuuugguuuucggugguggugaugguuauccacagugugguaaugaaggcaaagaauaaugagucuguaaacuaugugcucaaaaaacaaaaacaaacaagcaaacaaagaauccuuuuuuugcuuuauaaaguaagagggaaguuaacugguuaacuuagcugcauucugcuuccaagagagcaucaugcaggauuuguacauuguugaggagaaaggaaaagccuuugugaauguccuucucacgucccuuuuucuuccuacaagauccuucuugaugaacugucuucuacuaaacacugggcguccaugcaugucucagaccacaguggauuucacuaucgccaguucuugcuaaagucauugauuagccagacuacgauagacagugcuguaccgcagcacaacucuuugaaaagugagccaaaagaugaagcagcggcagccucaacagaggagccaagugugaaucuuccccagcuccuagaagaagagguggaauucugcacagaucuuauugauuccuauccaggacaugaaacccuuuggugucacagguaagaaagagaaaaccuguuucuugugauuagcuaggugugaccguaugaaacugcccaacccgauguaucuaacuucugucuguauauguaaaugugcucguccguaaauguggucauccauaguuuuucugguugaaugaggaagggcuuuuggucauccucucaccaccguuguccuuguuaauucgagguuucucacaucucugccugugguuuagguucaccccuaacuacauagcagaacgccuuacauuacugccaacauagcauagaaaacauaaaaauguuucauaacccuuugaagauccugacauuagcauauccuggauagaaaggauauguguuuuuaagaaaagugaaaccuuccagaucauuuugauguaggcaggauugaaacuaaugacuagaucgugggauagaagguaagcuuuaucuuugcccuacucuaaugaucuuccaauuaauuaaguauaauuacaaauagaaaagccagccauuuuauuaaccuggauuuugaguacauuuugguguuauaaaguucauguuggaaugagguccaggggagcuaacacauugcuucgguuccuuuggaucuuuacuuggaaguagcucagucuuuacgaauccaaagucggcuucaggucacaggggucagcguaggacagaaggccugucuuugcuagucaagggaaaggauuguaaaaucuguaguuccuaagucagcugaguccccacaccuuuccccaguccacucuugcucauggcugcuuagucuguuagcugcuaauccguacuaaguacauuuagaaggcagacguuaucuuucauuuuuuagacuguucaagaguagacaauggucuuuucuuuucauagcaaagcagucugcuuguaggguuuuaaggaagacaggacauaaggcuuuguuuagagacucugcugucugcuggaucuccucaucccaauagcaagaccucggugacuuaaugcugauauguaaggccuuagcccuugaaugaaugacgagcugugacagcuuagaaccugccauaugucaggucguaguuuguguagcaggugugcacccugggaaaacuguuuggguauucugcagagcaguuuuucauuuuaauaagcaauuccaggcugucccuugauugaaaauaggaauaguaucuuuuaugugcuuugcucagaacccagcacaccucugcugaauacugauaaguaagacuaaaguggaaguuuaggagagaucuucaauaagacaccguggguguagucuagguuuaaaaaaagacuagggacuagugggccaguucagcgaguaagggugcuugccaacuagccugaugccaugaguucucucccuuaacugagaacacgggacaugguggagagagaaaacugacuucuguauccacaccucccucucucucucucucuuucucucucucucucucacacacacacacacacacacacacacacacacacuugugcauaaacaaacaaacgaacaagugcaauagagauauccucagaaaggaccaggucgaggucaugaaccccauccaucuguaguccggaggaacugucuaccuuguuuuuuaauuacuuguaagagucuaaaucacguugguauuuuguuuuauauaauaauuuauggugaauauugagccuugacuguuucuacuucauguuagaguuagaaccgcaacucaaugauccaaguaaaugcuuauugaaaugcccuuagagcagugcgguuuccucacacaccagccugggcaaggggugaaguccugagaucucugucaguuucuuuuccagcacacaguuguggguuaugagaugggugugagcuaauacuguuuauuaguaaucaccuccuuucaccugagaauuuugaguuuugucaugauuuucuuucucccaccccaaccccauugcaggcggcacguuuucuaccuucagcaucacuuaaauggcaggcucccucccaaccugacucaccugucaccugcagacugcccugggggcgcuuugaaugacucgcuccagauuccaacaagcccucaacuaucucaggcaauggaaguggacggacugagugacucuagcaagcaaggcuauucccaggaaaccaagcgccugaagcggaccccagcuccagacucccuaggccuggagauggagcacagguuuauugaucaaguauuguccacuugucggaacguagagcaagucagguaugccaaugcauacaggaaauggcuggugacucugagucagugaaagggguggauucauccuaagaaauucccuuuagugcaauauugcuuuucuuucucagugccauaguugcauggacugacuggcuaacuguauucuucaucuguagcuuaaaagucuauaagaaaccuuuuguuuuauuuauuuuguuaagagccggcauuccuuuggguaugagauaaucguauaguuccuuccuacuaaauagagucuuaauucuuuuuuuuuuuuuccucuuugacccauggcucucuagguccauccuugggcuucucauuugucucuugagauuggcuuacauacuuugcucaccucuguucaguugcuacauagauaguuucuuuaaacauugaacauuuauuuugcaguucagcuuaagaauauuaauccacccgcagaagcacuuggcgcugacugcaguucugagaacacaauggcuacacggguggaugggaggacgucagccacuucccucucaagcguguucucccguuauccacucagaaccaaagccaggaggguuggaauuuauauagaaaaaaaaaauaaauugcuuccaauguaaucuauuuuuuaaaugauuauuuaaaagaaacuaaacuaauuuaagaguuuauguaauuguaguacugaaaaauuauuuuuauuacuaguuuugauagauuguuuuuaccucgcauuugguauaugccaaaacagcaagucagcccuuauaaaauaaauucuuuuuuua

SEQ ID NO: 9218 - RNA, 2523 nt, Mus musculus
ugcucccgaaacgcgcccuacugccuuguagaucugggaguuugcagcuaguauggagggcuuggugccuccaucaguugccucacguuguggaucacgucucagucuaguccauguguuuuaauaauaucauucugagccagcuuccacuuauucuugguccaaagagcaguuuguuuccaugugggauguggcuaguuuuuguuuuuguuuuuguuuuuguucuuguuuuuguuuuuuguuuuguuucauugaugaccucaguagagacaggggggaaaaaaaacuaauauauuuuguaguaugaauauaaucccuguucucugcaucugggauauuuauauuguaucuuuggaaaugggaguucagugagcaguguugggaaggauggauuuauggagggaagagaggggucugggggagggagagaugugaauagaacaagagauggaauaaggggcuucagccagggugggaaacagccaaccccuggguucucugacuucaugaaaugucuggagagauuugggaaagcccggugcuugcugggaucugccgugagcccucaguuugacucuagcacaaaaagccucagugauaugaggccuccggcuguccagauagcugccugagaaggaccgggccugcugcugcgagagcuauguggaguuaggaccacagaagccgggccaucgggacuugauuuuaagggugucuuaacagaaugcuccugcauggccaggcccaaggucagaccccagcaaauguggagaccaggggacaagccuuggguuuucuuuauaucugaaauaagugaucugucagguaucuaacaucaccacacacugaaggcugugguccaucucuccucugccagagaugauggguaggacaaagagggacauuauugcugccaucucuggcauugggaaccuugguaaagucccuugacaggcuuauguccgucuggacaggaaggcagaagcaggaccucggaggcuaaccugggacccgucaggggcagaccccaccagucaucacgcccagucaucacaaugaagucucuucaccccagggaaagaggaaagagaaugcuuuccauucuccuugcacaggaagccuggaagcuuuaagaggggcucaaaagcaaagcuucucuugcaaagcucuccuagggaacuaauaguuuagcaucauuguaaggauuacuuagucuuuuguguuaagggaggguccucccucccagagggaaaagcuguccccugguccaggcccccugcugaagcguguucuuccucugcuagcaucagacugaaugguuaaacuuggggucaggucuugucuggcaucuucauauacacaguuacauauguaaauaucucaucgcucucacuaauggggccgacuacccacagagccgccuuccucgaacugcaaggcacaaagccacucugcccacucagcuggaacgcgcuggugacuuggcuuuggggcaggcucccagauccacacacacacuccccgccuccccccucccccaguccaaugagguugcacuagaacccauucugccucugcuuccuccuggggagcuuuucagggagccaccaucagccuugaguuccugagagaagggaaggcucacagauccauggcaguagcccacuuccugagcgaucccuucccuuccccacagcaggcuccaggggguggaggggaguagagcacaaggcaggcugccaccucccugcacacggguuugcuuucugaacuucgcccaucaacauuggccuucagggaguccagaguaaccuacuaccucccccauagcucccccucccuccuccugcagccccacccacaccuauguucccuuggcacacugaugaaaacccacccacggagcccugcucaggucucuccacccacugguguagcugucaccaauguuuacaaccaagggccaccucucgcugauguuuuaacccucaccuucaccaggcuaccuguuaguuugaguuucaccucugucugcucccucccugauuaggguccacuugaguacacaaacccugauuuuaccuucccuccaucuaaggcagugugugaugacugugugggaaugaaaucucuuguacauacuuagcacagcacuugggguaugaacccacaccccuguucuguaacauuagcgcuuacuguaaaacaucgggagaaguauaguauuguauuuguaacaauaucauucuuuguauacacgaaacucaaugaucucuauauauaaauauaaauauauauaaauaaaauauaucuacacgugagccuggaauguugauacugcacacccacugaauguauuuccucugacagucuggucaccgguccuggcccacccuccccuucuuugugccguggcggcaguugucugguuugggguugugauguauuuaaugugcuaucuccuuauuuaacugaacgcuaaugucuguauaagaauugcugcaacaauaaacaaggacuuca

SEQ ID NO: 9219 - RNA, 2523 nt, Mus musculus
ugaaguccuuguuuauuguugcagcaauucuuauacagacauuagcguucaguuaaauaaggagauagcacauuaaauacaucacaaccccaaaccagacaacugccgccacggcacaaagaaggggagggugggccaggaccggugaccagacugucagaggaaauacauucagugggugugcaguaucaacauuccaggcucacguguagauauauuuuauuuauauauauuuauauuuauauauagagaucauugaguuucguguauacaaagaaugauauuguuacaaauacaauacuauacuucucccgauguuuuacaguaagcgcuaauguuacagaacagggguguggguucauaccccaagugcugugcuaaguauguacaagagauuucauucccacacagucaucacacacugccuuagauggagggaagguaaaaucaggguuuguguacucaaguggacccuaaucagggagggagcagacagaggugaaacucaaacuaacagguagccuggugaaggugaggguuaaaacaucagcgagagguggcccuugguuguaaacauuggugacagcuacaccaguggguggagagaccugagcagggcuccguggguggguuuucaucagugugccaagggaacauagguguggguggggcugcaggaggagggagggggagcuaugggggagguaguagguuacucuggacucccugaaggccaauguugaugggcgaaguucagaaagcaaacccgugugcagggagguggcagccugccuugugcucuacuccccuccacccccuggagccugcuguggggaagggaagggaucgcucaggaagugggcuacugccauggaucugugagccuucccuucucucaggaacucaaggcugaugguggcucccugaaaagcuccccaggaggaagcagaggcagaauggguucuagugcaaccucauuggacugggggaggggggaggcggggaguguguguguggaucugggagccugccccaaagccaagucaccagcgcguuccagcugagugggcagaguggcuuugugccuugcaguucgaggaaggcggcucuguggguagucggccccauuagugagagcgaugagauauuuacauauguaacuguguauaugaagaugccagacaagaccugaccccaaguuuaaccauucagucugaugcuagcagaggaagaacacgcuucagcagggggccuggaccaggggacagcuuuucccucugggagggaggacccucccuuaacacaaaagacuaaguaauccuuacaaugaugcuaaacuauuaguucccuaggagagcuuugcaagagaagcuuugcuuuugagccccucuuaaagcuuccaggcuuccugugcaaggagaauggaaagcauucucuuuccucuuucccuggggugaagagacuucauugugaugacugggcgugaugacugguggggucugccccugacgggucccagguuagccuccgagguccugcuucugccuuccuguccagacggacauaagccugucaagggacuuuaccaagguucccaaugccagagauggcagcaauaaugucccucuuuguccuacccaucaucucuggcagaggagagauggaccacagccuucaguguguggugauguuagauaccugacagaucacuuauuucagauauaaagaaaacccaaggcuuguccccuggucuccacauuugcuggggucugaccuugggccuggccaugcaggagcauucuguuaagacacccuuaaaaucaagucccgauggcccggcuucugugguccuaacuccacauagcucucgcagcagcaggcccgguccuucucaggcagcuaucuggacagccggaggccucauaucacugaggcuuuuugugcuagagucaaacugagggcucacggcagaucccagcaagcaccgggcuuucccaaaucucuccagacauuucaugaagucagagaacccagggguuggcuguuucccacccuggcugaagccccuuauuccaucucuuguucuauucacaucucucccucccccagaccccucucuucccuccauaaauccauccuucccaacacugcucacugaacucccauuuccaaagauacaauauaaauaucccagaugcagagaacagggauuauauucauacuacaaaauauauuaguuuuuuuuccccccugucucuacugaggucaucaaugaaacaaaacaaaaaacaaaaacaagaacaaaaacaaaaacaaaaacaaaaacuagccacaucccacauggaaacaaacugcucuuuggaccaagaauaaguggaagcuggcucagaaugauauuauuaaaacacauggacuagacugagacgugauccacaacgugaggcaacugauggaggcaccaagcccuccauacuagcugcaaacucccagaucuacaaggcaguagggcgcguuucgggagca

SEQ ID NO: 9220 - RNA, 14684 nt, Mus musculus
auguuaucaaauaguccuuuauuccuugcagugagaugucacauaucauugagcgagugaaccagcagcuucagagagagcccaccagggaagcaagccaucucaucagucuguuucuccaauggggucaacaaaagauggccacuuucugcacucacauuggagggggccuuggagugguuggcugugcccuaucucuugcaaccaccaguacucugucuuugauccccaguuucagcaaccauuacaugggugucccuaaaauauccccagaggagauuccauucuaaguucauaacccauuauagggaacagacaccacaacauaguuguguuugauauuaggacaggacagggucuggggcauuucugucccuguguccagacuccacugcagcuguuguuccugcucauagugaacaaugcugcuucauuuucuaaugcaaagacugaauauaaggugaugaccugccuccugcaugguggggccaggggguucccaucggagcagcagaucuucuugccacaaggcccaugacuuagcucucuuuaucacaaccucccugugcuugguguguaccccugaagauuuuuguaaaggggucacauaggaaaauaucgagauuucaaaugcuagaauuguggauucugaaaaaaaaagaagaucagaaacauaaauuaaguuuuaaucuuaaaaguacacucauauaauacucagcauaguguauuuauuuagaguuugcuguggugcagaguauuggcugguggaauaauuuuuauugaguuccauuuaguuuaugcuaccccaaaacccuauuuauuugaaaaauuauagcauauuauagucagaaucaauuucaaaaaccaagaugaugggacaauuccuaguaguauagaaguacucauuuuaucuucauaguaauccagagagggcaucagugaaauagcucaguguguuaaggcacuugccaccaaaucuggggcccaaaucauaaaagaagagaagaaauuuccauugucuuuugacauccacauaugcccuauggcauguguguguaggcacacucauacaugcacauggacaugauguaauuuuuaaagaacccagugaggggaugugccuggcuuucuguuuccauucaauggcaugaguucacgaacucagccaaccaugcauugaaaaucuuuagggagaaauauuucauguguacugaaauguacagaugaaauuguacauucuccucuguaauuguccccuaaagaguacagugcaguguugauuggcacauuuguuugguauuuuuguucucaguaauguggaaaugauuuagaauauauagaagaauagauguuggauguagguaauauucaaauauaacaccauuuuauauaagggacuugacagcgucuauagauuugcauuucuauggggauucuagaacuaauucuuuaugaaaauggacaguuguccuguuauucccauuuuacagaugagaaaaauuugauacagagagauuaaguaacuaguggcagaauagggcuggacgaccagcccugucuguguccagagucugccguacccccuccgcuaagaucugaauaauguauccagacaguggugcugccagugacaugaggcugaccauucugagccacguauggugaggcacaucuuuaaaagauugcaugggaagcugaggcaggagcaaagcaaguucaaggcuagcaugauccuuagacuggcaccccgucucagaggagguggacaccguguguguauguauguguauguauaugguguguguguauuguguaugugcauuuguguaugguguguguauguguauaugugugugguauguguguguguguguguguguauguguaguauguguauguguguagcauguguauguggggggggcauucugaauuauucacaauaauaacagaaacaagugacacagauaaacauggcaauuuugaauuggaaaaaagagauuaauacugcugaacaauuaauuaugaaacauuuuccucgcuucagugaucgaaaagccaguguguguuuuaccuucacacagaauccaaacuacaaccuggaggauaaggguacuuuuuccuauaaaauaguaauuuucugguaauuuguaaaugaggaauaaacauauuuugagguuauugugcagagugcugaagagaaaaggauaaauaaagcgacugacuccaaguguuuucuugagaguggagcucgggauuggcagugaggagugaaaucuaucuggcagauaaauauuauaaaugagaaaauuuggaggaaaucagcauugagaaccuggugagcuggcggcagguagauucucagguguaacgcuucgcuauuaauccacuuauagcaagcaaagaucugagagaggaagcccugggucugcuucaaaaguuccccaggggcaauccaggucucccaagugaacaccugccuuucugcugaguacagcccauccucuguugguccuguaccagugacuuuuaugauacuagaaaggggaagugagccugcuacuccucuuuggugaaaugaugcucuuugagauauccagcacaucauaaaagagagggcuggguaagguggcaguaccuggaauuccuguaagcugagaccaaucuacucuacauauugaguuccaggccagccagagguacauaguguggacauggagggagagacagagagagacacagagagagagacagagagagacagagagacagagacauagacagagagagaggaggaggaggagaagggaagaaaaaagaauuugucucucuguggagaccugaaaauuuagauuuuugucacuugugaaucuucuuccuuccuuccuuccuuccuuccuuccuuccuuccuuccuuccuuccuucuuucuuucuuccuuccuuccuuucuuucuuccuuuccuuuccuuuccuuuccuuuucuuuucuuuuccuuuuuuucuguccaacuucaucguguaaguauucucagucacccccagacacaauguagguuccauuuaagggaaaugggguuugccugaggucuugucaccuuguuccuugagggaagagguacugcucccaccuccacccggugacgucuccucauccaggaaggacagaagccuccuuguggagcagcaacccuugcucacagagaaccuaaauggccugguaaccuaacuccccugagguauguguuuacaguaugaccucgucauuucuuguggguguggucugggccuggaauauaaagagcauuugguuaaucaguugacaaauauuuauuuagcuuggcuuagugcugugccuuaaagguaaaacagaagccaaagaaagcaagaaucaucgcccuaaauaauguugucauuguuuugauaaaagguaggccagaaaaaauaagguuaaugaaauaacaagccauuuuaauaauuacggagaugugaaaagaauaagggggcgugggcgcugcuguugaggcauugcuuccagggaacuccucuaaggagcugacguggggccugcgguuacaggugugagaacaaagcagcugagaggaauggaaagaggacacuggucagagaggauggcuuuugccaagccuugcaggcaggaagcagccagguagauuccaggaacugaggugaagcuggugugguggaaacuucugaacaagcaaaaaugaacgggugagcaguucccagcuggagccaguuuugucugcacggggucagcagacaaaguugugacaacgagggagagggcugccacuagcauuugaugacaguguuucucugacaccuccggaaguacacacuccggaacagcacuucagcacauuggcccagaaugccaacagagcuacauuaagagauaguuaguggccuagacuaaaauaguagacugagaggguggggcggguccugacuugggugugagccgaggaaaugauaggaaaaauugauaaucccacagaguucuuaauggguagagauggagaaggcugucuagggacagugacaucuuuuaaacaugggcauguugguuggguaacgccaaugagggcuugaagagaagaaccaaguaagaaguuaaaacuguggauugggggccgggcagugguggcgcaugacuugggaagcagaggcagucagauuucugaguucgaggccagccugaucuacaaagugagucccaggacagccaguauggauuggaagcccaugggacaaguaucaaguucagcuucaauucaucaauuugaaggucuacaggauaaagagaggcuugguggcaagaauguuuuuguucugauauugcuucuaagaacucccucuacagacguauauagacuaagcauccuuaagugcuucaaaauccaaaacuuuaaaaaauauuuuuauuaguuuauguaagaauuuacauacaugcauauaguguaauuuuuuuuauaauguuuacccccaaguccaaacuuucaguaucuacauacugggaaaacagugucaugaccacaggaaacugccacaccugacccuccuaacaggcuacagucuaagcauacgcacacuaagcaugcuguguaaaagcacauucaucaaacgaguuucauguuucaacuuuggucucacacccguagucuccuaucauguagaugcaaguaaauauccuaccagaaaaaaaaaaaaaacagaacucaaaaugugagacauuucugguucuaagcauuuuugaguaagugacauuuuauuuauauuucuuaauaaauaaauaaauaaauaaacccacaaaucugaccagugcaugccuuacaaucuucugcuggcucuuguggacuacuaaaacuauccguagucuauagcaugagagucuuucaugggccaucacaauaggagugucguggccuaucucuugcaacuugugcauaagcacagagggagguccuuagcaagugucuugaaauccacacagcacuugcuuuaagagaucuauagcuuuuucuuuuaauccuaaaguugucauauacgcucuguggggaugcauucugaagucugaaaucugagaucuuccacuagagaugagacguguuggguggaaggucagacaagguagaauuucuacuuugcaugauugaauugucacaaauauacuuugaaagaguuuacagccauugauaugucucaacaggcagagguacugauggccugaguucugucccuagaacccacaguggagggaaagaauuaacuccugaaaguuguccccugacuuccacauaccugcugucacacaugcaugcacauaggcuuguacacauacccacauacauguucacaauaagaauaauacaauuuuuaaaaaaaagggcuaaguguggcuuccauggcuuuaucaaagucaacuguaauggugauuuggguuaucucucuccuggaucacuucauaggcguuugaaaguugaugcuggucaugugucaucccuaaguccuuuugucuguuguccaugaagugcuaauaaucagcuacuccucacaggagaacuuagcaacaaaugcuaacucugucucugaaggauccauucuuccuagauguuggccuaagcaaaggcuuccccccccccaauguuguugcaaaucaagacaugggauuggcuagcaucccaguucgacagugcagcaccuugauugacacucuugugaagcgaacgagcagucagggauuauccauauuugcugucugacaaauucgaaggaacaguaaaacaguuugaaaagcagauguagacucucagaagcaugggaaggguagagugcgaaucugcagcuuguucuaaagcugagacaguggugaaagaggcagagcaccuacccuugugcccacucuucugucuauccuugcaaccucucggagcucagucuugugcaggacacuuaacgugaguauagcacuacuguaguacggcuugaaucuuaaaucuaauacgguaggaaggaccacugaguggaugauauuugcuucuacaaaucuucaauugcuauuguucuuaauggacuccccacuugugcccaggggaauuuaaaucugaggagagcagggacuguuggguacugaugaggugugaauucaguccuuugagguggcacaaagaugacugccacccucuccauccuagcuccaaguuuggaauccugaacagacuaagacccuguuuuuuaucuguggcaaucuguauucuugaguaugaagggggcagauuauuuucaaaaagcacuagaaaacugucgaaaagaagucuuuuguugcauuaaugacauuuguuuaaaaacccacauccagaacaggauagaguucucugacugcuuucacauuuaguaggaaauccuauuggguuucaagaaccuuuccugacgucuccaucucugccugcacaggacaucugcuuugcuuggaacaguggaauucuccuggcaaaauagacacuguccuuucuaaggacccagaguggacuggaugagagugugugguuaaaaccagccccauaggguuugggggcaggcaauacccaguuuugcuuuguauggguuuuaaaggaaaugaugaaggcacgaagcaauggagacagcaaguccuaccuuccagaucacauguuuauguuuagcuuauugauuauuuaaacacugauuauugaaaaagaggcagaucaguuccaccaucucccucauuccauguuugguagcauauucauuugggaggaaaacuaaggucgggcuuaucuucagguuuuagaugcagaaaaagagaucugcagcagugugguugaacuaaggaacagaucaaaauguggcucucccgagagucaaccucguaaaaagaaacuuuccccccaggaaguauccaauguaauaaaaauaucagaaguuuccauuuccuuuuggaauuuagggcauggcaccucagucugggucgauguuuaucuccgggcuuuuuauucauucauuuguuuccaggcaagauauuuuuuaacacgaugcuauuuuuuaaauguaggugguuuuuuguuugguugguugguugguuguuuuuggacaguaugggucuugaauuauuucacaugugcucacagaugugugagaagaaaccacagaauaugccaaagcuccugacauaucuacccaaggaaaggucucuuaccaggagauugguggucacacaaagcagagcaguguguggcaucuccugggcucccggaguccuugccaguggagcacacugguuggcucacaaggcuggcucuagccacagcugggccucccgaaggcucaguccucuggccugagguuccauuucuaaccaaagaagaauguaagccaagccucucccuaaaagcaauuacaggcauccacaccccuccugcuuucucaccuaaguuuagccucagcauuuguguaacuuuuccuagagagcugugagcaagcuuguauucaccccagaugaggcaucaacaaugggccagaaaaacaagcauaccuaagucuuauuagugaaccagugaggguuucuguuuuuuguuguuuuuuuuguuuguuuguuuguuuuguuuuguuuuuagcagggggacagagagugaggauuaacuacagaagugugugagugagggguuacuuaugggaacaugggugacccaaagacaacuagauaucaaaaggcuuaucccaacaugugcacuguguggaauaguucugugucaacuugacuuaggcuagagccaucugagaggugggaaccucaauugaaaacaaugccucuguaagaaguggcugccgggaagccuggggcgcauuuucuuaauuagggauugauaggggagaguccaagggggguguaucccugggcuggugguucuggcugcuauaaaagcaaacugagcaagccaugaagaacaaaccugaaagcagcccuccuccauggccucugcaucagcuccugccuccagguuccugcccuguuugaguuccugcccuggcuuucuucagugauaaacagugauguggaagcguaaaccaagcaaacccuuuccuccccaguuuguuuuggguccugguguccccucagagcaauaguaaccuuacccagguagggugacacugagucacaaaagcuacauccuuagaucucaugcaccaccugagagacuguccaguucauagggaauggauacacagcagcaccagaccccaaaagcacuggguacccagguggcccagaacauuaccagcuucccaggucucaccccuauacucggggucaguagaucaagcuaggugcauauuugcauuaagcggggaaagagaagugggcacaagauccuuggcccuuugaccacaggaaaccaaguuaauacuauuaaaacuuaaccuuuccauccuuuaucccacaguggaguccccagcugauuacggauugccugugucuguccgcacuccucacuagcucugcacauuguuuuugagaugguguaagaccaggucuuuuuaggaaaucuugguuguccuggaacuugauauguagaccaggcuggaccuuaacucacaaagauccuccugcuucugccucuugaguguugggaucaaaggcacgcaucaccacgcccaccauguuguuauuucucuguagcuuagccagcuagagagguugagaugccuuuauuagcauuuauguuuauauuuguuuuuauugcucauaaccuuugaugguuucuuuuucauauaauuugcacugacuuacauguaucguuuugagaauuacucaugaguaccaguuguuuuauugcuaaguucuacuuacaugcguacuacauuuuguuuuagccauguaauguaaucaguaagacauuguuacccaccaccacccuucucuauuggggacacuguaacuugcuccuucuaacuguaacuuuguauacacuggccagcccacagcucuuucuccccaucccucuagcauugcucuccagucaagucuucaucaagacuuucauaaggucagacaugcugcugcuccauccccguguccagucccauuuuccauuucacuccugggaaugccuuguuuuaauuacaauaaucuguaagacaugcuucuuguaggguuacuuaauuuucauguucuuccuagggauguuuuuauauucauuccucuaacuuaacuucaggauaggauggucacucuacaaagaucauaccguggguuuugguuuuugguuuaugguuugguuuuuauuuaaaguuguauuacauguacuaauaaaucaagggagaaagaacauuuuuauuuuaccuuuccuuccaacuguuuuuuauccacaucagugaaauuuuuucuuuacuuauuuugugugcuauuuuuagauaaauaucgcucuguguaaccuaugugggauuuucuugucugguaguguuuuggggaguuuuuuuuuuucuauuaugucuuaguuuggguuuuuauugcugugaagagacaccaugaccuuggcaacucuuacaaagaaaaauauuuaauuggggcuggcuuacaguuucaaaggguuaguucauuaucacugugucaggaagcauggcagcacacaggcaugcguggugcuggagaaggagcaaacagcucugcaucaggaucagcuuauaaaauagacuuaagauauuaagucagaaaauaugaugggaagaauaauccuaaccauaagcugcuaacuugauuuauaaaaaugauuuuuuuagguucaugauugauucuuggauacagauagaauauauaccgcccuguaaaguauaaauguugguuuuucagucagucuguuuuaucguuggcucguuuugcuuuauuaaccggaucuucagaagucacagugucagaggcucuuugugcuaaguguccagccugucuucuugacuuuacaggacaaauacucuagugccacuuuccagaauacacauuagguugacacagguuauuaauagguauguaaauaaaaggcauuuggaaaaggggcacuccaguguuugucuuagugugauguuuuccuuaguuugaagaauauguuuucuuuguucacaaguuuucauucuaauucuaguuuuaccgaaagauuauauuuuuauuauuuaaucgagaacugugauuuuucuguaauugauuuaagugagcauuuggaaaagcaaucauuguaaacacagcuuuugggaauacuagcaaaugauaaagccauguuucucuuaaaauagaauucuguguagaguuuguaucaguccaggcaaaucagguaaaugcguuauuuuuauaacuugagaaaucauaaaauuuucucccuauggaucugcugcucauugauugccucaaagcaaaguaaccaguauaucaauuaucuuaaggggauacgguuugcaguguauuugggguaggccauuucuuccuaaggaaagaaagcuuuggguaagaaaaaaaauauacuucuuuuguaauuguuauuacuucgaugagggugguugguugguuuauuuugcuuaaaauguugcuuuucccuuuguugaggguuguuuguuuguuuguuuugauguacguuuauguaauaguugacucucucucauuugugaacacugaggcauggaaaggcccucugaguugguuuauguuugcuuugguucugugaugggcccuucugcacugauccaaggccaugcuggaggccuugggaggagagggaagaugggugaagaguggggcgaggcugcacuucauuucucauuugcuuccaaaauaagauggcucacauuccuauccauuagcacauuuuccuguccuuccuuaaauagccuguggaguagaaacucacaugacucugcuucaaauguuuaauccuguaagggaaaaaaauuauccugucaccuugcucuucccuagucuagggaaaugaacuucaaaagaauuuccaaaccauggcauggugauuucaauacugcuaaagaacaguguggguaagauacagaacacaccagaucuccucaacccuggcuggauucugacaaaaccagagccaaaacaugggguuccgucuugugcaucugcagccuauagagguucuagaaagaccaucuuuaauccugaaggccaaauguguacuguuccacgggagaaacucaucacgguucaucuguucaauaaauuaucuaaggccuguuugugccauccuuuggguccuuaugcaaaccagccuccuuaaugcuagcccagugcaaauuaccaguggcuuuugagacuaggaacaaagaguaaauaggugaaggugcuucacguagacaggacucaaagguagugagagcuuucaaaguaccuuacuguugcucccguaaugaacaaccauaagcuuugcaauuuaaaacaguguauacuuagacaguguauacuugggauuuuacuguuuuguaggaugggccuccaacacuuaucucagugacuaaaaucaagguguuguguggcuuuguuccuccuugggagcagaggagaaucucuuccuagcaucuagguccuuuuccuggauucucuggguuacuuacauuccugguucauggccccuuccauccucuucaaagacaaggggcaggguuggguccuucucccauugugugucacuuuccucuuuagccucuucccuuuucucacaucagaacugcuuaugucucccuaccuauagcgagcaaggguagaaacauaguaacaaaugcauuuugccuauucaaguaacacauuugcuuauucucugaguuaagaccugggcauccuugggugcuauugcucucagugccucuguauaaucaggccaccguccuccucuguguacccauaaugcuuuggugucuuguaaucauauugcugucaguuugcucgaagcucuuuccagacagacugagguccaagauggagacugucucaucucugcauuuccuccucuaauuccuuccccuccucuauuuaauccccaaccccugcaagcuuggaaucacugaacucaguaccuauaaucccuaaaugacccugcuguggaccuacauagacacgcgaucacuucacccaguacacacaugaagcugaacuuucugugaaacuccuugugauuaaaaaaaaaaaaaaacaauaacaacaagugugacuggugugguuuccaucagcauaaagcaauuaauauuugaauucucagucaaacguugagccuagugcugcagaugguuugaucugcuccauugcuuggcucagcaagccucucccucaguccgauuugccauguuguucuuuguguuuaaagaagcagggcacguuuacaaagcaugucuggaaaaaaggaaaugauguauggaaaauaccuauguagaguauagagucaggugacuccucagcuggaaucaggggcuauaaauaugucagugacuucauaucuaccaugggacugguauuuuccaucuuuaaacacaauuuuaauaaacuuagaugaauuuguuuuuugaaaguagaacauaaguuacccacagagauauuuuacacacacaaacagacacacacacacacacaauacgaauaaggucuuuaccucaauaacagaaucaauccuuuccuuuggaaggaauuugacauucacuguggauuuugcagucuguugagaauagucaccaucacuugagguagaaauagaggaaaugauuaauuuagaaaggagaaggauugugggguggguggaagugacauuuucugcauuguauucuuagaaacuuagacuuucagaguuggaugugccgcugauaaaacuguucccuagcauaagaggaaacggaagccaaggaaacuuucagucccuggggcaaguuggugcugagggcaaaaacccaagcugcagucaagucuccagaucucguuagccuuucucagcccugcacucaucucaggacccucggugguuucacagaggagaccagacgauggucucugcuccucagaugccugcauggcagucccuaccccaggcuugcuggugagcgaaaagaacucuguguaguuuaucuccuguuggacacagccccacugugucccugugcccauggaaggaggguggacaggcaagcagagccaacgcaccaccagaacauuuuucaagauccagaaucggaccaaagugauggguucugugcccugggacuugcugucacuucagcauuugugucucucacuuggcuuuguguaacaagaugucauuuaaaaaaacugugcaguuuucaaacauuguucuaaugagccugugacagaggacauuccuuugguucagggaacaggacagcaggcaugcugacgguagagcaaguauucacguggcauugucacccacagagagaaaugacuuacuuaguguaggcccugcaaguuuuacacuuaaaugaaaauacgguucucaacaguggguguuuagcagugucuauagacaugugggaguguccuaucaggggaagaggggugacuugcuuagagcaaauggaggccauacaggacucucccccacaaccuaaaaguauccagucuaacauaucacucgagccaagaaagagaaacccuccuauggaaguuuuugacuuagcuaauucuuggcuuuagaagauuguucagaggacugagaaacagacuaaccuaggcauaucuggucugguacagguuaagaagaguucuguaaucuuaacagggugaauggacagguacaaggaccucauuuggagauugggagccaaugaaagcauucucuguaugacuuggccucucccucaggccucuguucuuaguuaucagaguggaaaggcaguuucucuugguucuuuccaucuguggguucaaggcuuuagguauacuggggguguuguugcuguuguguuugagggagaggagggugucuugaaauaguuucaagaaccggauuugaagagauaagaauaaacagaacaaagggacucugugccauugccgucgucacacaaacagcugcaggcagcgaagcugugccaggugagggauugggucucagcaaacuccaucaucaccaaggacacagagaaaggagaggagggcccaagaggacauacugauugggaggaugcccuaagccuuccucuggcucuaagcucugcucaggggcagcuguccuggaaagauuugcauuuccuuguuccuuuuugaaucuuugaaagaaaauuuccauauugugugggguucccugcccccaacaccaggugguuaccuuucauacagacugaaccaugugguacagaugcacaagcacuuccaauccuguuccucgguuagggcccccagccaagauggaaccccucccaucaccacaccuccuccauuggagcccagcagcuguggugcugaccugccuggcagcccuaguuggugguggucugcagaagccaaggcugcuugcguucacuucuguucacauacuaguucauucucucaaaagcucauucguuuacccaacuggauggcagaaguuucucucaagcuagauaaccaaaucagguguguguuuaguucagaagccugccuguugcua

SEQ ID NO: 9221 - RNA, 1480 nt, Mus musculus
uuauuauguauuuuuuuuucacgaucugugguuguuuuaauuaucuucuuugugcugauacaaacuauuuccuuuauuuccaucuuuccaucuaguaaguuagcaaagcgugccauuccuaaucgaauuccaguuauguguguuucugaguggguauuuaaggacaauucugauuuacaacuuagucuuagaaaauagagaauuuaaaaggccuaacuugcuuguuucuaaaagcauuuuaauuugcagaucaacuauaaagaaguguuaaauacucuuuauuugauaucauacauaaaccacaguaaaugccuuucaauaguaaaaggcaacauccuugauguagggaauucuaauuaaaacugcacugucaagaauagacaguugccuccuggugguuagccaugaccugaaagaggccagugaacacaaacugaaacacauuugagucuucuuguuucugagacagugauagaauuuucccaguguuuaagcauauucauaugcccaguuauauaaaucuaaguauaaaaccauuuaguagguuugaggugacaugccccuauuuauggaaaguaaaacauugcuaauuaaguccaaucuuaucuugagaaagggagagccgugguagcauguauacaacuggaacuguugcuuuaauaaagaccguacccacuuuaugacaagucaguuuuacuuaaaucaggacuguccaacaaaaacauugcuagccauucaugaucugaauuuggugugugaauuaaauuaugguguacauuaaaagccaugagucauuuguuuuguaauaaauaaggcaguggaauuacucauuaguagccuuuuuaagauaagcuauuaggucugcccuuucucccuucuucuuaauuccagcgaagaucauuuuuguuccagggauguacuuuuugggauucuccaaauacuccaucaggguauccucuccccaggugaugccuuuguucuuguuggcaucuguguaagagaauccagcagccuggccugucuuccgcccgaacagaccguggagauuugguccagucuuaugcuugccucccuuuuccacaguguggcacugggcacacuucugaacaaaaaucuucuugccuuuuucaacaucacccauuuuuaauucguuccgggcuggucaacaccacgaacguucggacucgaagacagacgucccgcgcucuagcccaaggacacgccggcccgcgccuauguaccggugucggugcaaccacacuuguucccaauuauuauguauuuuguuacugcaaaguuauggugaacucacccagaaccucaaagccaaggaguacaucacuuacacguucucuccucuugguaucuuauauuuaacauugaaaguaagaguucuuuguacaaaaagaaguaccaugugacauauuugaaagauaggucugguaacgugcucaaagacacguucuuuuuaucucccaug

SEQ ID NO: 9222 - RNA, 2514 nt, Mus musculus
ugaccaagcuugguauuacuuuauucuguuucucauacgcucucaaaucaucagagggaauuaauucuuuuguauuggaaauugccuuaagugcucaaaaaucuuuuagggggcugauuuucaaauaaucgaaugcauagaauuucaguuuugguguaugcuggugugguagacgugucaguaguaaggaaccacaggaguuagagccaacacagagagagguggucccuggcuuguuuuuauaacacccgucaucuccaagccaaaucgaccccuaaguuucccaaaagauguccugguaagaagagacucguagggaggcggucccauccuccauguccaccugucugcccuguggcagaucccaucagagugaacaacagcaaggacuucagaacugcugggcuccagagcacugugugccuaucacguacaagcccaucuguuuucaaagcuucagaauggacgaggggaaaggugaucucagagcagcagggcaugggugacugugcgggguggggccacuugccuuccaaaacaaaaguaaggucaccuacagcacacagccuccugccaugcacaaugcugucuuccacggucaguuugucaccucuugguggcaguuuguaguuucgccucuuagacacaguugaauuugcaggaaauguguuccguugcgcuaugccgaagcugguaucucaagcuuauuuucugcauagguuggcuguagcguugauuagccaccauaagguuggagcaagaguucccauuuggggcccgcuguuaagaauaguaguaaauaaaagucggcuggagcucccggaaugucauuuguugcucucucagguuaaccuuuccuccaauggaugucugucugugcagaggaagagugugucagugucuguugagcuccgcucccguuauccuacacuaaacauucuuuccucugccucuuucccuccagcugucagccaagcugaauauccuuccaacgcucaucuccaugcggcuggaauuccugaggauccucugcagccaugagcacuaccucaacuugaaccuccucuucaugaauaccgacaccgcaccagcaucucccugccccuccauauccucccagguagucugcuaacuacaggaaaggggcgagcugcuuuguuaauuagcuuaguucaauggggcaucuccuaucuuacuaauuagaggaaaaucacacuauucaaaccagaucaguugauccagauaugggcucuacgguucccugaagcugcagcaucuaaauugaccauuuucaaaucaaguaauuuggcacaagggucccuaaggagguuaacuauguaggaagaaaucuguaagccuaggaaaaugaagaaacacagguuaagucucaaguccuccacugucgacauaaaccaauuauuguacaauauagugugcaaauacagguuuaguauauuugcaaauacagguuugcaaugucuagcaagauucagaagcacuguguuagccuagucucuuuguccgacagcuuacaaaggaagaacugcagagggggaggggcacgagaugaaaugauucccaauaggauuugacuguggcaaauguccuuacugcgucggcaccagagguuucucaaggaguuaguguccucuagaaaacccuuaaagaaauguuauuuuauagcccuaauccagaugugggaaacaaggcagauguugacagcaguaggcaagauagcucaggaugguauuagauucuauucugcugcauauccuugguacuaguacagagggaaaggcuugacagugauaagcgccuuaaguuccaggacuaagaggacggggguggggaucacaugggcccaggaguuaguuccagaucagccugagcauuauagugaagccucauuuaaaaauaauaauaauaauaauaagucauaguaguagcuauuugugccugacaauauaccugaaguuagcuccaugaccauuauaaugugaucugggacacacgugacuuacaaggaccaauuccaaauggacuuauuauugucugcugucgucuguucugugggcugaauccuauaacuuccccaugcugaccuugcccuggguccucuccccaugcuccucuucuggcugcccuaaagaguugacagacccagggccccuacuccacagagcuccaggacuugcagggacacuuacuucuguccccggugaaggaugucacgcucccggaguaagaacacgggacaggaauggccuagggcugccaacucuggcauugucguagcagacaccacuucugguuccaggccagcuaacauccagacacugugcucagaugaccuucagaaaggauucuggggagacagaccacagcgagggacuggguacaguccuuauuucucuguccacguguacccugggcuguucaucugcaacuuuuaauaccagacaggcaagggagggauuagcuaguuuucuuuguucuguuuuucccauuuugcug

SEQ ID NO: 9223 - RNA, 1198 nt, Mus musculus
aauggugaaagucggugugaacggauuuggccguauugggcaccuggucaccagggcugccaucugcacuccacauggcaaaguggagguuguugccaucaacaaccccuucauugaccucaacuacauagucuacauguuccaguaugacucuacccacggcaaauucaacagcacagucaaggccgagaaugggaagcuugucaucaaugggaagcccaucaccaucuuccaggagcaagacccugcuaacaucaaaugccagugcugaguauguuguggagucuacuggugucuucaccaccauggaaaaggcugggcccacuugaagguggagccaaaagggucaucaucuccgccccuucugccgaugcccccauguuugugaugguugugaaccacgagaaauaugacaacucacucaagauugucagcaaugcauccugcaccaccaacugcuuagcgccccuggccaaggucauucaugacaacuuuggcaucauggaagggcucaugaccaugguccaugccaucacugccacccagaagacuguggauggccccucuggaaagcuguggcgugauggucguggggcugcccagaacaucaucccugcauccacuggugcugccaaggcugugggcaaggucaucccagagcugaacaggaagcucacuggcauggccuuccguguuccuacccccaacguguccgucguggaucugaugugaugccuggagaaaccugccaaguaugaugacaucaagaagguggugaagcaggcaucugagggcacacugaagggcaucuugggcuacacugaggaccagguugucuccugugacuucaacagcaacucccacucuuccaccuuugacaccggggcuggcauugcucucaaugacaacuuugucaagcucauuuccugguaugacagugaauacggcuacagcaacagggugguggaccucauggucuacauggccuccaagguguaagaaacccuggaccacccaccccagcaaggacacugagagcaagagagaggcccucgguugcugaggagucccuaucccaacucgaccccuaacacugagcaucucccucacaauuuccaccccagacccucauaacaggaggggccuagggagcccucccuacucucuugaauaccaucaauaaaguucgcugcacccc

SEQ ID NO: 9224 - RNA, 37750 nt, Mus musculus
caagccacaaccgcgggagcgcucuuguucuuucucucuuucucuuucacacacucuuacuuaaagccacauuuaauuuuuaacaaaauggcaucucagcuugccauugagaugggacuccgaaccccacagcagaacagcggagcuuucgcaccccuccucuucaucacuuucagguuggaaagaagagucccccggaagaugcuaccuaccgaccucacuacaucagcccuuccuaggggcucaggagagggaggaaaaggguuccuugcugccccccagaccccucaacugccagccccaucaagccuggaggcgguggcaagagcagcaauaguugcaucagcgcuccuagccaaggcgccaggaggguacaguagcaacuguagggagcuagggagcgcacagcugcugcggccgcagguucccuggaucaggaaauuaggacaggcacccgggauuggaggugaggacggugcgcgagccaaccagcggccgccccgggucccccgugagccccgggccaacgcgcggagcagucgagccccuggagccauccggauggcggcggcgacagccccagccccagccacucacgcacgcacgcugccacuugcccccgcacccuccucacugcgcgcgggagagcggugcgugccugagcugcugggcugagcucccccgcugggguccccgcgccgcucggccgcgcuccugcggccgcccgggugguugcccccaaaccgcucacuugagcuguccucgguggcgaacgggcuccccgcccccuccucccgcgccguucccuccccucucccuccccuucucugcaacgccugcauuauuuuccgcccgcaggguccgcgcgcacaccgcggccgcggcgggggaggugaccgggugggugguuggguggguggcuggcggggaguagagugugcaaguugcagggaaagggugcccgcuccuugcgugcucuccgugcucccggcucuucacuccuucccccuccuccucgucuccucccuccccgcccccaccuccuucuuccucuccgaagggcugguaacuuguugugcggagcgaacggcgacaacgacggcgcgacggaggcaccauccgggcgggcagcaugggcacguccgcgcgcugggcgcuguggcugcugcucgcgcugugcugggcgccccgggacagcggcgccacugcaagcggugaguggggacgcgccccuccgcacucggcccgaaacaagccgaggcguccgcgaucgccgcguucugggggaccccggggcuccucuugcccauccccuccuagcaggcgccucuccacgcuccucuccugccuccccuccccacccggguggcgccucugagcugucagagccgagguuacugggagccaggcccgggggacggugggguuuaggguguccuaaagcgucccuugaacuuguugucauucuucugugucccccuucuucccagaaccucuguuuuacaugguuuucaccccccauugacaagggcuaggggaugugggcuuuggagccacugaacaaugguucugccuccucugccaggcgggcuguuaggaccguggcagagcacggggccuggaagcccgagugcgccccucagacuuaagcaggguugagagcgcacagugggugaaggugggcgucuccgaggacaccgggcgccaggugccggccgagccgggaguccucgcgcugccgugagcaagcgcacguucggugggcggcagccuggaggccgagccaugacaaguacgcagccugcgcccgggacugagacuccccaggcgccgggccgucucucgggcuccaagaguggcuuucaacuggacuguccuccgagugcuuuucuuucucccauccccggggauuccgcagcuacugcggcuuuuaaaaaccucuggggucucugagauaacugaacgggggaggggagugggaucaagacuuaaucagguuacuuugccgagccucauucugggcaacacuuucccccagagaaacugagucccaguguagugacuguaauuagccuuuauucugcacaauacggcccgaagguguggagcuggagcgugugacuggagcuuggggagggcggggugacuacugucgagucccagggggucggcacacuggcuuuggagcccuguguguuuccagcaccccaucuugggucacacaacuuuccagagcaggugauaagaugccuuccuaacaagguccgcgucugauccuuggcgggccacugaagaggucuuagaggucuuaagaggugacaccaaagugcuugcuugccaaccagcucuagguaauuagggcagaacgcugucccagcucuaaauaguccacaauccacaucuccugucgccggguagcuuagaaggcccgccugcgugcggucacguguguccuggagugagagcgaacuuucaaguguguggucaagcugucugucgagcuaugcugggguguuuaagucucccagcgccccugggccuuugguuccgcuguccggagcgugagaagcugggcagggcuuuucugccccaugcgauuggcugguagcuggauugcguuuagcuuggucacgugucuacgcggaguuaauugagcugccccagcuggguuaccuuuaagaucagccaggcucagaggggccuuucccucuggcgcuuucuccagcugcacucugaaaagggcccagguaucgugacgcuagaauccuuccugugacaaaccucugugcccagagaagcccugcuuaacagaacauuucagacgcugacauuaaucauuaauggaugaguaauguuaacuuauuaaaccaucucucagaagagugacuugacucgggcuauauauuuuguaguauuucaaaacacgaaugcauaaaauccauuacugacugugauccggggaguugggagaaaggagucuccuuagcugcagaaccuuuuggauucuuggaauguuuaaagugcuaacuuuccaucaggugcuguuuuuuacggaguggucggaaagcauccagacugcuucaaggagcuaguccaacaccagaaguuguugagcugggaucaggaaaguggggauagccuuuguuucuccuuuacugcaagugggcuaugguggugcuguaaaaaguggaagagagaaccaggcacaaaccuaagcagccagagugggagaggcaguucuuucugaacuacagcagacuuggaguugguugaccauaagugaacccacaguaguguccuaaguucaaagucccaaaacaugcagacugauuuuucugccccagaccuucugugauuacucuuucucuccaacccuucccucugccccccaccaacacacacacacacacacacacacacacacacacacuaaacugccugacacaggggaggcauguguguauagaguuucugcaaggaauugaagugaagggacacuaacaaacgagagaucgcaaggacugauggcagaacacauggggguucuaggacucuugccucauauagauuaagccuagguauagauuaagauacgguguguuguacagucuucaaagccagaguucugcaagagcucuuccaaucugaccagugacucucacuucucuuccccugggacugagaaauaccagaguaucugcagguaggaaucugaaagaccaggagagauaauuccuggcuuaccagagcaucaagaaaaggcagagaccguagcaauccaugcagaugaaggcuuucuuuuuaaaaagagagucacaacccaagcuucaugggcagcgcauuucccaaagcccgaagcagcuuuuugcccagguucauucucuuaccaguaccucuagugcugugucaucucuacacaauucugcuuuuaaugcuugagucucuagagaccuacacuguguauauaaaguucaaguucaguagagccaacauagguuaagacuucaggcugaccaacugcacuuguaaaccuguguaaagguggcucccuccaucuucuaaacaguggcaaaccugaucaucagauuccugcuuccuaaaauaugaguaaccucagacaggacuucccgguagaacuucuugugaagguucuagaagagcuaaagagcuguugugaccccuuucuguucccuggacagugucagaaccauaaaacgugugccuuaagaugaagagcacagacagggccccaggcauauggcuucagguuuagauccccaaacccugacaguuaccaaauggcauagaaagagaaaauguauaguaacuauuuucuagucucucacagagugucaagugguucucaguggagguaagauggagauggagcuguucucauuucagguccuggucuugauuggcuuaacuugaccuuguuuuggaaagccacuggcaggugccagccuaugagacauuaaggacaucacagagcccaaacaggccugaaguggugcuugucacauaaagaucuggcuuacaacagagagucucacugacuaagacagcuguccuccgaaaggcaggugauagagucaucuaacuugagauaaucucaagagaugaucacccaggacgaucccccagaccacagcacgcagauggcuuucaagaaaaauagaagcucuucuuuggagguuaugacugaaauguacuuauuaaaaaggaagaaugcaagacucuauccccuucuagcugaggaggggauaaucugaggacugguagcuuuuucugaggucuccaaggcauacucuaacccaguucuuggagaaccuacuuguaaguaaaacuggcucaauuuuacucuauuuguuuuuaauauaaaucuguauuuuucugcuuagcuccaggguugguuugcaaucauggcccuaaacacgguuaauuccagcuaguuagauaugcuaacugugguguagcuacaugagaaagcaccuuaaacuggaccugcuuugccuucagguggagaaagaacccuggaugauuugggccuguuagucauuuuuaugcucuaaauuagaucaguguuugugaaggggccuugcacuaacuuuuucugguauacaugcucagcuuugugugguagaaaugcucgacuuuguacgguagagaugcacuguguggaggagagagggugugccugagccagcacuuaagaaguacauuuagggcaagaagcuacaacuuggaagggucaggcacucacuagaauggccaauucugccaccaccaacuuggggcaucuggguuggcaauuggccaguagucuuuagguguuuaaaaaagucuugccauggaggugagggagugggggggggaugcaguuugccaggaagugaugauugacauuugaguguucauauguuauaaccacauuuccugcaaagaauuuaguguauacuguccuauucucuauaccugccucuaaucuugaauuguccuaagaaugcuuucucaagauauaaauuauuaacuggccaggagguuuaccaggcaggauauaaaaucccuucuggcuuuagcauauuaaagucuaaguugcuagugaacuugaagucagucuccuuuguauaucugcucaagaccacgugguaacaggucagcauagaagccagaaagcugcccacuuggugccauguuuuuguaggaagucaaaccaggaaagucaagaugcaaaaggaggugaucguagaagcugugaggggaaugagcagaccuggugcuucguaaucacaaaagccacugacaucagcugaagaugucccgugagcucccaagugcugcuuugaucaucgcucauaauguuucccuaaaaucaccagcaacuuagacuuuaauacgccaaagccagaagggauuuuaucucugccaaauggucuuacgaagguaaggauucaaacaaccauaguggcuauggccagcauccccaaagagcaguaguaugucaaaaguaagaccugggucugacacaccaaccuccuaacuugcucagaucuuucauguguuuuagaaucucucuccugugggaguguggcugacacacucacuguggcagacaggugugcaacaugccuugcuuuuuaauaacucgccacacagauggguuaaaaguacucucgugggcucagaaagcaggcaccuuuauaacuuuaccuuucaaagauucuaccaggcaaaacuucauuuagcaggucacacuucacuugaaguuuagacaagcugagaaaauauuuugacaaaagucuauaagucagaacagcuuuacagguuaauucauuaaccaacuaauacaaucauggcuguugacuaggacauagcaaaucuuuggauucugggugauaaauccucagugcacuggcucugggaaagguaugaaaacuuuugggaaguaagccagaucuuccuuguuucuugggaaagaauuuaaagacccagaggggcacagagggccuccauggagaagugcaaucugaaccugcccccuugggggaagaggauggaaucagauggacaaauguaaccaaaacaucagugagaguggucgaaggcaggggacauaagggaagccccuuagagcccauagcuccuuagcucugcuguuguagccagaacagauggcgggugaucacugagaggaagaagucagggcaagcugguagggaacugagacucaauucuagaggcaguuggaagccaggaaaugauccuauccucggcccuucuggauauucuaaguggcuuaaaucacucucuuaauuuggauagagacagcaacagcccggaggcaaagggaagggugacuuaaauuuagaccgagugagaaaugaaggguuacccuuggccaagauuugauggcccaauggcaggggagaaggaucccggcucccucugggcuacugaguuagaauaagaggcaagccaacugaggauaaaacucaaagagaagaagguggguuuuagaucaaacugcuuuauguugcaugucuggcaagccaucuagaugaauguuuccuauaucaugugcucaaaagcuguauuugggaugucaucuacaugucuguucuaaaacacuuucauuucucuccuuucugagcccagugacagacaugagggcuuaugggggauuaacaguguauuuaguauucaauuucaauuacaaccuuguaaacaaagucucuuccauguuauauguugccucuguaacuucuuggucuucaugcugaugccccuugggcuacucuccaucuccaggcagauaagguacaaagccuuuacaaugacuuggucaauguacccucaucaagaaaaucaagagacuuaguccuucuaggaaaagcugcuaggggaaaucuagcaacauauuuaaaaggcuacgauggaaagaagaaaaacgggcccuaucucaacuauaaagcuaugcuguggagugucguucuugagaaggaaaacuacuucauucuugauggauuuaagcagacuguauuaggcaaauucuaagcaaauggaauauucuagaauuaugcaguccuguauggguuacuguuggguuuuuugugcuugguagguagaaugggauuuagagccagaguaccugaguucagaucuuugguaagcccaggguaaucuugggcaagucaccauauuuuucuuuuccaaaacuguggagaggaaaaggggaagggucauauagaaccagugauuaaagacaugagaagucuuuagagcagcaacuggccaacaaugaaaagcauuuauuugcuguauuuaggauucuaagauaaucccuauccaguauaaauggaacaacugugacaacugaacuguaaaauucauuagucugcaucucagagccucuuccugggcaccuugcuauagacuuugcugcugacagccucucauuccuguaggaaaacuuuuucuuuuuuugcugacucagaagucugcuuguccuaaaaggaguuuuagccuaugaauaggauuggcauuaaacuagcaagcaguagagacgaaguagacuaaaaauaaaugcccuugguggcccuagaugugccaaagggaauggacugaagaaaaaccaguagaugauagcacccuuaccaugucugccagugaagugaaugcugggccuggcagaguguggcaacccucuaccccucacagauucaaguucuucugagccuaauacucugaugucuggaauacucaauauuccagacauucaagcaagaggacuccugccaacauuacucaaagccuacagggaaaucuguggcccauccugaaagccagcuaggcuauucacuguaaggccuaugcacuacuucacugaagcucacacacugauuuuccauguuaacccuugcagaaccaauuagacaauggcgagcugacuucucugugcacucaaacccuuacaccgccccccaccccugccccaagacccauaaacggcaggucgcagagugaaugugaagugcguaggugagcaaaccuccuggaacauagauauuuucugaagccuggugccaccuauucaagcgacaacagaagcauuugggagaguguagcuauuacuaacucuaauagccacaugaguggauagacacaagccaauccaaaucucugggcucaaaaggacaaagguauuccuacucaauauuagagguagaggaaacuuagaaaguuugaucucuucacggaagaggagccuuuucauauuccuaaacuaauaccaagagucuuucucauuugcaguggaggcagagcuccaggcuccaugccucuccccucuagccugcccccacccccauuccuuuagccucaagcuacuuccuaggaacacugaagcuuuaaggaauccacugaaaacuguauuuuaccuccagcuucccaccuuucagaacagacagaugcagggguauagagugccuagcauuuccacucccaagguucuuuaugguguacaguggcuuuagaucagcuuaacaauuaaaagaaaccuggugauggaugauuucaugccaauuguucccucuauguacuguaagagugaacuugagauuuaacguccauggaugaaaauagacuacaggucuacaauccuauaauccccaaagcuuugagaaccaaaagcuucuuaacucauguggcgcuuuugguucuggaccucugagcagcaguggucucaguggaacauccgaauggaaagguagaaucuuuuugggaccugcagagaaaauccuguaguauuccagggugguggcuggggucucuguguucaauuuaguggcugagcucucccugcugugcauggaacacagaagugaacagaagcagggaacacuuccuaccuagcagcagccucuuaaaaugcucagggaacuggaaaucugagcugcaccaacgcuguugauucucuuuagaggaccuuuaucaagccagcuggcuuuucguccauccuuuucuccaucaucuuuuagauaagcagagauguuucaguaaccauugucuuccucauguacauuuuuccucuuugauaauggaaugucacgugugucauaguaacauacaacuuuccgauaagcaagcagaagccuuggugacauggacacauguuagcaaagaaaagcuagacauuagaucccuuucugcuuuaggauauuggaaugaacagaugaaagugcuaugucuguuauaacccuguuuugagccaaaccuccagggauuuuaacauaaccuauuacuguugauagcuuguguauuacaacuggauccagaguccagaacgaccaggaacaguauauuagcuuuaucagguuauauguugggcuuuuagcuccaagacagcuugagggucuacaaaauccaucacaugagccucauuuuuugaggauguccucucccacaagccuaauccuggggcuaaaaauauuuuuuccaagucucucuggaagucugauggcaugguuaucauuucucccugagucucucuggaagucugauggcgugguuaucauccucacuauauagauuucaauguuaaugguuugggcucauuuugacuuuugcucuucaaaaguaaagccuuagaagucacucuuuuugccuuuccuguauccuaacugcagggagcuauccuuuccacauuuguuuguuucauucuauguucucugaguguagauccuuuuuccuaaugaaguccucugaguggauuccugccauuccuguaguccucaaagcugaaagguuauagagcuguagcaaauggccucaggaacauagaccuccagcucugagaacuuggagaacauuccaaggacucaugguggcaggaggagagaggguggggcgagagagagggaggaggcagccaggugccucacacuuggcuucuccguuuugaaacaaacaacugaugcucaccucuuguucccuuuguaacucccuaguauuuuuuuuauuugcuaaaauauuuguagaacgaauaaacauuaugaaauggugguagaaaauaucaucaaguuauauugcuugguagccaaguucuagcuagcuaaacguuuaagagcagaaagcuccauauagauuuaaaaagccauucuggaagguagucacaccuugguguuaaucuugucuugggccgaauuuuaaacucuuugggaauuagccacaagugcagcauucuuccugacagcagggcggaguugacaccagggagaccaacuagagcauugugcgguucacacaaguguuccagucugugcuugccucugcccucucuguuucuaugccagcaugccccagcugcaagugcugagaggugguaggaaaucggaaggcuuucugcuuggaaccacccuccccccagcaaaucugcaugcacccugggaagaaagcuggguucugcaaguccaggcaguguauugaagagaggccuuuaagggacaagagcuacaucuuuuauugcaaucugcaaucuggucuuguagaaggauagaagugcuaaugacuaaagcaccugaacagucacuguccuggccauggaguaccgccaugaaaaucuuaguucacaccucucuaaaggacauguccauaaugagccaaagccacugagcccaggcaagcagagucagcucuauggcuugcucuccuuuucuuucguggcaccccguugucuccuaaccaugcuuucuugaugcuuuugauuuguuuuggagcugguuuguaaauguauguuuuccaaaggaggccucaguuuuuaagauacaugaccauuaucuaucugugguuucugcuugccacccucacaaguaguuuacucuuaccuggugauagcagagucacucuugaguaaaguggugccuguagccaggaaaugcuaugaaaggauuaggauggucugcauguuguugcccgcccccucccccccccacacacagacaauuuaugcaaagaagagucuugaggccauucgauggccccuugugucucugaucuagcuaaguucauuaauccuggucugacuccauuggcuaaagaucacuauuccagccaccauguccauuuuuuuuagaaauaaaagggauuuuuaauuacauuuauuuacucauguauguauuuauguguauauauguguacacaugugccauagcauagaugagaggucaaagggcaauuuacaggaagcaguucucuccaacccuguaugaauaaaacuuaaugucucaaucuugggagcaagugccacuuccugcugagccaucucaccucuagaucauggaagcaaaaacuaaagggaaggaaaaugaacucccuguucuuuuagagagacagccaugcaucacauaaugauagagauaaguccuacacucuacaguucauugugcaauucauuguuccuuuacuuaaacacacagcagugguugucuugguuacuauccuauugcugugaugaaacaccaugagcaaggcaacuuauaagagaaaguacuucacugaguacugcuuacauaggcuuagucuaugaccgucaucauggggagcauagaaacagguaggcaggcaugacacuagaacaaaagcugagaacugagagagacagaaacagagaaacagagagagcacuuaguguggacuuuuaaaacuuccuaaucauccccacaguugcaccaaccgggaaccaaacauuaaaauguauuagccuaugggaggccauucucacucaaaacacaaugguuugacuucauaccuggguuauagggucuagucuauugcuucuaggcucccugcauacagcauaguacuugcacuaaauuuuguagacauccauaacgcaacggcagguauguguguagccagauauauuaaaacauggaaaaggcacacacaaauauaucugcacaagguuaacaggguaucucugugcaggaugcuuagcgugaguggacuuggcagaguuggcaguugcucugggugagccugugagugaauaaaaagugagauccaaggccuaagacauugcugucacuucagaaacacuguauccuuagugggccuuugauuuacaguaaguuuauaaaaauauuucugcuuucaauaaugaauauucuuuuuucuuuuuucaacauuaaaaaaaauguuuauucagggugcacagcaccagugugacaguugguagacaaauuucaggagucauuccaccguagguucaagagcuugaccccaggugaucagacuuggauagcaagugccuuuacccacugagccaucuaccucaccuuaaaaauauauuaaacucuaauaacagcuuaaaacacauggugcacaacuaugcaaaaaauugucucuacaugcucauucuacaagcuuuucuguauuuaucuuuuuguguuucaaacguuuccuaagagcaaagccacggucauacaccuucuccugagccuauugagugccgggccuguuaguaucgcccccugugugcuugaaacuauccucuacaacaguaaggccuucuggacucucuccugaaggaggugacgggaacucucgcuuaugcccauggugcuuuguaucuucuuuucaaucagaaaaaucucuaugaacauaccucccuaucagugaauacauuuguguuggguguccauguuugccgauacauccccaagcuacuuaaagcccauaaucuucuccuaacccuugaauuuucucagaggugguuucuuuucuucugaaguuuccuuuugcuaguucuucaucuggguguccucuauacgcucacaaguauguugcuccauugcaguuuuaugguuaccauuggagauggugacauauuagccaaaauaucaccagccaacaugugucuggauuucuuagaagcuacguaauuccugucugcuugcaugccaccaguuagaaccugcuaucucagcuguggcucucugggggaaaggcuagaacuccgauguucaguuuuaguuuguugcccagugaaggagucugcaacuguuuuccacuguccccaaacucaucccagucuggcccccuagaaagacacagcuugcugagucugcagcuguuccuauccaucggucuuggggaacuuguaucucuaaauuaccaucuaugcaugcauugaucaaugucccuucuuccuccuagggaagaaagccaaaugugauagcucccaguuucagugcacaaauggccgcugcauuacccugcuguggaaaugugauggagaugaagacugugcggauggcagcgacgagaagaacugugguaagucuuuggcagucuuguucgucaccaagcuuuaggucuaguuuggacuuaugcaucugacuuaaugugcacauguucuucuagccucugcaaauauauugagauucuguaaguaaaacucacuggaguaugaccgugaaucagaguccaaugaaucuagacuggucuagaggaauagaauugaauacuugacaugaggaaaucaccuugaauauagaauguugacuaccaagagggauuucuuucaaaugacgagaucugauuuaucauaccucagaaaaaugugcugcuggaaacugagaaaggaaagagaggaccagacauagaagcaggcagaagacugcauaaaguaacuuuauaaauacgcaaaugggggaauuugauggagggaugacuuagugguuaagacugucuacagcuuuuucagaaggccugaguucauuuccuaccacccagauuggacagcucauaaucucccugcuuuaggggaucugacacccuuauuugacauccaugggcauccccuguguauccacgugaggacacacauaugguauacaauuaugcagaaaugcacacguaugcauauaaacaaaauaaauacaucuuuaaauucacaaauggcucugauccaagaauguagaaagcucuggacauuacaacauccccuaacauuccagagguuaauuaacugcuauaaaaaugacaagacaacaacaggcaucaaagaucagaaaaagauucuacuuguuuguuuguuuguuuacaauacuugcuucuacaaaaccaugaggcagaguagaaacuauuccccuucacaaacgaaugugacuauaacagcauaccauugaucagaaccuaccaaaaaggucauggugagaaaggccugugugcauuggccccauaaccucaugccauaaagaauaacugagaacuguaugucagcaucacauggaccuggauauuuuguugaaguuuacuuauuuacucuguucugugauggaaaaaaaaaucccagcacaguguugcaagggaagugugaccauugucguuugccuuuugagagauggugcagacaaugcuggaggaacauguguauuccagcacguggggaucagaagaaaaauaaaggccaugugggguuuuauugacugucuuguugguuauuccuucagcgcuucuuuauuuaucagcauuaaauugucacggacauuauccacucucaaauugaccauaguaguugucaggugccaaaaugagcccucuccaaaauugcagccauguaccuaccggucaaagguuacauggggaaguuggaagguggcuucagaaguuuuaaguaaguguguaguuuuugcauuucagacacacauucuuaucccuucccuguuuaccucccaggagccagcaacaaagcugcagacagauguguuuaauuuaucccaccucaagagaucuugaaaugucaaggcagcaagaccccgggugcuucugugccagugccagcucugaaaguccauucuacagcuggggaaacuuguccccagucucaagaccaaggcuaguucuccugugcuauccuucuccauugugggcuuuuaauguaaagauuucacucugcaccgcagaacaccgaguuuccugcuacuucuagguuguuuaaagucuauaguucucucaacucaucucucacuaaggggacuuucagcuguuuuaugguuguaaggugugaagcuaccaaaaagucauguauugagcaaaggacaucuuacaccuauuuuuaugcuucccauuauaggagguuuuaucaucuagcucaccagagacacccgggucaucauaggaacagugacuggacuuuuuuuuaaguccuuucugcaugaguacucucaaccagccacaugguagaggauuugggugguggaaauugguaaaugaacagcgaaucaagaucucuugcgguggcauaaauuaaauauaucaauagguagauuuguuguugcuggcucccaggagggaaacaggaaagggguaagcauuaucaaaagcagccugaaaugugugucuggaauggaaaaacuacacccuuacuuaaaacuucugaagccuccuuccaacuuccccauguaaccuuugacgcgacuguaguugcgguuuucgcgaggauccuuuuugcacuugacagcuacuacgaucaguuugaguguggauuucuuaugccacuugcuucugcgacuucccagaguauguauccaauggcuuuccuccccuguggaacgcuuucuaucugcaugucaguauuaauuugaaggcuuuucuuugccccuacaguguaugcucagaauugcgaaagaugaucucuaugaagauguguccauauuuaucuuugcucuaacucuuuguugcacaguugaucuuucauaucaugacauuuucuacuugcaaaaucaucugcuuucuuuauggccaguuacccuguuuucacuuuugcaacuaacagagcugaccacagguugaauuguagcaucaagccccauagccuggccuugguuuccauaugggcccaggagaacacaggccuuguauaguauuugcuguguuaacguuguauuaugauuuuaaaaaugggucaauuuaugaguuggcauggcuuugcaugguuccuuagcuacguucaaggauaugaauaagcccuuaggauucaucauaauuuaccagcccaugcugaguguuauaaagugacugucuuccaaguguauaggcuuaacaagaaaggcauaagaacaagccauagccuucaaggccucuacccagcuuaaaccacuugugcccagugaucucuuagaaauuugcaaaguauuguaggcuuugacugauuuacaaacacaaaaaaaaaaaugaugagagggguuuuuaaaauggacuuuugaguagaaauuauagacacauagggauggaggaaucuagucuaaaaagacaaccacaguauguugguaucucaucuagcuacuuuggcaaaacucuuccagauugugggacuccuucguggguacggugaucaaacugccugcuuuguuuauauuuauuuuccuagucuaauuaauugguggcaaguuguagcguaacucuaagucucuaguaguagaauugauauuuugccuuaggcuauuugaugggagcugugaauuaugggacuuaguccuggcagcuccagugacuuuuaguugguugauguuaaaccaaacuuuggcugaaagccuaaaaucucuuugaauuccaaguccuaccacuuguuacaaguguuauaauuggcuuaagcuugucuggugugugaguuccucuaccucaguagaccagcaagcguggcaauauccaguucuagagcauaccucugcauugugacaauugucacugaagcagccuugguuuucacugcugggacacaaauacuauagguaaagaggcuuaaaugauagaaauuugauuuuaggauucuggguguuaggaagacccaaaacaaagagacaaauagagugucugauaaaagcccucuuuucugaaaugcagaaggcuguuuucuuuccauguccucccaugguaggagagaaaggagaaggagagaugggaggguggcaaacaagcacucauguuucuaauaagggcaccgaucccauuggagaagguucuagccucgccucccucagguccucccuccuacaacagagcuguagggauuucaagaugugaagauuaugaagacacacauacuucauaacaaacaguuauccuaggauccaguaggaaaucuuuucuaugguuugucucuucuggaguucacguugaagucugauuuuugauaguauuguguugagagaugguaggguacuuaggaagugauuaggucagcgagagagaauaaauccuuuuucccugacccugauuaaucacuaagagagucgccuaggaagcaagccacacuccaaagcaagcagguguugguggaaugcucucaggauucccagcucagaaccuugaguugaaauaaguuucuuuccuuuauaaauuguccacucucaaauguucuguuauagggacagaaaauggucuuggaggaaaaacaccucagagugugugaaugcguuggaagaaauccauggugcuaacauuguacacagaugagaucauuuuaagaugaccccugggucauaagacaauggacaaccuuugucuuuccuugacuuucucauccucugagucucucuaaugaauaacucccuccucugaaaccuaugaagaaaagaugagcucccuagagcucagcccuagagaugccaacaauuugaauaucagucagcugauucagcauuguuuuuaaagggaaacauacuuaaauaugguuuuuaccuuaaucagaaaacugaggucuggggcaaaugauauuaauucuaacucugagaauaaacguuuauaguaaagaagacgugugcugagucugacuucgugugcaaaaacggccaguguguuccuaacagauggcagugugacggggauccugauugcgaagacgguucugaugaaagcccugaacagugccgugagugugccuugacuugcuuuggacuagaccuccuuugugcuguucugucuccguucuaagugaugcuuuaucgauugcuugacauucauuuuucuuugccugccugaaacuugaggccaacugacuugaaggucauuccagcuauuaacaguuacucccucuccuuuaaagacugcucucccuagucuaacaagacugacauucucuuggguagcuuccucauugaauacuuaagacugaagccagcagauucaauuaagaacuccuugacuaggugcauagaucucaaaugucugacaggaacuggauagaugguuucccugauccuggaaguaaaaucgagaugugaagguuuccuaagagacacacauaagcuuugaaacaaccagauuuuuuauacuacgaaaauaugcuauuauuaaaacaggaagaugauuaguaauaggauaauuugguuuuuuuuuaaacaaauguguaaccaaaagcaggggccauagaguuuguuacugaguaagaaaaacuucaugaagguacaaauaauuucucuucucauaggcugauauucaagagcaaguuucaaagccccagagaaagguguguuggaaucacacugggaucauuuggaggcuaagaugagggcaagucugaugauucacugcaguagaggccugcucacacagaauaaauaggauugacauaauccaaguuuagguuuaggguaugauuaugaaaauaccuaagguuggacuuucauugucuagcaaagaagugaacuguuuugucaaugaguuaggguccuagacagaaucuucagccccauguuucaguggugaaugacaugguaaaaaucaauagucaaggcauaucccugcuuuauggauacaaugaaagaugugaaaaggggacuuaggaaggaaacuguuccauaguagguguccuagagguaacgcaucugaccuuuaauggaaucaggauuaggugacaauaucugguaugcccacugauauccaaacauaaguaagggacuaggaguaggcuaacaaaucaacuuaaccgugccaaguaaaacaaaagccagaacuaagcgugcggcagaaccuugaaagaguaacccagucaagguucucagguacgcugccagguggccuugcuuggcguagcuucuaaggacggagcuggcgaaggaucugccuggcuuccacuacccagugugccuguguaccugaccacugagccccagguguugcacuuccaggcagcacgggagcagcaacuuugcacugaccaguuuggaggcucuuuugagacuguaugucaucaacagauaugagaacaugccgcauaaaugaaaucagcuguggcgcccguucuacucaguguauccccguguccuggagaugcgauggugaaaaugauugugacaauggagaagaugaagaaaacugugguaagaagaccagugugcaguggcauaucccagagacccuuuuccuaaagaaaggcaggcaagggaugcuaacuuaagccugaagacccagugccgcugacccacuuugcaguggcuuugcugucugcucaauauuuguccuuccuaaccaccauaaaacugugaaaggccuuuuccugcugauuggccauugccugguaugucuuccaggcagauagaagcaaucagagaagucaucuuggugcuuacauucagcauaguucagcauaguacauuuagcacagccuaguaagguugcagcgaugugggcuuuugucuuuuaugacaguaacucaugggccuuucuuacaguggcucaauaaaacuagaaagugaugggaccaacagacacauuccuagguuuaguuagauuagcuucuuggaauaagguacaugaguaugagacaaacauuuccaccaacuggaaucuauggcuaaguuagcugagaaacaugaccuaucauguugccagcaaauacaaagccuaccugaccuuuguguucuauuacgaugccuaucucugaaugcuagugcuguuuccuauucuuucaugcuuauauucuuggaaagucuagaaucaaguguuccauguuaaaggcgaggcccuggagaaaaucugcggguuaaauaaacaugacccugacuucuuucaaacuacuaccccuuuaagacccccccccuauaaccugaguuugaugaguuuaaugaggacaggcugcaguaguauccaagggagcucaggguccuugcaggucaaacacuagucuggcagguucaagucauuuugugauuguaauaccacugcaccuaguccaaggaguuucacguucagucacagaccugagcuucauacuuugccauggugagcccuggagcugccauacauuuucccucgaaaaucuacacuuugcuucccaagagaguuguggucuccuguccaauuaccaccaaauuauaaccuugguauguuuggcaggaauuuaaaucaaaaucuaaacuggcuacugugaauaccuugucaucaauagcaugcgggguugcuaggcuaugauucuaguccuagcaggaacauuuccuaaaaauaaaaaauaaaaauuauuaaguugguauuccuaauguuuauuuaaaagacucaaaaggaaggaaccauguagaguguucuuugguuuguuucuuuuuggagagugccuuauuuuccauuauaccuugcccauauagcugauguauauucucagcuagugauaugacuucagcugacaugcaauagguuggucuagguauaaacgcugccuuccaaaaugaaauacccaaggccagcuuaagcuuuugaacacugucccuuuaagugucaguugugggucucaucucgaauuaguuucgagccuucuacuguuuucuugguccuuuauuucugcucuuacacauaguauggcugcaucuuauuuuauacugugaaacuguuuugucauauuucagaaacucguucucaauauaacagcacuguagcuuuacaauuagaaagcuaaaguuacucaucgaagaugaauauauuugauuuggugaugagaggcuuguauguugucuuuuuguuuguauguuuguuuuuuuauaagugcugauguacuuucaaugggcauccucccucuaacaggcaacauaacauguagugcagaugaguucacuugcuccaguggccgcugcgucuccagaaacuuugugugcaauggccaggaugacugugacgauggcagugaugagcuggacugugcuccaccaaccugcggagcccacgaguuccagugcagcaccucuuccugcauuccccucagcugggugugugaugaugacgcagacuguucagaccaaucagacgagucucuugagcaguguggccgucagccugugauacauaccaaauguccuaccagugagauccaguguggcucuggcgagugcauucacaaaaaauggcggugugacggagacccugacugcaaggacggcagcgaugaggucaacugccguaaguaacuuuccaguucaauuccaugcgccaaccggaagccauuuggcugacuucauuccaucauuguuaccuucuuucguagcuucucgaaccugccgaccugaccaguuugaaugugaagaugguagcuguauccacggcagcaggcaaugcaauggcauccgagacuguguugauggcucugaugaagucaacugcaaaaacggugagguucuuucuccauuguguuugguuaggcuauuggcuacuccugucagaacagcaguggaacuuuucuccuguguuugaauuuauagucaaucagugccugggcccuggaaaguucaagugcagaagcggggaaugcauagacaugagcaaaguaugugaccaggaacaagacugcagagacuggagugacgagccccugaaggaaugccguaagugagagggaggcuugcucggggccagagcugagagguuccauucagcccuaaugcuguuuuggacacagcuuaguucucuguugaacucagaaugagcuaauuuuuaauaguuaagcuugaagauaaaguauuucaaaguggaauuuuagcccaugacaaacuaacucaggguugagaaaccccuuaagauagcuaaaagucauagcaaaacuugaguaaauccuuaauaacuaacuaccauccagccugaaauguauaucucccaaacacauaauaaaaucuuugaaaggccaucaccaauagccggagacugaaugugaauaagacaacuaucaauuaagaauaagaugucgccaggcggugguggugcaugccuuuaaucccagcacuugggaggcagaggcaggcggauuucugaguucgaggccagccuggucuacagagugaguuccaggacagccagggcuauacagagaaacucugucucaaaaaacaaaacgaacaaacaaacaaacaaaagcaaaacaaaagaauaagaugucauacuaauuuggacucuggguuuauaaaacagaaaacaaaaugaccacuaggaaauugggagggagauguuugugcagcaucuucagagaguuggguggagugucauguuggauaugaucaaaauacauuguaucuguauguggaagucucaaagaauaaaucuaaaacauuguauucaaagcaaauaaauaagcuaucagaugacucugcuacccuuuuauuccagauaucaacgaaugccuggucaauaaugguggcuguucccauaucugcaaagaccuaguuauagguuaugagugugauugugcagcuggguuugaacugauagauaggaaaaccuguggaggugaguugaagcaaagagccuggccccuggcggacacgggaaagggcaacauacaucuagugaggcauaggaagaacaagacuaauucuaauuucccuccuagauauugaugaaugccaaaacccggggaucugcagucaaauuuguaucaacuuaaaaggcgguuacaagugugaauguagucguggcuaucaaauggaucuugccacuggcgugugcaaggcaguagguaaauagacuugggcugguguugcucugguaccuuuuugaguuagugauucuaaaagguacaguuggugacugcagcagucaaccuacacauaaagucacaccccagagcaaugcuauuaaacucugagugcagcaggauagcugaaaauaaaccaucuucccacacaucugccuugguccuuccuuuugcauaggauacugugaauagucaccguaguuucuuccuuucugcuucuaaaacugagcacaauucaaacaaguaacuuguuuaucagccacccuacuuucggaugcuguaaccccaagacugccuuccuaaacaggguggaaauacuugcagguccuaggggaggggaggggugccuggaaauccaggcuggauacuacugagauguucagcaguaucuuuacaagugguccucuguggagaggagaugacuuagaggaucuugccuucgagcaaaacuaaaucaaccuggcuuaugucuugcaggcaaagagccgagucugaucuucacuaaucgaagagacaucaggaagauuggccuagagagaaaggaauacauccaacuuguagagcaacuaaggaacacgguggcucucgaugcggacauugcagcucagaagcuguuuugggcugaucucagccagaaggccaucuucagguaacuuccacuugcaccccugaugucugggaaucuacgucacugucauuaggucuguggaaaggauuggaguaugcaugggucuucucuugucugugacuccuaucuaccaucuacuuagcuaggaguuuuaaauucaacacugauuuauuuuuagcuauuaaaugaucaccagaaguuaccuugauaaucauugaucaugauguaaaaggugccuaugccugaauaugacaucagaauuucuccccuuuugugguugugaacugaauugucuugcuacaaacagaaaugauagcagcagcuuucccucaguugacaccguagacccaagaugauggcuacugaguugaauaucucuuuucaaauuuugcugggcuuugagcucguaucuagaguucauauccacaacuagauaagcuaaaguauuacuaauuuuccauccccaagcaacauggcugaauaauuucugugcugagcgaugggguuccuagagucuuuucagaguaaaguccuuaaacauuuuguaagcagaaaaguccauuuugcaggguccaauggugacaacuuuuaaaucucuugugaccuauucuguuucagugccucaauugaugacaagguugguagacauuuuaaaaugaucgacaaugucuauaauccugcagccauugcuguugauuggguguacaagaccaucuacuggacugaugcggcuucuaagacuauuucaguagcuacccuagacggagccaagaggaaguuccuguuuaauucugacuugcgagagccugccuccauagcuguggauccguugucgggguuuguauucuauguuuuccuucacuuagccuuuuugggugcaagccacagagguugagagcuuuucucaaaaagagcucacuugucauaagaauucccagaaacagaauuagcugguucaagacaucaaggacaguguucauugccugccccccuuucuccuuuacaccccccccauuaauucucuuucuucccugaucucaugucucuauuccucucucucucucucucucucucucucucucucucucucucucucucucucucucacacacacacacacacacacauacacacacacacacacacaauuuaucuuuauaaagucuaggaucuauaaauuuguuggcaucuuucagugcuuaauaugaucaccuacaguugccuccauuuuccugaaaauuacuucuucuucuucuucuucuucuucuucuucuucuucuucuucuucuucuucuucuucuucuucuucuucuucuucuucuucuucuucuucuucuucuucucuauggcuaacuaaaauuccauuguguaccugauaaauuugaaugaaaauauucucuugaaaccaaucaugauacauaaugaauguguacuaaugaaaauaaugcugugagugacaaaauauggagccucccugggcagcucuuguaugugaugggcccuccucccagucucacuccuucuuaagccagcuguuugguggcaauagcaaugcuguagauuucauguaauacauaaaccuaaagccauaucugaacccuuuauccacccaacuuucucucucucucucccucucccucucccucucccucucccucucccucucccucucccucucccucucucucucucucucucucucucucucucucucucucucucucucucucuguguguguguguguguguguguguguguuggggggaggguuagaggguggagagacagagagauagauagagagagacacuuuacuggguuaguuagcugugggugcucaaaucuaggacuugcaggaaaugggauuugcauaacccuguccccucaacggcuucuauuuaaaaaugcagauuacgugaaaguucaauugagaggaacagauuuuugucaaaauguuucacugaggcaggcugcuuagauaguugacugcagugaucacaauuggucccuaugaauaucauuagaacauaauccccaagcucuucuuauagagcuuacaguaaaacaucuccuucgugguucugaaagaaugugccuuugaaaaggaaaugguacuuuggacugauaguuacauaucagaucaacgcagaauaacauggcuaugacuuggaaauuauauuauugucuccgauaguccugaggaguagaccuagagccucacacauggugggccaaauguucuaccacugagcugugucuccaacccuugugaauuccgacuguuaaguuuaauucacucaaaacauaauuagagucuuaagcaucagcauuuaucucaagagccucaagcuuaaggguuuccugaucauucuuuaagcuuuuguucuaagguaaaacuuuauuccuucuaauccauuaagacacuucucugauuucacucuucccagcuuuguuuacuggucagacuggggcgagccagcuaaaauagaaaaagcaggaaugaauggauuugauagacguccucuggugacggaggacauccaauggccuaauggaauuacacucgguauguauguccuucccuguuacugacuaguuaacuaccuuuauaauuuuuaaaugcaugcccgauauaaauuugaaaugauucuucuagucccaccuauagcagaaacuuggggagaaaguagcuaaacaaaaauggcagacuuaacaaauuaugggugccagaucacuggcuugucauccaguugaucuaauaugcaacagaaacucagggaaucuuggaucuuuggggcucucauauagaauacuauaggcauuggugccuuugucuuuccugggugguaacuuguaacuguuuccuucugaauuaucuuggaagaaauacaaaauacaagccuccuccucuaauguagcagauucugagucaaugacuuugagagucuuagaaaucccauugacccucacagagggaaugcagacacauuuucuuuuggugacuucacaaguauuuauaguguucucauuaagagcuccugauagagaggaaaccauaaaguagaauagauucuuuggguguuuuaaauagaaaccagagcagcaauagcucaaaucaugucaauucuuuuccugccuagaccuugucaaaagccgccucuacuggcuggauuccaaguugcacaugcucucuaguguggaccugaauggucaagaucguaggauagugcucaagucucuggaguuccuagcucauccucuugcacucaccauauuugagguaagacucgugacucacgucuauguggacacuugugaagcaguucuagagaaaagagcaguagacaacugagaaaccuuuaccuaaagccuggaauacaauagacacuaagugcuuaaagccuggaauguacuagaugcuaaguccacaaagaacuugagucucuugcgccuuguacucaguauuccaaagaaucaugcaguaaccuugcgccauuaaaugucaaguaaaucaugauaaucuuagcuugugauuugugccagucuugggucuacaugcuaauuguaggguucuguuuuaggaucgcgucuacuggauagauggagaaaaugaagcaguguacggugccaauaaauucacugggucagagcuggccacucuagugaauaaucucaaugaugcccaagacaucauugucuaccaugaacucguccagccgucagguaacauggaggugcccacucccuaaagaccauccuaaaagaguauuaugauccucaacuuacuacuuacuggcuccuuagcaauucaacucacuuuaaaauuggaaccuuuguccucuugaacccuaggcccaacucaacacuugaugccugauauuuccuuucagccaucuuaaagaaauggcuugagagucagcucuuagcuccuucuaaccccuaguggcauagcuuucaucuacaucuuuugggucuuccuugcugcaccuguuguaccaguuuccaugguaaccuucaggccacagauacuccucaggauuaguuuucuagguuugcuggagcaaaauaacacaaauuggaugccuuaaacaacagaaauuugcugucccacagucuggaaacuaagaguauaaagucaaggaguuggcaauuugguuccuuuuggagacuugagggaaggcucuaucccucucuucuuuacuagaagauggccauuuccuuacaguaucuguucacaucuccuuuugguacauguuuguacccauaguucaucuucugggaaggauacuggacacuugggguuuagaccuacccuaaugaccucugucaauaccauaucugaaacuaaggccacauucuaagauauugucaguuaggacuucaaugugcaaauuuuauggagggacacagccuaaucuauaacaccuuuucuucaccauaacacaucuuauauaggauuuaacaaguuaucaauuguaucuagucauguuuuucucuugcccagaacaccagcuugucuaucuaaugagacccucacaccucucuggcugaguucccuuacacuuuguaggaguaagucaauauaaagccaggaaauuaugaguugucuccuucuucugagucuuugcucugagcuuuggauaaacaguaugagccaggccuggguucuuucucaccuacucauggaagacauaacucuuucuuagucuacuuccaagaagccucugaaucagguaucuucagaguguauuuccaguacacugagugauacccauucgacaccagugauacccauucuucuuugauguucggcucacuugaagaacugauagaguagacaaacguaagcuccacagagacuacagguaguuaacacuacagugcuuauuuuaaaggacuuuuuuuucccccaacuagguaaaaacuggugugaagacgauauggagaauggaggaugugaauaucucugccugccagcaccacagaucaaugaccacucuccaaaauauaccuguuccugucccaauggguacaaucucgaagaaaauggacgagagugucaaaguaaggcuuucagcguuucaaccacaagcaagacauagaacgagcacugcaagacaccagcuacaacuuaccuggauuuuagagacucuguuguggcuaaccuuuaaaauugauuucagaauaagugauuagguauuacgguuguauagcaggcauucauucuaucugugcuuuggggcucaccugugacccauuucaacaucaguugaguuuagaggggacaaaaauaucaaugugccauaugguaacuuguccccauugcucuauaacacccccugagcuagucaauuuuuagcuaauuaaagucuuccauagagagcuaaaccaguauaugaaggcacuugaguaaggaggccaugguuccaggaugcuacuagccucaguagaugacacaaguuuaaacucacggauagccugaacuugaauuuuaauaguuuguucucagcuuuugauuaaggagcaaacugaacuuccugauuguaagcaaggagcucacauagugaugucuuaauuagcuucauuauguaguaccauaauaagcacuuaguguucuuagaaaauagguacaagacccccuggugugcacugcaugcuagaguaauuuugagaacauuuguggacauuucaggagcuuggggcuuucuugagagggauccauuugucugaauuuuucugaguugucaaauuccacaugcugacagcccugcccaacguuuccuaauuuccggauucuuugcacaaagcuggcuauuucuguccauucagauauguccacuuuaccaguuaauuccgcaguggguugucuuuauuaccuggaauuaaaauaaccuuucagcauuacuucucuggacuacacagucagcaacucaggaaccuuggccuuaaccggguucuugguuuuuauaauccagguacuucaacuccugugacuuacagugagacaaaagauaucaacacaacagacauucuacgaacuaguggacugguuccuggagguauuggguccagcacugcaaacuguuaaucucaacuaacugccgcuuaaauaauuagugcagcuuuuaacuacugguucugucccaacuggcuacuugugccuaaagcccaaagauuuagacccugcacauccuggauuucucuugacuuauuuaaaccuauagguuuaauguaacucaaauaauuauaagccuaaguucuucugauaucuaauuauaauggauacuagaaaucaauauuaaguacaaagguauaaggaucucuaccuaauucguagaugucuaagucuuaauucaaauccuuauagacugauuacuuguauguccuuguagggaucaaugugaccacagcaguaucagaagucaguguucccccaaaagggacuucagcugccugggccauccuuccucucuguaaguaaauuugcuucucauauagauuuuuauggacaauuuuaguucaucuacagccaccuuccaguggucucuuuugcuguccuaacacaugugacacugaauuccauuuaccuccucaccuaccuggcaccuacucuucagugucaucuuucccuugauggugaauauccaucaguuaucuacaagaucuuaugggcuguugaacauguuaaccuugcuuaucccuauuuagaggaaguaucuccaauaaggguuucauuccagucccauuuauuguauauagucauucacaaagaggagagacgcaaauggucaaaugcuuuuugaaugagcuguagaauucaugaagaguaaauuaaaaguaguuaaguauuuucaaacucagagaaaagcaucucuaaagccacugucaagcaggugaauuugaaggcacuuugcuuuacuguccccuucgacugagcuuacugguugaccuaacacaccagaaccacuugacuagcaugccaaaggcuucuguaauuuuuuauguagcuggccuuggguuagggcucaggacucuauacuucccuggguguacuucccccaacuccagugcaaagauucacacaaccacugggcugaauuuauuucaaaacuuugucucaucuauauuccaacuucuaguuguccaagcucccuaaaacauggaacuguuguuaguguuaauucccauagauccauaaacauuagacuccauuuagucaccucugauuuuuuuuuucagugcucuuagugauggcagcaguagguggcuacuugauguggaggaauuggcaacauaaaaacaugaaaagcaugaacuuugacaauccuguguacuugaagaccacugaagaggaccugucgauagacauugguagacacagcgcuucuguaggacacacauacccagcaguaaguauacuuugucuauauucacuggcuugacaucaguugcuuccaaggagacuagaaucacuagcuauggcuaccugggcuggggaggagcauugaaucccagacauuuuauccaaugacugcuuguuaaauacuaaaugucugguccaugagagcagucaguuaauaagcauuucacccacagaggaaggggagguaaguccuaccuggccuuauuuuagaugauagaaaugacauaugaauaguguaugaaccaacaagcuccuuuguaaacuuugauuccuugcauacuaauaccuaaagguaaaucaguguggacacaugagaauuguggauagaggaguugacugaaagucaauagcuugaguaagauucaauuagccaaaaguaauaagugcuuuccuuggagaggugcuccaucccacccagagagacagcuuucuacaagagcaacaacagcaaucgcuuguucuuccacuaaaaacucaaguacauauuuggccuccacuucaggaccaugcugacugaaccaugaugaacaugaacaguguccuugcaugaucucugguggaacagggaguaagguucagugcauaucauauaucuuuucacauuugucuuuaagauuuauaguccguaaacagaaucagucaaaguuuuuuuccaaccaaguagguacaaguuaaauaucccauauuuaaaauacuugguguccaaaguguucagaggggcauggauuuugaaguuuuugcauacauaagaaguuugaacacaaaauccauuuguuuuauauacacuuuacaugacauuuugauguauguucauuuugaccacaaccaauaauauaagguuagauguagaauuuuucuuuuguagugucauggugauacucagaagauuucagacuuggaauccccuuuugaauuuuagauuuucagcuugggguacauaaaaaaaauaauaauguuauguuucugaccuccaacucuuuuggucuuuaaauggccuacucaaaagcaaaguccacuccguagaguaaccgccaagcucaccugaaccuuugucuucucugcagauaucaguuguaagcacagaugaugaucuggcuugaguucugaacaaaucuuggucuaugaggucuacaccaauaacacccuacucuggaaugguaacagagccagcgcugaagucuccuuucuuccucccaucuggaagaacaucaagauaucuuuuuguggaucaaguuugaguacuugaucauuuuuauauuacuuuuguaaauauucuuggccacauucuacuucagcucuggaugugguuaccaaguaucuguaacccuugagccccuagacaguauugccaucucuggccaaauaugcacuuucccuagaaagccauauuccagcaaugaaccuugugcuauagugacucccaccuguacauacauuguauaggccaccuguacauaucccagagaacaaucacuauucuuaagcacuuugaagauauuucuauguaaauuauuguaaacuuuuucaaugguugggacaauggcaauaggauaaaacggguuacuaagaugaaauugccaaaaaaaaaaaaaaauuuguaacuaauuuuguacguaugaaugaaaucuuugaccucugucgagguuugcaaagacugacuucaaacuacuguacguuuuuuucaagugcuaaaaaaaaaauuaaaccaagcagcuuaaccaugguuuugauuauuccucuaagaugagcuucugggaacaguaucaccaaaugucccaaacauuuaagcuagaguuaguucuugauguuguauaccuaagcccauaaucgagcuaguaucuuggaugguauacaaccaagaaccagcuaaacaauuagauacaguuuaauauuuguaccuccaaaucuaucacuuccuuccuucuuuccuuccuuccuuucuucccuugcuggccucaagcuugcaaugcuccugccucagccucucaacuucuagaauuacauggcugcaccacuucacccagccuauguaguuuuauuuuauaaaugacacugucuuccagaauuccuuucuuuaacagauuucuuuuucuuacuuuuuuuccccaugaucuagaaacacaugccaagauucucaugaguuuucuuacuuugucauccauguucuuuuucuauuuguaggucaaagacaagugccuucuauggcaugggaaagggcuuuauucuuauaagagucuggccugucuuaacuagaagacggguaggaaggauacuagguaggcagcguugcugaacaaucuaaguugugguucuuagccugucccaggaacagcagcaugggaggcuaggaacuuaacagaaaugaggauucuugguucucaccccaaaccuacuuaaucagaaaccccaguaauacagaccagaaaacaguuuucacaaauuccucauguacuuugaauauaacauaaaguucgacaaaaucuauucuaauguggcuuuuuauggaggguguaacuguaauguauucaaaauugucagugugguggcaucaaauauguagagauggucuuucuguggagaauuuguggaacuuuaguguggagaacaaagaaggaguuggagaugaaaaagugguacugugucaagggaagauuuuugugaguuuuccaucauguuggccaucacauccugacugaagucucaagauuccuggaagugaaggaagacacaaagcuuaaaacucagaugagaugcucugacuccaucgugaaguggucacugaaaaaaauguugcugguuucuugggaugaaagaacugagccagcaucugaaaaagaucauuucauuuaaaaacaaaaacaaaaaaccuugucucuucuguaaaaauccaacauuagguagaacuugcuguaauuuaaaagucacaaagucauuuauaaaaaaugaagugauuaaauauugaccgaguauuguugaguauugcuagaguagcuaguuaucuggugagacugcuaauugauucaguguaugauaguucacacgggaugagaaccuuggccuuuaucacccaaacaagaacucucuaugagauugguugacgugaguugguugagucucuggagcaucaguuuucaacuucuggaucgcaaccccuuuggggguggguaggucacauaacagauaugcugacuaacagagauugccauuaugauuuauaacaauaucaaauguauaguuaugaacuaguuaugaaauaaucuuaugguugagggucaccacaacaugaggaacuauauuaaagacucguggcauuaggaagguugagaaccacuucucuagggcucaauguauuagauaacucacuaagggguaaaauaugaaauaucaaauccuaaaaaggauauuuauaauuaaaacagccugucaugaggcaacugugaguggaacaucugggaauuugagaaguaucugcaaaguauagaaaaaucaacagauuuguggacccugguaaagaaguucagccaagucucagugaaaaauguuaagaaguugaugcaagcugcaugcuccuuguuaagaugcaggcuuugcauaucaccaggucacuuagaauauucuaacaguuacucugaagaugugucaugauuugugagccuuuggaucuggguaaauagaggacaaaacuaauucuuugaggcuuuaacuugggcacuugccuugauuccuuuuauuauuggaagucagauacccccucuccaaagugagcaggcagguuuuaaacagcuuaacuacugaccaguuauaagacucgcuuuucagucauggauccugcagaaaucugagacccacccauauccuagcuuuuaacugucuucgcuccacccucaaagaugcuacugggcuuccugugcaucgcauugcuaaagagaacugauuuccuagcauucuucccuaguaaaaucuuucccaauagaacaguauguucccuuaaacccaaaugaacaucacgcuacuuucuuuuaccuguggcaaagcaaacaaauuaaaaaaaaaaaaucauacacccuuuugcuuaccuaauuucaagaacaaaacaaacaacaaaaaaaugcuacuccuaguucagauguugugcccuucauuucuaaagccgauguuuugcccucuuuggaaagacugagaacuguggccugauuucguccauauucuagacucuuaagcuugucaaauuccagaaauggaaaaaacucugcaagagagucuugcuuucaaggagaaaggaaaauggcuuugaaaaugagacagucuuuguggguuuugucguugguuuuuguuuguuuacuugguuuucucauguccagcacggaggucuccaguucacaagagcuuccugggaaggauaauaaucauguuuguaggaaucucauucccaucgaccuuuaccgauggagagccaauuguaauucuuuugcccuaaggacuagggacuccuaaguugaggguugugaucagaggucccaucucuuuacagugucacuucaaucuguuuguguuucugagccugguuccuccaagacacaggaaugaaguggggccacagauuuagaauccauuuaaguuucccuguugugugucuguguugacccugggacaagugugagacaggaagaguguggggagucugggcucgguaguaacucugggauauuucaaggauggcuuucuuuuugacugugcuugggagcaaagucagaugggcagcuggguguguguuuagagcucuacgaauugucaauaacacaugcuucucugucccagggguccuagagagggcaaauuacuaagcaucucuguaggauggagaugauaggaauucacugagacaauggcgugauauagcaguggcauccaagagcucagcacagugucuggcaucuggugugcaugggcacauguacugacuaugacugucgguguguguuguuauacaguccaggaacugguaagugcccucaccagcgagcauggcagguagcuucacucagugaguagcaagggcacucagcucugaggaucucaauucauacaggugaaaauccuuaaaggacucuaugauuuaaacucuggagucaaagcuagugugugugucugucuuugcuccugcuaagacauggaaacaaguauuggaaccuccagaguguuuaaauggcuauugaaauuuauaauggcccuucaauucuuacuauaugcuuaauagugugcuaaauaagugcucuucugucuuuuauuagagcuucucagaaacccuaauaggcaaguauuaucuugauuuugcagaugugaaagcuaagaccaugaaccaugugagauuccaaaccaaauaagcuugcugccauggucuagggugagggugcuguccugugcaaauguuaaguuggauaucacacuguauauuugcugagucucuuuuccuauagguuugcagagcaugucugcaguuucucgguuguuauagauuuccuaccuaaccgggaugaugaugcacagaacucuaaagccaguaguguggcaacagaauagcacaguauaacucaguugagacaugacuucaagacucgagacuugguagaauccuuuuacuuggccaucugaguagaaauaggaguagcuuuaagaaaaaggcagauucucuaaaggaauuuggagauaugacaucacuccugagcagagcauauuagaagaaagcaaacugccauacaauaauuuucaguuuccaaggcaaccaaguggagaacacaucacaggagacaggaaauauggcuuguucauagaaugaugcuacugugacuucaaaacugaucucaaguauucuagaaucugcugggacauugggcuguuucucaacuuaugugucuacuuggagagaaaagaaugucuuugaacaaaauggcuaacuuucacaaaacugucuugccucuuuuaaacauuacacuugauacgagaaauauggcuuaagaacacaugaugucucagaaggcccaugcgcacaccagaccgcugucuuaguacugucacuguuguaaaggcacauguuggaacacauccaguccugcugaccuguagauaauuauuuuucucuaaaugaacuguacauuuaucuuaaauaaaaauuuauuuuugagauaacuguug

SEQ ID NO: 9225 - RNA, 2597 nt, Mus musculus
agaaaaacucaaggacaauuuuauuggaguuugcuuuuauugauuuuuaagggugcuuuuaaaaaaucauauuguguguguauuuacaaugguacauguauggaagucagaggauaaguugggcuccagggauuaaauucaugucugucuucaggccuggggcaagcaccuucacuugcugagcuaucuuaacagcaaugugugugugugugugguguauguuguguguguuugagaaaacaaaaagggucagcaagcuagagcucuugacagcuuccaggaagagagcacuggguaagaagaaagcuaaguuuuucaaauuauuagucaagaaaguaggcaggaucaguaacauguagccuagugcauggccagucggggagggaucuucagagaaaacaacuguccagggagugaaggcaauccaguuugggaucgggcuguuauccagagcagggagauauaaaaagggagguggaagaguuggagucagcuguaauuccgaaagcagggucucagagcagagagcaucuguaagcgacugccuugugagagaagcuucggggauauucauaagugcauggcucacugaggagacaagcaugcucccaucuuaacaugcuuuuaaguuuauuauauuucguuaagguuuccagaacauuuccuguccagaugcuugacaggcagaucuggauuaacuggagggucugauauguuuuuguaauuuuauuuucugaucaguuuagaauauauguguucuaagucauacccagcaacagagguacaacuugggucuauuuuuuucaucaucaucaucaacaacaacaacaaccaaacaaaaccugaagaucuuuuuaaaauuaaagugaaacaaaauaauauagccagacuuuaucaggauauuuauaaccuuuccuugauuggucacaauagagcccugcaacuccguuccuucauggaauaucuauggaauuugcuuucauaagccucuuguaacuguauaauauuaaauauugaggggaaguuauaauacauccuucacaugguacuucuaaaaaggaucaacugugguauuuuccacuuucuucaaauagguauugcuggccauuuacaccaacucaagcaacaggcuuuucugccaugaccucccuuuguaaauuuuguauacuuaguagccguuguaaauccucaaggcacaaaaguggcuaggucuuggccucaggagcucuagcaaggguguaaaggcuaaaacagcuguaacugccuuucuagugcuucaaggcaggaaauagccagacccccccccccacacacacaugugcccuugacuucccuaauggucaucuuuuaaaggcuguaauagccauucccagcccaggucucgccguacaagaaaaaaguaaaauaaaaucccagaccacccuggaaaguaaccccccaccccagaauccugauauauuuccccaucccccaauucugcccaguucucuguugcuucucuuccaagcagggcaaccacccuccuuagcuuuucccuccaaauuaaucccuugccugagcuuaguugugcagcaagacuuugugguauuccuuggcuccugacugccaggauaccuuuuggagcagaacugucacagggaaaauuuucuaugagccagagcaaagcuguaacaccugcaucagggaaacuuucccagcagcugaagccuuccccuaacagagccguaacacuuaaagauguguuaccagcgacacaagagacaguguccacagggaauuauagucucuaagcuuauuugcaagcuaucuuaacaaacugacaaguguucucacaacaaagacggaagagaaugaaaggcaggggcaggagucagguauaagccaaggaacgucugaagcaccagaugcugaagauacaugggacguccacucacuccuuggggcuucaaaaagggcccccugcucaaccaacuaacaucugcauuucagaacaguuaggcaguaagguucuguuguuuggcgcgacgugggauccccuggaacugccgccauguaggugcugggaaaugaacccaaguccucuccaagagcagaaaacagcuuagccaucucugcagcccccaagaccaaguuuguuucuauugcuuccucgcuaaaauggaguaauaccuuaaauauauauccuaaaguggaaccgugggggaaaaaaugcaugcccaagaacgggccuacauuaaaaacgccacacacacauuuauggaaagagcuuuucacaauauuugacugugcuccguucuuuacacuuaugguucccgagggaucuaauuuauccggagauucgcagcuagggugggaaauaagggagacauggguguuggcaaacacgauuacaacagaagagacuccgguacagcuuuuacccuccaggcuagacuaacgacgcaaacagacacuaacgagcgagcugucccaacgcuaacccagcuugcagacuucgcugucuuuuaacuccuucaggaccuggguggcccucgcgagaacccgcgucguucccagaaaucugcaggcucaagcgucacuuucccaagccacggacu

SEQ ID NO: 9226 - RNA, 1338 nt, Mus musculus
auccagauuucuggguguucauaauguguuuguuuuaugucuuuucacauugauauucugcauacaaguucuuuguuuaaauugaaagagcuuauuaaaauucauuuuagugcacuuaggaagauacccugcccauuuucccuuuggauauguacagaaauuuuugcuuggguguacauuugugagagugaugagcaaaaaugauguagucacugccacaagaaagauuaaaauuacuauuuuuuaaaccuuucugacauuuaggauuuucuuuucagaucguaguaucugcagucuucuagaauguggaauagccaacuuugaggaucugcuuuaaaaggaacugaaauaaaaagcagagaguaucauuuggggaaucucagcaugguccuugguaccacagugucuagucaaggguaaaaugaugaccucauaguccauagcauaucuguucucucucucucucucucucucucucucucucucucucucucuguguaugugugugugugugugugugugugugugugugugugugugugcgugcgcacaagcacgcaugaauguaugcaugcaugucuaugaguuugugaguucauguacacgccacagcacacauauagagguguggaggucaaagacuucagcugucaguccuaucauuccacuuuguuugaggcaaugucucuucuucaccaucguguaugccaagcuacauggccaacaaacuugagaggaauuuuuucucucacugggucauuaacagcuucccuuuguaugcacagaaagaucuugugucaugaagcugccagguggcccacugaaaagccgcugccguaccacgaucuuggcacucguuucucccuuuaguagggugguccucucaaguuuagcaguagcuuuugccgucucagccucagagagcgaugccugugcuauggagcuccugcugaguuccuugcgugcuccuauggccccuucauacauggagcauugaaaaaguacccaggcaacugaugugaucaucacccaugaucccugcgugucuaacucuucccugcaggagaccccuucugggguaaccacugaugugauagaaaggcagcucacacuccuugucccucugagagaaccuagaccauauuuuccuaccaagcucuugucacccaucggacaaucuuguuuuccucaaauccaggacugcuuagucacuggucucuuacuugcagugcagucuccauguaaggaagaaaaggagaugaaacuugaagcccugaccccuugggagaaucccuuauaccacccuuucaccaggccacaucugagucaggagcugua

SEQ ID NO: 9227 - RNA, 249448 nt, Mus musculus
ccucucucucucuuuugugaguuauagcaaccguugccuugugaaucaagcgccauagucaccguaguccuggcgacuguuacccaucaacaacaacuacuccucuccuccuccuccuccucuuccuccuccuccuccuccccaccaccaccaucuccaucacccaccaacaacaccacaauaauccacagccaaggugaauauucuucggucucucuacaugugugugggagcguguguguccgugcguguguucgugugugcgagcgagcguggcugugcggggucucccuccugacaccggcugcggccgcuugaggggcucggucccgggggcuuguuuacaauggacccgcgcgcggcgggcucgggggugugggcgccgcgcgccugcccgcccggccucggcgcucggggauggagcgggagccggggcugcggggcgagcgggcuaggaagccgccgcuguccgucgcggguguuggagcgucccccccagguccgcgggcgcccaggaggaggggcagguggagagaaggggcucgcuuucucccucucucuuucuuuaauucgcugcuuugcaaagcugccugguggcugcugcuuuccaaaucgaaauagacagcagugagcaggggggguccccaaaaggugcugcgcuguggugguuguuguucacuugcggggccuuguuggggguuuuguuauuuuuauccugguaccucggugaacuuuucccgaagcccgcucccuucguuucggccccucugugccugcugcugaacggacugcacuuauuugaccaucacuggccucacgggauucuuuuuuuuuuuuuuucuuuuaaaacuguauuuuucuuugugcugcaaacagucuuaauauccauucagcagucuucuccccccuuccccccauuugcacacacauugaaacuagggggccucugcugcucuugagagauuuuuuuuuuaagucuguuucucuguuucucuucucuccucuuuccucucuugucucuccucugucuccucucccucuccucucucucucuccccccuccccuuuucggguuugugugugugugugugugugugugugugugugcuugugauuuaaaccggaugcagggcaucugugcuacuuugguuaguggcuacugacagcgcuuuauccuucauguggagaugggagggguaguccugagguucuguuucacuuugaugcaccucccuccccacaggagaguguuaacaauuuucauugugguuuagacuuugucugugaugaacaggaaaaggauauaaggaagcuuugugagaacucaguucacaacgcuauuugugacaguuaugguacuuugagaguuuuuuuuuuuuuuuuuuuccuucucccaucuucaucucuauuccuuucccuuggagaguugaaauugaagucaaguuguucauaaagaauguaugaagcuucucaacuugaaacguguguauauuucacuuucuuuguggcuguuaagaucuaggcauguguguacuuaacauauucuuuuuuguugacuuuuugguuuucuuuggacaaugauuuaaaccuguucagaagaaaaaaaaaacuuccuuuuaaaguguuucuuuagaggaaauaguugcccuuguagaucugaauacuuaccaguuaugaaguaguaucgucuugauuagaaccuggcuuugcagauccuuaauuugcucauuuucagcauaacaauuaauagguuaucagaaaaaaauugaugaugauugugagcuaaaacaaauagauuguacuauuauaguggcacauugaaauuuccaauucauauuuuaaagugcuuauuuaaauaaucuuuccaacagcaaacauuuauugauuuaacugacagagcagccugugaauaaugugacaguauuaauuauucuugagauugucaauggagagguuggguaauuauaaugccauuaaggcuaauauuuuguaaaacaaguaagaguugggggauugggaaaaaccuuacuuuucaauucauuuucgugugauuguuauuuuaaaugaagcugagauuugauucugaaagaagucuguuuggaucucucagcauucuuuauauuuauucauccauucccaaccugucuuugcaauuuucaaauacuaacuuuuauuuuuucuuuucuucucauuuucuuuuuucuuuucaucuuucuuuucuuuuucuucuuuuccucuuuuuuguucagaugagugucaaacgccugaacacuuuucgaugguaaagcuccugggucugaaguuaaaaggaguuuugcugucuugggacaguuuuagaucuuaauggcauucacauauguuucagcugaguagauuguauauauuaaaaugucuuagauuaauauuuuauuugucguguccaagaguguuuaagagucauuucacucaucaagcauguguuuaauuuaguuuuuuccauucacaaguuaauuugagagcaaauguggcauugcauuauguuaaguagccuguccauuuaaagcaaaucuuuguguuuuaagaguugauauuagagaugcuuuaaaauaaaauaguuuaguggauugauuaacuuagaguuauaacaauuuaucuuuaaaauuaaauacaaauuuaaguaccauuuaguucgacuuuuuuuuucugugcuauuuuuccuaggagggacuguacuaugcauugacauucuuuguuuucaguguuuuagacuaacagaaaucugugaacauaaucaugcuuugaaauuaaacaugugaaauaauguuuugaguagcugaauauuuguagcucagaguaugccaugaugccuaucucugucuuuuuaaauuauauccaguguacaaaauucacauauaugauugucuauuacacaauucuauuaaacuguauagagaauagguauaguaaauuuauauguguauaagaaauuaaugcauuccuaguagcucuccauuauuucacagugcucccauggugugagagucuuaugccuaaugucuaaaauauugcauuauuuauccaauauucaaauaaucuuguauccuguggagauacucacagguuuauagcuuauaagugaaauagugagaaaucuuuuuuaaaaacuuacaaguuaauugaggcacuuuuuuuuuagcaauugaaaagcaaaaaaauucagguugcacauuaagcuuagaaggauggauaaugauaucagauaugugggaagaguuaauuuuuuaccuaaauagucuaguaguaugacuuagugauccuuuuagugagacuauauuauaagaaacaagaauaagaaauacaucaacuuuuaaauuaugaaguuugcuaaccuguuuuuauguugagcguuugguuaaguguccucuauucauuugcaguuacauuaaaaauaguuagcccuacugaaucauuugccuuaacucuuuaauucuucugguauauauucccaguugucaucacaaaauagaauuuaaauucuuuucuguucacagaugcauaguguucccuuauuuuggaaaaccaagauuaaguggauuugacuaaauuuagcuuguuagagacagguggcugcuugaaacaggugucagucucccuuuuccugcauugucuuggaacuugcagaaguucacagagcugucuaaagcagguggcauuuuacagaguuaguuguaucauccuuuuauuauuuucacaggaagaggguucuuuuuacaugcaaaaguugaacauugcuagccuuugaagugcucuauguuuuaaccuaaaucacuaguucaaacuguauaaaugauagauucauuugcuaaacaccuaucuauccauucuuauaaauaaugccaaacugccuuugaauucagaaaaaguauagcagcauaacaguuuacacacacacacacacacacacacacacacacagguucuauuuugugaugacaacugggaaacagguguguguguguguguguguguguguguaugcggguuuaaauaaaaugaaauuuagcuuacauaauaaauaauauauuaaacuuugucauuccauaccucaaggauuuuuuuauagcauuaucauguuauaauuggaaaaaugaauuauuugcauuuuaaaacugaaacaaauuuuucugacauucaguugcuauaaaauagugauauuuuaaagugaaaauuguuuuuguuuauacauguuaaauauaugaacuggaauaaauucagaaagaaucacccuauugauuucuaagguuuauuuuugacuuaaaauuuuaucccuuuauuugugggacuuuuauauaucuuauaauagauacaccagagggugcugugcuguuugcaauguaagauuauuuucacuaaaacgugaauugauuggaacuguuacguaaagaaaauuuuaguuauuuauugcauauaagcaucucaguuacuucuguaaaguuuaacauuuaauauacugcuugccuugguaguuuuuuugggaaagucugucuauauagagagaauauguguaauaauauguaacaaaucagauccaguaaugaacuauagaaccgaucccugagaacauagccuugguccagucuaauguuagcacuuuguuguauacauuggucaaaugaagauauuucacuuuuaugcucuggaacugugguugcugggagcugaaccuguguccuuugcaagagcuacaaauggucuuaacgcugagcucucucucccacccugugacucuuuuucaguuccauuuuccaucuuuugagugguuucuuccuguuuaaauauaauuuuaaguagcaaaugcucugacaaauuuuaaaacuuaaguauuuucuucaaggaugcuugggaaaggauagguucaguguaaaaacuuaagucuagguaaugauacacuauucucccaacucagcuacaaugguuaauuguucuaguuuugaaaaguaacuauaagcugaaacaauuuguaugcaggaacaccuugaucccagaacuucaaaagagaguagcacccccccccccacaaacacauaugggucucacuacaauaguuaagucauuuuucuuuaaaagauaaaauucuauguaguuugucauuuuaugccacugagguuuuaauguauuuguggauguauuaaaaugcuuuguacuugaagucuagauuucacaucaaaguauauguagugaaaguugagaaaguaauuuguauuagaguauuaauaagugaaugggacacccuguuacaggcuaaguguauguaccggcuuuagucagaguucaguuaaucuuauuaacugugugacuguggacguuagcugcuuucagugagacucaguuuucucaucugaauagucaagacucaaucugccuaucuucugacaucuaugcaacuucaaagagauaaauucauguacuguauauugugaagucuuuagaaugcauguuuaaugccuguuggguguuucaaugaggaauuguugagaauucucuacacgauguuuccaaaauaguuuuuuuccaaaaaaauuuccuacuuuuguuacuuaagaaucauuuugauaugaccaucuagccaucccuuuguuauaggacuuaaguuuuguaauauuucccccuaaucugcugucauuaaauauuuaaucucuuuuacucauuaaaaaaaucaaaaccaagauaucaacagaggcuuggauuaccauuugauaaucaguuuuuuuuuaaaccauccuaaugcuauuccaaagcuaugucuuaguuuuacaccaugggcuuauaaugggcuccuuuuacuggguuuacaugacuuuucuggccuagggauuuuuguauuaagaaauaauguuguaacauuucauuaucuccuauucuuccauuguugguuucauuguuccauuuauaucuucucuucacaugcuacacaugaauguauuugaaaacauuuggagcucuuuuugccaacuuaaugcuacauaccaucuuuaaauguaaugacaguaaauaauagacuguuuuaaaacaugaauucauuagcaguuauucuacaauuuuauaucuuacugcucagcacccaaggagaguaagacuaccacugauacacuuauuuggcauugaugaauaauuugcuaacaguacuuaaguuguaacuuuguaauauuacccagguaacuuaaaauaugaagucuuacacaagaaaaucccaucuuuugaucuuuuuagauguuaaaaaguuucaaauaacauuuucaaguuggcuguccuauguagcauuguuguuugauaguuuugacuaauaaagugauuucucauuuuagagugauuuaguuauaaucuuaaauaaaaacaugauuuauuucuuuucuguguaguccaggccagcccccaauucaugacucucuugccucaguuuccuggauguggggaugguacuugugccuugccacugugcucaguucagaugugauagauuuuucaaaggaaccuuggaagaaagcuaggaagugugacuuaaaugaaaaauggauauacuauaucacucucaaacauuauuauuuucuugacaauuucuaucuucuugaacagaaauguaacuuuauuguauuagugauguaauuugagugguuuuauuuaaaagauuucuuccuugguauguauuggccucuggcaaaguacuuaaggguuaaaugucuagaccaauccaaaauuaauguguuugcacaguuucccauaccuauggugacucuuaacucaaguauucuuuuauagaaggaguuauggccagucaguacugccugcuguuauuuuauaguauuuggucagggauucccaaggguucuuauauuucccuuaggcaaaaauauaaguaugggauuaguagaagcuuaaccaguaacauuaaaacagugaagcaaagaggccugaguaaaagugagaggaaacagauacguccagcaaugauagagaagaaaggaaacaauguuacuagacugggaagcaaaguguggccagaggagugugaagaggaugacaaagguguccccaguuugcugucugaaacuguaagcuaguaacauaaaauguguggggcucaguuucuccaucugucagauaaacagugagacaaugugaucuugcaaacuuuuugcaaccuaugaauccauggcaagauuaaccugggaagucagaggcgugcuacugacacagagcuaggaacuagucugugauuuaucugugguuucaaaaaucucacauucuacuuacuuguaguuucuucugaggagagcaacaaagaaaaccucaggcccagugguagcuuaauaacuaugccuaugacaaggucucaaaguucucccauuuuggugguuucuuuagagacugguggccaagugaucugauuuccucacccacauaggagugagcugagccucacagcuugagcuccugcuggaaccagcuucucuaaguaugugugccagacaagugucugacaguuggggcuccuguugcucaccagugagauauuuaaaacaggacauaauuuucccaguguguggauagacagaggacagggugggaggguguggggagaggcaggcgcuaagggaggaaacaguuuuauacuuaggaaagaacauauauuuugcuguaucacaacucucaccagcuuaacagagaagugugugaaagauaaagagauugccauucuuauaauuuaaaaguuauuuugaaugauuuuucaauugguuaauaaaagcauauuuaaguuucuggacuucauuuggauuuguauguuuaauagcauauguguauauuuuaguauaaccauuauuucuaaagugacuuuuugcacucugaguuaguacaguccucccucccucccucccucccucccucccucccucccucccucccucccucccucccucccucccucccucccuuccuuccuuccuuccuugugccauaucaguucagagacucuuugcuuguuaaguuucuucaagcuguguucaauggcauauaccugcaaucuaaggauccaggaaguugaggcaggaggacugaaaguuggaggauaagguugcaaagggaaccugucuagaaaaaaauuuuuccuuucauacuguagcuguggaggaaauagaacgggucuugaagagggggagcaagaaccguacacauuuaaauuuucuguuccuguuaaguaccaguaacuuacauacuucucaugguuuacugcauugugaaauccuaguggguauagauguguagggacacagacucuagaaggcgggagugagaagaagcuaaagcacuaugauuucuccugcaucuuguuccuuuucugcugugugguuguacaguguacauauacuuccuuaaggauagauauuuuauuacuuuacuaaaauguucauuguauuuuaguaaauuauuuuauuuaucuucaagacaauauaugugaauuuuucuagucauuaguauauuacuagauuaaaaagauucuuuuucaagagucagcauugugcuuuaggaauguucauaugugaaucucuuccccucccucuuuucccuccccucccucccuuucccuuccucuccucccucuuuccccucccucuuuucccuccccuccaucccuuuuuccccuccccuccuucccuucccccucccccucccucccucucucccucccucccucccucccucccccuuugucugucucuuugucacugucucucucugucucucugucucucugucugucugucugucugucugucugucugugucucucuuucuuuuuuuuucugcaagccagguuagcauugaacucuugaaucugcucccaaguguugggauuaaagguguguaucauuacaccugguuugaagugauuucucaauuaucuguuuauacuuugcuuuauauagaugaauguauggauauauuuuugacaccaaaaccuagcauuauccuuugcuuuuauuguccugacauuuuaaagagccaaauugucuaacaccagacuuuuacuuauuagcuucugauuauauucgauaaaaaucuugacagugaguuuugauaaagugccauccuuaaggucauuaauuaaaaacaaacuauuauacuagcaaucugaauaucuccuuuacaacuugaaauguacuuaaagcauguauuuuaauguuguauggagaaaacugaacauaaaaauuuaguauaugaaaaaugaaauaaauuuugauuuuugugguuauuuugcaguuucuaaagggcauuuaaaauguuuuguuucaaaagauuacacaguugaggugcuuguaaaaauaacguuugcuuagauacucuauuuuauguguguguguguguguguauuuuguguacauauuuagaaaguuauuuuaauuaacguuuuguugagugcuguagaaugugaucaauauuguuuucucuucacugucuucugcauuaucuucaucuuggaggccacacuaggaaccuugagccuuucaccucagugcuguguucuugagacagcgaaauugggggaaauguuugauuaaggucaucaggugacuugugugugagguugguaacauuuuuaauagugcuucacauugugauaacuuguagaaacuacuuuagcugugggcuacauguggcagaguugaucaaaggcaaaaauuacgguucauuucaguuaaaauaggguucaacaugacaucgauggauuaauauuccaccauucugugcuucagaaguuugcugaguuuuagaacuuucgaaauuuuaaauaauauugaaugaguagcuaugauagauguggcuuuaucucugagcaaaggccauucacuuuccaagucaagugugauucuuuugucuuugaauuuggaaagagaauacuuugauugcuuucgguuugcaugaacauuuaauuuuguuuggcauuagaaggagugcaagugaucauggaguggagaugaugaucagggucacucaagagaggauguguuugauccugacaccugauucaccuuuaguccuacaucccuguauagcaguaaauuaaggugucuuuguacauaauauaagcuuuuucauaaaguugugcuuugaucaguuuccauugaugccuagaauuuagcuuccaaaacacacuauaugugaacuuugaaaguucuaauuuaccuuugguuuaacuagaugcccauagguggcaccccaugcccagaacaacacuuuggucugaaggaaugguaucaaaaugauacuaagugggagugggauuauguaauuggaaaaacuaaaauacagacagugcuuauuacauagaggaaaagagguguuauuugauuacauaugauucccaguaugacauguacaacaaacauaauaaugccucuaguauuugauuguaaagcauucuaccagaauguaaggcauauuuggauauuucagcauauagguuuuuaauguuauaucaguuguuuagcuuuaauaaaggauauguauaagugaguauuuggucccauuacuauuuuguuuaguuuaggcauugugaacuggcucagcuuagauuucuauuagaauuuuaagacuuaguuugaaaauaaaauacaaaguggaauguuaaagucaagauugcauuuuccuauuuaugggaaucuaguuuuaauguuucuaauuauagaaggcuaaaacugaugagugauacuuggacauaagaaaugauaggagagaaugaaaaauggaugaaauuaguaggaaaauuauaauuaaagauuaaauaagguuagaugaacaaaucagugagacuaguaaaauaaucacuugaaugagguuaucuguggauuugaaccagcagaagaaggucaggaaaggacuauuuagguuuuuaggcuuuuuuuuuuuuuuuuuuaccacauuuaaaagguguuuuuuuuuuuuuuccuuccccacaaauauuuacaauaagacuuugguaccuugauuuuuguuguuguuguuguauaaaauuugacauuucuggaauuuauauauagaaaaggaucaacuuaagauguugcaucaacauuuuauuuuuauuauuauaaaauguauacaauauuauacaaaauaaucaaaauugacauucauuugggaucucugguuaucuuauauuuaaaacuguacauuuugaaaacuaguauauuauauguguauuauaagaaucuauuuuuagauguuuauauuuugauguauguaaaacauaucuaaguagaaggguauaaagaaccauguguacuuaccacagagacuucauaaguaauaucaguuguuccuaaagcuauauaaaaaaagugugcuguggugcaugccuguaguuccagcuacacuggaggcuaaagugggaggcuuucuugagcucaguaaauuguagguacauuauagaaagacuuguuacugaaagcaacuccaacccuuccuuauucugugaugcuugaaauauauuuuuacaguuuuacaauuuaagaaguuucgauggagauuugaaaugauauaagauggaggguagauugaccuucauauugcuucuucugagcacauuaaaauuaggaaauuuguuuuugcuugcuggcuaaagucauuuguuuaguaaugucaggcuucucuacuuaaaauuugauuaaugaaaagggagugagccuaaggacagaagcccauguuugaaguguagagaaagucuugguaugguaaaccuuucagaugugauggaauucauauuugaucugccauuauuccaacuugcuuaugagaaaguuugcauaaaauaguuaagaaccauuuguauguugucaaggggagagaagcaacugccuucuggaauauucagcgaucuggauguguagcucagcccugaugucaguuagcauggacaaagauccauccccagcaccauaacugacauaaacuacggaugguggcaaauguccauaaucccagcacugggggaguggggggucggggggggagaagaggaccagaaguuugaugucauugucagccacauagugaguuaucaagcuugucaugagacugugcuucagacaacugaaguuagcuacucaaugcauguuuuaaguuauugugacacauuaugaaggaaggaacaccuggaagccgauguauuauaaugauaacaaaauacuuuguuuucugaauuccauaucuucauaaaaugcaugggcuuauuuuuucucguacuuauuuuuuuguugacugaagucauauagucaagacaaaaacauuucccucuuguuuugaagucuauaacaaaagcagacaaaaaaccccuccucauccccagauuacucuucuguuggaauauauucugugauggaauaacauacauuacagauuauaauuacugaccuuugaugaacuacacuucaguuucuuuauuuacagguugaucuuuuugguaugaaauuauuaaauccauugggaaaugcauauauuaaauaagaauugauauuuuaacuuauauaauguaacuuuaauuguaugaucuaaagguuuuaaugaaaauuccugugacuuaaaauauaccuguuacauaaguagccagacuggguaguagagugauacuaaguaaucgaacuauguugugguuaaaugauuuugugcuauaacuaaauuucuauaaagaaacauuuaaauagcuaaggcuagagauguaacucaucaguagagcauuugcucaaugaguucaaaggucuggauuugaaucccccaaaucaaaaaccauuaaggagaugaaguaaaauuaaaaaaauaauaaugagacaaacacuuuaaacaaaaugaaaauuguaaaccagcaaacaaaagaauggauuauaaugcuaauaaaugauauuuauaaaggauuucauuaugaaacuaaggcaaugccaauuuuagcauuagcuuuaguaacuuuucugugcauuuagaaacuguacaagaagcauaauuuuauuugguuuuauuacuuuacauugcagaaauaucaguaaagcuuaggaaauuuauucugaccaaucuuuacaaguugggguuuuugcuugcuugcuugcuugcuuguuuuguuuuguuuuguuuuguuuuaauuugacugucccucuguuaucugauauaauuuaaaaggcagguguuucuaacuugagaauaauacugauauauauuuguccuauauuggaauauccaccuaacugcaagcagcuguaauuugaaugaacuccugacucuuuauauguaaaaagaaauacuagccaaaaaauuuauccagguguuuuagaaccugucaaaauguuguaucuggaggaguaaaugccaugugaugcaugccuuacuucuuguauauucaacuugagucccugucucagcuuagcuauucgacugugguuuagcucagauaaaaaagcccaaguggagugggguggggugggguggggugggaugggggauauggugaggacaggagagaugcaugggucucuuaguacagccacauauguuuuccagugacacacaugugccaguccacuagaaacagaauugggaugucuucaucuuaacacuggagugcucacauuucauguguacuugggggguuauccuagagaagcccuuuucugucacccguuuguuuacuuuacguuaagaaagcagacguaagugacuuguuuguugaaccuguuacucuucaccgggacagauuucauacagcuagugcaaaacuuuccuuacaggcaaacacaacugugaugcuucgaacauuguagacuucuuguaguguauacuuuaaaauaucccacuuuucuagagaguggaaacauuucuaauucuacauucugaaucugagugcauuaaaaaauauuuccaacugcaaagcuuggguauaaguaucuuuuaauuguucuguuuugcagugaauuagaaggaaaauuaauuauauccuuuaaagcccuuuaaagguuguacacuaaacgaaaauacaguauugaaaacugcuuuugucugugucauuuguaaauuuguugugucacaauugauauuaaaaugcaagaaauucucaugcuugguauauacauuuucacuuuuuguaugugaaagauggaacccaggaucucacccacugagcaucugcucugccacugaauuagaccccuagcucuucucugauuccagucauucugagggcuguuaugaaacucaguuuguuaauuucagacauggaaaugcuacuucuugugggccacucuagugaagcuaaagugaacuaauugacccugauauaguugguacaagcugaggcuugccaacugggcuuuaaagguguugcuguacuuugaaguaugaaugaaugcaccuaaagaaugacuacuggagcagacugcccuuaacuccauagcgacaggaagcaauacacacacagccaugcuguauaucauguguaauuuuguaacuugagguuuuggaagaauaucuuguuuaccauuuaaucguauugagacuauggcaggaagaagcaguuaccaagacuggauucuugccccugcuucccagauagagcauugguaguaaaucuuugcccucagucuuugaacugcauuugcucuccuuuuugugaugaaggucuguaagucgaacauuaccacuguugguuacuugaagcagucuaucugcgauucaccaagaagaugacaagugaacuuuacagcacaaccugauuucucugcagucuaauuuguggcaccaaaucugaagauacauuuauauaaagcaagagcagguuuccuaugggggaaaaccauuugucauuugcucuuaacaagauaaauccccauagacagaccuucuuguaaaaugguucccauuggauuuauucucaacuucaauaaaaaaggagauaugguaaacaaagguaugacgaaauauuaguuagcucuugcauuuuugcuggaaagcucccaguucuaacucucugagguuuaaaacaguacaauuucauaugaauuaagugggccucagaauagacugcaagguguugcuuugugcucagcugaucuuguuuuuaauguggaaagugaucaaaacaauucauguuuacauuucaguguaucuuugucacuaauauauuuacugagccauaaaauggaaacuggaaguauuaaaaguauaaugcagaugaagagagugccaaauacuuucaggcuucgaauuaaaauaugaauuuagagaacaacuuaguagaguacuuacuagacuguugaaucuguuguguauaaaggggaagaaaauaaaacggcagcugugcuuuuauaucaugaauuuauaaccugggucauguuugcuucaacugacacacauucacauuaguguauauuuauauuaauaugucuucuaacaguuuuccuuuuuuuuuaaaauaaguuuuauauuuuucugagucagaaucuguuaaugcaguggcucucagccuuccuaauguugcggaccuuuaaugcaguuucuuauguuguggugaccuucaaagcauaaaauuauuuuguuacuacuuuauaacuguaauuuugcuaaugauaugaauuguaauguaaauaauugacauacaggauaugugauaugugaccccuccucaaaggggcagugguccacggguugaggaccacuguuuuaaugacuccucccugccuaguuaucaaaauaauuaaaauaaauuuauuuuguucuaccuuguggcagcaaacugcuuaucauuuuccacuaggagguuuuagucucuggugauuucacacucccguuacuacuuggcuuugcaguuccauuucucuagccagcuuggcuuaacuguauuaucaacuguuuaaaaacaggugguggcagccuuuaaucucagcacuugugaagcagaggcaggugaaucucucugaguucgaggccagucuggucacagagcaaguuccaggacagccaaggcuacacagaguaacucugucuugaaaaaucuaaaacaaaacaaaacgaaacaaauaacuccccaaccaaaccaaaucaaucaaucagucaaacacuguccuccaaaagacucccuccccaaaacaaagccaugaaucuugaauauucuggguuagaaucccagagugcacuacugaccagaguuuaauccuggacagacuucuucagaucugcaauagaguugguaacuugguuuggaaggccccauugcaugaugcauauggaaguucuaugcuugacagcggaguaagcaagugaggguugcuaucacuuuccagcacgggcuccucaacuaugccucacugcucuuguucucuuaacauuuuguucucaguguuuacuuugcuuagacuacauuacauuuuguucccuaauaugucuuuuuguaagguugagagugcucaacuuaaauggacucacuuauaacaaacguuauccuugguacugauuagaaauugccuuuuauaguuuuguuuacuaaauguucaacauuuucauauuguaagcuucuugaggaaacaucauaaauuagauuuuagaaacucgguaucauuguccuuuccuaggagaagaaaucaaucucuuguugauuaagccucagacuguauuguguaaugagcuguuuuaucauuuauucaauccaaaaauuuaauugccauuagaacaggguuuuuuuuguuguuguuguuuuguuuuguuuuguuuuuuguuaggguuucucuguguaacacuggcuacccuggaacuugcucuguagaccagacuggccuugaacucagagauucuuuuuuugccucuugagugcugugugucaccaucacccagcuauaacaguucauuuuuaaaaugaguaucauuguguuuacauuuaauggcauaaaugaaugaauuuuuggcauuuuguuaauuacuaccuaguuaacaguaaauuuggguugacuuuacucugucucauuuccucuuagcuuuucaaaugaaaauuuguucccucucucuuuauguauucuguaugccuguggcauuucuguagcaccuugacaaagaaguguuaguaguugggcaugcucucucagauuugguuguacuaggugcgugcauuucuaauucugcuuauccuaugagaaauuguggaauuguggggauuuugccuuugggaagcuacuuugaccacuccaagucacuuguguuucuuucuuugcugccuaacuugacuguauauacugggaugguaaagcaguaggagcaggucuugaguuccagugucaucaccaagguaacugguggacacagaauggaauucuucagaguagucaguccugugaugggucuguggcguuuuuguauuauggaaaguuaccugccuugaaaccuacacagagauucuuaaacugaaagcaaucuuugauuuauguagauuuuaaauccauacaaauuuaauuucagacucccucuguaauuuaaaaguccccauaugccccuuuuuugguuaguauauuuucauuguguaccauuuuuuuuaggugauaauuuugcugaguuauucucuuugaaggcauucuaauuccagauuuaaugaggaacucaaauuucuauaaaaacuuuaaaaauauauguuccuuuucacuauuauuuaugagugugugcguguguguguguuuagaugggugcuggguauuuuugugaauuucuuuucuacuucuuuuguagaaucagugucuuccugaacccggaauucugauuguggccauuggccagcuaucuuagccaguccucccagggcucuccucccucugccuccccacugcuggaaccgagcaugccugccugcucgcauguuaacuguagccauuauauguguagggcaagugcuuuacccccugaaucaucucccuagccucuccacuucuauuuuuuaaagauuaaaaauccguguguguaaaaugugcauuugugugugagaguggauacauguauaggagggugugaagguaagagaacaaucucugugcgccaucuccauccugaggcaccuucuaccuuuuguuugagauagacucauuggucuggcaccuugccagcguaggcgauccugauccuagcgcuugcaguguuuuaccaucacugggauuaucagugcacaccaccaagccuuuuguggucuauggguugugugggugcagacucugcuccuucaccuuacuuacugagucauuucucugacccgcauuuccacuuuguaucuucaugcauuuauugaucaauuauuaacacaaaaugaaucaagacgugaacugcuguaaacauagcauagagcaaaguauccuggaaacgaugccauucaaacaaugggagguaaaggagacagacaauaaguggaacuggauucuaguaggugguuguaggugcuauaguaggugguuguaggugcuacggagagaacuuaggugaggaagaaggauggacacagaugagaccugcagaccauugaacaaaggcaugcaggagucuuugcaugcuucuucagugugacugugugcuuauccuauugacgcuuugaucgaugcuaacuuuuuuguuauauuagcaguucuguuuuauccccauuccuucucauggcauauucuauuuuucuguuuggacucuuauuuuaaauuuuuauaugccuuuuccugaaaaaaaaaaaaaacaauuuuguguguguauguccugagaacuauagucaaauauacuugagagacuuggaaaauuaauccuucaugcauccaaguucaagauucuucugaaaaacuugaaacuacugcuaaaauacauuuuaaauacccaaauuaaacuuuugugcaaaggagaaaauguaaagauuuuaauuaguagaauuggcuggacgucaacuucauugguugcucucucaauuugcuuauguguaacuuuaacauggaaaaaacaaucuuuguuuaugauagauucuauuuuaaaaguaauccucccaugaaauuuauuaucauugcuuauaugauauagguaucauaucucaucuuuaaucauagucaugagucaauuuuauuuauaaaacuuugauuaugcaaauagacagguuauuuagaaguuacugauggaggcacauuaucuugaauuuuguuauuuugaguaaugauugucauuuugauauuauuaaguguagaauuuucagucaguucaagucaaaaccauauuuuccauuucaauucauuggaaaauauuaagcauuauuugccugucauccauucugaaauaacuucauauuugaggcuauuguuguacauuggaaagcuuaaaaaucguacauacauauuuaauaugaagaagauagguauuuuauagcauuaaaguaaaaauuaguggauuuuuguacaaccuuaagcaaaacaaaaccuuucucuagccuuuuguaauuacauaugcaauauuauuuaaaauuuuauugcuuuuuaguuagugguauguauaugccuauuaauaugcauauuaccgcaugcugugguagacuaaggacaacuugagaaaguagguucuuuucuucuaccguguagguccuggugaaauacuuagaagaagcaaucugagaacacaaugucugaugagagaagaaaccuuggcucugguccucacaaccaucagaagggaggaaggagccucacuuuugucccuugucauguuuuuuuccuuuguaguugcaaaggaauauuaguauuuaauaaaauuugcaccugcaagucauuggucacccaucuuagccaugugauguaucaaacacagacaauucccuaucuaaaaacaauuaugaaaguaaaauauauauagaacuuagcucuauuuaacauuuacuaacuauugaugaucuuugauugaagaaaguauaguuagguagguauuugggucugaaguaugauagggugguacaaaucuagggauuuuuauagaggagacauagcuacauagcaucauguauuugaugaagcuucauagcuugcugucuuuuaaggauguugcacuucacacugcagcuguauuaucucaaggaggcaagguccagugagcaacagaaaacacucucuaacaagacuuagaauguugcauauguacacucacuuauuuuauuuuuauuccauugccauuuaauuguuaauucuacuuaauaagcuccuaaauaucacaauaucauaugccuaaauaggacuuuacuuuuauuagaucaguuuuuccugacaagauuagaauaauguaauguauuugucaaauaguugaccaaagaauuaaauaacugcuuuggaacuuaauaaauuugcuagcacaugcacugcaaauaauauacuccuaagucaaaugugguuuuaauauuuuuuuugguugcuguguauguguaucuacaguauuguauuuuaauguuuugaccuuuuuaaugaaaucaauauugaaauuacuuaaaaauauucuuuguaaauaagguucuucagcauuagacuuaaaaauuucuuacuagguaugaacauuagaaagcauuccaguuauuucuuuagaaauuaaacagucuguacuugguuucccuagcauguguuaauaacauaccugaagauugaaaaugaaacauuucugaguuguacuuuucuuaggaaguaagaguggacacaagaaauaauaaacuuuugaauguagguuuuccuacuuguuuuuguuugcuucacauuuguauaucacucuccauguguuuucuaccaguauucucuucauuguucucuuucuaaagaguguauugucucugucaccuuuuccuggcugacuguucucuuugcucuguuuucagguugguuuuauuuacaaaacagucaguucuaaaucuuugcccauccuuccuuuagcucaggccuugccuuuuggucagaauuacuccucagcuucagccuccuucagcucuccuuuuguauccauccucuuuuguuuugggauaguuguuccacauucugcuguuuguuguuucuuagaacuuuuagagaaauaguuuucuuugcucugcuccuaugguauguaaugagaagaaaugaaagcagugugaagagauagcuguggcucuuuuaaagucagggagguagggcacugacagaaauguuuccagcgucaguggaaggccuaaagauuguuaggaauauggagaaagggcccaucuuaauuuuuucaaauuuauuuuuaagguugaaaaguugcuggcaguauuaauauaaccagaaucucaauggacacccugaauacauucuuuaaaauuggguuaauuguuaaauaucauauuccucuuuuccuguacaguuuuugauacuuuauaauauuacauuuuugucuuuuucuuccaauacuuuaugaaaaugggccuaaugugucuaagcauguaagucagaacaauuucuucuuuuaaagguuguaguugguuccccuacucuaugccacugugugcuucaacaaucuguuuagcagaauuuuauuggcagacuccaugaucuucuugucuaauuaaaauaaaauaauaucuaaugcagugaacuuuugugaauaacuuauucagcauuaaucuuaauacuugagauagaacagauuuuauaaguuaauauaaaaauauuacuggucaacugagaugaauagagaaaauguuuucaugguaaagugcuaucuagaauuucccuuuaaguuucacugcuacuacuuuuguaaauauuggguuacuaaguuuacuuuucuauuguuggauuuaaaauagauuuugagaaacaaagucgaacguacuuagcacuguucuauaaccuuacaagcuugcuggguucguuuauauauauuacaaccuuuuaggggacuauauagagagaaagacuuggggugguagguaguauaauugaaauguagaucauaaucucuguuuguuuuuccaaauuaguuagggguucugaggauacauuuugaauauuuguguauguuuagcauuucgucccuuuguuagaaaucucucagugugacuugguuuuaauaggaugugucuugaauugugagccaaucacucuugaaaaguauuaagcccuuuaaacacacuggucagccccacagagggaagccuacagguuuauuagcacugcuuggccugaaagcacagcauacccuuuuagguugcacagcaacagacuccuagcaaccguaauagauugaauuucuaagagugaccaggccggauguaauaauaaagcaagagguacaaacaguugucaugguuuucuuuucucagcaagcuaguuugauuuagggaagcuuagcuuuucaaaaaaugggcaaacuucuaauaaaacuacuacuguuuguacauaggacuuuugguauuaccauggcaauaauggcaccaaaauuuaagagucauggguuaauaauaugcugauaauaaaacaaaaguuaaaaggaguauuauuuaaaguuuucaggaggaauguuuugaaaaagauguuaucauaaacuuaaauuagaauuggauccagauaaugcuaauacccuuuuuaaaaaauagaaacuucacuauauuuauguuuucucuuuuuuugguguucuauuuuaauuuuaaugcaauucccuguaguuuuauguugugauauaauugaacauucauauaacauucaaaacauuaaaaaccagcuuauuuuagcugcuuugaaguuacaaaccaauugaagcagagaauuuauuagagaaacaauaauaaagacauauuuaaucuuucauagugauaggaaaagcauugcuugucuacagauguaaugugcucugacuuccucagcauucuuucuguuuagacauuaguguguguuugccaauguugccgugaaagggaacuuaauucagauauagucacaggcugaagaaggauguuuccaucaaaagaagagacucuagcuguugggaguugagaguaguacugcagccuuugacagcaauaaaguguaaauauacacauaugcuaauacccuugauuuguucaucuuuugugucagcauuuggaaaagauuguuaaaguggcaguuguaguaaagacuagcaauuacaguaaagagcagaaauuagguauuugugaccuauuauauuucauuaaaagacguccuuauuaaaauggcacugcuuacucugauuacuugacagcugcccaaacagauuagaaaauacacaguuucagcuaaagguaaaaucaaccuuuuaagcaaacuccuagugcaggacaaauaauauaugguacaguauaagccuuuuugaacaguauauuugcuuuugggagaaauguuuaucaguggccaaauagcauguccccuuagcguucguuuagaaagagcacaccagcagugggauuuucccacugagaugucuuucaacacucaucugagacugcacuagcuuuucacuagacaacugacuuugagaagaauaggucuagggagcagcauggcuuccugaaagcauuuucugucuuuuuucuuguauccacaacucuaacuuuggaagccucauugcuagguuauuucugaaauauucuaaguguccuuugcuugagccagucuagccccaaugaguccaguacuugaacguuaggcaucuccuucacaauaaugaauggucuuuuuuuuuuuuuuuccuagacaaaguuuucaucuucuauggcucuuacuaacucuuuuaguauuucuacuugcuuuggaaaacacaaaguaaaacauccuuauuucuuugucccugucuucuauaccaucagguagaggauaagcacuguagagcauucuguaaguaccaaacacacacacacacacacacacacuuaguaugaaacugauauauacaaaguugacuugucagaauuugcaauauuaauagaaagcugcuguauguauauauauguguauauauguauguguguguauauauauauguguguguauguauguauguguguguauauacauacauacauacauauauauauauggaacuguauaauuugcacaaagugccaaacuaagcuauuugagacacucaugauaauuccacuuauacccaagcuggguuuuuucagcuaaauaaguaccugguagaaguuggaguagauaauaucaugaauuguaucuuacaauugugaggaagggguuaugcacaccauagauauagaaccaagcaaugagguugaagaguuccuugguaauaauaaagcagaugaaauagauaagaaaagacagaauuuaaaacauggcuaggaugucaucaguguacauuucagaaggaggauccaguguaaagauaaaaguggucuuacugagaugaacuuggcaggcauuugcagaauagauaauagaccucuuacaugaaaaccuguaaaacaggauucugauuuuuaauuccaaaaggccuugcuugaacuccuuuuguucuucuuuuuacuuugaauucaugggugaugcagauaaccaguauugaaugaagcuguauuacaaagugugaacaaguguuacaccugcuauaugcuuggcacuaugacagugaguaauauugcuaguguagcaguugauuaguaaguacuacuacaggugaugguacuguaauaaucaccaucaauucuguuguaaugaagauugauucugaggaaacauuucuguaaagaggaugugggaaucaugccagucccuacaucaauaauggucacaaaucauaucccuccauucuugaauacuuagcaugaaguauaauggaacauguucuaccaccguaacuugaccagcucuuugugggacagugguaagaggagaacugacucauccuauuggucaugaacuauaguucaccucuuuccccagugucccaggugcuuuacuguagcuugcccacauguaugcucaacuuuagagccuggucccauuguucucaagggcuuuuccuaacaaguccugagucuagaggugagcaugccucucuaucugcacugguaagggugguucauggcugccuacugugcgguccucagggucaacuuauuagauuucuaaggggucagcaugacacugaacugaacaaacuucuuuuccuaagagcugagcccuggaaagauagucauagcugacauucagaagugcaaggaggggcuauagagauggcucaaauauuaagaacacuugccacuuucccagaggaucuggguucauggcccaacacaaccugauagcuuaggaccaaaaguaauuuuagcuucagaggaucugacucuuuucuggccuccauggacacugcauagauuuauugcacagacauacacacagacauauaugcaggcagagccucccccgcccucucucacacacacacaaguacaaggacuuggaacaaugcuuuuucuugucugcucucaagauggugcuggaagugccuauuuggcaugaugacaaaucagcagggcuucuuccuguauuugugaaacgccauaagaaugaaaagguuaaaagauagcuagagucuuggugacuuguagaguagcuaagaaaaacaguauuugggugcaguguggauaggacauaaccuuguguuuguuaccaccauaucuacuagcaucuagucacuuucucauacuuugcuaaccaccuuaccagaguaagaaguuaccauagaauauagcaagagggaaauguauuacugaaaagucaccauagaacuuaggacacuaggaaggaaaguugguugacuugguaaugugccugugcauugcaugugaggaucuuugauuguauauaugguauucaacaugcuuccuuuuaauugaauuauugaauaugaacaggcucuuaaggaauaaauuagacuuacuguuaaagugaugggagguaaaggcagaauuucaucaaugagcuagugugguagcuguggaacuugcaaucccuuaaaagaucugagcaauuguaucacagugugguacaauacaauagagaaacagcuguugcaagaagagauauuguuuauagccuauuuggagaggaggcauuggcaaagauaaauugacuauaauuuagcauggacuugcacucacaagguugacauagggaaggauauuuggagaaaauaauuaggauuaaaggaauagguagaagauuuaaaaagucuguaauuauaagccuguauaauuaauaauuauguugcuuaaaaucacugugaaauauguagucacuucauuuauaauauauacaauaaacuucauuucagagagcauucauaguguaacagacauaucugauuauguagaguuuaaauugcccacuuuuuuugagaaaguggauucguuaauuaguauagacuguuucauuuuguugaauaugacuuguaauccccuagauacacacaaacaccugugauuauugugugagccuugucuugucuuuaguuaguccuaaauacauguauuuagauuugcuaccuguucauauagacucagcugugccuguuugcuuugcuauuuuuccaaguuuaauggaccaauauaaaaauuuauggcaacugucacuuaaugucucuucuaccuuuaaggaaaaugaaaacaaaaccagaucaugcuagaaaacuguguugcuguguauaguugacuauuauauacauacuaugcuaaacugaccuguaauauuauggaccaaauuuaggccacaaaaaccagucugaacagguuuaaacauagacauaaguguauguuguggcaucauuguuauuauaaguugacuauguuagaaauaaagaacagugguuucaaaauaaccuuuucuauuuuucuagagauuucuuuuaaaaacaacaaaaucuggaaaucacucugcauacaccuuuuuuuuucuuuuaaaauucugucuuauguuacauccugauugcaguuuccucucucuccauucuucccaguucuucucucuugccucucucccagauccacuccuccucccuugcccuucagaaaagcaggccucccagggauaccaaauaaacacagaauccuaaguuccaguaagacugggcacaaacccuuaccucaaggcuggacacagcaacccaggaggaggaaaagggucccaagagagagacaccccacacucccacuguuaguuguugucccauaagaacaacuacagaaccauaguauaugugcugaggacuuaggucagaucauacauguuccacugugcacuuuaauuccaguacucaggagguaggggcaggcuguuuuuugugcuucugaagcuaaccuagucuacauaguaagaacuuauuuugaaauuuuuuucuauaaaguugauuauuguguguauuuugcuauuguuuucagcuuuaugauuuauguuugcuuugcuuucuuauuuccaggaaauauuuaagauuugagcuaauauauaaucuguuaaucuguuuucguuuuuacuucuuuaaauacagaagguuagcagaaugguuucaguauuguucuuuucacauuguaaaguauacauuuagaaaacuccccuuuuauuuuuccucacuuauauuuguuuuugaucaucaaaacauuauauuuguucuuuaaauucuaguucauuaagacauauuuacauuuacucccuauaaaaucaaagcacaguauccuuucuugcuuaauaagaaaaaaaaagauuugguuguacaaugaauacuuuuaaauaauugauauacaaagugauuuaaaauaaucaacaguuucaagauauuuuaaagauugcucuaccuucagcugauguuuuauuuuuaaacauguuugagcucuugguauuuuuggcauuuuuaugauaaagaaucccuugaguuuggcugguggaaaggcuagggguaaauugauuacaugucaucuauuacccaugugacacagugggauacaaagaguacuauauagauuugacugucauguauagaaucucaauucugaauuuuuuucaaaaguggcuauguacauuuggaaugugcuuuuucuuuugugguguuuacaguuaauauggugaggcgcuuuauucuuucacaacuauauauguacuagagacauuauuagauuguguuauguaauucuuuuaaaugcuucaggaaaccuguuuauccguggugcuauggaaacuguaagagaacuacucucugaugucuaucaccuacccccucugucaccuccagcugucucagguaggaauaaaggaugcuguauuuaaaaaucauauagcuauuacucagauuuuauaggaaagcaaugagaaagcauucacaucccuguaugugacauaauuaaguacuuuucaggcuuagaggaauugagugagaucaaaaauagaagguggaguccucucauauggcuuugguucccauguaucacccuccacagugucuggaucagguauccuaaaaugagccaaagaauuuuauauacucuuuccauuucuauacuaguuauguuaccagacaucaugcacauuuuagaaucuacuuaagaguagaaaaacagcagucaguuuauugaaauucagauaauggcaugauggcacuuggaucaguggaucuuaacuauuuggugagugauuggcuaccaugcuucugauaaugucauucaauaauggcuugguuacuacaguuuggauaugggaaccuuugcuuuuauugcaaaaaaacaaaaacaaaaaacaaacaaaauucaaaaccuuuaaaaggaggccuccuuuggcauuuggaaaugcagaacgagcuaagauggauguguggugaaugggaggcucauuuggagggcaggcuuugugucucaguacuuacaagauggacaucauugugcuugagauugugcuugcauacaguguauuuucauaaaaucccaaauuguuggaauuaaagaucagccuauuaagguuguuaaaaaccuuauuauuuugccauuucucguuuuaauugaaauucaaacgauuaagauugguauuuucuaguaauuauguguuuucccuuuucauaggugcaguaguggaauguuuguaaugguuuuaaauauaguuuacuuuccccccauuugaugcugguuauugaacucugggccucaugccuguuaggcaaaugcugugagcuguacaccagaccuaauggacuuaccuuuugcuguaguguggaucaaaacuaguaucuccaauggguuaaguaggggggacuagcccugagcgacacucagcauucaauuugucuuuaagagcuaccauuucauguuuauuucuuagaucuaugagccuuuauauaucucuaaugaaagaugugcugauaggauagaaucugucaaaguucuugauucuuuaaauagccuuucuuaccaaagaaaaccuucaguuuuagagggaaaguaaaugcauaggcugugaauuaaagaacaaggccaaagggaaauaagaacuaucuccucaagagcuaaagagaaacgaaaucuauaccagaccccuguacacacacacacacacacacacacacacacacacacacacacacacacacacacagagggagauggggagagggggagggagagagagggagagauagggggagagggagagagagagaggagagagagagaggaaaaggagagagagagagagaaagggagggagggagggagggagggagagggagacagaaacaaaaccacaaggccuuauucugaagaauagcuuugucucaccccccccccccccaaguacuggaauugcugggauuacaguuguauacucugaugcuguagccuccccucaaacuuguguuuuguaaauguccuccagagguugcaccaagaguucaccuguacacuuucaagauuuuaucauagauaaaagguuacaauucgguuuuaagaauggugauuaauuuugugucuaaguccucacaauauguuuuggaacauaaguauagugugcgucuauguauaggaauuauauuuuaagagcuaugauuuuaucaaaguauaucuaaaguacuagcuauuucagauaguuuccuaggauguuguaauuuucuuguauuuuucaaccauuguaguuaaucaaaucaaucugauauucuuuuuacuuacugagaauaucugacuauagacauuguauaccuaauaauuauauagacuuaugcaaguuuguguaaagaucugguugcaguauauuuuuagagguaauguaaaguauauaaaccaaugagugggcugguggaguccuuucuuuaggaaaguaguggaggaagcacccuaaagucaucccuagggaagaagcagagaacaauuuacaugucucuccuaucagcaguuuuccuuuugcucugauauuuagacuuucuuuagcuuuggcagcaaagcuaaagcucugcucuucucuucucuucucucccucuucucucccucuuuucucccucuucucucccucuucucucccucuccucuuccucuuccucuuccucuuccucuuccucuuccucuuccucuuccucuuccucuuccucuuccucuuucucuucucuucucuucucuucucuucucuucucuucucuucucuucucuucucuucuccuuuuccugccugccugccuuccuuccuuccuuccuuccuuccuuccuuccuuccuuccuuucuuccuuccuucuuuccuuuuaaugaauauuucucuguuguaaaugaaaugaauaagguuauugaagagggaauggaggaaaggaagcaaguuuguauauuggucaguaauuaucauuuauauagcaggccacaauuuauagauuuuuaaauuguuguuugcguuuuuuugggguguguguauuuauguguguaguaauuguaagagcuugcuguggcuggcugguugugguauagucauuggcugcuuguuguaaacagugaagcaguaacagauugagaaacacaauucaaguggggcaauuuuuaugucagugauguagcugugaagugugauaggacucuguuccacauaucaggaacuuugaaauuaaaagcaguucugcaggaaccacauucgugggauuacuggaaguugagcucaaucugcagaguagauuugauuuuuucuuucacgugggcuugugcauuacaaaauuucagccugucccagcgcuauaugguugucuuuaagaguagcuaacugggucucuucuuguuuuucuuuauuuugguaugaauggcaaucaguguuauauauacuaccucuuuucuuucuggugauuauggaucuagauaaaaaguucagacucuuuuuuuucccaagcguaaaaugaauuuauugaucuucucuggaauuuuauuauaauaaaagggaaacucaaaacgaaacucacugucauguuugaaugaaaaauguuccucguaguguucagcauuugagcauuuguuccagaguagauagugcuguuuagagagauuuaaauggugagaccuugcuagaggaagaaugucaccaggauggccuauaagagcaugaggccucagcuuacagccaguuucucuguuucauaauugcuguugaagauguggucucauagauuacugcuauugcugccaugcugucuucaacauuauggauuuaaaaaaaauuauuagauauuuucuuuauucauaucucaaauguuauccccuuuccugguuuccccucugaaaaucccuuaucugcuccccccucccccuacucaccaacccacccacuccugcuuccuggcccuggcauuccacuauacuggggcauagaaccuucacaggaccaagggucucuccucccauugaugaccgaccaggccauccuaugcuacauaugcagcuagagccaugagucccaccauguguuuucuuugauuggugguuuagucccagggagcucuggggauacugguuaguucauauuguuuuuccucuuauggggcugcaaaccccuuuagcuccuugguuccuuucucuagguccuccauugggggcccugugcucuguccaauguaugguugugagcauccacuucuguauuuguuaugcacuggcagaaccucucaggagacagguuuaacaggcuacugucagcaagcucuuguuggaaguuuagauucuugauguuccuuccucuccucuccucuccucuccucuccucuccucuccucuccucuccucuccucuccucuccucuccucuccucuccucuccucucuuuccucccucccucccucccucccucccucccucccucccucccucccucccuuccuuccuuccuucuucuuaagaaauauuuccuuuacauacucuauagggaguaaaaauaauugaaaaaaaaaucagggccuuuuguaagauacuaauuuaaaauauauaaguaaaaaaaauugcuaaacgugagaguccuguaugaaauauuuagugccuaaacuacagaguaacauaguugcuccauauggcauuuaaaguguuccuuggaugucaugacaccaguccuggcaguuacauuuaguuuugacaggguaauuuucaugagcuacucuuuguuuacagagugaaaaugcuggaucaugauaaucuucagaaauagugguagaaguucuaggaaugauuucuuuuuuacaucagagaauuguagagucuaucauuuguaaguuucaguguggguuuucaugauaaacaaacaugcacuugguucuuacuauauuguaauaaucuaugaagugucuuaucuacaaacacagacaaaucuuaaaaucagugguucuuccaaaccauaaugaaauguaaucaggggugaguguaaaauacacacauucaagguaaaaguagcuauuuagacuaaaauuuaauucaacuguuuagacucaaugcauccuacaaauugaauuugugucuggaguuuaugauucuaaaagugagugacaucuguuuuucugaaagugauuaaugagcuuuuaguuuaacgugcucagcugaacacucuuagguggucuguacagugauuuuucuccacagucuauucuggacaugaguugauugacaggguuccccaaaugacagcaaaaugcucuugauaggaggagugagcaaagguuugcaccacaggugugcuuucuuaaugcaggugacucagauuuguaauccaaguaauuugcauuuuucuuuuucauuguuaggaucuuuucuucuaaauuuaaugauguggauaaaaaagaauuaacuuauuucauugaaaaccaaaccuauuuagaacaagcuuaaguuauagaaagggcauuuuauuuuuauuuuauuuuauuuuauuuuauuuuauuuuauuuuauuuguuuuuucgagacaggguuucuuugugggacucacucuguagaccaggcuguccuugaacucagaaauccgccugccucuaccucccaagaucugggauuaaaggcaggcgccaccaugcucggcaaaaaaaucacuuuguguguguguguguguguguguguguguguguguguguuauuucuguagcccuaucuguccuggaacucacucuguagaccaggcugguuuuguuuguacuugucuuuaaaacucccacuagaauaguccauuuaagcucugcugguggaauucuaaaacuuuuaucucuuuuuauuauucuuucauuuauuuauauuucauauguugcccuccuucccagccccccuucccaaagcucuucacaccccucccccuuagccucugugagggugcuucccagccccucuucaccuacccucucaccucaccuccccauccccaucuacaggauuaggcccauccucucccagugaggcuagacauggcagcccucagcuauauauguguugggggucagggaccagcccauguaugcucuuugguugguggcauaguuucugggagcucagaauacuguuguucuucauaugggguuuccaucccuuuuagcuccuucaauccuuccccuaacucuuccauaggggucccugacaucaauccaaugguugucucuaaguaucuguaucuaucucagucaacugcugauagagccucccagaggacagccaugucuacaagcacaacauggcaucaguaauagugucagggugguguaccugugcauggaauggaucccaaguugggaugggauggucacuguauagccuuuccuucagucucugcuucauuuuuaucccugcauuucuuuuaguuccaaacuccuccucuuccucccccuuccuccuccuccuccuucuuuucuucuucuucuuuucuucuucuuugacuuaagaccuacauggucaaggcagggcagcaucaauacuuuuaauaguuuuggucuuaguuacucuucuguuguuguauaaaauaccuugaaaagaguaauuuauaggagaguuuauuuuagauuucaguuccagagggauauggucccucauagaaucaggcgugggacaugcugugacaggagcaagagacugguuagucacacuaaccaguauguagguuaaccacauguaggaaguugagagugaaccagaaguguguccuauuaacuuuguaagucccaugugcuaugacccccuucaaucuguggcccacuacauucagugacucacuucagucagugaggcucugccuccuaaaggggccacaacuuuccugaccagcaauuucaacuggagaucaaauguucaaacaagagucuauuggggaacauuucauauucaagcacugugauuuuaguuuucauagauguauguaaaaauaugguuaugaaaaaaagagaauaccuuuauaggugaaauuuaguuaccuuuaaugcuuuuuaguguagcagacgaauauuuauugaggucuauuauguuuuuaaagauuaaagaugguuuugccacuuacuacuagauauaaaauuggguaccaaguuguaguaguguugauuauuuguaguaaaauuuggcauaauuuuagcaaauaacauaauauuugccaugaaaauacuucuucuuauguuuuuauaaguugauacuuuugaaagcaauuuuuaccuugcuuauacuacauuuucuguaaaauagggcacauauaauuuugucuaguauuaaugaagagcugauauauugagagauuaauugacuuguccaugguuguuuggcuuaugcgugauuuaucaguuuucacguauaauuacauuuuugacuaaaccuauauuugcccuuacugggaaggagcugagcauagaguccaacuguaauugcuguccuucauucagcuuuaccgauuccagaguuuuuuauauuuguuuucauuccaaucaccuuaauggucuuaaugacacuaauguugccuuaauuuccuacauuggugguauucagaacuuuugcagaguccuuuuccuuucgauuugagcuuuaacaaauauguaaaaggaauauuccacaguagaacauagaauucaacuuguuccagguguauauguaagcuuuacuuuaggagggucuggaagugucaauguuuguuucuaagagacugaauguuguaagaaauuucacuagccuucuagaaugaccacgugcaaggcugggccagugcaaagggagagucuggaaaagcagcuggaaagcaaagcccagccaucucagucucuagagcuaccuaagccucaccugcaaguaggaagcagucacaagaucaccuguaagcuagaaccucugccucacgaguaacuacagaauauaaaaugaagcauuuuggguuaguuaguuuugguuuaguuuguugucaaaacagaacaaauacgugaaaacauucuugaacagguguugaauuauuuuuguucuacuuggagaguuuugaucuuuuuuuauuagauauuuucuucauuuacaauucaaaugcuauccugaaaguccccuauacccuccccccgcccugcuccccaacccccucacuccagcuuccuggccuuggcauuccccuguacuggggcauauaaucuucguaagaccaagggccucuucuuccauugauggccuacuaggccauccucuguugcauaugcagcuagagacacgagcucuugggguacugguuaguucauacugcaguuucuccuauaggguugcagaccccuucagauccuuggguacuuucucuggcuccuucuuuaggggcucuguguuccauccaauggaugacugugagcauccacuucuguauuuguauccacuggcauagccucacaagagaccgcuauaccuggguucugucagcaauaucuuccuggcauacgcaauaguaucuggguuuggugguuguuuaugggauggauccccggguggggcagucucugaauguuccuuccuuccaucucagcgcugagcugauaguuuugaucuaauauggauuauguaagcauaauuuuaagagaaauaauaguaaaugaauaauuauuuuccagaauuagguuuuauuugacuuaacuccacaaguuugauuaaacuuguguagaaaaccccuuucuguacgggaaucuccucagagcagucuugggaaggagagcugccuauaaacaggccuaaggcuguuauuguuuugggacucucauugucucucauagggcugucuacuguguugaggucuguucucuccucuuuauacuucuuacuauaaaucaccccccacuccguguguguguguguguguguguguguguguguguguguguguguguguguguguguguguguguguguguguguguguguguguguauauguguguguauauguguguguguguauguguguguguauguguguguguauguguguguguguauguguguguguauguguguguguguauguguguguguguguauguguguguguguguguauguguguguauguguguguauguguguguguguauguguguguauguguguguauguguguguguguguauguguguguauguguguguguguguguauguguguauguguguguguauguguguguguguguguguguauguauguguguauguauguguguauguguguauguauguguguguguauguauguguguauguguguguguguauguguguguguauguguguguguguguguauguguguguguauguguguguguguguguaugugugugugugugaaucccuuccugucacaguugaauugacuugccaagguaagaugaagcagccuuuccuuuucacugagccuuuucuguucuagagaaagaauuugggaggccaugacuaagcaagaccccaaaccaccuuuacuuuaauagaaaagaaaaaguugcaguaugauaaagguuuugcuuguuuuacuucuuuggaaagcagauuuuuguuaaaauuuucccaauaauuuguuccuauagauaagugucagugaacuaaaauuuacaaccaaaauucuuaaagcuaaaaagaaguuuuaaaauauagagcauggucaacuuucauacugauaaagaauggauaaaaaaacaaaaauauuugugaguagaaugacaauccagcugccuucaggauucugauaacuccccacacuggagacaguacagacaacuuaaaugacugcucaagagaaagcgacugacggaaccuuugaaacaugaggucuguggaacucaauacuuccaucucccuucuacuccacccuggugccauagcuaaaaucugucagccuagcagguuugaaugaggggaaagaaaagaaaaggagaauaugaaucuuacugcuuuuggagcuccauuaaaauuaaccuccaucccaagagcauaguuaguacuuugucugaacuugcaacucccugggagaacugcucucagagaacacuuggcuaggugguugacuuugagcuguucuuggagaaagaaaaagcucuuucuccagggcauuucggagacaauagcaaacccuuggcaagaucacugcuguugaaggcuauaacuucauuugguacaaaccagagccugguuaggaauuuuaaaggaaguccuggagaacuggccaaccagagaaacguuagaaaguucugacauguuccuugauaugugaaaguaugcuuaauacauauggcugugauacuugccuaggaaagaucuuaaaaauguuaccucuggcuuaucucaaggcucugugucauuaagaagugaaagcaagagcuuuuaaauaagcccuucaaagcuggaauugacacuucauaaagaaccuuucccagaggauggaacauacauagcuaggucaguugaaaucaucuaaauagucauugaacacuauauuauaguggcauaagugugaccacuuguaagccuugcuuacaaauuaagaucaggaauuuaaaaagaaaagcagacaaguuggugaccauaugcagguaaucuaaacuguaaaauaauuaaauaauucuugaaacugcuaaguuaguaccauuaggaaaacaaaaacaaaacauagguacauugggaggauagugccuccaggauucugauguaggcacgcuaaaauaugcuucauaaaauguucaauuuuaagcaaaauauuuaaacuucaaagaauuaugaaauaugucagggaguuuaucaaauggugaaagaauuuacccuuuagacaagaagaaauaaaagcaguuuauuuaauaucacugcuagagcaauagauauggcaauaauuaaagaacuacuugcauaugauaauuugauacagggaugaguccuguguggguaaggugagacauuuugcuuaauuuuucucucauguacuuugugucaugcaaaugaagguggcuuugugguauucaguuaauuuuuuuucuuuacauuuuuuauuagguauuuagcucauuuacauuuccaaugcuauaccaaaagucccccguagccacccaccccacuccccuacccacccacucccccuuuuuggcccuggcguuccccuguacuggggcauauaaaguuugcguguccaaugggccucucuuuccagugauggccgacuaggccaucuuuugauacauaugcauuuugauacacacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuagcuaggaauuucauaaauucauucuuuuuaauagcugaguaguacuccauuguguagauguaucacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuuucugaggaaccgcuagacugauuuccagagugguuguacaagccugcaaucccaccaacaauggaggaguguuccucuuucuccacauccaugccagcaucugcuguuaccugaauuuuugaucuuagccauucugacuggugugagguggaaucucagggcuguuuugauuugcauuucccugaugauuaaggauguugaacauuuuuucaggugcuucucugccauucgguauuccucaggugagaauucuuuguucaguucuaagccccaauuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuuggaguuucauuaggucccauuugucaauucucgaucuuacagcuauucaguuaauuuugauugucaaaccauuccgauuugauuagauuagauuagauuggaguuuucuggacuaugcauucauuggagaccugaaaacuuucuggacucucaguuacagccuucuugucagaggaaauaauauauauacaggacaaaaugaaacaccuaaacaaaaacugccaacagaaagcuguucuuugccauuccuuauuugucuuaauugaugcagccuuggcuggcucggaucuuacuggauagaauaggcuggacuggaacuuauggccaucuuccuacgucugucuccagaguucugggauuguaggcaugcuuuacuaugcccagcuaugcacauacagauaauuuauaagauuuguaaaguuagccauuauaaaugugaaaccuuaaagaauuuagugaaaaagucugaaggacuaaagaggaaaaaaaaugauguuucaucaaagagagacuacaaugaugguguagacuuuaaaaagagacacaugaauauucuggaauuuaaaagcauagcaaaugaguuaccagagggacucaacagcauacaugaacuagcaggguaaguagccaacuuggaaauaguuccacagagauuaucugguguaaggagauccccccacaaacaaaauacaggaaagugacaaagagacaccaucacauguaccaauguaggcauaaacagcuccaugagauguucuuuugccacuuugugaguucuuccuucuuuuccccucuauccauuuucuuccuaacaccuuaacacuaaauuggagaaccggaaauuaaaaaaagaugaaaaaaaaaagauagagcggaaagggagugauguuaucacuagacuacuaauuaggggcaucaaguuucuuggggcaaguuugaucuucaugaucuucaugugcaugaguacuucacaaaccacaaccaacagcaaccaacaaccaaccaauaacccacacugccucuugggacccuagcaucuauauagccucugaaaagaccucagauuuccaaacacacagucacagaaauuaucuucagcuagcaaagucacccccguucuagagcgcaaagcaaaucauagucagcugcuggggaagcagccccauaucccacauugagauuauaaugaaaaucuauucuuacaauauuucuuuguuuuuaaagaaaccaaauuucucacuacaggucuagaagagaagacaaggauaauauuuaaagaaacaauuucagaaaacuucccaagugagcuaaaauauauuaauuuauacauucaagaaguugaggauaaucugaaugaguuaaauaccaagauacccauaucuagauacucuuguacacuuaugaaagugaauggcagaaaggcauugaugguagcuggggauugacacucaguuacaguacuuggguuggaagacauuucaucauuggauggaaaagacuguugaccagaaguuuugugucuagccaaacucuuaaaaaaaaaaucgaagacauucuaaauaagcaaaaccuagaagcguuugucaccaaaagaccucuauaacaaacugcaaagggacucccaauaguucaaauaaaagaucacaagaugccacaugaaauaaagagcaauuguaaaagugacaauagaucuaugaaggacggguauguauaaaaauacauguaauauaauucugcuucuaguauucuccaaacuacaguuaacagcaaaacuuauaaaauuauauuuauaauuugauauaugauuuuauccucaaaaggauaauuuagaaaaaauauuaucuuuaggaagacuacuaagaaaauaacuaaacaaauauaguaaaagaaacaacacagguaugugaaaauauacuagaaaguaacggaguaaugaacuuagaauugaagauauuaaauagcucagucauagucucauaaaugaagauguacugcuacaggacauuuaaguuuauaaaccuaacacauaauuucucuuuaauuuuaaaacauuuuuauuuucaauuauguuuguuguuugugugauacagaguauguacgcauguguccagcuuccugugcaugcuagaagaggaagcucuacgcccuggagcuguagguaucaggucacugggacauacuuguuggugcugggacucaaguucaggaucuguguuaaagcaccauaugcuuuuaccugcuaagccauaguuccagcacuuuccaccauaauuaagauaaauuagaaagagaaauuuuaaggaaauagaauuauuuacaguuuggucaaaccugggggagaaaggcuuucuuuuauuuuccugcuuuuccuaaaucagggucacaacuuucuagaaacgaugaaaaccauucaugcuagcuucccugagaacugacucuuccagugaagcuuaucuggauggcaucagggcuucaggugcuucaccugucaugagaagcuugaauuuggguuuguuggaucaguagucucaguaguggaagaggaaguacauuugucuugcuuuauacuggcucuuuuccugucaaggcuccagugaagguuuauggugagaguaaugcaugcauuuccuauguuaaauuauaugcucagauaauuguugaagagaaaugcuaaguaguugaugggauaucucucaauggauuuuuaaaaaauaggacauaaaaugcauagugguugcagaauuuuguaucccauaaguguugggaaacacugaccaccuuagcuguuacucagagucuuauccuaaugcuacaaauuagccuuuguuuucuuuauauuuucuaaggaacauuguuauuuuuaauggucuuccuauaauauuugcuaauauuuugcuguuucuaacuuaacaguagacuauuagaacuaauacuguccuaauuugaacaauaaguaaaaaaagaucuagauacacuaguaaaaaugaaacauacauucucauuagcauuuuaauuuaagguauaaaugaacuauuuugguugcgacuaagaaccuuuucuuguauuguaguuccaaaaaggucuacaaucaugugugguuacaagaagucuaguuuuaugcuuuguuucuugaauucauaaagcaagcugcccgaagguuuacaagcaaauacuacuauucugcuugaccacacaugugaguauuugggaucagacuugaggugcuaacugaaaaagcgauuguagggucugaauuucccugugguaugucagugugguuagacaggaaauggugggugugaggucacgccccaugcuggauagauaaagguugaucaacugcucuucaucucugugccuuucuauuagauauaugcauuucuuuggcucauuugucuaguccaguaaauguguuuuagauauuuguuacuagguuccagagauugaaaccuguuucuaauaauucucagucugcauuacagaggaauuagagaaaccagcaguucauggggagaaguauuagaaauccaugcagggaacuuuguagcagcugauaauuuaaagaagggagagaugaaagccuuuccuggccaagagugcagccuuugcccagcucugaugcuugcugugauguugggaaacaguuguuugugggauccuaacuacuaacaugccagaaaagcauugguccccucuaagagucauagauuggccagaugaguugaaaauauugcuuguuggcaacaugaaaaauguuggauggagacuuuauggagcugauuuuuuucuuuucuuuucccuuucuuuuuaaaaagaaaggguuuuugguuuuguuguuuuuguuguuuuguuuuuuuuguuuuuguuuuugauuguauguuuuaucaaauauagacuccaaacccauaugauuuuauucaaagcauaaacugauuuuguauuugaauucuauuuugcucucuggagaaguuuuuauaauagcaauaaaaaaugauaucagacaugccaggcuggcagguugcucagcagguaagggugccugcuucccagccugacacucuuuuaaguuugauuccuggaauccauguuguagaaaaauagaccaaacucaggccuauugucccuugaugucuguccacaugcuuaguguucuagcuucauccuguugcucugaugaaacacaagacuuaaaacaaccuagggaggaacgguuuauuuggcuaauacuucuaggacacaguccaucaggaagggaagucagggugggaacucaaucuagaaccugaagcagaaaccuuggaggaacauuguuugcucucuggcucucugacucauauuuugcuugguugcuuaacuggucaggacuaccugucuaggauuuguaccacccacagugagcugggcuuccuauaccuguuaaaauaagacaauucacuagagucacuaguauauuaguuaacauuaagacaguuuacuaaugacaugcccacaggccagccugacagagucaauccuuuaauuaaggcuuucuucuuagaugacucagauguaucaaauggacaauacaaguaacugagacaugggcacagacacacacacacacacauacacacauguacauacacacauguacuauaaguaaauauaaacauuucaugucauagaaaacuaaugaauuacaacagaguuauauugaaauuaauaaugauuauaauuuaaguaguaacugugagcuaauuaaguauaugcauguaucuguauacuuguauguuugugucugugugugucuguaucugucuaccaggguacuguuauuuagauuucaucgaugggaauauuggaguaagagauuuggugacaugccucaugccauuucaaggaggugaagcuuggauuugaacugucacugaagaccagccuuuuaaauacuacuuuauaaucguacacauuaauauccggugguuuaguauuccuggcuugcuuucaaaauccuuccuucuuccugucaauuccagagauaacauucgauagcuugacaacagugaccuuucuaaacaaauacagaguguuacagaaccagauggcccaagauuauauuuuauuuuucuggcugaaaauaaauugccugcucuacauuugauaaaguccaauagaaaaaagacccuucugugucccaggacuucaucaggccucauggcuagccagugcccuucagugugagccagucagaagcagagagcccaugucuuuauuccacagguuugaguagcgucuaaugaaauggcaaggaacaggguuggugacaugcauuuauucuggcccuuaguaaucauuaugauuuaguagaaggguucggaggaauuggcagauaauccugugauuuuguuaaguuguugugaguaaggggaugucugauuuauaauuuuauaaaccugcauguugugcaucucuuuuuggagucuuguuuuucuuuggggauuuuagguuuuuuuuuuuuuuuugauaaucagaaauuuuaauucuuauuguaaaaacauauuuucuuuauuucauauauacaacuaaugcuuguuugcaugcauagugccagggcauauauguagaugucagaggaaaacuuugcuggcuguuucguuucuuccaccuuuauaugggcucaggggauugaacucgggucauccgacuuacauugcaaggggcuuuuacuuguucagccauuuuacuagcauaaaaacuuuauucuugaccauucacaaugugaauaaggauguucuugacuguguuacacaaacauucuaagaaacuaauucuacaguagauacauaagguggucauaaucacaacaccucuacaaguuuagucacucuuaaagacuuucagacagggaaagaucagguugcaugggguaggcauaaaaaugauuaaagaauugaagagacaaugcuuaucaucacccagaauacaugaucaaaaggcacacuaggcuuggaauuaggagaccugugucuaugacuuggccuugccaucuguaaggaaaauugaacguguaauauaaauguucaagauuuuaguuuugucauuugaaaauaagacuuaaauaauaauaauaauaauaaauaauugccuuguuacauuuugagauuauuuugaggaaaaguuaaggacaugugcuagagugauuauaauuggugcucuuuacacagugauguuuaauauguaaaaguguugcaaaugucuguuguacuaauggucagugaaacgaaaauguauguuuaccuuuauagccauugcuucaaaggacuaucacaucuauuacuuugggaugcaaacauggcuaaugauacaucaaugcauaaaaaguugaauacauguagccaccaaaaagaaaaaaaauguccaauggaguugaaacuagaaaucuauuugcuuucgauccucuccugugacucacacccgcuugccugcauucugucgucccucgucucucagcaucaccuucuccuggucuccugucuaaguguaugcucacaucuguuacauagagacacaugcacuuacagacuaagauccacuaguaagggagagcaggcgguuuucuuccugaguucacuucccuugauauaccucuagguucauccauuuuuccgcaaauuuuauuuuucuuuauagcugaacaauauaccacaguguuuauguacaguuucauuauuugucuguugauggaugucucagcuguuacuguuucauugcuauugugaauagagcagaaauucauaaaucucugugguaggauauggagauauuugaguauaugucuuuguaaaaaagauuuguuuauuuuuauuuuaugaaugaguguuugucugaaugugcauaagcauauugcauuccugccuguugcuuguggaaggcagaagaucagaucccaggaccuggaguuacagacagacaguauaagcccaccaguguuuguacugggaacuaaaccuguguccucuccaagagcagaaagugcucuuaccucugaaccaucaucucuccaggucauugcuuugaaaacaagcuaaguuucauuuaugcauuuauaugugugugugugugagugcgcacguguaagcacuaggguacuuguagauccaagaugccaacaugcaggaguuguuuuuuccuuccaacauuuuaguccugggaacaaaacucagucuuggaagcaaguaucuuuacauguucagccaucuuuauagccuugccaaguguucuucuucauaacaaguaagcuacgcauguugguccauggcuauaaugucaauauauaugaaacugaggcaggauuaugaggucaaggcuagucugggcugauuagcaaguucuaggcccucuugagcaacauaaugaggauuuauccagacaaaacuagaagagaagaguuaguaaacugauauaucauaaugaggauuuauccagagcaaacuagagaagaagagugaguaaauugauuuaucccuucuacucuuugccauucugggagcuugagcaugaaguccuucaugugggcccuuagucacauauuucuauuuaccuccaacuuugucuauucuaauuuauauuaguuuuaacccuauuuuguauuucuuaauuuuauauuuuacaauuuucacauuguuuuuucauaauuuguuacauucaaauccauuuagaauaagguugggcuuauagacaucauguaaacuaaucacuuuaaaggauucagaaaguucuuuguugaaacacuaggcugaauuaugaguuuuuuauuaaaauaauaaaauuuauuuuaaaauaugcuacucaguauugauauucuuuuaagucaucaaaauaauuuauaauaucuaaaugugccuuaaauacacaugauauuuucugaagcuaaaaguaauaaguacccaaccaguuuuuaaaauguauuuggaucauuaaacaagauagaaauagaaaaaaaaaaaacucuuaugaaguccucuaugaaagcaaauugugauaaguuccuaauuagacaaaaacuguuccaucuccaagggagaauacucaguguaauuguggcuuugaguaguguuccuucuguuucuauuuuguggaauaguuugaagaguauugguauuaagucuucuuugaaggucuguuagaauucugcacuaaacccauuugguccugggcuuuuuuugguugggagacuuuuaaugacugcuucuauuucuuuagggguuauaggacuguuuagaugguuugucugauuuugauuuaacuuugguauuugguaucuguuuagaaaauugaccauuucauccaguuuuguugaauauaggcuuuuguaguaggaucugaugauuuuugaauuuccucaguuucuguucuaucucccuuuucauuucuuauuuuguuaaguugaauacuguucccguguucucugguuagccugucgaagguuuaucuauauuguugauuuuucucaaagaaccagcuccuggcuuuguugauucuuuguacaguucuuuuuguuucuacuuugucaguuucagcccugaguuugauuccugcuaucuauuguucuuggguguauuugcuuccuuuuguucuagagcucucagguaugcuguuaagcugcuagugaauguucucuaguuucuuuuugaaggcacucagagcuaugcauuuuucucuuagcacugcuuucauugugucccauaaguuuggguauguugugccuucaucuucaugaacuucuaaaacgacuuuaauuucuuucuuucuuccuugaccaaauuaucauugaguagacaauugcucagcuuccauguguauguggacuuucuguuguuuuuguugcuauucaagaccagccuuaguccauaaaaaaagaauaaaccaaacauucaaagggaggaggggaauuaugccacaccuccuucuguuauguuagguucuccucuuaggaaucauuaggcagcccaaaaagcuucacagugucagcguccugccgucuccuccauuuuugugauugcagccaaacaccagcagaaccccuuaggaauaugaagccauugugaaggucugggacucacacuguucauuccaguuccugucuacaugugagcuuucuuaaugugauccucugaugucaaugucagcguuuucauauuguggaugaaacugagauuuccucagaggcugaaaauuucuguaaagcacuuucuacacaguaccucauccauauccuugaauguggccaaagcaccuguacuuucuuggcaaauuucacaaugggguuaagauugauuccgaugagauuagaaggaugggccuguauauauuguacaauaaguacuguguagcugagacuguugauaaacuauagcugcuugucagggggaacaugucaucauuguucuaggaaauaucguugaccucaaacucaaacagugucugugcuuuggaauggugggucuuggcaucaguaaagguugcaacauuauccuugaugcccauagcuauuaucuccccaaugggacucccgcagauauuaauguucugcuuaaaguuuagugucaguguguuuguggucuucauauccccacagaaaugucuuuaucuccacacacagagacgaagggaucaggguuacuuggauaccaagaaaaucaaaucacacuaucuccacauccccuguagccuuuuucuuuguucagagugcccuccuccagcaagaagacccuugcagucaugucaaagaauuccaagcugagugaaacccacccuagcuccaggcuauaucuguuuuggcaagaacccauccacgucuguggcuucagaagaacuccaguguucacaggggaccacuguuccuuaagugcagccuuccuacaggcccuucccaccauaugccuuagcaaaccauguaaguuguagaauucuaugauguuacacuuuguagugauguugcuguuguuugucauucugcugaaaaccuuauaaaauuauaaaauacgauuguauucccauuagaagaguuccuguaaaaaaaauuaagcaaaagcaguguuuaaaacacgaauggagauaacacucaugagaacugggaagauguuugugcucugucaguagguaguauggauguugguuguguucuccaaaguugagauggaaacuugauucugucaguuucuaguuuguggcaguggggcuuaguguuggguguauugugaccacuuaccccaucuucccuucccugccuguguauacuccuuaauggaaccggauuucuauuuuuauaugugcuuuggaucuaggguuauccuuuacuuauucaugcuacacugaugaauucuugacguuuccaaacaaauuugagaugugagaauacaauggugccucaucaggauuggaaaggggaccugguaaaagccacagucuugauguuuccaucacacgagcuuuccagugucuccugaagcaggguuacaaucacaaacagagagguguaauuuuaaaacuauaaucuugcugugugucaauguuuugcucacauuguugauuuuuauauuugauuauaccuuuguuaaugcccuuguaauuaaaaguuucauauguuuuaacauuuauuagaaaguaagagauaccuuuaauguggaauuauaaaauacgauuguauucccauuagaagaguuccugugaaaaaaauaagcaagagcaguguuuaaucacugaacgcaaacaaaaucaaagaacauuuauauucguaauuaugaacaaucaccucaccuuugugugcauuguagauacgacguagagagaguagcgccauccagcuucuucuuaagcuccauuugguagcaggcuugggcagcugcaucuuuaccuguugugccaucuuucuggucccaguucuauggguuuuauagugacucucucuuugauucauuuuuuaaaaaauccuuucuucauuugauaugcucuuuaaguuugaaaacaaucaaaacgaauuagauuuuugcuuauauucggaugggagcagacuagaaaauggacgguugguggauagacugcaguguaagcacggguguccgugaguugggggacuuucugcaaauuucaacuugugucuuuauuuuccuuucuuucuuuuuguuaagcaaagguauagaauucuucucuuguuggucaacagucugggcuuucacuuggaugcuuuuuauugaauugauauagagaugucuugcaucugucuaagucuugccucuacuaaauaugaaaugaauaucacaaaacugguaggcaguuuuucuaaaauaauaaaugagugagcuauuauacaaguguguaauucuaauacucuacuauguuguuacuuuguccuucagaauguuuaauauuuuauagugaaguuaugaguguuuucuuguuaaaccagguaaaaauguuauaaauguuuuuaguuauccaaggcuaauauugacuuaaauaggucuaggguuucaugguugacagcuacagauaauuaguuuuuucuucuuuaacaaagaaagcagaaggagcugcauguaguucauugccuucccuuucaucuuagcaguaauguauguauuuaaugcaguuccuuagguucagugcuaagcugccucccuugcauacaagaggaguggcaaauggaaguugagcacauauuugcauggcaagggugcagugauugaccgaaacuuucucucuauaagaaagagcagugcugugcagcucagaagggggccauacacauaauuuuaagaccauagagcagauugauaaaacgaauugugggaauggaugguugguugguguauuuagguaucacugcucccuuggcucuagguaaagggcacagaugggcagucguaccugauugaugcacaugaagaacugucaaguauauuaauaguauauugcauauaagcauauuguaguuuaagauugauccaaauucuaagucaaacuaugauuuuauaguacucaguaacugaacuuuuuuuuuuuugucugcaacugagucauuauuuaauggagcagaagcaucuauucaaugaaagacuuuagggccacgcauugagcuauucuccacugaaaauauccacuuucccauguaauaaauauuucuggaaagauauucauauaugguuggugguuucuguugguaacaguagcuaagugaacauguuugaaaauauucaaaacugucuauucuuuuugauuguugugaaacguguaggagauguagguagaaagacuguuguguaaaucucucugcugaggucaggaugcuggccuuuauagcauaucauggccuugcuucuuauuggacacucugugucugagauagggagggaaacugagugucccuguguaguggccagugggaaguguagcauugucuucucuguucauugcuguauuuguuuuguuuguuuguuuguuuuuaguuuuaacuuucaugauguugucuuuggaagauugcuuuauuuguuggauaucuucauuuauauuuguuagaaaugcuacucauguaacauuuccuucaaaacauaacauaaucgaaggguggauauuuuuagacccuucggaaaaagucauaaguagaacucugcuucagaaauauuucuaaaucguuaaggcauacucauaagcauaaauuuuaaaauaauuucuacauugaaagucuuucucagcaaucgagaaauuagucacuuacuugugcuaacaaaucaccuuuauccccugaggggaggcuuuaauucagugauaaguuugauuaaauacacguuuaauauuuuagauucauauaaaucaauuacuuuagguguuuuuaggaaguggacauaaauuuuacuguguuuuaugaacgugaauaacucugacagcuggaaggaagugauuuuuugaguuuuggauccagagaguuacaggaagcuguaauaaaaguccaaggauagcagcaaauuuuaggcugguuuaauuuuuuuaagauaagaggcggcuaugcuauuugauuugauaacuuugcauuuaugaaauaauuguauuauaauuaaaaaaaccuucccuaagaaaguaagucuauuuuuugauauuuugguucuaucagguuccuuguuaaucucuacuuaacucugaaugucuuugcauuuucauaaaagauauccuauaacguucuuuuauauaagacccccuguuucauccuuugagcuacugcccauuuuuuaaauauuaaaguagaaugcuagauuuucauucuuccuguuugcuuccuuuuaauucagacuuuauaaguuggacuuaugcauuucguaaagcauugcuuuuauuauaucacauauuaagaagaaccuagcaaccuaacuuuugcuugcuucagaaaagagaaaacaguugagugguaugccagugaagagaaagggaagaacuccugggcuaggauuagaaaagcauagcguuuguucuuaguucugcuuauauggucauagcaagcauacuccugcugguccuguuucccacuuuguaaagaguguuuguacguacauugucacuuucuucagaugcacugagagggcauuggaucccauuacagaugguugugagccaacaugugguugcugguaguugaacucagggccucuggaagagcaaucucuuaaccacugagccauucaacagaaagucccagaugccaggaaagcaagaggcucccaagagcccacagggauggcauuagcugcaauacccaacaaaggaaagugagaaccuguagagaccauauccagaggguaggcauguccccuugguugaaggauggggccacccacccaucuccaaaauuuuaaccuggauugcuccugucuaaaaggaauacaggacaaagaguggaucagagacugaaggaaaggccauccaaagacugccccaucuggggauccauuccacaugcagacaccaaacccagacacuauugcggaugcuaaggacugcuugcugaaaggagccugauauagcuguucccugagaggcucugucagagccugaccaauacagauguggaugcauucaccuaaacacuggacugagcgcggggaccccaguggaggaguuagggcaaagacugaagaagcugaagggguuuuuaaccccacaggagaacaacaauaccagccaucuggacaacccagagcucccagggacuagaccaccaaccaaggaguacacauggaggguuccauggcuccagcagcauauguagcagaggauagccuuaucuggcacuaaugggaggagaggcccuggguccugugaaggcucgaugccccaauguaggggaaugccauuuuggugaggugggaguggguggguggguuggguugcacccucauagaagcagggguagggaggauagguuagagaauuugcagaggggaaaccagaaaaggggauaacauuugaaauguaaauaaauaaaauauccaauuucaaaaacggggagaaaaccagcuuucguuaauauuaauauguaaauguaaaaauuaguaucuaaaaccauauacccuaauaauugaaugcuuuagauggucacagauauguaucacaaucuuaguaaaugaaaauaucgauguaaaauaaauaaauaaauaaaacaaaaagcagucaggcugagcacauaaagaacagcaagcagguaagcagcuuucccgcauggugucugcuucaucugcucucgugccuuccuuuaauguugcacuguagugugguaguguaagccaacuuagccagcuuccuccccaaguucuuuugcucauguuugaucacagcaauaggaagaaaacaaaggugguauucaucuuucucaaacucuguuguuugaaaguaguuaagccgccuggcgugguggcgcacgccuuuagucccagcacucggggaggcagaggcagguggauuucugaguucaaggccagccuggucuacaaagugaguucuaggacagccagggcuacacagagaaaccaugucucgaaaaacaacaacaaacaaacaaacaaaguagucaagccuuucuccuaauuuaauuucauuuuuccuuccauuuugcuguaugugauagcuuuuauuaucaaggaaaggguccugagcauacucucuccuuguaauuaagcuccuggagaagaggauaauccuuuugcuuuugcaguuacuacuuaaggauauauuuauugagguuuuuuuucuguaaaauaaaucuuagucaaaaacugucagauuguuagaagaaguagguuauuaaccugcuggugaaccaaugguguucugauguauagagcugaagaauucaaaauuuaaggcuuuugaggaaaaucuuugggaaagaaugacccaagaguuauuuucauguuagagauucuuauaugucauugaagcuccccuuuaaacugcauaucuuaauuagcaaacaagguuuuauaucuuauugucauaguacacacaguguaaagagcugugagaggugguggaggugagagaggcuguuucacugguacacuuuuacaucuguauuauucuucucaaacaaauugcaauuguuucuucaauaggugaauuaucaggcauucccaucaauguauaugucgucaccaucuaguugauugcuuuuaacuaguuaguugaaacuacuuucaaauuguagcccagacugacuucaaauucauaauucuucugccacagccucccaagugcuggaauuuauaaguguaauccacaacaaccuuguauuuuuauuuguugauucuauugccuacaauuuacucauaguguaauuuaguaauuuuauauguauaguaauuuuugacaaguguguuaaucauguagcauaguucuaaucaacauagagaucauaucugagcaugguguuuugucuguagucccagaugcucagaaggcugagugugaggauugauuauuugagcagaauggugaguuucugugugggguggggagaagaagaaaggaggaaagagaugucauuuccguuguuuugcagagauuuguccuaugacccauucccuugcuccugaucacaguugugcccuuuguagaauuucauacugauaguagaauuguucuacuuuucuucuguagugccagaaaucaaaucuagggcggcauucuaccauggcugaguauagaaauuguaggguauauuguucuuacacuuaucuucuuuaacuuuuacccaggucaguaguuuguuccuuuuaaauuacugcauaguagaucacuauauggcaauaacacaauucaguuuuucugugugaaauaggcaaugagaauuagauuguuucucauuuaucauguuauaaauaaaauuguuacauaaauucaauauaaguauuuaucgggucauauauaguuuuuuaaaucuuacccagaucauuuaauacaaugaaauaucaguguauuaugguaagguaauacuuuacaaguauauacuaaaguguuucucacaguaucuguacuauuugacauugucauaauguauugauuuuaauugauguauauucuugccagugaagcacgauguuaauucacuucaguguuuauuuuaauuuguauuucccugaaauggcugauguuuuaauggcauuucauuuauuuguugucuuuguacauauuuccacauauucuggauauauacuuuuuugggcagaauuauauuuugaagacuucuuccagccuuacacccaaaucuguggauauauguuuuuauuaaauuguauuucuaaagaauaagaaggucucauuugggggaauuuagauuuauauauuuuuuccuuuggguuuuuauguuaauuuuuagugucucauucaaugucauuuauauugugccauuuuuuuucuaggaguuuauaaucguguucuuaguacuuuguguuuguguguuaacuauuauauaugauguuagucaacauuauuguauaucacauuaugggugaguuuacaguuucaggaccauuuguugauaaguuuauaauuuuaccuuuuaauuacauugguauugucauuaaaauuaauuggcuggauuuacuucucuguuuuugucauugucucugugucaguaauccuauuuucauaauuacugagacuuuauucaauuagcauuaggaaguguguaaauucuuccauuuaaaauuacauuucaagauuguuuuacuuaccuuaagcccuuugcauuuucauauuuaaauuugaaagcuaaugagucagguuucucgugguaauagcacuccaccuuaggcuuucauguguacuaggcagugcucuacaaccaacucuaccauauaauccuuuuuuaugcuuuaccuuuagacagaguuacuaaguuguccagacuggccuugaacucauucuguagcccaagcaggucucuaaaugguaagccucuugccucgccuucaugagugacuggcacuauaggcuuaugccaccaagccuagugucauauaaaguuuauaagucuguuauaauuucauuuacuauagauauguuuacuuuucacaggaugguauacaaugauccugguuucuugauuuacuuagauauucuuuagugugucucacuguugcuuuaaaaauuuuaauacugaguuauguauuuuaauaaaaguuuauccugucguauuuuauauaaugaaugguauauauaaggggauuuauggauagaauuauguguacucaguauuuugucuuuucuuuuguuucaugguucuugacaguuuuguaucaguaccaugcuauuuuuauuucuguaauucagaaauauagcuugaaaucuggaaugaugauacacauagcacuguucuuuuugcucaggauuucuauguauguauuuacacacacacacacacacacacacacacacacacacacacacacacacacaggcugaaguuaucugucuguuugucugucuaucuaucuaucuaucuaucuaucuaucuaucuauccauccauccauccauccauccauccauccauccauccauccauccacucacuuugcugaaauguugacuauuuccagacuuugucugguggauuuugggguuucuuguacauaguauuacaguaucuacaaauagggacuauuugauuuuuuucucuuuguaucacuuuuuuccauucucuugucauugcucuagguagugcuuuaagcgcuauguucaaaaucaguggggagaguggacagcccugccagguuuugauuuuuaauaggauugcuucaacuuuuucuguuuaacauggugucaucuguagcguugucauaucuagcccuuauuauuuugagguggguuaccucuacuuucucuagagauuuuaucauaaaggcauguuggaucuugucaggccuuuuaguauaugcugugaugguaguauaauuguuuuuuuaauuguuuaagcccauuuaccugguuauuacauuuauugacuuacaaauguugagauguccuaacaucucuaugguaaagcaacuugauugaggugucugauccuuuugacauaugcuuguauuuggcauagaaguauuuuacugaggguuuuugccuucauguucauaguaaauauuggccuguaguuuucuuuuguugugucuuuuucuggcuuggauaguagagugauacuggcuucauagaaguaguuuggaagagcugcuucuguuucuguucuuuuauuuuuuuaaaaaauaauuugagaaauacugguuguaggucuuuaagagucucguggaauuuugcugugagucugucuuagccugaucugcuauuaggaugguuuucacuacauuuugaucuccguauauuucuuuuuuuuuggggggggggcagcugucuguuuaaguuguuggucaguucuuuaguuuaucuuuggugguuuggauuaauauaaaaaccuguccgguucuuuucuaauucauugcaaauuaauaauuauaaauaauucucauuuguuuauuuggguucuuuccuucguguuuuuguuuguuuguuuuuugauuaacugguucaagggucuaucagucuucuuuaucuuuaaggaaucaacuuuuagguuucuuuguuucuauuucauuaauaucugcuuggauuuuuacuauuucuuccuaucuaguaaacauuucuguuugguuuauucuuguucauccauuuuggcaauguauucuuacggagcucggagugcuuugcuucagguuuuucuggcucucagagucuccauugagaaauucuuguuacuccaauugguuuucauccccacgugacucgugggcuuugucucgcagcuuccaguucuuucuuuguucuguguuuuagucuucuaacuuuagugugcuguggauaguuucuuuccucaucuuauuuauuuggugugcuugugauggggagugagauaucuccuuaauuuggcuaaguucugugauacugaugaaagcccuugacuugggacccuccuucuuauauccuuauaauucgauaauuugacauuuugaugcuuucccacaguaccugcacguuuguuugugugccauaauuuuuuucauauucuugcuugugugguucaguccucuuguuaucuucaaauccugauauucuaucuucugcuuaauccaaugugccuguaaggcuuucuccugcguuuucuaguuggcuuguugagauuuucagucuugucuucauuucaccaugacuuuucuauguucauauuauuuauuuauguuuuauugaauuguuuucaaaucccgaauugucuuacucauuaagccgaucuguguugccuugggcgucucucagguguucaucauuauucuccucauugaguugauuuuaucuuguuuaacucugaauucuuaaugaaguuuaugauuggacuuuuaaauucuuggguucuccugaauaauucucacuggaggacauugcuguagaaucaguggauuugggguuggggguggagacauaaugucuagaccuuucauauuguuuaugguuuuucauugagaccuggacaguuguagucaugcgucugaugugaaauucuaggaugacucuguugaguggagguuuguuuuucuucuucuugugucccaaucuugguugauuuuagaucaguuaugaaaaguuaggucugcucuuuagauacucagggacgguuuucaauuaguggugugggucaauccagcccauuguuaaguaugaaagcauggcuaugggaucuaaggcuagaucugcuugaacugcugugcaaauugugcuacccaugcuauaccuggggucugagggucacaugggugggcugcaugggauuuggggcucuccccagacuaggucuaccuauaggaugugugacuaaggcuaggccugagacuuggagauaacauggggaggugagguuucauggacucagcaggcuggcauaggauguaggaugugacuggagccaagcauggugaugggaaaggaggcaggugcaguagauucuauaugacucaugucuagugugcaagaucuaggcuaaauuuugugguuuggaaagaugcaggcaggcuaggguccaggaaacucaucauugcauugaagcacuggaugccagguccaugauguuuuuggaggguauauacugcccagguaggcuagggucaggcaggcuuuauagacaggacuaguguacacacaggaugugugagccaggccaagccuggaaucugagaaaggugcagguaggauaauguccccaggacucaccaaauggagcaggaggcacaggaugugcucccaugguaacuuggagguugaaaggggguugauuguugauauuauuguauaacaaauuuaaaaauucccucuuuguaggcauggguggcucgugcuuuaaucuuaacacuuacgauacguagaucucugugaauuggaggccagccugguuuacauagugaguuucaggacaaccagcgcuuuguagagagaaccuguuucaaaaauuaaaaacaaacuaaacaaaaacuuucccuuaauccuguucacauuuuuaccuaguagaaaacgaucuuccuggcaggauuuaguuuagcugauugagugccuaccaugcacaugaccuugguuugauucuauauucuauacacuguucuuagguaaugugagugcucuaauugcugcacuugagagucgcagcaggaggaucagaaguuuagggucacccucagcuacauggcaaguuugaguucagggugagguuccucaggagaaacagaccauaaccaaaacaaaacccuauguuuaaaacuauuuuaaauaauacaauuauugagaagacuuauagauguauuccaauuuuuagucaaguuaggacuugaccuggugggauggguuuuacauguuaauauauaucuccaaaguacacuuuaugaaauuuugaaugaggcugauaaaugcuauuuuuugacugagauaauauuuguuaaagauauuacggagaguuguaaauuugaauuaagagaauaaaaauaaacucuauucgauaauaaacaaaauaugcugaugauaugaaaacacuuuguuguucucaauauacuauuaaaaguauuagaauuucagcuuuaccauaagcuuuguaacauuuguuacuuacauuuuguuuaugucuuguugagaaucugauucuucuuuggagaagcuuuguaccuuauuaaucucuuagcauauucuuguuuugauaaauauugagugucauuuauuaggcuaccagacauguaaacguaugugaaaauuuuagcuugcagaagaugggaucuccuaaggcgcuuaagcagagccuuucuccguuuucccucuuuacaauagucaugaacuuggauuuucucuccuguuuaacuuugcucauguucucuuugaaauggauaccaccuacauaaugauacaacaugaaccaguaccuguaacuaagucauuaaaugcauuguggauacugugcauggcuauguuuuuaugaaguaucucaugccagcugcauuugcauuucuuuacuauauggaaugacuuuaaaagccauggaacaaauuacucucuuaauggcagccaugugggugcuacuagaaugcauauuuuaaauaaauaauaaagagaaagaaauaagaaagaaauuguacaucucagcuggauguuauaacuaaaaaugcuggauuugauaaauuuugauaaccugucaucuuauaaccuguugucuuaaguaaaagucuucugugagaacauuaagugauuaaagucagacugcgaugggauuuugaaagacaugcauugcucucuguuguacauacacgcagccucuuuguuucauuucucaccauagagacaagucuguauccuugggagugugaggaguuagcaguaccuuggagcuuguugugguacagaguauguguggcuuauaauuaauauauccuaauggaguuggugauccaaagagcuguuuaugaacuuuaucauguuaccuaauauucucccuaagcaugccuuugggaagggagguaaggaguucuaagagucugugaaauccugccucagcauaagguauaaaaaaaaugaaaugacuaaaugauacagaugacauuuuaucaagauuuuaguuuaucaauaucaaguuuaaugcugagaacacuaagguuaagcauuaaaaaauacauuuugugguuuucaaaaauguguuuuuaacauguuuaucugcugaauccaucagacuuagagugaguggagagcauuaggaugacgauugcagcauauuuuucuagcaaugucaaagcuauuaugugacacagguagccaauacguuacguuaguuuuaucccuucaucuguugaggcaaaacaguguuuuuucucuuaugaaauaauugauuccaccauuuaauuugauuuguaucucauuauaagaaaacuuugaauuuugauauguaaaauuaguguaauaugauucaauuuuguagcccucuacauucuugauauuuuuuuguuuuuuagucuugucuuccaucuuccauaguuauauccuuuguaacaaagcuggcaaauuugugcuuucauaccaggauauugaaggcaaagugacaucccagguuggagucccuuggacuacucuguuuuaaaaucaaaaucgcauuuuaguagauucuuuccuucaauauugucaaugagugguuauuuaauaaugauaaucauaaugguguuaaugaguguaucacugugugcugaggugccuaccucaugagaaggcugggaaagcagacuucccaucugaugcugaaggacagauaaaggaaaacuaggaacacagagcugaguaccugauccucacaugugcgccaguggcagaguauggguagagaaagaagcaguguuagccauauaacagcuuagcuguuuuuuauuauauuuuauucuuguauucccauuggauggaaacuacugucuuugcaaaugacgagggcccaggaguuguaacaguuguuuucagcccuguguccugauaccuucuuccaucagcagggccuuguucuaggauucacuguguguguuuuccuguuucacauguguguuugggguagaaaucaugucuguuuaucugaaugcaaagccuuuggugaaauucuuaggauucuaagauagacccucuuuuuuauaggguaacagaggccucugagaagacuugucuaaacuauagaugaggaaauuuguuauuaaaguuaaauguacauuugcaguuagaguaaaaggucauuuaauacucuugcuugauaucccacuguugugcaagugaccuucaauuuaaauaugagaagaaucacauaguugaagugguuuaaaauugacuaagcuucugcaggucugcuagggcgaagacuuagaaggaccaaugcagugcagugcagugcagugcagugcagugcaguggccgauucccucccuccccuccuuccuucuucuuuuacacucguuuugcagaaagcuguauugauaguuugcacuucucauauaucacauucccuguaccuacugcuaugauagguuucuccagcuauuacucaggugaacaaggugcuuaguuaggaaagugccccugguuuuucuccagaaggaaggcacuauauaguucauacauagaacagagguguugcaucuccauacaguggagauauaaguaaauuauuuuaaauauuuccacagaagggauuuaucuccacuaucuuuucaauuacuuaucuauauaagugcacuuuuguagauuauuaagucaucaagcaucaauucuuuauuuguaaaauuauucccaucuugcucauuaagagcucuuuaaguugucaucuaggucucacugauaugccuuauuguuguauuauugagaacuuuuuuuucugauacuagagaauaauuuaauuuucaugugaacauuuccuaaccugcuucuauaaucaaccaucucuccaaggaacccugguuccuuuuacugaagacuaauacuggaagccaaaaaccagugccagauguaauugcagagcucuaaauccaaauguugagccauuguuacagguaauacuaaauuaggucauuguaauaauuaaguuuuucugaaauguaaaauuugccuuaauuaaaugaaauaagacuaggauuuuuaaaugaaaaauuccagaaaauuuauuauaucuuucuguuaguuuuuaucaaaugucaguuuauuugagaugucuuuuuguguauguguucuugaacagaaaauguugggcaaaaaacuuaaaacaugguaauuugaaacguauugagauuagcucuaugcuauugaagagacuuuaugcuccauuaggauaauuaacagguaugaacucuggaaaaauauaucuguggaauaauauuuuauuuuauaucacuaaucauuuuaaauuuuauauuuaacagaagauagagaauauuuuacugaggaaagaagaaagugauuaagagaugaccauucaacaauuuaaaacuaucuggaugguuccuaucuaguuuucauuuucugaacaauaucuguguagauuuugccuucugauguuggaauugagaguuuuuuaaccugggaguuuauauagaggucagguaauuuuuagaggcuuuggaguagccuaugugcuugaauuuguaaucuuguaauaccaguggacaguuaugaaagccauuuuuuauuuugcaauaccucaugagcauauauucucucuuaguuuuuugcauauaucauuuuaucaaacagacugaauuguaaagcuuaucaguguaagaaugacaagaacccaugcagaggcacgaauagaagaaacaaacaaaauuuuaagaguuagauguauuaguugucuugaucuauauuuaaaauuugguugggguuuaacuccaaagaguggccuuuuauauuaaauguagguagaaacguauuaaauaaauggagagagaucccauuauaauucauaagaaauagcacaugaggcaaagaagcagcagggaaaagaugaagugguagugaacgaggcagcugucagugcaugaggaacugaggcaaggccaugggaaugugugagggggagagagagagggagagagggagcccuguagugagaacagcaguuuaucaggguguggagagcaaagagguacaguuguguguugauacuggccaagguuuccagagaaaacauggggaccugcguuguuguuuguuuauuuuugauugaacauaaaucuugagccagugugccuaaagucuagaacauggccuuuauugaaccauuuauauuguuaggaguuucuacauuuagucauuuacgggaaacauuuauuauaguguuagguuuagaucauuuauguuugguugaaaauguccagugcacagugcauucacaguaugcaguguauugugguguuuaauccuuacgucagcucuuugaggaguggcuguaaacuaugacagauuuacaucgaggaauggggcacagaggggugggaaacacgaugccaaacacauuugaacuagagauaaaaccaggguaccauguuucaguaauguuucacguuugugguaaucgagauagaaaaucaacuaguaagcuaagcauagguguagacucuuuggguuugagacaaccauuuauauuuagggauuucuuuauuuaguugauaagggaaacauuauggugauuguuagguuuagauugauauauucaguugaaaauuuggacuuugaacaucagcugugucuccugaggaucucggaguguauaggaaguuugcagugauagcugauggagaggugugcaagugaaguuacuuagaccuuuuagcuagucaccacucguuugaauugggguccuuugcccagauccuggaaggggguuggggacucuucuuaggcucugaaaaacugguuguuagaacauuaguccaugagugaaggggaaaaaagaaugagugaaaucacuaaauuuuaagauaauuuuuuaaaaaagccaguauguuuacauuugcagaauaaaccucaagagcacauuaauuauaugucuguaguucuugaaguuaaguaggcuaagugagggaaaagugcaugauuuaaucuggcuuuauugcuggcuaaaucucuaggcuagccauuuuuuccuuuuaauaaaaauccuugcgguuccuuuucuucccauuagcucauaguugagagcucugugaaguugucugugagacagcauguauuacacuggccugauuaaaauuguucacaagagaucaagcagacaagagacuuuuagcauaauuaaaaaaggacggccagccuuuaaagauaagauuucagagauuuuugaaauuuauaucuaccuguagggaaguaguuuauguaauuagauucugguugucuuaugaagccuucuuaauucaugcauguuaucuguguauggaauaguaucuguuuguguaggacaugggaaauuugcuuaggggagucugaucgugaaagaauaaaauguuuccuuggaaagaucacaaggugauauguuaaaaaaucauuuaccuucggugguaaccuguuuuauuuuugaaagaaaacucaguagugaaguucaagauagaaauggaagaauuaaagcaaguugcaccauguucugaggcuccugugagaaaguucuaccagcuuuugggaaguagucuccuuuguuugguggguuucuuagcccaggcucuuauuuuuguugucuuauuaguuuucaaguuuuguauuacugagcccugaaaucucucaguuauucccucuuuacuaucauguuucaaaaaagugauuauauuuaaaguggguuaaaguuguuucuuccuuugucccuuggaagccacauccccugcugcucacaguguguguguaucuuugcuuccagaggcuuccccccuccuuuaguauuuuaaaaaaggcauuuuaguuuuucuucagaacggagcccugguagcauaaucaaaauguuagugcuauaacaagagagcauuucagagaaaaauuacuaaggugugagcuuuguuguuuuauuuuuuugucuaccuccacaguuaaggcaucugauccacacuuaaugcaucuauuacgagaaaccuccuuaggacuuuccuuccaugaagaauggagaagagugcugucuuacacagaagauugccucagaacauaucuaguucacugaaauaacaguucuaccuaccaagaacagauggauuuuguaacuuuaacuucuguauugcaaguaauuauuccuguucuauuaacuauaacguacagcagcaguguccgacaagaaccaaagcucuuucccaaucaaguguggguaagagaacaagauggcuguagaugccccccaaaccagggugcacuacuccagcuauauuugggaugauuuaaggaaaccagugaaacacucuuuggccaggagcaagaauauuuuaauuuaaaaccacaaagaacuaaagaggaaggagccuagaauuucaaugaaggaagguuuuuucuuucuuucuaguuuugugauguuucauuauccaugagagaaauguacuaaacaagguugugucuugaaacaguaugaucucugaauaguuuuauuuguaggaggaggucaugaaaagguuucucucugguuucuucuugacaagcaaucagaggaguucacagaucucauuucuaaccauuuuaaagacuugaaauuuuuugcaucaaauuauauauugcuuuugcuuuugauuaaauaaacugcuuuaacagauuguacaaucacguagcccagguaaaaauaguugcuucaauuaagacauacugagaugaaauccuacagaauugauauguagcuguguuauuaugauuuugcuaacuaguuuaucucugcuauauacugcacacacgucuuuaccucgccuugugacuucagacacugguugguauggcccuuuguucaucauuguacuguagaaaguuagcaggcacugaaagaauugaacaugagucaguaacauuuuuguaaaaguaacaauucagaugagauuacagccaauauuuuuaggagaauggucaucagugguucaugucuucagugaaccaggaagcauucaaauauuaaacugugaagcccaaaagacuugcccgccagagcauuuucuauacuguggucucccuuaacuuuccuuaaccugauguucauuuauaaaaugaaaauaguuaucucaguguuauaaaguuuauguguacaauagauugccugcucaaauuuccaggccuacuucaacauaauaacuuguaggcauuauuauuauuaaauucuuaugugcuuaaccuuguguaauaaauagaaauuuguaauacaaacaaaauacucacuacauaaaaugaaaucuucaaagccuucuuuacugaucuucuuaggugaaugauaacccaauugcccauuaauauaauguauuaaauuucauauacuccuauaucuuuauaaccacuugaaaugcauagacaguucuacuuguccauauauuuuguuaaugcagcuaauacaaugcccuuuugauguuucuucuaugaguauuaauuaacuuauaaugacacacaagccacaucaaaucaguauuucuucuauugugucuaaagauaggacauuucugaagcuucugauuuacaggcucagaguauuucuacauuuuccagauuuucugaguauugauuuuaaaaaagcauuuaaggguuauuuuauauacccuaaacuguaccuauuuaacaugugugguuuguugcggggcgggggugugggugugaugcaguguaucuuugcaauaugaugacuauaaucaaaauagccaauacauuguuguucucaagguuuuccuggcucccuuucuggccucuuucuucugccugucccucucuccaguucccaguucugcuccuacuccugcagucuacccguucccuaucacuagauuugcauaaauuuccuagagauuuauagaaauuaaaucauguguuauguauucauuaugccuggcuucuuuaauucagaauaaggcuucacgaaguccagguguuugcguauaacauaacucuuguuuuaaaaugguaaguugcauuauaugaguaugucaaaguuauuuuguccauagauaaguagcagaugcuaauggcaacacggguauaaaaugaucaguuacccaguuacuaaguaguuuggugaaaauugcuaugaccuuuaauauuuuugguuugcuuuugagucacuacuuagaaguauuguaauuggauggcaaguucauauuuacacuucuaagaagcuccugagcugcuuuuaaauguacuaauuacauauuucagcuaauguuggaagaauuuuacuuccucuacaccuugccagcacuucccaauucuuaaauuuuagccaguuguguaaugagauccagcuguuauaugauauuguagcugagagugcugcaccugaguuugugcauucuguccauccuauuguguuuucccugggaguuguucaaauauuuaucaaauuguaaucaggcuguuaguuuugagggucucuguauauuauaagcauaaguccuuuauuagaugucaugcucuccauuuuuugguuugcuuauuuauauauuuuuguucaguuuuucccuuuccauaaagugccuuucagagcacguaguagguuuuuucauuugaugcagucagauuuaccaauuuuuaucucuuauguucuuuugcuaucauuuugccaaaacuaaacauuaaaugcaauuucuuauauucagaaggauuuguagcuuugcuuuuuacacuuuaauuuguaacccauuauuauaauaagcuuuuuacuuuagaauaauuuuagaccugcaaaguugcuaagguagcacagagaguucccguauaccccucaccuacuuucuccuauuauuaacaccuuacauaaccccagggaauuuaucaagacuaagcacugaauuguucauuacaauuaacuucagucuuuauuuggauuucaccaauguuucugcugaagcuguucuuuccuggguucaguucuaacauuucccgcaucuacucugaaauaugaugauuucuuaauuuguucauuguuuugugguuuucaugacuuuagaaguuuugaauaguaucagcuaugcauuggauauccuuuaagauguguuugcaugaugguuucuucauuauucaaaugagauuugagaaguaccuguuuacauauugucagcagagcaaaugccuggaaugcuaggauuuggaagauagaagcaccaggagguuguacccagcaugugugauauaaagagacucuacccugcccccccaucugacaauaggcccuucucaucauacacauugaauugucauuggagcugguguguguguguguguguguguguguguguguguguguguguguguguuugugugagugcauguaugcaugugaggagggaagagaggagagauggggaccagggaaaucaguauguuuugucacucuuguuguuuauuccugauuaccugaguauaaaguuaauuuauucuauauuaugcucuuugaaaguaagucacugucuucuaggaguaaaggggauuaagagguucuuauggcuuguauagagaaguauccacauaaauuauuugaaacucuauaaagagucaucucuucuuguuuauuuugucacucugaaaccauguauauuuauuuuaugcccuacaucaauuucacuuucuauguuagccauuuaugauacuacccagcuugcucuagcucaaggcagugaggucucugagauggcuccaagauucccuuaacuuacuagccucuuuuauuuauugauuugagaauugcuuugcauucugacauuauaugauaucuaaggguuucugcuuucuuuuuucuuuuuuuuguccuuuuaauauuuucuuaauggaucccugguuccugcuucuugggcaugcccucuccucacacugggugguuagcuguuugcugcuacugguguuauauaucuugguucuuuugacagagucagaagguaacuuuucuauuucaauauuuauaguuauuucuucagcucucuguguguguguguguguuuguuuaauugagaaaucauauuuaagucucugauucuaauuugccucacaguaauuugucuuggcauaacugauuaccuuuaaugucgauuucccguagugauaggaaccaccccaauuaucuauuuuccaugggcuuugaaauuuaguauuagccuuagaauuguuaauauguagcaugaaauccuuuuuggguuaauuuuugcaugcaguguaagguacuaucaaaguuuauuuuguaauauaauauuuuuauuugagaauuuuauauauauacauauacacucaaauauuuuaaaaaauuauguauauacaguugauugaacauuauuuauuaaagacuauuuuuacuccacauucugccauaguaucuuuuuugaaaauagauugcccauuuuucugugggucaguuuuggaauucuuuauucuguuugcuuauuuuuguagcauauugucuugauuauugcugacuuauaaaaugucuuuaaauccuguagugguagucuauuuucuuuuuucucuagaaguuguuuuggcuagucugucuucucuauuuccaagaagaauuuuaaauuagcauacuaauaccuauucaaaaagcuuauggauagcacagcuugguggcucaugucuguaaucccagaugagggaagaggaucagaagcugaaaaucauuuuugguuacacagugaauugacgacugcuugagcuacuugagaucuugucuaaaagaaacauaacaaagagccacaaguaaauaaaaaagcuugcagacauaaggauuugaauucagugaauauuuuaaauuuuuuuuguuuugcguauuauauuaaauuaaaucauuuucuccuucccuuuacuccagacucuccccauaaaacauuccucaguugccuucauuucuugccucuuuuuuuccauaauuguuauccauucauauaauagacuggcucauuuucacuguugcaguucccuuuuguaauaccuuuuucacauguguaauagaaccucucuacuugcuugacccuauccccauuccacaaauggaaaacaacaaaaucaaaccaggaauguuugucuguguuauuucacuuagugucaugauuucuagguccauuuauuuuccugcaaacaacauaauuuuaguucauaaagaacugaaagucuuaaauuuauauccaucgcauuaucuuuaucugauaauuuguugauggucaccuagguugacuuuuaugaguugggcccugauaaacauggguacacaaaagucucuauucacucacuaauuuuggaucuuuuggguauauaagcagaagaagaauggcugaaugauguauuuguuauauacuaguuuccacaaugucugcacuuacuugucuucccacuaacaauggauacaugcuguuuaccuguguagucccagcagcuucucccccuuuuugacaauagccacucugacagaggugaguuggaaucucaaaguaguuuucauggguuuucucugauugauaagauuuuuugagcauuuaaaaaaugaauuugccauuuguagcucauuugaaaggugucuguuuucauucggucaguuauugguuguauuagauuacuugcuuaagguguuuaauguuuugacuuuucuauauuaucagcauuucucuuccuuuccuguaggcugucucugaacuucauuucuuucuuucauuguuuucagaagcuguuuaaguuaauuauuucccauuugucaaaucaugcuaacuuauauucaggaaggcauuuccugugccugcuggugaugcaccuuuguucuugucacacccuugucuuuugaucaucgacacagcuggcuuuauagaaugguacaguacaugguagagacauuaguucuuuuuacauguguaguagaauggagggcaaaucugucuauucuugggguuuccuuuguuuauucauaaauaaauuaauuugagcuuuccaagaaauuaaucuauauugucaaacuuaauggcauaaaguuuuucuaauauaacuaugcuauguauaaauucuguagcaauaucuuucauuucugaaauugcuuacuuauaucuuuaauuucuguuuaguuuguuuuagaggguuuuuuuccugaucuuuuuagaucaguuuagaggaauuucacuguucuuuuaaaagaaugaauugcacuuucaguguuuuuuuuucuauucuauuuuuuccuacccugaaagucuacuuugauccauuuuccuuuggguuuaucuuuauuugaucuuuuguuuguugguugguuuguuuguuuguuucuuauuuugugggguucaggcugaggccaaucagacccuaguauagguauuuagugccacaaaucucccugaaaauacuguuuuggugacacuuauauuaacaugguguguuuuccuuuuuauucuuuuaaaaaugccucuaauucuacuuuugauuuuuauuuugaacuuuuugcaauuuagaaacacauuuuuagcguaaguauuuuguggcaucccaaagacuuuuacuagugucuuuuaauuuaggugauuguuaguagagacuauguucuauguuguucuagacauuuuaaaauuugagacauacuuuauggugaugacaauauagaucuuaaccuauuguuuugucucacuuguuucaugcauagaauaauuaggugcacgauaauuuaagauuauuugaucuucuugauaaaauaacaagguuuucauugagaaauuauucucuuuaucccuggugacaguucucuucugucaaauauucccacacuggaguuacuauacugucuuuuuucauacuuuugcuuuaaauucuugugggucuauacuucauauacauuauuaagcaacacauuauacuuuuauuucugggagucuguuaaucuaugcuuuuuaguuuguauauuuugaucacauuuauuaaaauaauuuauuuuaguauuuuugucccaucuuaacuuuuucuuuuuuaaaucauguuucuucuuucuuucuuucuuucuuucuuucuuucuuucuuucuuucuuucuuucuuucguccccucuugucuccuuuuuguauauuuggaaucugucugucuucauaguuucugucuuuuucaaacaucuauguuguagccaucaguuagcugcuauauaucuaaaggggcauaugacauuuugugucauauugucacugcauuaaugucuaaguauuguuuaaaaguauuuuuggcuaggauauuuuaggaauuaagcucucugucucccugauccuuucuuuuggucagaauacugaggugugaaaggguaugaguauugacguuuguguccaaugaucauuuuuuaggaucucuuccaucuguuauuuugauccuagaggauuugcuuaaguaacaugaccacagaggauuuucuugcagugcauguaguuucaagaagauuuagaaaucaugguguucuuguucauuguauauucuaaagcuaguucuuaaauguucaaagcagcaaaugugcugcaucccuguugggcaagugcuuucuuuuuguccaguguauccagacaguugaaugcggauggagugguuagggccgauuagugagcuggugaaugaugacaaaaacuccaugucucgaguacagugcagccuaugguucagucuccaugaagaugagggaagugugccaacagaagcuggcuuaauucugaaaacaggagccuuuugcaaaaggauucaugguaauuaaccaauucaaagugcaauauuuuccuuucauuacuuggcagaaaacaacuaaauaucuacagcaaaacuguuuuugacauuuucauuuucugccuggaaaauaaugggcauucuggauugcacucugaaagaaacugcuagggcuuuuucacuuacacuauaacuuccuaaaaaguggauuacucaauuagcagaguuaaauuuuuuaauuaaguaggauucauuggcugcaggaaucaccagaauugauucacauuuuaaagggacagguuugagggagguucucggaguuuacuggcucugauuuaguuugcuuaagugguaggacagcgggugauguguucauaucgucugauccucagcucacaccugcucuacagacgacacuccauuccuggccuuccaguuguuuugggcuaagucaguuauauuuaccuaauuacuucaccccaguuauugguuuuucugguuuaaaaaaugugcuuucuacuaaccacuagagaaguaucuggagggcuggggagauggcucugcccuuaaaagcuaggcucacaacccaaaauguaaguagugucuugaauauaguuggaaggguccauuguugaaaaaucuucccagaguuauuguagaccuuuguguuuuaggauauguuuguuagaaaauaaaauagaauaaaauaaaacuccacuuacccgcuacuauguaagccaccacgcuuugguuuuucagugggagugacaagcauaaauggaaagaucagaguggagguccaguuucaaaacucccuggcaagagaaugccaagcaccgugugucacaucagcacugguuaugaaaacacacaggagucacagaacgguguggacagggucacugaguguaaaccuggcugcugccuccucagaugaaaggcacugugaguaguuggggauguaguucagcuggugcuguuugccuagaauacaggaagcccugagugacacacuguauaaaacaggcauuguggcacaguucugcagguuuaucauucuagagguugaagugggaggaagagaaacugauuccugugccacauuaggaauugagagcgaucaaaaggaacucacuguuaaacaguguauauaaacauaaauauguuuauucaaucaaugaaugcacuuauggucauaugugguauugguagagauuuaguggugaauaaaggaaguacaauucuaaacuuugaggagcuuauacaguaguagguaaggggaguuuuauuuuaucuuauuuuuuaacuuauucuuauauaauauauccacacugcagccucaccucccuccauuccucccaguguguucccaccucuccucugccacagauccaugccuaauguuugggugugggucucugcaucucuuccuaagaauuaauagcuacuuauaauuugaguacguaccaugguuuucuuucuaggucuggguuaccucacucaggaugaauuuuuuucuaguuccauccauuugccuuuaaauuuuaugauguuauuuuuuaaacagcuaaguaaugauucauuggguguguguacuucauuuacuucauccauucuucugcugagggacaucuagguugcuucaguuuuugacuauuaagaauaaagcugcuaugaacauaguuaugcaauuguccucaugguagguuggaccauccuuuauguauaugcccaagaguauauaagcuaggucuugagguacaucaauuaccaauuuugugagaaaccaccuuauugauuuccauagugacugcaaguuuacauuccaacagcaguggaggaguguuccccuuccuccacauccuugccagcguaaguugucacuuuuguuuuuaaccuuacgcauucugacagguguaaaauggaaucucaaagugguuuugguuugcauuccccugauggcuaaggacaucaggguuacacacacugacaaaagguuaacacauuuguuucucagccaucugagauuucucuguugagaauucugagucuagauauguacuccauuuuaaaauuagauuuuuuugguuuguugaugucuaguuucuugaguuccuuauauauuuuggauauuagcccucuaucacaggugcaauuggugaaaaucuuuucccaaccuguaggcuaucauuuugucuuauugacagugucauuugccuuacaaaagcuuucaguuucaugaagucacguuuauuaauuguagagaguagugccuaaucuaucaguguucuguucagaaagucaucucauguaccaauguguuuaaggcuauaccucucuuucucuucaaucagguucaguguauaugauuuuauguugagaguuuugguguacuuggacgugagcuuuguggaguauuauagacaugagucuauuugcauucuucuacauuuagacauccaauuagaccagcaccauuuuugaagaugcuuucuuuuuccauuauguaguuuuugguuuugguuuuguuuuuaaauaaaaaaaaucagguguguauaggugugugggcuuaugucugggaucuucuagucaauucaguugaccaauggucuguuucuaugcaacuaacauuuuuuaaauuauuacagcuauguagcacagcuugaaauuaagaauggugauaccucuggaaguucuauuauuauuccggauuguuuugucuaaucauggguuuuuuuguucuuccauaugaaguuguguauuguccuuucaaggucuguaaagaauugucuuggaauuuugauugggauugcauuuaauuuguagguuguucuauccaugaaaaagugguuuuuccaucuuuucuucuucugauauuuucuuuaauuucugucugccaauccuugaagcuuuuaucauauaaauccuuuacuugcuugguuagaguuacuccaagauauuuuauauuauuggaggcuauugugaaagguauuguuucccugauuucuuucuuaguccauuuaucauuuguauauaggaaggcuacugaguuuuugaguuaaucuuauacucagccacuuuccuaaagguuaucagcuguaggaguucugugaacgaacauuucggcuuaguuauguguauuacauuauuugcaacuaaggcuacuuugauauuuucauuucugauuuguauccccuugaccucuuuuaauugucuuauuguucuaguuagaacuccaagcacuauauugaacagagaaggagaguguggguggucuugaaaaguuuaauccaugcugcagagaugacugagcagugaauggcacuuguugcucuugcagaggaccugguuuguguuaccaacacccacauagaggcuacaaaucuguaauucauuuccugaggguacaguacaucuugccucuguugguacuuuauggcuguggugaauggaugcacauguagguaaaucaccuguauacauaaaaucaaagaaugagcucugaaguaaugaaugauaaauauagcaugcuuuggagaagauucguugcuuagagagacagcuacacauucacugaggaaguagauggguagaggguaagguuaucuguuuuguucacuuccuucuaggcaggcaaaaucguguuuaaaguugaaguagugagggguaugucuuaauuuuggaaagcagaauguauaaaugccuugaugucuaacaagcaugguguacuuguacaaguaaaagaugaucauugugggugaacauagaagagucacuugaaugaauuuguccuaagagugauuuaucaagcucuaagauguaguguuuguacuguuuuuaaauaccaagugugugauuuaauuggguaacauuuagaagaaaaccuacgauguuacagguacuguuaguuucaguaagcuuauuacuagguauuacuaggauggacauaugaaugauaagcacauaaagguaacauuguaaugacauaagaaagagcuuagcauugcauucaaaacguuucccuuguuuauuuuguguucauuacagaaauauuuauuuagcacuuuauuaucaauuagacaguuuuaaucaucauagcuaucaaauagauaggagcccucuucauguaggcuuuaccaaauuucugcuaacccaaaauucucuguugagguucaacuuuaaaaaaaaaguuuuguuaaauuguuuguaugcauguguuucuuugggggauaagugcacauguacacuauugccuguagaggguagaagaggauaucagauacccugaagcucaaguuauaggugcuugugagcuguccuccaggaucuguaagaauagcaugucuucuugaucucuuaaccauuucuuuagcucuuuuacuuuuagucauguggaagagucguggaaucuuagaaucuuagaccccaccugguucuacugaaucagaaucucuguuaagaacagcgugcgauucguguggauuguguagauugagacgcaguagucuagaguagaagagauugggacugcauguauauauauaugcagcauaugcaugcuuugugcccuuggaaaccagagaggccaucagauguccuagaacuggauuuggaguugguucugagccaguauguagguguugggaaaagaacucagaucuucggaaaaagcaguaagugcucuuaacugcugagauaucuguccagcccuguuggaagcaguauuuaguccccuaucugauuuaggauugguaaagauccuuucccaaacaguugguguccuuuuuucuuauugacagcgugagaaacugugcaauuuuaugaggucccauuugccaauucuagaucuuacagcacaagccauugcuguucuguucaggaauuuuuccccugugcccauaucuucgaggcuuuucccuacuuucuucucuaugaguuccagugucucugguuuuauguggaguuccuugauccacuuggacuugagcuuuguacaaggagauaagaauggaucaauuugcauucuucuacaugauaaccgccaguugugcuuuuuuccauuggaguuuuuagcucccucaaucaagugaccauagcuguguggauucauuucugggucuucaauucuauuccauugaucuaccugcgugucccuguaccaguaccaugcaauuuuuaucacaauuacucuguaguacagcuugaggucaggcauagugauuccacuagagguucuguuauuguugagaauaauuucugcuacccuagguuuuuuguuauuccagaugaauuugcaaauugcccuuucuaacucagugaagaauugaguuggaauuuugauggggauugcauugaaucuguagauugcuuucagcaagauagccauuucgacuauguuaauccugccaauccaugagcaugggagaucuuuccaccuucugagauuuucuucgauuucuuucuucagagacuugaaguucucaugauacagaucuuucacuuccuuaguuagagucacaccaagguauuuuauauuauuuuugacuauugugaaggguguuguuucccuaauuuguuucucagccuguuuauucuuuguguaaagaauggccacugauuuguuugaguuaauuuuauauccagcuacuucauugaagcuguuuaucagguuuaggaguucccugguggaauuuuuagggucacuuauauauacuaucauagcaucugcaaguagugauauuuugacuucuuccuuuccaauuuguauccccuugaucuccuuuuguugucgaauuguucuggcuaggacuucaaguucuauauugaacucaagaagauggacuacagaaaaucaaauaacccuauuaaaaaaugggguacagaacuaaacaaggaauucucaacugaauggcugagaagcaccugaaaaaauguucaacauccuuaaucaucagggaaaugcaaaucaaaacagcccugagauuccaccucacaccagucagaaugucuaagaucaaaaauucaggugacagcagaugcuggugaggauguggagaaagaggaacacuccuccauuguuggugggauugcaagcugguacaaccacucuggaaaucagucuggcaguuccucagaaaauuggacauaguacuacuggaggauccugcaguaccucuucugggcaucuacccagaagauguucugacuuguaauaaggacacaugcuccacuauguucauagcaaccuuauuuauaauagccagaagcuggaaagaacccagaugucccuaagcagaggaauggauacagaaaaugugguacauuuacauagugggguacaauucagcuauuaaaagcaaugaauucaugaaguucuuaggcaaauggaucaggaguauaucauccugagugagguaacccaaucacaaaagaacucacaugauaugcacucacuguuaaguggauauuaacccagaaacuuagacuacccaagauacaguuugcaaaacacauaaaacucaagaagaaggaagaccaaaauguggauacuucguuccuucuuagaauggggaacaaaauacccauggaaggaguuacagagagaaaguucugagcugagauggaagaaaggaucauccagagacugccccacccggggauccauuccauauauaaccaccaaacccagacacuauugcauaugccaggaagaauuagcugacaggacccuuauauagcuaucucuugagaggcuaugccagugccuggcaaauacagaaguggaugcucacagucaucuauuggauggaacacagggccccuaaagaaggagcuagagaaaguacccaaggagcuaaagguguuggcaacccgauaggaggaucaacaauaugaacuaaccaguaccccacagaacugugucucuaggugcauauguagcagaagauggccuaguagaccaucaaugggaggagaggcccuuggucuugugaagaucauaugccccaguacaggggaacgccaggaccaggaagcaggaguggguggguuggggagcagguugggguggggggugggggaaagguacaggggacuuuugggauagcauuugaaauguaaaugaaaauaucuaauaaaaaaugaaaaaaagaaacaauauuuaaaauuuauuuuguaaaaauaaaguuugcuagcucaggauguggcucaguggaaacauacaugguuaguaauccugaggccuuguguuugaccccuagcaccuaaaaauacuuaaaaagagaaaaaagcauauauaugcuaauguggaugucuguauuuuuaagguuacacacacacacauuguuuaaagacugauauguaguagccauguuuuuucucauccaucuguuauccauacucauuuguuuacaacuuaugugcaguugcuuucauaccaaaugugaauuauuugccucagaccuuugugggcccacaaaacccaagacauuuaguauuugagccuuuacuguguuauugugcugcccccuauagauaauaaacaggugcccuggcaugcaugauaggacuagacacaaacucauugguuaugagcagcuuuaaggguuagucaguguuugaauugaaacacugacugucaucuguuuuguagacuguagucuuuuuuuuuuuuuccuuguuuuuuugagacaggguuucucuguauagcccuggcugucgugaaacucacuuuguagaccaggcuggccucgaacucagaaauccgccugccucugccucccgagugcugggauuaaaggcgugcgacaccaggcccggcuccuguagacuguaaucuuaaaauagugauuuaacccaguguuaucuuguaguccauaauccaagugaaaacuaaacaucuaaaagaacaaaucaaaauucaugacugauacaaguacgaaaauggagaucaggccuaugacauuuuagaauauuaugaucagccgggugugcuggcgcacaccuuuagucccagcacucagcaggcagaggcaggaggauuucugaguugaaggccaaccuggucuacacagugaguuccaggacagccagggcuauacagagaaacccugucucggaaaacaacaaaacaagcaaacaaaaaagaauauuaugaucaucauaaugaaauaaaaaauggaaauaguauacauuuaccuuuuuguuuuuauaguaagagucucacuauguuuucuaguccggugacaugaaacucauuagucaggugaucuuccugccucaccuucgcaacuaacuggcaguaaauaacagucccacuaagugccaccugucacauugaaacaauuuauuuuauuuaaaaaauugccaaguucugucuggagagauggcucagagguuaagagcauagacugcucuuccagagguccugaguucaauuucccacaaccaucuauaaugggauccgaugcaugcccucuuuguguugaaagacaguaaauaaauaaauaaauaaauaaauaaaucuuuuaaaagaaguuugccaaguucuucucagaaaaaaaucauuauuuaauggugauugucuuuuguaaauuguaguggcguaucuacuuacuuuauguguaucugaggagacuaaacuuaggcagagacauuugccaaugagaauaugaccagccguggagcugacugacuucauuuuauagaagccuguggaugacguuauaguagguuaguuuuucuccauccuugcaccauuccaagcuuauauaacauuacauuuuuaugugauuaaacauacuguugacuuaauguuuuuugaaagaagaaaaaagcucauuuaaaacacuauuucuguuacuaagaagcgugguggcuugaagcuaagaaaucuuuuuaaaagaaacuuugauaaguaauuaagagaacucagaaagauuguaaaucuaaaaucuaacucagcuaagguuggagauuuucauggguuuucaagagugauuauaucuucccucugcaugugccugugguugggagcuaucaccuacacaggaacuuguggcuuuauaguccuucaccagucugaggacucugagauaacagguuccuuucuggaguacagaaagcagcaguaaagcagaugaguugcagcugcgauuauacagccacgaugucugcuuaccuagagcacugcuugccuugcucuguauuuuccaauuguuggcucacacaaguacuuugacagugacugaaguuucuguaaauacaaaaacuguguguuuguguguauguguagaggaagcauugggguggauuguugucuuggaggaagccuguaggaaagaauaccuaccuaauccaguaggaaguaccuggaguuagguauagugaaagauugaaguagcaacucugagcacacuuaucaauuguaucuuccuguacagacuacaaacacauaauuaggguuuaaggcugaugcuguguuauuaccaccagauguuaaauguuugauuuucaauuauucuucaugccuuaggauaauccaaaagguauuuuggacccuuaagacaacuaugauccuagaucucagagcuaaauuggcccuuaguaugucuaagcauuuguguuagucuauuuaauaucuguugguugagaaaucaaugcgcagcaaauaucugcuuuugugagauuaucaacuuuaugaaaaugguuuuuaaaaauauaaaaguacuuaguuaucuuuacaguaauuucuuauauaaaccacucauguuucccucgagagagaguugaauguuucuguaaaguuuaaauauacgaauaaagucauuuauauuuaacuagagaguaaaucaaugcuagaauuggcaagaaaggagaguucugagaacuugaaguauucugaauugucuauuuuuguuuugaugugaauaaaaauaggaagauagcauucaggaaggaaggaugugaaggcagcucgguaggcuuuagugaugucuugcuuguguucagucaacacugucauacuguaaguucuacuaaagucaguucuguucaauaaacauuuuuugucaucaugauuguaaucuaacucaauuauuuaaacuuuuaagauauggaguuuauuuauuuaauuaguuaguuuuuauuuuauuuuuucuuuuuagcacugggucucaacauacagcacaggcuggcccaggaucuggaccugccccucugccaucugaauguugggauaaggcauacaguaccauucccagaaaauuacacacacaaaauuuuuuagcauuuuauauuuaacccaaauucaaaauaugcaaacugggcacacagaagagaacuaugaguugaaauaacuaggagaaagaauauuuaagguaauauagagaauaauuucuguucccgguauuggguucuagguguuuagcugcugauuucacugguugagucuaaaggucacugcuuucuaaaggaacauaaauauaguuuaaaucaccuacauuuacaaaacauaauauaugauuuaaaaaucuguucuagagaugucaaagaaaaugcagcuuuugcuaaagagaaaagguaaauagagaugguauagaugcugauccccauggaaaagauugugugucggcaucugugcaaacacuuacauaugaaaacaagcacacaguagaauaauuaugauaauaauaaaugaacagguaaaaaucaauaguauaaaaaugaaauaauuaaaacaaguugaaauuaacuagaaugagcaauaaucaaaagguauugauuuaccaccuguaggauauuaagaaaauguuaauuucacauauaucaaauguguucaauucuaaagcacccagcuauaagagauuaaaggaaaaugagcaauaaaugauucugaacagucacaugugaugguuuuacacauguauaauaauugaaguuauagcaagagaggagcgugaagggaauauaagggacugaagguugagaauguaacauuuaaaaucagaaaaugugaaguuuuggaaauucuucgugguagaaauugaguauaauguauccuaugaauugcuaaaauagcuaauaaucauuccagugauaauaauaauaauaauaauaauaauaauaauaauaaacauuuugagacagggucuuacuauguagccccagcuagccuagaauucauucacuguguauagcaggcuggccuugaacucauagagaguaguggaauuaaagauaaugugucaucuugcccagcuugaaguaguaagggacuuuaaaaguauccaacugccauucacaaaggagcuaucaaccuuuuccgauuuauguauuuaaaaauacuaugucauaaagucugcauguguggguccauuuaaaaguaauuuuauauuucagauaauaagcaugcaggcccauuaaaugaacuacacaaagcaauauagauuuaaaguugacugcuuuaucaucauguuuuuauuuuguuuguuuuugauaggagaaauaucauuuuugccuaucacaaaagaaaacuuuuagaaaguuuucuugccgggcgugguggcgcaugccuuuaaucccagcacuugggaggcagaggcagguggauuucugaguccgaggccagccuggucuacaaagcgaguuccaggacagccaggacuacacagagaaacccugucucgaaaaaccaaaaaaaaaaaaaaaaaaaaccaaacaaaaaaaacccaguuuucuuuuggaaacauacuguuaguuuauaauagccauauuaucaguuauaauuuauuauuguuguugaggcaagguugucuucuaggcugaauuaaaauguuuggugguccucuugccucugucauccagauguuaagagaacaggcaugggccccuguuugugacuaaggcuuuuacuuuauaaaauaagccuuaaagucugaugacuagauauaauuuuauuguuaaguuaaccuaaauauauuuuguaaaaaaagcgugugguaaauucaguuuaaccucauauauaaguguguguguguauaugugugcauuugaagcucugccaacuauagaugggaaaugaauugcaaaguauaaaaacugcuucugcuuucuguuucugccucaguugauggaacuuucaguuauguauuagaauuucugcguuguugcuauuucucacccuuaccaauauuugagaagauuguugugcuaaguaauuuccagggacacaucuuuguauauuuauuuuuucucuuaaugauuuuuuuaaaaaugaaauugaagugauuuugcaccugaaguucaccaaagacagccuccuguuucuuuuuuauucagagauuuuuaucagaggaauguagacuggaaucugcaaugguucucaaaaucccaaagugguaagugagaccaauuaagucuuuucuuaccaauauuuaguuguaauuuuucucuguaguucuuuacugaaguauuugaaaugacaagugacaucaauucuagugcuuacacaucugauaacuuuagagucuggcuauuagaagcucuguguuuguguuccuaaugguuuggauuuauuuggucccuggaaucagguuccaggagagaaggaagugggugggcaggaggcucuccgcaugacacuguccacauugccucuucguuuuggagcuaaacaaaccacaucucuaaauugauguguggcccuaguugaucuuguuagacugacaguaaagggggcauuuccuguuuucauccuaucaguuuaagaauuagaacucagauuuaugcuuaguuuuauaauccaagugaaaugcuuuggagacugguauauaaaauaguaaauguuuaaaagagugaguccuaauuuaagccuaaugaaaaaaugaagauuagaccugugaaauuuaagaaugugacaguguaaugcauuauuuauuuauuuacaguauuucauugaauuuagggcugauauugacaaaauagaugguaagaaucaaaaauacuuacgaguuugagaaauccucauaagaauuauuuaggguugugaacccagaucauugggaaaggacuugcuuagaguguccugcguuagcauacaacacauacauacacacacauacaaaaaaagacaugaaaaauaaagguguuauagagcucaaaaucaauuuucaaguugacauuuuaggauuauaguacauuuuuuuguggaugaaguuuuuguuguaugaauaaaaaaugauuugaaaauauuugaaaauuuuucugaggugaaucuugcuaauaaguagcucuaggugcauuaguauuuaugauuuacaucaagcuauccuugaacucagggugguugucuucucucaagcaccagaguucugggauuguaagcaugugccaccaugcguguccuauuaaaaagcaauaauuuuagacgagauauguuuauuuacacacacacacacacacacacacacacacacacacauauauaaaaucauggaauacacauugaguuuauucuaauguaaauuuacaaaaaagcuucagcguuaaaacugacuuugugguaucuauaugaaugaucuuaaaggagaugacuuagcaaaauaacucacgaauuuuauccaguagcaaaauacauaacuuaaaaagugacugauagugugccuuugggaaugguccagcaacuuagacuuuguuuuaacaugcugauauauaauucauucuaauguuccugguaugauuuauuugacaaauuauuuccauauuuauauugcuagaagaggagguaucugucucuguauacucaacaaauaccuuaauauauauucugauuaaauuaguguagauaauauuuuaaccucagaucuguugugucuggauugugugaucccagaagacaaagaugaaguuaauuucuuugcagcccuuuaaaucucaauugaaagucauugucuuugagaaauguaaaaacuaaauguuaaggcagacgauuucuguauaucacaugugguaccauccuuaccauucuucuguagcuuuuaauuucugccagaaguccuucuuucaucucauauuccuaccuggccugugcaacaaugagaaagcccaguuguccauggugaccauuggaagcacacagcuugcucuauuuuucuuucucaguaguuuucuuuuguuguuagauacaacugaaauuauauuagaaauuauauuagauaguaaagccagcccuugugguauacauuugcaaauaccaagaauuuaaaauagaggcagaaagaucaggaguucuggucuaccuuuggugucauaaaugauuugagaccagccuaggcuauaagcaaccuuuuuuaaaaaucacaaaggaaaaacaaaacaaagaaaaauaagcacuauaaauuauauuuuacuuuccagcaagguagaauuuuaugauuaaguuguaaaugauaauuuuaaauguuauuuaacaccucuauuagcuauuaauaugacccagcgagcccuuccccacucuaauaaucaaggcagaguccuaucaauuuuuaaaucaacuuuaguaccauuaguggacauauuacccauaaucucuuuuuucuaugguagacuguuaauuguagcuguguuccccaaguccugccuggguuauuucugcuuuauugccuguccucaggggccauuucacuuggcaugugcuccuggcccaucacaucuaauggaaaccucccguucucucuguuuucuuuccccuucucucuccuccuuccuucucuuuuucuguuguguuccuuaccucuaacccccagcucuguaacaaaaacccugccuaccucucuuuuccccaguaauugaccguagccacuuuucuuuaaccaauagcuuuaaauaggggagcaagguauacacaacggaaagugguagacaugagauuucucucaucugcgggacaaccauuucuuaggauacaaaauuuagcauuugaauacauaacagcaccagacuaaaccccaacauuagguaguuaauacuacccaagaauuuuauuuugguuauguuuguuuuaacagcaauaugucuuaauuagcauguauuuauaaaauacugauauacaggaaaauacagcuaugaaauuaauucgagacuauauauuuuacauuguguauuucacaggcacauacaauauaauguaggggacuuuuaaaggacauugaucccauuuucuuaacauauucucuagcaugguaagacaaauuuagcaugacaguauagugcuuugcuaggaagcuuguuccccucugagagacaguaaaaguucaagacaugugacucauuauuuaguacaugcucugauuagaaugauuucugucucuuguauauuuagaauguucugugcauuuauaacuucuacccaguagaagcuuauuuuuucccuuagaagcuagcuuucagaugugcagagacaguuaugcaugucucuauuucaugcucuuguuacugguccaaacagcaccuuucuuucacauaugaaugaauuaccagauuccacaguucacuuggccauuuuaguuugcacacaaacuuagaagguucauagauguugcuagcuaccaugccuuaguaugaacugaauaguacaguguacuauagauauacuauacuugguucaaaauagaaauauuuauaaaauaaauuuauuauauaauauuggaaaauuuaauucuuaguauuaauaaaauuuuacaaugugacucuuuugaugaauuuguguuauuaaagagauuuacuagauaugugcaauauuuugcuuuaacaaguuuucuuggaaaguaauuugacauuuagacaguuucgauuaaaagagaaaggguuauaacugaaaaaauugauguuccaguaaauauacacauuuuacagaaguauguguguguuuucuaaguaaggauauuucucuccuuuuucccccuuugcucuuaugguuuuuaguuuugcuuucuuacuguuaaaaaaaguuuuaugcauuuaauguggaauuuauagguucauuacaaaaaaugcauuagagucuuauuucuaaauuguacuauucuuuauuuacauugcucucuauuuuacuuccauuaaguaauaaacugguuuuuugccacuguauuaauuauuaaugcucaauuuggaagaaaauuuauugcuaaaauguuaacaccaaugauaaaaaacuaaaaguugcauuuuuuucugaguacucaggugacccuaaagucucuucucuauacagaugugcuuucacgcugagguugcugcacuuacagcaggcacugccucuggguuugaucugguagagucuuuucugcaauuacuguccuaucuccagccccgaggcuuccccagcuggcuggauuuggaacagcagcuucagaaaugccauucucauccauuccaguuuuuauuaacuuuuuacuaaaacuguuuauuuucuaaaaauacucuagagcacucucaagaagaaaaacagucaaauaaauaaauauuuuuucuuacugauuuguuacacacauuggcuuucuuaccuuuagacuguuaguuacugguuguggacuugaaaacaaaaauagaauugccuuggagucauguucugagcuaaaucugcaacuccuaacguuccucgcaagugauccauuagacccuccacuguagagaugcagauaaaccccagggugaacuaagacucagggccauugcccaaacagccuguuuugcccugcucucugagccuaggauucaaauacaguccuguccgugauaaaagaucacuguugaccuucuguggagugacuguaaugcagucugcccuagagcuuacuuacugcgcaagccaagaauauguaacagcgauuugauuucaugacgauagcauuauuuucagauaagaaacauuuuuguucauguggcauacaagaaucuauaacauuauaguuuuccuguuuuaaaauuaauaauuugaauuuguauauuuuuagagaauuuuuaaaauuagauauuuuccucauuuacauuucaaaugcuuucaccuuuccuaguuuccucucugaaaguccccuauacccucccccccuguuccccaacccacccacuccugcuuccuggcccuggcauuccccuguacuggagcaaagaaucuucguaagaccaagggccucuccucccauugauaaccgacuaggccauccucugcuacauaugcaguaagagccaugagucccaccauguguuuucuuugauuggugguuuagucccaaggagcucuagggguacugguuaguucauauuguuguuccuccuauaggguugcagaccccuucagcuccuuggguccuuucucuagcuccuucacuggggacccugugcuccuuccaauaggugauggauuuguauuguugagaccgacucccauguagccaggcugggguucauuagguagcugagcaugagcucgugcuccugguuccccuuccuucucuucccaaaugggagcacuacacauguugccaauaguuuuggcuuuuccuggauuuuaaugucuguagcguucagguuaugacuaugccccuaaaguuuaugcaaaaaguaguuggcaggaugccccccccucaaaaaaagcuugaaaacuaaaauaaauggcauuacugauaguugauauaccagagcaauuuagaagugcuaucuugucacuacugcuuaguuguauggaaccuuuuuauuuaacauggucagcagagaauagaagggcaaagaaaaaagaaggggugucuaguuagucucaaaacuaagaaaauacuguucuuuuaaguguaagagaaucuauucagugugaaauaaauuuuauaaugaaagagaaagcauuuuuuauaauuaacuuacucaguuuguuuaagaaacauuuuuuguaaauguaaaaaaaauggccacauguuaaguguggcauaaccguaauaucuuacaugugauuuuagauauguaaauauuacaguacuguugaguuguaauggaauacuugauaauaucauaauaaauacuacauauacuucagaauuuuuguaagguauuuguuucgauguugcuuuaaaauccuuuacuucuguguauauuaugucuaacaguucuuaagcuaauaaagucuaacagaacauauugaaccauuaaagaauuuaagcaguauggguuguuucaaauuuacccucacacaauagagauuuuaaaucuuuuaaaaugaaaguguuagcacaauaaauacauagaaggaacugcaaaauaaggauaguuagugcaugcuguggaaagccuguaaauugccacaaaaccccacaaacaaacccaacacacccccaaaccgauuauccucacaagcguuucaugcaauuugacagugaaaagcgcacccuguaaaagcuguuacacuaagcacuucauuuaaaagguuuccuucucacccugaaauuauacuuacucccuucaagugaagauucaaaauuuguucccuguuuauuuugguugcaauuauguguugauuuuugcugccucaccccucuuccugauaaucuagaaagucuuuuggguuucuucuuugcaauaaacacacaauccauaccguagguuccauucagaaauaauaauaaaauccucagccugcaacaaagauacucuguaugauaauaaaauagagaaccuagcaugccaaguaaccaggauaacacaaaauaauguaagugggccccaaagcccucaaaauaugugcaaucauacaaacauuuaguuggcauggccacacacauuugcauaguuugauuuacuugaauuuuuguuaaaugccuugaaaaagugccugauucauuuaugugagaaagacacuuggaaacuuguaggcgagauucugacugugggauucugugcucugugugauaugaguguuccuuucccugugcaacaagggcccugagcaucuggcugcauucccugcucuuugugacagccuucucgucuuuucuaagccuugcucuguuacagcuuuuucuuuuuuucuuuucucuuuuuuaaaaacugggaacuaaaguccugaguuuuggugccagcucugauacuaaccaauagaaccauuuggaauauuagucucagagucugaauagggagugugagcacauaauaauuuuaaauguugauauugggaaagcggucaguuaccugauaauugauuauccuccugaacccaaaaaaacauuuauugagugauucauuuaccgaugaauauuccuccugaaauaaauuuauugaaacauauauucacucacuauccauuuuuuuuauuuuuucacuauccauuuuaaucuaccaacuagugugaugcaucaauuugcuuaauaucaaauuauuaacuucuugaaauguguuuauauugcaucugucuaaaguuuauuacaaaucagucuggauagaauggcuuuagacacuggaauuuuuaguggcaaguauuguuuguuugguuuuaauauuucuuuauaauagccguuugaccccagauauuuuguaauagaauuauuuaucaguucaguucuauugaauccuaaauuucuuauguguauuugauaagugaauguaguuacuuuaaugcuuuuuaguauguuaaaacagaagauauguccuacugaacuaugugagaaaaauaauaauuuagguucauaaaggauuaagcugauggaagacauuuucaaaugaaacaguucacguugugacuuacaaacucaaaaggauucuagaaauuuguauauaauuugauuuaaaacaaacauucucauuccccaaaguuacuguaccaaagaauaaugcaauuuucagauacaaucugcauagacauaggccaagauugcaguaaaucucaugggaaauugaaacauuggacuuaucaguccuaaaacaucaaauaacucuuccaaagcuugauaaaccuaauuauuuaguauaguuaacugucaauauaacacaaguuuuaaagaaacaaguuuuaggugaacuggggaauuuguuacuugacaagauggauuuauuuuuagcauuguaaaccuaggcuuuuuguuucuuuauuauccuucuugcccggguuggaggaggcagggcauguggcacaguaugaggcugggagggagacuguccauguuuuagguauaaguccccaucccccagccacacccuauaacugcaguucgaaccagguugaaauucuauguguauauauauauuuuauguugaccgauguaugaccaaggguuguuugagaaacuagcaaaguuaaagagaccuguaugagaaccagaaaguuuauuuuuacacucacugugucuucccacuauagcgaauuuugucucuaugagcauagagaugucuaugucucugaaugaauauaucaaguugugcagcaaguucuuggcauaugccaagaagaaaauggccuugugcccaagcaggggcagagauaaaauuaaauuagagaaccuaauuguggcacuguaaugcaguaaauuauucuaaacacugguguuuguuuuuguuuuuguuuuuauuuuuacugcauucuuacuaaaggccccacacccacuuucaauuauuaccuuucauuaaaggcacugccauuaggcuguagacuuaaguguauuuucuggaacuuucuuggaagaggcagguuguguuugaauaaaaagggagccacaaacucuggugccuaugcagaagacuacuaacugagacucaccagaaagcuucaagccacuccucuuccuuuagaagaauugaagugggauuuugagauuucaaaaagaaauauauuucccaaguccugauucaaauuccaagcuuaauuguauuaauguccaagcagaagauuauaguggccacagaauuaaaugugugugugugugugugugugugugugugugugugugugugugucugucugucuguguuggaggggaaacagugcuaggggucaaagauaugaccuugugcugcuagacaagugccuuuccacugaccuccuuucucuagccccagacucaaugauuuauaauaaucuuagcugggauauacagaaaagaacagcuuguuaaaagaguaccuuguuagguacugugagcugcugaacuagaaauggaggcuucuuaagaggauaauauaucaugggagauuauuaacuagguuaaaaacucacagcauauccaauuauuguaauguaggacuacauaagaguuaaucugucaaacacuuacagugucauaugcuaagccgaguacuguguauagcugagagauaaaaaggaaaacaagacaaaaccucucuuggaccuuagggaucauauauugcacaacauccucaccuucuuuucuacuuacacaacuuugcugcugauaggauuauuuaaauaccaugugguuuuuuuuuuguccagagaaaaauggaauaauaauuguauguucuucacaggauuuccaaaaagaugaaaugauauacuuaaauucuuuuucuaacuaucaauucuuuuauuuucagauuauaaauacuuaaauucuuuagguaaaauguuaacugauuaggaaguggaggcuuucuggaauaccuuuuuucuguagaaaguuucaguacuuacuaagaaacauuaggagaguaucaguugaguauuggcaaauaaauuucagaugauuaauuaggcaugaaguccaacaaucacuaauaggcuaauugcuuauccuuaacauuuccucuaugagaauuaaagcucuguuagugucugucuagcaaaggaaguguaacagggcccccaccuguucugagaugacaugguuagaacacugguucugaaacugccauucagugagccauuugcacuuuuuaaagaaguaaaugaugcaucugaaugcuaagagcaguagcaaaagauuugauuuguucauuuaaauuuaguuaauccuuauuucuuuauuuuaaaaaguaggcacaaagcauuuugaaacuuaaaagggaguuauuauaauaauacaacaauugaaauugaaaucacauuaaaaauaaagaaaauacauucuuaaugaaucccacuguugcagugguagagcagacaauuauacuuuuacagaauuuuaaguauuaaauacuuaaugaaagcauaguacuguuucaauaggaucuuaaacucauccucuuugaggauuuauauuuguuuucaaugccuugaauauccuuguguauuagguaccguggcauauuugugggugaugagguaaucacaguccaugugcucaugaaguuuguucuuugcaugucaagaugaauaauuacacuacgguucaaaacaacaacugaugcacauagaauaaugguagauugcuacagacucacuggagaggacaccaggccuaagcuuguuaagaggaaggggaaagagugauaagugggaagcuuaagggacacaggauuuauucuagaccuaaaguugaagaugaaagaagcaaggaggaaaacauuguuugaagcagaagaucucuguugcgguacacgagggcuccaucucccuagauuguauaaucuugggauauguaaacugaagcuggauucuaaagagccccugaagucucaacaggaaguuuacaguuuauccugaguaccuaggaccucgaacuccaaggaucugugugguaggauggagauccaagaauaaauguugaaggcuaauuaagaagcuaaaucauuggaguagguaguugauuaaacucaggagauauaagaaaagaagucuguuucuuauuaguagauuucuuugagaaauagaaauauaaaaguaacuagaugcagagguaguuccucuggucugaaggaauaagucaaucuugaacucacugagaacagauuggagcuaacacauccacauuuuugucagaaauauaauuagcaugaugaaaauuaagcuuggguuugaugauuaaauuuuacaauucagacuuacaugcuaugaaaaacaauucaacaaguaguuuaaaauagugaacaauucauagaauuauugaauaugcuuacuuauugggaaguuaacugcauacaguugacauaaaugcuagguccaucaaaacagcauuaggaaaguagaccauagaucccaaacccaaguuguguguguguguguguguguguguguguguguguguguguguguguguguguguucaaaggggaagaaacuuuugagagaaaugaaugcaccggcagauugggauaaaagcagaaauauagaauccugugaaggagcuuuuccagaaauaagagguuguuauuaauucaggcagaaacuaagaaaggugguagaauaagauauuucuguuaauaucuuuggaacaaggauucucugagagugaugacuagaaagagauacccagguguccuguagagucuacaaaguagaugaugacauuaggguauucuuguaaacaaaugugguuaggaaaagaauuauuguauuaagaauacuuaacuauuaauauauuuguagaauaugaagaauucuguccauucuauaccaacaaaaaccuagaaaguuuagugaaaagaaagaaaaagaauaaugaaacucauuuguguggauuuuuaucuuuauuuaaaauguugucuaacauaaacuccugucaaucauaaagaauuaaguugauuuuaaacaucugcuuuauuucaguuagggauauuaaacauguaugaaaugacauaagagauuacuucuuauuguaguacuauuuugaaaugaguuuuagaagaaauuacuguuuuaaagccaagaaaauacuuuagacuaaguuauuagaucagccagauagaguguauuacuaauucucaaacugcuucaugagaacagucguucuaaauaauuacaaauauuauaaacuuuacuugcuuauacaaagaaagauuuuaaauacauuuagguaucuguuuaaauaguaaguaucuaaguggugaaucuuugaagguggcuagauacuucaaguacauuucugcaaugaaagaugacguguuuuguuugauugcuggcauuaaguuuugcaguaaaugcuucucucugucucugucugucucugcccccccccagcccgcgcgcuugccuguguguguguguguguguguguguguaugugugugugugugaaauacagaggguuuuuuugaaggccacccacucaaucacuuuuuuuuuuugccaaaaaugucagugaugagaauuuaauacuuuaagcuacuguacauuuaaaaugggguauauuguuuccauuauuaguaguguuauuauacaguauucuuuccccuuuguagaugguguugauuucuuugagccugucauuugaauaguuaggaacugcaaaagaguauucucuacuuuauaaaaagaaaaagagauggggaaaauccuuaugugggcaagaaauuuaaguggaaaauugacuuuggggugugaagaaaagaaaagcucuugcuuuuuaguacuuuauaaaaggcaaauacagacuuccuguuaggggcuugcuucuccaguaguucuuauaaucucccugccuuuuaagacaaucuuugccuuuccuuuguugccauccuagcacauccuauuucagcaagcaucgucuugguugucaagccaaagcaugauacuggacauguccuuuuguguguauguuggaauggagguuaaacugcacauugugugugauguuuuaggaacaaugcacacaugauaccagagaguaguguucauuuuccuugcauaugugaaguccuagguguuaccccagcacuacaaaaacaaacaagagacuacuuucuaagaggcaccaaauacuugauguguauuuuccagaauuucaauccaaaccuuuguuagagacauucuugcccuuaucaguuguuuucaaagggaucagaaauaaauggcauguuuuaauuacugauuggacaguaaguuugggaaguguuguaaaacggguuaugucuauuugaaaguguauauuaguauagauuuccuggcuuccacacaaaauggcaaugauugugaaacuaccaagagugaauuuagagacacccuucagggauuaugucuuacuuaauguuuugagacaaggucucaggcugcuguggaauauacuauguaacccaaacuggccugcaguuugagauucuacugcuuagcuagguccucagauuacagccauuugccagcauuccuggcaucuggcaauauuuaaaaaacaaaacaaaacaaaaaaaaaaaacaaaccagaguggucuauuaaaaauguccagagugcuuuucaagaacuguuugagagauuugaguuacuuagcaguaaaaagagagagguagaacaccugaccugggacuaaacagaucaaaaucaaauccauuaggagguauuuuacugaugggaaaucuguguuggguuacagaauuuaugaaagacuguuuugcauugcuccaucuugagacuaguuuauuggucaugcuaaggcggguuucuaguacauauguuccuuuuuguuuggauacacgugucuccuguagucucagugaccuagaacuaacucuguagcuaaggaugacuuugaacuccugauuuccuugcuuccaccucacaaguguuggcuuuaggcaugugcuaccauucccuacuuaauacauguugcuuuugaccagcaauuuuagguuuagcuugagaccacucaaaguuuauauuaauugaucuuugauggcucuuggauguuccaaugauaucauugucccuucucauggccaguuacuguauaugccucaagaagguuucuuuaagcaugugguuguaucaugggguuacuugcuaauucagaaguuggguuuuaugcuuacaguacuguaucuaucuguuguauuuuacauaucuguguaaaaaucuauuccugggauguuagagcauguuuugacaguugagcagcugaguuucuugucauugacuuauacaagugaagagaucagcaguuacgaagcguagugcccaagaggccccuagaacaugcagacuuauguauucuaaacaaaacuuaaaauuuuucagauuauauguuaaaaauauuuuuauucuuugggaauuucaugcauugauacaguguguuuagaucauauucacaccccugcuucaacucuucccuccgacuucuuuaagaucugaugcccaacaccuacuaacucuaugucauuuuucuuuuuaaaaauuagccacuaaguauacuuaugcagccuauacacucauagguguggggcccucuaugggaacacugucaccuaccagaguccacacaagcacauagagcugauguuucauccccagugucugucaauaguuaguagcaugggaggaugugcaaacccuaaccccauauuggacuguugacuggcuuaauccuguaaagguccucuguaggcauggacucaagugaguuuaugagugcgauguuccugccaugccuagaagauacuguuauccucagguuauuucugaccucagucucacccauuccuuuaugguccuugauccuuugguggaagaaauguuugauagucacaguuauaguugaguauuacaaagacacuguuugcacucugagcagucgugagguuuugcguugacugauagacauggcucaaaggaccuucucuggugagguugagagcuguacuaaucuagggguauagacacaggaaucuagauggcaguuugauacuauagccguugaacagaauuuuagaagagcacccuugugguccagagacccagguucuuggccagauuuacaguaucaggaaugcauuuccuccuguagaauggguuuuacauccaaucagagaguuuugguaaaggcauuagcaucccugccaccuuugcucucuugggcaaaucuuuccacgcuggucguuagcucaugggguucacagcuggguagacugcuggugacuuuuuuccuacagcagccugcauagacccuuccaauacuaugaagucuggccaacaggccaagaaacuucaaguucaguaaacuugauuuuacuaaguuccauaacacaaauguguggugccuucagcgauuuuaguuauauuuuaaaauucuggguggaaaauaagcaauggcaacagccuauauuacuuggggguaucugggacagcuuugaugugcuuuucuaaauaaaaaauugcagccuuguagguuuauaaaaauuauauuaaugaagcauuauauauaugauauauaucauauagauaucuuauuccuaugauacauauguguguuuaaaucuuuaauucuuucuuuuaguuuccaaacucuuuguuuugguuugguuuugguuuuuugagacaggguuucucuguauagcccuggcuguccuagaacucacucuguagacgaggcuggccuugaacucagaaaucugccugccucugccucccaagugcugggacuaaaggcaugugccaccacugcccagcuaguuuccaaacucuugacuggccauuauuauuaaauugagacagacuuggacuugaauccugcuuauguauuaauaccucuuugcuauuaauuauuuaacaauuaaaauaauuuaaucccuuuaggcaauuuaggauauuuauggacaacuuuagaauuaaauauauauaagucaccuguuccuuaggugacaaacauaguaacuuguccaaguauggugaaauagugcuuguuagcuuuucaauucuaaaacuucuuauuuacuugauagauucagguuguucugaagaucagauaaauaaauagggaaggaauaucuuacucugucucauaauuuuuuguaggaaucucuguauauuauacaauuuuguuuccagagucaagaauagaguuggcauccuuagggaguuaguuuguuuagcuuuucuuauuuuccccacuguuagcuggacacugucuuuguggugguugucuggccucuaucaucugcgcaagacagccgaauuuuaauucaagagaguaaguuggagaaaaagcuggaauggcacugugccugaugauggccucuugauaaccaggaacaaagcaaguggcaaaacauuuuccgcugugcuuccuugcuuuggcuuuggugguuuuggcuuguuuuauuuuauuuuuuauguaauuaaucuuuuaagauaaaaacagucaaugguauuuuuuuuccauauuucauuuuugaagaagaaacaaucuuuuauaaucuauucugagucaaggcaagaauuaaguaagagaaagccuuuguugaaaagugaaaaaaguuacccaggcaaccgguguuugccacaagugugcugauucaucaucuccaacguuacucacugucacugauuaccacagacguguggcuguagaggagccuaugccauugucauuuccucagcuuuccuaaggaugagcugagcaugagagauuuacugugcgcccuucuaaaaucaugcuuucaaccuuaaaguacaaaccagggcuguuagcauacagaacgaccugggcuugcuuuguuuaucccucaacuacuuuaucuguugaugggauaagauuucauuuugcaguguacaaauuuacccuagaaauauucuuuaaauagaagacuugggcuauggccgcaguauauaguucuuucaguuacuaacuucacuuuucuaagugaaaaucaagucuuacugucuuaccucuguggguaaaauaaccagcucuacauauuuuaaggcuuaaaauuuuaucaugugauuauuuaaugcauauuaaauggaauacauagaccauuuaaguuuuuaaguuuugucacaauuugggcuguaaaccguuguggaaacaaauucaucaaucccagugggaaagguucuauuacuuuuauuuauucauaaauggcaaaagcaaauaaaugguaaaacaggcccucauuuuuucguucacacaaacacucuuucacuaaccuuuccggucuggcaggcuuauccuucgcucccagugguagcaugcagguaaaggugcaacuccauguuccuugcuuccgaaccucaggagcugagccgggugugcaggcccugaugucuaagcaguggauguccguguccggugggauccacgcagauuuauuucucaacccgaagcuucuccucugggcuuucgggaguugagcgauuuugccaugccagaccagaguuuuaaagcuaaauuuggccaauuacaacuaggggguuccacacauuauuucaugcccuucuuuaucacucacaggcacacacauguuuucuauggucugguucucaguuaucuugggccguuggcgggcccauggcguugucccaccucggguucagggcagugggugugcauccuuuaucauucucgcccauucucuaagacuugguuuucauaacuaucuguagccaccggaagugcaacugugguagccuccaggcuggcaauuuucacagcuucaggaaaaaugcccucuggggcuauguguucuuuacaauuuuuauucaaguaguauaucccuuuaucugugugaguguauguugugugugugugugugugugugugugugugcgagcgcaggcaggcuagaaaaagguguugacagaucgauuggauuggaguuacagagaguugugaacugaccauugugggugcugacaaccaaaaucuguuccucugaaagagcacuaaauuuucuuaacccacugagcaaucucucuagucccaucauacccauaauuuuaauuaauggggguuuaacucauccugauuugaguguuaguaauaaaaguuuuauguuucagaaucucuauaaugguauugguuuucuuuauguaaaaauauacugucaagcuauuuuuucuccaguuuaaaacuaauaauuuauacuuaugacagaccauugauugcuaugaucuuacguugaaucagucuucuaaaauucuuauaguuuaugugaguauugccauguuguuuuaccauaaaauacuaucauaauaacuuugauuuauuugguuuaaaugggaaguggaauuagcaucuuggucuuucuauaagguaaaaggaagaagcaauuugaagauuaagcuguauaucuuuaucacauucuucauucagaaagcugagucauuuuaauggaaucacagucagaguacucagccuuugcuuugugugagagagaguauuucaggaaggaagaacccaguaaucgauggauggacacagucaguuauaggcuuauaaaguucuguuugauaagcaauugacuagaucagauuauuaaucuauuuaauuuggcauguucauuguaugugauaaaaagaguccaacugugaauuugaguguguuaaauaauuuucaggaagcccccccacaaaggacauuugaaugccuuaaaacuugaaauaaggcaugguuguuccaaauacacuugauuugccuagguuuacccaucagguugaagagaugcuaauuuguuacauucagcagcuggguuuugcaauauucuuuuccuccuccuagggucuaauuagccuucuuucagaauguggccuauuuagccuuagauucucaugacucauccagagcuggcuguacaaagcagaacccuuagcaggcggguguguccaacugcuuaauuagccagaauaaaaagguccuuugucaagcaagcgccugcugccccugacacaccugacaggcacauuaggcaaggaugacuaggcagaaauugugcuugucucuccuguaagaguauacaacucauuuacaugugggcuacaucagugacaaacugcaggggguuauuuaauuuaucaaaacaaaguaaugugacugcuuuugugauccauaaacaaauaucacuuaacaggcacugaaagauaaaaacuaagcaaauuacccccaggcguaaacaaaaccuccaaaacuucugcuggugaacgagagaaaauagguuauaagcacccaguguugcucaggggguugaagcaauagcccaagguagcaggcuucaggcacugcccuccugugagagagaguucucacuuugcacagauggaggggaguccccagaaugcuacagugugucaguagguuagaacagucuguuaacaagcuuuccucagaggauuguacucucccgaugugcuguacaccgucauuguucugaucagauuagguccucugagcuagugaauggaaagugcuucuggaaaaagaaccugcauuagaaucccaaaccuuucucacuaucagucucaggcucuuuguugagaaacuguccugaccugagccugcaucgcaggacacccagugagcauggauuuucaagucagacagaaguugagugaauuccgauucuuccuauuucugccugcaugcuuuuaacaauuuuuauuuuauuuauuuauuuauuuauuuauuuauuuuuuuuuuuuuuuucgagacaggguuucucuguauagcccuggcuguccuggaacucacuuuguagaccaggcuggccucgaacucagaaaucugccugccucugccucccaagugcugggauuaaaggcaugugucaccaccgccugucuuuuaacaauuuuuaaaaaucccacccauguaucaguuuacacaguuguuagcuaaggauaccaucugcaucaugggcuuccugugagcauaaagcuagaaauguauguaaggcauuagacuuuuuucugcaaucaggaaaggacuuuguaaaugauggaccuaauugcaguuauagccauuuaugggagugaugggaugagccuggcagagaguuucuucuucugagcugauggagguguugaaacuggagcagaaugaagcagugucugucaggagagcuugcucaggguuuaacgccauugacuguccuuggagaggaugguucccagcacccacaugguggcccacaaccacccauaacuccaguuccaaaggauugaaaacgucuuuuggaucuccuaaagagucaggcauguauuuguugcacauauauacaugcagcagaaucacuucaacacauaaaaugaauauaaugaaauuuaaaaagcuggucaaaagcauagaaacugggacuaagcagaaaguauucuggguuugacugacacuugaugcacuagauugggcuuuugaugccaguuuggauguggcagaggcagagcuggaagacaaauaaaagguucuccuacagucucgcuuuacauuuaaaaacgagcauuuguccuuacuuguuuaguuuacucccguugaauaguugacauauuuucuaccuuuuucagugccccauucuaaaacuuaaaucacucuuuuuauucuauuucccuuuucccugcuuguuauuaaacucagagauuccaauguauccugugaagucgagagcaugaacuucacuguagugucaacccuuuccuugauguuuccugugugugugcuagugagccagggaugggauucgacaucuucaggccuccaguuacucaccuauaaagugaaggacaucauaauuucauuaauuaguuacaaucacuaauacaaaauacuggcacauaagcucaucuuggcgcaguuuuagccagcucuguggagagcaggaggggaugguaguguaagaggugucacuguggaaacccaugcauaacggaugagucagaggucaggagacgcccuagcuggccacacaugccgucugaauguguacaccauacagacaacgucuccuggucauccuaaagcuggcgagacugagcgccaucccagcagacgcuauguguucgugggcuaugccuuguccuacaaacaucuagcucuguuguuagagcacaacaguaaucaguacucugagugugcaugauaaaucaaaggacccaaaagguucuugcauucauguuuggauugcuguuuuucucucuacuugucauggaaggaaaaaaaauuaaauaaaaggaagagcuaggguuucuaauuuauguauucuccuuuaagaaaaagauaauuuugaaggggauagccagugcugggaucuaacuagggcuaaguaagcacuguuucauugaacuauaaccuagcuuuggcuuccagcauuagagcaucauugucugccaucauccuaaccagaugggaauuuuguauacgcaaucauguaauucucauucagucuuagguaucuccaugguuuuaaugcuaguccaaauaaaaauuuauugacaugauuuuuacauuugaaagagccacaguuuguuauauuucacauaaaaaaaucuugauuuuucagcgucuuuugaaaaauugcaacuugucuacacaguggcuucucacguauccaggaugucuuaaagcugcauaugagcccaucacuguaaaugacccaagagccacaguccucauuguucaugcauuucuuccuucuucaguauacgcaacaccccucaauuaaaagugaaacucaggucguuucguggauuccuuuauuccugaguaaauauguuuauaaaaagcacccagaagauccucuuacuucugaacacaaucuguugcagcuguuacugcuggacuuuguggcuucugugcagcuuuaggacuuugacuaagaaagcaauaaggaaauucauagaucauguauagaaaugccaguacaacacuggagaacaugacucaggucauaaugacaagcauggcccagcuauucucuugcuacauuaacuauguuucuaaccucucgcggcuacagauuguguauuauaagaguagguuugugguuuuucaagguccaccgcuaaacuugaaugagauggugguuguaggaaaagaauaggauuggucacgcugugaggaagauuuugagaaguaacuuucucccccaagcauugaguacuugagaacuuaauuuucugaaggaacauaaauguucaccauguucuuuacaacuuuaaacugaaauguauugcucuucauaggcuaccaauuaucaguacugcauaccuuaucuacagaccuugcaauuauguuccuuuauccacagaccaggaaauucacauuuauuuuuauugaauuuguaacuagcauauaauguauauguaugaauguauguguauacacacacacacacacauagagacacacacacacuuagaaauuaauuuagaaaugauuuacucuguauucuuuauugacuuccuaauagccuugaaaaguaucuagaaaauaugguucauuacaaugggcaucuauuucagauuguguucugagauuugaauauuaugaauauuuauaccauaguucauuaaagaauugaaauacuuuuaacagcugaaaucaaaggacagccgcuuucagagaaguucugccucuuagucucagaccaagagguauaauaaggauuuuuuuuaaguaaaauaguaauuuucuuuauuuaguuaaaagcuggugacagugacuaaagauagacauaggcugugaugacaguguauugguaugagugguauuauauguccaaagccucguaauaggauuuaagaacugcagugacacuuaucaugcuuaucaugacacuuucaacuguuuucauguauucuagagaccaucaugcagacuucagagacggguucagacacagguucgacagugacucugcagacgucuguggcuagccaagcagcagugccuacacaggugguacagcaagugccagugcagcagcagguaaggaccuguccuuccgagaggugcugucuguugugaugacuggcagagcuuacuucaaagaugacuaggauuuacucucuugcuucuuggaggacugagacagugcuccagcucgcuucuuaaguuaggauagcagacaucucuugguuaguucccuggugugccggguccuuuccuugcugggcuguagagauaauaggacaaauuacagaccauguucuucuuguaagaacuucuaaugauuacagggaguugauuuuccuaacuuguccacuuuacauuuucuccucucuuugcacugcuuacuagaacuccuuuuaaugaaaagcaugauguauuuuauuuacaaggauuuugccguugugguguuuuagaaauugccuuggcacuaguuagcugcuaaauacucuuuagugaaaauaaaauauucuuuuuuuuaauuggguauuuauuucauuuacauuuccaaugcuaucccaaaagucccccacacguucccccacccacuccccuacccacccacucccacuucuuggcccuggccuuggcccuucucuuuccacugauggccgacuaggccaucuucugauucauaugcagcuagagacacgaguucggggggggggggguauugguuaguucauauuguuguuccaccuauaggauugcagaucccuucagcuccuuggguacuuucucuagcuccuccauugggggcccugugauccauccaauagcugacugugagcauccacuucuguguuugccaggccccgacauagucucacaagagacagccauaucuggguccuuuuuuaaaggucuguauaucuggcucaucccauuuaaugaauugcagaagaauuuaucaccagauacuuagucuuauucaugcugagggaauuugacuuguuuugaaaagauacugauaaguacuaugugccaguuaacaguucuguguguggacugugaacacacugugaguuauuuguuccaaauaguggcaaggacuugcauauuucaaaauaguaguuacgcuuaucuuuucacuucuucccuccuuccuuccuucauuucuuuuuuccuaauuuucuucccucucuccucucugucucucucugucucucucucugugucucucugucucugacucugucuuugucucugucucucucccucucccucucucucucuucacuaguacuaaaaaggaacuucuacaaauagugccuuaaaagccacugggauuaccgacaucauuaccaacuucacaauuuaacacuuuucacaaagguaggacuuucuucaaagaauaaguaaaaaucaauugagacauuguucugcauuuuuaacguuaaaaaguuaacaccgaucugucaauauuaagcacuuucugaacagauaagauuucugguucaggauuuaauuuugauccuacccauguaaaaaacugacacuugaguauaaaugugccagagguuccuaguuccagagcguaacuuuuugagaugguagcaggucuguaucuagccugaucuauccuaguccuuacuuucucccucucuuucuuugguuuagcuuucagagacaguuuccuuuuuuuuuuuuuuuguauuaaauuuguauauuguauuuuauccagugcuuucuauagcuuuuguauagaauguauaauaauggaaagagccaaauaauucauugacuuuguuacuaaaaucaauguaucggagcuuagcaccccuuuccgugcaccguucucagagggagccauguuugucuuuuaauuuauuguuuuuauguguacuuggguggaucuaaaaauaccuuauucuuacaacuuugcugugucuuuuuuguuuguuuuguuuuuaguauuuaacaugcuuccguugggucgucaauauaugaucucucucuuucauguacauacaaacacacauacucuucccguucuuuaugguaguaauaauauuuuagaguuacuauguaugugauauuuaguauguauuuccuuuguuuugcugaacugacaguagaauugagggccuuaugcuugcucagcaaguacuuuaccauuaaucuauaucuuccuccuucuucugauguacuagcuugaacugugugagucucugauaugcaaagcaauuauuucaaauauacugccuacuauuugcaauugaacaugguaggacaacauccaguguuuaugcugcuauguagaaaugcugcuaacaucuaguauaguaaucaaagacuuagugaauauuguuuuuucaauugugagauugcugggcuguaaaaaauaaaaacagucuagaaagacaacucagcaguuaacagcucaugcuguuuuguuuuguuuucuuuucuuuuuuguuuguuuguuuuuguuuuuguuguuugguugugguuuuuuguuuuguuuuguuuugguuugguuuuuuaggguuuuuuguguguguguuuuguuuuguuuuguuuuggaagacccaauauguacacauaguauuucaguucccaauauguacacauaguagcugucugccaacuuuaagccugucucuggagggaucaaguacccucccucuaugggcacuaaacacuuuugugugccuacagaugcucacuuacacauaaguaaaaauaaaggaaaucuuuaaaguaaagguugacauguacaagagaaacacuuuucugacuucuggucaucuguauggggacgaugagaugcuuuucucucuaaaguuuacagaaugaaacaauucucaauuuccugaaacuuuaaggugaugccugagauaggcagauuuucacacacacacagugcugggaccuggguuggccuuucuccccucaacucuucaguccuuuggcucuggaaaucuuaaguuuuuauaaaugauuguguucccucuguuuuuguucuuauacaucuucuuguuugacuuucauuucccccuuuaaccuguuaugucuaaugucauacuuuuauugaaaauuauuuauguuuacuuguauaacauuauuuugcaguuguuucuuuucuuuaugaagguacuauuauuuuucuaaguuggugaccuuucuuuucauucaguuuauuucaagauaaucuguuccagagugugugugguguauaccaauaaucaaaacuggguugacugaggcaggagguccagaaguuugaauccagccugaguuauaaagaauagccuauuucuaaaaaccaaauuaauaauuaaaaauuaaaauuuagaagacaccacaguauucuugauuuuuaaaacauuuauuuuggggguuauaauacacuuuuauaauauccccccuuccauuuccuccuuccaaaccuuaccauauaucccuucuugauuuuuuucuaauucauggucucuuuuuacacauacaaacacacacacacacgcacacauacacacauacauucugaaauacauaaauucaguuuguauguuacuuguauauauguuuucaguguggaucauuuuuuauugaauaaucaguuggugggcucuucccugggaagaguauuucuuccauucucagcauuuuuuaguugccuguaauucuuuguguguaguugagacuauuuagucuuuccucuauccacuuugguguaucuauaguugaucuuguucagcucaaguuugggcagucauguucguuaagacuuuauagguguaccuccugacaugacuaggagacacagccucacaguaaauucccagauccuuuggaucguagaauuuuauacuccuucuuuugcaauaugcccugagccuuaggauugauggauuuuuaaauuuuguuuugguguguguguguguguguguguguguguguguguguuuuguagcuguauccauugagacuggcaaagagaaguuuccuugaugaagggugacaacacuuaucuguggguauaaagacaagacaaauauuuagaauauagggguuuacugguuuaauaaaguggucuuuguagauucucccccaagauccaugauuucacucuccuuggguaguugcacuuaauuuuuguauauaaaguuccauuaagaaaguuuucccccaguuaugucacguaggcugacccauacauuuucuucuaguagucucacugcuucaggcuuaugucuuuguucauuuggaguuaguuuuuaugcaaagugauagauguggcucuguuuuuguucuuugacauguggguccaguuuucuuagccccauuuguggaaaguuuuuuuuuuuuccagccuuuguuuuuggcaucuuugucuaauacuaagugcaugaagucacauauacuuauguuugggucuuagauuuuguaccauuggucuacauaucuguuuuuguaccaguacuauauuguuuuuaucuuaagauaaaggcaauugggggggggagggggcaaaaaaagauaaaggcaauauauccuaagaacuggauagagcaggacacugaauaugggaccugagcuagaucuacgagguuaaggaggucauauagauagggggcaucagggagacucacuugucuagacccugggaaggaugucagaguagcuggauguggcauagaguauaccuauggguugagcacaguucugcacuagauccuggaggaggaugaggaagaucuuucuugguagggagguuuaauuuagugaagcuuuagugaauuuuguuuguuuguuucccuguuuugguuuuuguuuauacuauucuuguuaaaaaauguguucaaauguagauaaccuuuggguauuuauccaaauuuaaaauguguggaacuagguguaaccccacaucaaggaagugaauauaaagauugucauugguuugacacuugucugggccaccuagagaguuacagacuagcauuggcuuucuuaucaaauucugucucaaagaacaauacaaaucaaaucaaaacaacagcaacaaaaacucuaaacauaaggccaaaucaaauauacacaagagcaaaccaaauaaaauauagguauuaagaaucuggucugaaugccuuaguggcauucuuguugugcuuaacugauuuauacuucggaaucguacuguuuaauaacucugucuuccuuuuuuggcuaguaauauaucuaccaaaacuuaguucagccuccuacauaggguucaaaugaaugcuugguuggauguugggaauuggguagggaaaaacaaacagguuuuuauugcuuuuugucucucuuuccuaaccccuaagcccaaugugguaccacaggugauuagucuuccucaguguagguauugaacucaaaaaauaaaccucuaaacaaacucaaaggauaaaagggcugagaaagaaauuaaggaaacaacacccuucacaaauagucacaaauaauauaaaauaucuuggugugacucuaacuaaggaagugaaagaucuguaugauaagaacuucaaaucccugaagaaagaaauggaagaagaucucagaagauggaaagaucucccaagcucauggguuggcaggauuaauauaguaaaaauggccaucuuaccaaaugcaaucuacagacucaaugcaauacccaucaaaauuccaacucaauucuucauagaauuagaaagagcaauucucaaauucauuuggaauaacaaaaaaccuaggauagugaaagcuauccucaacaauaaaagaacuucugguggaaucagcaucccugaccucaaauuguacuaccgagcaauugugauaaaaacugcaugguacugguacagcaacagacaaguagaucaauggaauagaaaugaagacccagaaaugaacucacauaccaauggucacuugaucuuugacaaggagcuaaaaacauccagugggggaaaaaaacagcauuuucaagaaauggugcuggcucaacuggcaguuaucauguagaagaaugcgaauugauccauucuuaucuccuuguacaaagcucaaguccaaguggaucaaggaacuccacauaaaaccagauaugcugaauguaguauaagagaaagugaggaagauucaaauacuuggacacgggggaaaguuccugaacagaacaccaguggcuuaugcuuuaagaacuucaaucaacaaaugggaccucauaaaauugaaaagcaaaggacacuauaaguaggacaaaauggcaacccacagauugggaaaagauauuuaccaacccuacauccgauacaggguuaauauccaaaauauaagaaaguagacuccagagaaccaaauaacccuguuaaaaaguggaguacggagcuaaauagagaauucucaacugaacaaucuugaguggcugauaaacacuuaaauguucaacauccuuacucaucagggaaaugcaaaucaaaacaaccuugagauuccaccucaccagucagaauggcuaggaucaaaaacgcaggugacagcagauguugguaaguauauggagaaaaaggaacacuccuccaaugcuggugguuuugccaguaaaaccuaccuaguaaaaccacuuuggaaaucagacuggugguuccugacccagcuauaccacugcugggcauauacccaaaugaugcuccaucauauaacaaggacacaugcuccacuauguucauagcuaccuuaaauguacuagccagaagcuggaagcaacucagaugucccucaagggaagaauggauacagaaaaugugguauguacacacaauggaguacuauguauccacuaaaaacaaugacuucaugaaauucucagucaaauggauggaacuagaaaauauucugagugagcuaacccaggcacagaagagcacauauguuauguacucacuaauagcugaauacuagccccaaagcucacgauacccaagauacaaccuaugcaccauauggaguguagaaggaaggaagaccaggggauggaugcuucauuccuacauugaggggggaacguugugggagguggaaggagagagagacaagggagggaaaaaggagggggaagaaauaaaagacucaguaucaggaacuggaagagaugugacagagguacagaggguuaggaaaucaaacaaaaauagguagcaggggaaugaggaaauggggguagucacuggagugucccauaaagguaaccagagaaaggugagguucccaggacccaaaggacccaauagagaagggggagauagaaccuuugcagaccaucuccaguagauaggcauggccccugguggaggcauaggaccacccacccaucugacauuuuuuuaacccagaaauguuccuguuuaaaggaagaacauggacaaaaaaaugagacagagacugaaggaagggccaaccgggaauggauccaucuguggauacaucaugucugcagacucaaaacccaacacuguuguagucaagaggugcuuuguaacaggaaccaaguguggcuguuccuugagagguucagccagcaaaugaccaaugcaggugcuuggagccaaccaucagacugaacuuagaaccuggucggggagcuggcagaaagacugaaggaguggaggggguuugcaaucccauuggaagaacaacauaggcuggccugacuacccaguucucucaaucuagacuaccaacaaaggaguggaccuggaagggucuguggcuccagauacauauguagcagaaaauggacuugccuaaaagcaaggaggcccuuggucccaggagguuugauaccccagaguaaggggaugcuggagcugugggggcaggagagugugggugggugggggagcacucucauacaggcuaaaaagagggaguggggagggcagacgugggaagggggaggguuuaguggagggguaaccggaaagugagauaucaugggaugggugauuguuggaggggguaaucaggaagugggauaucauuugagauguaaaugaaugaaaugauuaauaaaguaaauaaagaaagaauguuagggaacauccuugaccuuacuaaauagagcugauaaaauuuuacuccuucuuaaauaauacugcugcacgugugugcauaugcauguguguaaaauuaauaaaaacaaaaaaguaccaguaugauggaugguacaugucuguaaucccagcauuuggaagacuaaguauguuagaggccagucuggaguacaauagcaaguucaaggcugaacuguaggacaugguaaaaaucuguuacauugucccacucaaaaggagacugcuuccagaaagucaguaucaccaaacauaaauagcugauuguauacauauucacacacauacauacauaugcauaugcaugcaugcacaugcaugcacacacauauaggugugcacacauucucacacuuaauucguguacaucuggaccacucuaagaacuccugagcuauccuguagagcuccuuucagaaaacagauuuucaguuccucaaauucuuuccucuggagugugcaaggcaggugauaccuuccuuugcuuuucauggaaggugagaauucuuauuuucuuuuugucaacacuguuuuauuuuccauagcuggcuaguguuagauuugcuuggaaacacuuguuauaucauccuagugggccugcucggaaggauuuuuuucucuuuuguccuuaagccccuuuuccuuuguuucucuucuccuucucucccugccuacuagaaagaguuucuuguuugaaguucucuggguugaauguuauauucuuaauacaaccauccacaaaugauaauaauuucuuauugcucuaaugugccuguaauguuugaaaucuuaauuaggaugcuguugaauacuuuuagcuuuuauuugugacacugguagaaacugauggagauugaaaucaaguaucaauguuaaagguaguuaauucuuuugauucagcuuauuaguauaacuugauuagaagugacaguuuuuauaauacccaucuugucuuuuuaaaauccuagauuacaugacuauauaucuguagaauugugacuagguauggacucuuagucuuacauuguuucuuugcuauuugucauucuacuuugggagguuuguauaagaaguuuuucagagcuucuucuucacagcagugauuuauaccugccucuaggagacaauccuccuaggccuaacagaauuaaccucuaggagagggacccuauugcucuacaaguucuuagcuagaucagguucuuuuaaugguagaucuguggcacaggacagaauuucaguacuuauuuuacuccugcaacuacagauauugccaauauugauaaugaauuuuaaaccauuagaacuaggaccuacaagccuuuucaaguuuuccaaccuuuacagcuagcuguaacuaucuaacacacuuacauuuucuuuggagaaagacacauauguauuguuuuuauccucaaaucaacaagcauauaaaucagcaaauaugcuaucucuauaguaugccuucuaggggaaucaugggauugaguacuucaagugaguucaagaaucaaacauacauauguguauauacuggcugggcuagaccaacuauucuaauaugccuguugaugaguguguuaugguagaaagcaaauagaggagaguuagucacacuggggaagugaacaaacaaugggacccagugacccucuguucauaguuagggcauuuaaauugcaguuggguucaaaugaagaaauaauuauggcaagagugcaagaauucaccuaauuaaccagcccuguuguuguagguguaauugacuuuauaaaguaaucugaauaacuccauuuacuugaggggauuaaucuggcucucauaaugggauccgcuccaagggguagccacacuaucauagauguuauacaaaauuaggaaucaaguagggauuuuauucaagaugauguacagaaagagagacaagaaaugaaggcagacauggcaggcuuucaugcugccuuuaguuaucuuuaucucuugggcucaagugaggaaccagugccuuuuaaguaaaaagauaguucuaagaaacuaucauauuagagcuuacaaaggacauuuucccagagggaaugauuuuuuuuuaagccaagauuugcuaagauuuuaagugaacuagaaggaagaguuucuguuguuauuuauuuuuuaauaaaagaaaacauaggcaggaguuuauaagaccagguacaaagaaaacauaggcaggaguguauaagaccaguuaguacaguuaggacuagggaaaggaggagaaagggauuucagagaggaguuaacagaugugaucugacauuccucagaggccauuaccucccuaacgucucccuugcuggacagcauugaucccaccucucuguccucauggucacaucuguuuuuuucuguaccugaauguuaggagaguaaguuguacacuccuuguauuuuggucaugcucaaugaauaauugugacaaaugugguaguaaauuuuacuagugacuucuguuucccaucuggaguuauauggguccuuaauucaaagauaaaaaucucccaucccuuguaaaacuuauucagaguccccuccugaauaugccucuuguauucaauaggaacagugagggcagccuccagaaauguguggccaacauagacaauaauuuuuaguuuggucauaaagaaagcaagcaaaguagccaaguaugaaagagacugauguaggggucauagggauauauaucucuuacuaucaaccuuccaucaaacagucuccgguuucuaccauuugaguggucugggugaauuguugaguguaagucucuugaaucccaaauuuccauacauggacucugauaccaacaggagugagcagcaggaaguagaagaaggaaagguauguaauaaccuaguauuaucagacccgagccucagcagaugugugaggucacauucuacugagaguggaagcaagcuggguuucccugguaucaccugaugucuaagggagcaagguuuuguucagauugaaauguuaaaaggaagguuaugggaaagaugaauccaguguauugagauuagcugugguuaggcacccugaaggugccugcccauuuaucuuauuaaagggauguucaaacugugaaaugggaaaugaucuuccugagaaaaucagagacugucucugaccacuacccauccuaagaauaagucaacaaggaucaaaauguauuugaaaugucuaguagugggcaagcagaugaaguugagcugcuagucuggcccagggagggauccccuagcuugcaguguuggagaaggaagaugcgauaccuggagguugaaugggaaauuggauagauuuuacaagaagcagugauggucuuuauaaaagauccucaggggugggcuguaaacagauuuagaaaaauuagacaaagccuggcuauuaggaugaaagagcugguacagauaggauagaauuuauugagugucuggggaugauagaacagaugugggcuguaaagugaggaugucuuguggcaugugagcggaaucuaggccucugagaucugaggcucaagcugccauguugacuugguuauuucccuugcagauaauugucugcuuggugugaucaguuuuggacaauuccuaugaccaugguaagacgaggggccuuuagcuuagccauaauuugagcagagauaguuacuaaccuccccuuguuguuaguuguuaagccaugcuucaucuagauggcagcuuguugcaggagacuguggaaggcauauuuggacucuguauuaagguuaaggaauugucccuuugcuaguugaaaggcauggguaagggauaccaguuuggccuguugguuugugguucacgcuggaaaggccugcuccucaaccaccuugaugucugaaacuauaucguaucccucuuuucagaccgacucuuguaggaagaaacugccaucuuguaccauguguagguggcugagguaguguuccuucguguauguaugugugugggaugaaguaguagcucuucuuggauuacaaugcaacagugagauggggcauguccugggacugguagugggaggagcuugaaauguugagaggcgagugugguguccucuaucaauacuaccugaagaggagaacaccuaggauauaaaggauuauuugagcaaggaaagugucaaauaaaaagugggauucuugaauuuucuaccuccaaucuaaacacaaauccuaggagcgagcagcaguguauccagaacauuuuacaaacagggaaauaaaauaaaacucguauaacaaaauguuaauccaaggcaagugggcuguacuuaacuucucugaggugagaggacuccugcaguagccaugcacugacuccugucgggcauugccagagggauauucauagaugugcguaauauccgauugugaauuggagugcgagggagccaaguaggcccugccuuaagagacugggcugaaauuguacauuggguugguguagaugaacauguacaaacagcacaaaugguguuuacuauuuauuauaaauauuuacauuuauuauaagagcaacugccaucauucguuuacacuguggcuuaaaaccucagugacaccucuuaacaaucuugucuuugauaagguuuuaacuuuuaaaacugaauaaugguauauuguuauaguuauuaguuuugguauauuauuauaguucucucauuugcuaaucaaguuucucuuauacccuuucuucuaagaagagagcauuggcagucucugcugucaugcugacacuuccuccccaaccucugucuucuacuaacccaacuuacuuucagguucuucaguuaaaguauuucccaucacuuaccaauuuguguuacugcuuuuuggauguucuccagcuccucuucaucucucauaacuugauagucuguuuucucuagcuacuuuuucaagauuauacauuuauuaaagagauguguuacauaauuuaaauuucugaccauaaguaaaacuuucuacuugauuaauaauauaucauaacuucauggaacugaaauuuaaaugauuugaggaucuauaaaucacugaaauuaucuuaaacgucauagcaugucuguaucaauuacuucaguuauuaaaauguaucucagagcuguguaaguugaaacacuaguuuaaucuuaaguacuuuguucucauaaaaauaaaguauuaaaauuaaacaguaagaauugaauaugcuguuaaagaaauugaauuagcuauauauuauauuauauuuuaguuuauauuauauauauuauuuauaauauauauuuauauuauauuuuuuacaagucucuaaauuuauuuacuuuaucuuguuaagucuuuuaaguguuaagucuuguuaagucuuuuaagugugugugugugugugugugugugugugugugaugaagggagagguuccuacuguuaaaaacagaacuauguaacuuuuaaagaaaucaaauuuaugaaaguuguuacaaaauauguucugauagcaauuauuaauaacacauaucagucauauacaacauacacaguuacaaauaacuaagugacuacuuccgauaagauuuucucuuaaguagaguaggguaauuaaguaacuuuuuuguccaguuaagggauucuuucuauaguaaaaauaaucuuucuuugaauuauauauuuggccaucaccucucagaguauguaucguauuauuaaaaauaaaugacauuauuugaaacucaaauuauucuuucacuuuugcucaggggaaauacuccauuuuccaugugauauuuuuuccagccccucauuucauugcauucucuuuuucuuuucuuucuuuuuauuuuuuguaaauuuauuuuaguuuuaauuaauuuauuuuuuuuacacuccauauuuuauccccucaccccuauucaccucugacuauuccacaucccauuccuccucuccaccccccugucuccacaucgauguccccaccccacuaccaacuucuaaacucccuggggccuccagucucuugaggguuaguuacaucaucucugaaugaauacagaccccggcaauccucuacuguuauguguuuugugggccuucuaucaacugguguagcuaucuguuggugguccaguguuugagagaucuuggggguccagauuaaaugagacugcugguccuccuacaggaucucccuucuccucagcuucuuccagccuucccuaauucaacaacaggggucagcugcuucuguccauucauuggaugcaaauaucugcaucugacucuuucagauguuuguugggucuuuccgagggcagucgugauagguuccuuuuugugagcauuccauagccucaguaauaguguugggccuugggaucuccccuugagcuggaucccacuuuggccugucacuggaccuucacugaagugcccaacugaggguggcucagucccacuugugagagagaagaaagcaaucacaaguagggagggaggaagggaccuggaagggaaaguggauggguggagggggggacaguggaggagagaggggaaccugaucugguauuuggugagggaaaaggacugaaccucugaggaccaucagaaagaauggaaacaggcaaacucaggaaauaggagguuggggggacccuccaaaauacaucagagaucugagagcugagagacucucaggauucaaagggagggaccuuaaaugaaaugcuagacaguagggaaagggaacuuuuagagcccaccuccagcaggaagacaggacaucaagugagggaugggguugccaucccacagucacaucucugacccauaauuguuccugucugaaagaauuacagggauggaaauggagaggaaccugaggaaaagaagauccagcauucucuuuuucuacccuggcuugucuuccuuguuuuauuucaguguuuauuuguguccucuuuauuuugggcucaugcauuugagucuugugugaauucauugaucauucuugugaucauuacagucaguuacuauggaaguguuaacuuugagggaaacaucuugcugcuuucuguuauuuccuguguuucugcacuggaacuuauccaugugggcccagguaguuggcuagacgcuuuauuaaucccuuacguucuuucaguggauucaggcuggaucagaucgugacaagauggaagugcauuuucuccugacuaaagcacaacgucuacacccacccagucuuugcaaggcaccaaagcugaugugcaguaccacuuagcucaaauauuuaaauaugauauuuaacacucuuuaguauaguuucugguuucuuuuucuuuuauauuuaugucaugaggaucauuaaguuuugacacagcagcuggaucacaguauuuuaagauuuuuuguuuuuguuuuuguuuuguaaaagagaguuuguuauccuggauaguguugccauuuagaucugggcagccuagaacucacuguguagagguuugucuugaacuuacagagauccuccugucucugcugacaguacagauagauaggugcuaccacucucauuuuuaaaauguuuggguuuuuguuguuguggguuuuuuguuuguuuauuuuuguuuaaaaggagaaaaauagauguaagaagauagacagaacuaauuuaauuuaagaagaaagagaauuuuaaaacgaguguuaaauaucauaugcaaauauuuaagcugcuugggcaugguaaacucaauacuuagagaaagauaaaaacuguaacacuaagaacauuaaugaacggggaaaaaguuaggcuuaagagaaaaaggaggcguacaggaucccagugcuggggcagcugugaaagguugagacccugcucgcuugcucuucaguagagaacuuuggccccugugcucucuggccugcucuucccuuuguuguacucagcagcagcaguagggggagcuggcuguaacuaaucucaucugcuuaucagcagguugcagccaaccauuggaaugagcacaggguccccaguggaggaguuagagaaaggacugaaggagcugaagggcuuugcaacccuuaggaagaacaacaauaucaaccaaccagacccccaccccaucccagagcuccuagggaauaaaccaccaaccacagagugcacauggagggacccauggcuccagcugcauauguagcagaggauggccuuaucuggcaucaaugggaggagaggcccuugguccugugaaggcuugauggcccaguguagaggaaugccagggcagggaggugggaaagugugggugggugggggagcacccucauagaagcagggagagggaagaugggaaacaagguuucuagaggggaaacugggaaaggggauaacauuugaaguguaaauaaauaaauaaaauauccaauuaaaaggaaauguaaauaaagaaaauauccaauaacagaaaagagaagaagcaaggcgagcugcccaaggguuguuccaguaucuugugcuuccauauaucgagucuugaggcaggggggaagugcgcgagcccacagcagauggugggaauauccgacuauuuauauggaugacgaugguuugaacucagaucuuagugauuuugaggcaaacaaauauguuuaccugugaagacacgcccccacuccuccacuaguguuuccuaaauacuaccucgagcacagauuaguuaagggcugaacugauaaaauucuguaauguguucaugaacacauaggauaauuuuaucauuauuuaccuguuggccauagaaguguuuagaauagaaugaggugucaccaaucauuugggagccaggacagcucaugagaggucuugguccuaugucugguuugcauuuuauaaucuaaaaccaccaggugggucaguaagcgagugagguuuuacaggagcauagagggcaguagauuguuaauggcaaggacucauuguuucagcgauuucuccaggucauucugguagagggagcaugugaaggcaggcuuggcagacaggcaguauuaacagugcucuagguaaaucacuaaucaaaucaauaaaucaguaucuaauaauuggucuuuucuagauuucucuacuucauaccuacuucauagaugucacuuaaaacaucugauuguuuguagugucuuaaaagauuuauuaaaugagguauauauaaauauaauuaguuauauaguccagccugaaauucucuuugguuauuuguucuuugcuucagagcagacaggcuuguuucuguuucuguaaaagauacgucaucuaaguuuuacaauaauacaucuuuucaugauaauuccuuggaaggagucuaauagaauuuuaauuucuacuauguauuuuuauagauuaauggagcuauuaaaugguuacagaguagagagaaauaaaaaugcuuuauugguauaauccaaauguuuguuuagaagcaaaucuucccaaauccugguauuuaaaaaguagaccucccaaguauugagggaauugauuaguccauaaagggagaaccuuccuggagaccaucaguguccuucaaaaaacggaauaacucccuuauccuuuccaucacauggggacacagcauagaguuacaauauaugaggaagaaagugaguucuuaucaguaaccgauuuuccuuauauuggacuucccaaucucuagaacucugugcaauaaauuucaguuguuuuugagacacccaauuuauauauacuuuacuccaaacggacuacgacaggaauagcaugagaacuaauucuuucuucuuuuuuacuauugucuuuucugugucuucuugcuuugauaugcugucuugccugggugauuucuuuuucaggaacuccuaaagcuguuuguuguguuuuaguaugugccugcucgggguuugauuguauaccagugcaugcaguugcuaguaauucagcaguaggcgcuaguacgucauucacggggauacucacacauacaaaacuguucuuucucaucauuucaaaucuaacauagguuuugaagaaagcugcguauauuaagaugaagugaaugacaagauagggagguuaagucuccaucauuuacaaauaaauaaaauauuaguaaaauacuucuauacugugagcuaccgggcacuuuggcaggcaggugggaaauagauguuagauggcuaggcuuugccggaaacauacucuuaccacaucuggggcacugcaacaacuuaguaaguuguaccuuuacuuauuaaaucagcauuuguucuaguuuccuuucuguugcugugauaaaacacuguaaccaaaaagagcuuaggggaagaaaagauuuauuuaauuuacauuuccagaucagaguccauuauuugaagaagucaagacagaaacuaaagcuagacugugaagcagaaaccauggaagagcaccgcuuacugcauugguuacuugcuggcucauugacagcucacuuccuuguacagccccagaacuaccugcccaaggagugguaucacccacaguugcugccauucuacagcaacuaacaacccggguacucucucacaaauauaccuacagaccacucugauauugacauguacucaauugagacuuuucucuugugucuguaggacaaaauucauugugaacaugacacauagacauaucacuuuaaaccacagauaaaacaugcagcgcguuuuaaguuuuguuauccuacuguuauaaauuuccuuucaaaauauauuuuuucaaaguuuacauaauucagcuauguauuagaauaugaauaauucaguguuucuuagaguaagaaaaauuuuagaaauuuaauauauuauucaguagucauuuuuccuuccagauagaaggucaguuguggggcaguuuaugcuaaugagauuaagauugcugguuaauuccuauauuaccaaacuauugaguuccauaaacauuauaaucacugcauaaauguagauaaaauacugaaauaugcuuccuuaucacauauccugaccuuugugauauugauuuugcauuugugaucuugaucguauuauuaucguguuauguuuuugaucacauuuuuacuuaguaaagcugagcuucuagauugucuuauguguaggacauguggugucuaccauaucugugucaguuugcucugugcugauaauaugcacaugguuuggggagguacuguccuuucaucuuagcaagguauuaaaauguaacagggauuuuagagauuagguuuguauguguuaguccuaacuagggagcagcacuaggaauccaaaugugucugauuauguccuguguccccugacccuguuuccaagagugaucccaaaagccauaggcaugucugauucuggcaguaauuguucuggauccugucucauugaguuuucucuuccgugcugauggaucuuuugucugccugauauaaccuugaguugccuggaaaaaagaaccugaauacagaaaaucccuuccuccauacuuaccuauaggugcauaugugggcauuuucuuccuucaugguugaugugugcaugcucacaucacauggcacugggagauguggguaggagaagguugccaucccuuggcaggugaaacuaaguuuuuauaagaaaucaggcaaagccaugggguacagcuuccuccauugcuuuugcuuuaguuccugccuucagauuccuagcuauggcuucucuuucaugauggagugugaccugagaauugccagcugagacgaauccuuuccuuuccaaguuucuuuuggucaugguguuuaaucacagcaauagaaaccccagugaaggcacuugcucuguaagaaguuguaguaaauucugugguucccagcaacauuguuauguuaguuuccauaggauauaaguaagucaggcuggcugggcuagaccggauacucuguugcaagucgcuggcagugaauuucaucugucccaguaggcauuguucuucagaguucuuggagaagagaucuguacaaaagcauugaaguuggugucccauuucuggcccuguuuucaguuguacaacugacuguuucacugcuguccaucugcugggcccuggucuguacuuccaggagcuagucacaugaacuucugcucauuccaucuucugaguagaaaugaaaucuuaccgcugcugauucugacuuccucuucaucuaccagcuagaccagcacucgucuuuguaagggcugcuggcugcagaucagccugcccuuuuaauaaguaaccugcacuguguaagaauuaggauucguagucuuuugggaacagaauuuugacaacucugccuacuauaacacuuugaaaucauaauagcuuauucaucacugugaccuaggaugaaacauccaacucucauaugaaaauuuacaucaauucuaaaaugagagauuuguuacagaugauauauaauaauaguacuuuacucuuggauagaaagauucaguauuucaaauaauuuauuucuguguuauaugacugaaauuugucacguuuccaaugauucaguguuucaaauaauuuauuucuguguuauauaacugaaauuugucacaauguuuccuugaaaggugaccguacugauucuuacauuaccaggaaagaguauauauauauauaagaauauuugaccaaaauggaauaaugguaaagaaaaauuuuguucuaaaucuauuguaauaaacacugagugguggccuggagauguaguucugucuuaaagucaugccuugaaucaugacaaucuaacuuccacccccaaauccaugaauccauggagaaaugcaugggagaguaggaguggaccuugcuuauaauccuuccuccugggaaaggaaucccugggccauauuagccagcuagucuaacugacuagguaaguuccaggccgguggggaagccuggggagagggggagaggggguagggggagagagagagggagggagaggaagaaagagagaauaugaauaugaaugggaauaguacuugaggagugauacucaagcuuaacuuucacacauauucacaugcacccagacacacccaaauacaaacauaggcauacucucacacacgcucgcgcgcgcacacacacacacacacacacacacacacacauaugugcguacacacuugcauacaguaguauaagacuaguaauaaauaaguguaucuuuguauaaguaagaauuuuguuuaucaaaauuauauuuuaccuauucaaaauggacaugcugagcauaacaguuuaucauuauaauccccuuguuaggaaagcucaguagaacucuuaaguucaagaagaaccucaacauuauaagaaaauauauuaguaaacaacaaaaauaaaccuaaagccaaaaugacacugauguuuuacgaagaaaaccuuuuuuuacaagaaccuucagaaucaguaauggaugagaaaccagugucauggacuaaugggcaaugguugugaaaagcuauucacaaagcaugaaaaccaaacggccaguaaauauguugagagauuguagccaugcuguugaacauagcccagguuagccuugcucucauggucuuccuuucuuguuccucagcacuggaauuauagcauuuacacuaaacacagcuuaagguaaauauauauuuucacuuuaaaacaagugaacuuugcuuugcuuugcagugcuggcauagaguucacaucacauacaugcuagaaaaguacucuaccacugagcuauguccacaaugaggaguauuucuuuauaguacuuuauauaauaaaaguaaccuaccuacugcucccuauaagugaaacauuuaaauaaucuuuaucuauauuguaggauauucuaaaaucaauuaacaguaguuuuaggauauauuuacaaucacauaaacacacaaagauauaaacaguucucaguuguauuauugaguaaagaaaaccaauuaguaaaaauacauuauauuuuaguuauuugguaaaacacgggaagaguggggugcucauaauuccccuugguaguacauguucuuaccucuuaagagcccuacccuacaaggaccauguacauuuccuuauacauaaacaucguuccaggaggugcugcggccaguauauaggcauuaaaguguauauuuuauuuuucaaaauauuacuuaguguauguaguauauuguggugguagugugcucuagugggccuugagaagaaauaaugcuuaagaacuuacuguuacuaugaugaaauguuacucuuugaacacuuucaagugacuucaagcaucaagugcuuuggugguagccuguuugggaguaagcaguuagaaauauuuuauguuuuuaguugucuaccauuugaucucccagguucuuaugugaucgggaggugacugaguccaucaggaauauacggcuuugugauuauauucaaagcccagauguaacuucuucaaguugcccauagcagucacauaguuuuaguaaauaacccuauggaguucaguugucuauagcccuguugcagaaaugagcuuugugguggucuuuacuggguugaauuuaaagagauucauuugaagccaagggacagcauuuaaagaaccaagauugcuuuugaaaucagaagcuacacagcguauaaguggaggagccaucuacccaagagccacugaauggauuuauaacagaaggaaacaaauucaagcuuuuguuacaaugaauuuuguccuuuuagugagaaucaugcccuaccaucaaucucccaucuucuuugucuucacaaagguuccccacacccaggagagagacuaaacgacuuauuuugguuaacacuuacuguccuaggaugaacuuuauaaauacuaacauuguagagaaacucccucuucucaguaagggcaggcagugagagagaacuuaaguaacuuuccccuuaaacuguccugugauuucaccauuccuuguucacugugauucuaugcuuaugaagcaauacacuuuaugaguacacucagucugguauucacaaagaugguaggaguccucuugguaggauguauuaaaaagcuuaugacagaauuuacauugcuuuuaacuagacugagaaaaacaauuuuuuguuugauuucuauuuccuagcuccgugcuuguuaaaccagcagauuuuucuuuguaccuuuucuuucuggcaucuugaggccagcuugcacacacugcucucuugacuuuucuaucauuggcuacgucauaugccuccaguuugguaguuugccaugccaggaugaguccgucucucucuucucuuggguggguagcuguugucauuacugcugcuccuacacagucaccccugucacuucccccgucccucuugccgcuguuacacaguacuuucccuccuguauaacucuuggucaguuguauagcagccuuuuaccuaacugcucuuguaucucgucuuuuuaaucuggucugaacucuugcacugucucuuguaggccuguuagagugaugcuaauacagcuuuuuguaguucucaaguugaacacuuaaagcacuuggugccaacuaaauguauaaugauuccacuuaugaguaagauaauuaucuugacauaaggaagaauuuuuuuacaaagauacuagaaaccuucucaacugacuaaugaacuuaacaauuauacgugauuucauuuaccauugagaaggguuucagcuuugaaguaugauucauguucuuuuucuugaaacacauccaaaauaacauauuguguaaauuuguccucaaauauacuaauugauucuguugaacuagcacauguuccugugguguguaauuuccuuugauauucccuuccauuguaauaaggcaaaucaugagaaauauacauugaguaagcacauaagcucagaguauuaaacugugaaugaugauauaagugcuuguuuauuuaaauauauauccauaggaaacacuuaaguuucuacacuaccuagucacuaugacuauaaauggauuauuucacauauuuacauuuggcaguauauuuuugguucaaucggcagaguaacuaucugguguagaacguuguucuaaggagacccucauuacugccaacuuuuuaagcuuuuaaaaaucgguccuucauguauucaaacacccuuaaucuuuuuuuaaagauuuauuuauuuauuuauuuauuuauuacuuguaaguacacuguagcuucaggcgcaccagaagagggcaucagaucucauuacgggugguugugagccaccaugugguugcugggauuugaacuucggaccuucggaagagcagucgggugcucuuacccacugagccaucucaccagccccacccuuaaucuuuauucacugauuauuuaauauuaaaaacuauugauuaacuacaucaaaucuaucuuuuuuauaucuuuuucaauucauauuuuagccucuuaauucuuuacuaaaauuaaaaauaaugaaaacuauuuauuauuuuuagaagcuuuuugggaauucauuuggaaaagcaagugaaauuaagagaugaacuuuaagaccaguguaauuaauuuuuucuaaggaccuggauaagggauaauagcagcagaugugucagcuuagagauuguacagagauuuggggauaagggccuuggagaugcugaugaaaugcugacaggaguuaguuuccuagcuccaucagaaaugcuuacuugaauuuuccugcauucaccuaauggagaucaaaguggaaaucagguucuaaugcacagccuuuuaacacagauccaaacaucgcuuaauguucaacagaauaacaauuaauacuugagaaauuugaaucaguuguuuuagaaagugagaauagcgugcaauguaaaaaauucucuucauuuuuagugcaguugaagcagcaguuaaaaauggucucauccagagaaugcagaaaugacuguugagagcacuugugguuuguccaguggaugugaguccaggucccagcacucaucucaaacagcucacaacugcuuucaacucuagcuccaauagugucuggagauacacacgugcauacaaauaggauacccucacacaauauaucuauguaaauaaaauaugucuuuaaaaguuguuuuguuuacuuucaaauaauguuccacaguagcucuauucuucaauaaaaguugauaccuaaguuuagaagauaauauauuuauuuuauaaauauucauuaguaauucauuuguaauguauagugcauuauuuaacuauugaguauuuauacauauauauguauauguguauauauauauauguguguguguguguguguguguguauguauauauauauauauauagugagagagagagagagauacauagauagauauuaaccuguuuggggcuuuggguuaauauaauacuaauuuguaaauaaaauagaaugggcuggguucugccauucucaauuugcauuuugugacuggguuuacuaaucagaauagacaaucuucauggcuuugguucgucccuagaucucaccaucucugaugaagaguggagaagguggggugacauuucuauggcuuuauaaucuaccucuauuaauaaggaaccccacucccaaacaaaauuaaaugauuaacuuaauugaaaaguaucuuagcuuuuuagagaacaggauauauccuauggugugugugugugugugugugaguguguguauguauuuuaccacugggaaugugugccuaguuuugccuccugcacugugauucauccuaggaggaaugugugcucaccuucuuagcagucugucuuuuuccaucuguuucugugcagaaacugcuugaugggcaucuguagccuacuauuucaguuguuuaggccuuuccccauucacuguguccguucuuugacuugguaggugcuaaaaaaguuaaagccuaguuucauguuguccucagauaucuccaugugaccaagaaccuuuuugaauauugcuguccuugauaaaucucuaauaggauuuuacuucugagauucuugacauuuaugguuuaauucuacuuuaaugauaauuaaauuguaauuauaauauauuauuauauuaauuuauaauauaauauauucuaaaacaauaauauacaauauuaauaauauuauaauuagauuauaauauucauccuauaaagccacaauuauucuaauaucuaugccacacaaagacucaacaaagaaagaacuucagaccaauuucccuuuugaauauugaugcaaaaauacucaaaauaucacuauuuguagaugacaugauagugaccccaaaaaaauccaccagaaaacuccuaaaccugauaaacaacuucagcaaaguagcuacauuuaaaaucaacucaaacaaaugaguggccuuccucuacacaaaggauaaacaggcugagaaaggaauuagaaaaaugacacccuucacaauagucacaaauaauauaaaauaccuuggugugacuauaagcaagugaaagaucuguauaauaagaacuuuaagucucugaagaaagaaaucaaagaaaaucuaagaaaauggaaagaucucucaugcucauggauuggcaggauuaauauagaaaaaaauggcuaucgcgccaaaagcaaucuacagauucaaugcaauccccaucaaaauuccaaaucaauucuucacagaguuagaaagggcaaauuguaaauucaucuggaauaacaaaaaacccaggauagugaaaacuauucugaacaauaaaggaacuucugguagaaucaucauuccugaucucaagcugaggaggaauuguaauaaaaacugcaugguauugguacagagacaggcagguagaucaguggaauagaauugaagacccagaaaugaacccacauaccuauggucauuugaucuuugacaaaggaacuaaaacuauccagugggaaaaaaaaaccagcaauuucaaaaaauggugcuggcucaacuggugguuagcauguagaagaaugcaaaucaguccauucuuaucuucuuauacaaagcucaagucuaaguggaucaaggaccuccacauaaaaccagagacucugaaauuauagaggagaaagugggggaagggccccaaacauaugggcacaggggaaaaaugccugaacagaacagcaauggcuugugcuguaagaucaagaaucaacaaaugggaccucaaagaauugcaaagcuuuuguaaggcaaaggacacugucaauaggacaaaauggcaaccagcagguugggaaaaaaucuuuaccaaccauguauccgauagagggcuaguauccaaucuauucaaagaauugaagaacuuagacuccagagaaccaaauaacccuguuaaaaaugggguauagagccaaacaaagaauuuucaacugaggaauaccgaauggcuaaggagcaccuaaaaaaauguucaacauccuuacucaucagggaaaugcaaaucaaaacaacccugagaugucaccucacaccagucagaauggcuaagaucaaaaacucaggugacagcagaugcuggcgaggauguggagaaagaggaacacuccuccauugcuggugggacugcaugcugguacaaccacuguggaaaucaguuuggcaguuccauuccugggcauauacucagaagaugcuccaacguguaauaaggacacaugcuccacuauguucauagcagccuuauuuauaauagccagaagcuggaaagaacccagaugucccucaacagacgaaugugguacauuugcacaauggagaacuacucagcuauuaaaaacaaugaauuuaugaaauucuuaggcaaaagcauggagcuggaggauaucauccugagugagguaacacaaucucaaaagaacacacaugauaugcacucacugauaaguggauacuagcccagaagcucagaauacccaagauacaauucacaaaacacaugaaacucaagaagaaggaagaccacaguguggucuucuuagaaggggaacaaauuacucauagaaggaguuacagagacauagcauggagcagagacugccccaccuggggauccauccuauauacagucaccaaacucagacaguauugcagauggcaacaagaacuugcugacaagagcccgauauagcugucuccugagaggcucugccagugccugaaaaauacagaauugaauacucaacagccuuccauuggacugagcacaggguccccauuaaaguugcuagagaaaguacccaaggagcugaagggguuuugcagcccuauaggaggaacaacaauaugaacuauccaguacccccagaguuccccagaacuaaaccaccaaccaaagaauacacauggugggauucauggcuccaacugcauauuuagcugaggaucuccuaaucagucaucagugggagaagaggcccuugguccugugaaggcucuaaaucccagugugggaaugccaggaccaggaagcgggaguggguggguuggugagcaggggaaggggacagcgaauaggggguuuucagaggggaaacaggaaaggggguagcauuugaaauguaaauaagauaucuaauaaaaaagugaggagccagccgggcgugguggugcaugccuuuaaucccagcacucgugaggcagaggcagguagauuucugaguuugaggccagcuuggucuacaaagugaguuccaggacagccagggcuauacagagaaacccugucucaaaaaaaaaaaaaaaaaaaaaaaaaaguaagcucuuauaaauguaugcaauuucugaucaacauuuauuuauugaugugauaaaaauaauagauuucaaaaaaaauuugcaugggcaucaaaauuuauuguguugccgaaaaagaccuauaccauauuuuauuuuuauuuaauugauuugcauaauuaauaaaucucguuuguuauuuuuauuuuaugcaaaggaaauuauuauuggaagaugcuaggguacucucagacgguucauugcuuaaguauagauacuguucuuguagaauaacagaguuugacaaugagaacccaugucgggugacacacuaguaccugcaauuacagaucuagaucauccagugccuguggucuuugacugugccuagauucacaugcccauacccauagcagguacauacaauucaaaaauuaacaaaugaaccaaucugccacuauaguacucaaguguugaguaucuccaaaggaguauaacuaguuuuuguagccaaaauuuguggaucuuacacucuccugauauugaccccagaaagaaguccugaaaaauggcugaaaacacugcugcaggagacuuuuaucuuuguguuuuguuuugugcaguguuauuuuuucauuuugaaaaugcaagagcaauaugaacuuacagaauaauaaaaaaaaaaacccaaaccuaacaugugacucaaacucggugucacacuaucaggucuacuuugugcuuuuacuuaucagugggugcacauguauauaugcauauguauacacauacacaaaucgaaugcuacugaaaguaugugucuguaauaaugcccugugggugugaguucgucagcuacacauauugugccccucucaguguggaugggagugcuaguauguaauuggcccaguuuuuguuugacuuuuccauaguacuaaaacuucucuggacaaaaguguguuugagaaaauaaaagugucaaaaguauggaaacuaacauacauguaacuacacauucaguuuaauuuaagaaacaaaauaaacauuaaaaaugugaaaucauuuauaauuuuaaaauggagaagaugguaagcauucauagggcagauacuauacauaguauuucuagccacuuuugaagcaaaacauauuauuacuuggagaagagaaaauauacuuguauauuugaauaaauaaacuucaauauuuaauacaguguuuagaauacaaauaacuaccaucaaccaguaaaaaaggacuccaacauucaggaaauuauaaaauuuauuaauaagugaauuacaagauuaaauuuagagaagaacagugcauaucgguuuuguaaguuugauaauaaacaugagagaguuuucauuuuaaaauuaccuuagucuagaauuauaaaaacuaccaaauauauuauauugauagcugguguuuucuuaagaaaguaggcauaugcuuacauauauaucauggaagauucauagacacaaguguauguaagaucuacaugaaaauguacucucuaaagauauguuguacaauauuacuuaaaauaaugaguuuuauaaaaacagaagaaguaaaagcuuaaagauuaugaggaauggaaguguuuaaagaacuucaguaaaacacuuuguacacuauagaacuaacacuagaagaacaaaauacaugaacauggcuuuuaauaauaagacuaagacaucuaagagauaaaaaguggaugugguagucauuuccccuccauguucucauguccucugauacucucacuguuuuguuuaugcugccauuucuaggacagacagcagacuuccugcucaucaggcuuguuauggaaaccucuuaagaaaaugacagaaaauuuuaacuaccacaaguuuacaacuuuuauuaaccuuuuucuuuauagaaaguagcuuuugcaacccuauagguggaacaacauuaugaacuaaccaguacccuggagcucuugacucuagcugcauauguaucaaaagauggccuaaucgaccaucacuggaaagagaggcccauuggacuugcaaacuuuauaugccccaguacaggggaacaccagggccaaaaagugggaguggguggguaggggagugggggcgaggguaugggggacuuuugggauagcauuggaaauguaauugaggaaaauaccuaauaaaaauauuuuaaaaaaaaagaaagaaaguagcuuuugaugauuacuaggauucucagggaaaaaaacuaggucaugagccugacgagucuggcuacagcaacccgacuccugauaccaaagucgguauuacagauggcuuccauaugagccaauggacaggcgcaaaaggaagaucucagcuucucaaguuggaacuucuuccaccucuagaguuuuacgugacucuuaaucccguguauauggggguuggaguggggaguaugagcauaugagugcaggugcccuuggaggccugaggcaccuuggcuggaguaagggguguuugcgacugcucaagauagacugugguauccaauguauccucaguggaacaauaugccguccucuagcccugugcagcuagauuuuaucaacaauuuauaugacauguuaaaagucguagcacaaaauuuagugaugcuguucacugagucuagaaugccagaaagcucaauuuuucccccucuagaugauaagaggcagcauauuaaaaaaaaaaaaaaggagggggaagcuuuuauugauuaaggugugagguaccuuacugcacuaugggaaacguguuagcaucuugauuugaacaggcacacauugcacuggucaucggaaugauguauuccugauaacaugauggcacuguuaaugcuuuaauaauuuugaucucuugguauuagagaaagggaucaaugguuagcauguauccugcccuuguggaggaccugaguuugguccagacaugcauauauauaauuauuagaaauaaaucuuuguaauaauuuucauuucuuagaaauaaugaacugugacccuugaguggcucaguggcaaaagguucuuacuacuaaaccugaaaccuaguuuugguucuagaaugcacaugguagaaguauaauguuuuccaagauccauaugucucuccuccauaaauacauauauauauauauuucauauguauaugaaauaugauccuugaauugcuuuuuauaauccugcaugugugggauggacagagaguaaaaggaaaggacauggugauaguuauuucaaaaauuaaugcaugaaguuuuuaagguaauuuuaaacauuugaguguucaaacuuuuauauuauggggguuuuauuauaauguuuuauuuuuuuagauuauaauacaaugacauuauuuccuaacuucccucuguuuccuacagccuccuccauguaauuuucccuugcuguuuuucaaauucaugaccuuuuuuucuuuaauugauuuuaagucuguauaugugugaauguauuccucaauguauaaagugcaaccugcugaguccauaugauguuucuuuucuguaucuauuuuuaggguuaaagagaucaucaguuugcuaauaccaaaugcuuagccaugagaaaaaaauauauaaauaacauuauaugaacugagauggcuguuuuuaauuaaaaauaaauuuagcuuuaguuuaaaauuuuaaauggaguagaauuucauaacucaucaaaaucagagaaacuuucagaauguuaaacaaagcuguguauauguacacagcgagaagaaaauuauagcauuauuuauguaugugcuauaacugaucuaggcaaaauuucuuaacuugaaaguacuuaauccucagaaauuucaauacuagccaccuccuguugaucaguacucuggagaaauguuugagauagaucuaauguaguguacucuuccuacuccuaccacuuaccaugaaccuaaugcaauguaggcuuuuaaggucuacuaacccuugccauggaucuaaugugguguacccuuugugucuuccacuugccauggaucuaaugugguguacccuuugugucuuccacuugccauggaucuaaugugguguacccguucugugucuaccacuuaacuauagucuucauauuuguuuuucaggugcagcagguacagacaguucagcagguccaacaugucuacccagcucaggugcaguauguggaaggaagugauacugucuauaccaauggagcaauguaaguuggacgcugacaucugauugucuccaccaacuccgagaaauacuguacuuucuaauacagcucucuaguccugggguuguuugcauguuuuuaaacauuuauguugauuuuguuuuacugugaguuauuuaaauuaaagugguacuuagagcuuugucuauguuuauuaauaaaaguaucuguauuuucuuuucacuuagccuucccagaauauuuuaaauuguucaaauugugugugccuuagcaauuuccccugaauugagaaaaacuuguauuucuuguuaacgguguccgugcuuuaauaaugucuuaacaucugugauuucuaaaugucaagcuggauauguaugagguuuguguuuaucuguaaauuuguauaaaaucauauguaaggaauuuuuuagacuuccacgcaguuaaaucuauauaaaaagagaugaucuuccacgaaucuucuuuccuuucucaagucagccuccccaacugccaucuccucugcaucuacaauaguagcaauuuguguauuuauuggcuuucugcagcuacucgauugaaagucaaugccucauuauaaaugaagaaacuaaaagguacuccagccuggguuuuuguuagcaggcagguucugauuguaccuaagugaauucaggucucucagugucuuacuccagccuucuaguuuccaugcccuuugcauccuuggaguucauguccccccgcaguguaugcuccuagcaucccaguagcaacugcacuccucagggccuguagcuugggugcuucuugcaucccugcagugcggcugcuccucaagcucuucugaccuugcuucuuuccaugguugcuuccauuggucccagugauaccagucugugagcucucagagggccuggauuuuacccacggcaguaacuguaacaagacaagcaugcgugauggaguccauucgaaguuguucaucauauuauuaugacuaaaagcuuagguuugguuuaaucauguauuaguauuauauucagaacuuucuauuaugccuuuauggagguggcauauacucuaaucaaauucaggugucagaggauuucaggauauauuuaauguuccugacaugaggucuagaacaugauagugggacauggaaagaaagcuccucuuugucucuaucuuuuucuuuugugaauuagaauacaaaguuggucucauuauggcauuucaaauaugauuuguuuuugccaaaauucccuauucauuccccccugagauagcccuccuugccauaugugguagccccuugcucuuuucauagcacacaugucuccuuugcuucucagaccuuuuucuucuuauccccuuccgaguuuaaugaucuguauagacucccacacccaugugaauaugaaucaggggcugaagagagggcuuagcaguuaagagcgcugccugcuucccagagaaucuggauuugauucuuaugcccauggcagcucuuaaucaucuguaacuuguguuccaagggaauggccuucucuggccucugcaauuacuagguaugaauaaaauacauguaaacaagaaaauuauauguagaaaaauuaauuaaaaauaaagcuuagaaucugccuaagagaucagcaugcaguauuuuucuuuccaagucuagcuuaccuuaguugauacaauaguuuccagauuuauccauucuccuguaaguuuuauaauguacuauucuuuauggaugaauaaaauacuauuguacacauuucaaugagauauauagacuaauuccauuaucuuucucuugacaaaaaagaagugguaagauuggugugcauguaguucuuuauauauucuacauacuuggcagguguuuugcaccaaucuguaggcuaucccuucugcugauugucucuuggcuuucuaagaggucuuuuuaguuccuuuuguugcuuuugucaauucgggguuauuugcuguguuguuggagucacauucagaucccauuuaccaguucuuaggguuaugcucuaggccuuggucaggacuauuuugccuauaagugugauuugaaauauuuguucucagcuguuucagcuuuucagauauugaaucagugucuacccauaggccaauguuuaaucaagugaacagauaaggauuuacuugcauuuuucugcagguaaauauccaguuuuguccccaccauuuauugaauaggaucucuguuucuucggguacucuuuggacaaguuugucaaaguagguguuauagcuaugugagguuuucucuggguacucucuugaguuuacuagguuggccucucugucugucuuccuuccuuuuuguguaucaugcuuucuuuuucacuaugguucuguaguauaggaagucaguuauuaugauauuuugacaccucucacgguuuacuuucagcagauacaauaucuuuggcuauuuguggccuuuuuuguuuucacaugaauuuuggggcuuuuuuuuuucuucuugacuuauaugaagaaucucucaaauuuugauggagauuagacugaucugugucuuacuuuggguaauagagugaguucugcuuuaggauggauggucuuuccaccaucuagggucaacuuccuuucugaguguuuuaaaauguacacugcaaagcuuucaccauuguguuagguuuacuagacgagguacuuacuuuuuguuuuuauaagcuauuuuaauugggauauucuucuuaauuucucagcaaauuugguacugauauacagaaaagauauuaauuuuuguaugcugauuuaaagcauuuaacuccaccaaaauuaaucagauucaacauguuucauaaugaucuucaguauuuuguugaaaucuauuauaagagucuguuccgucucuaauuuuauuaauuuaggucuuaucucucuuuuuguuaguuuggcuaagagguugucaaucuuacucaucuuucaaugagucaucucuucaucugcucugugccuuguucuuuuaaccuuuauaucauuaauuugugcuccaucucgucuuuauuuuuucacauggacugaguuuggguuggcucuuguuuuucaaaauggugauguguaucacuguuauuuauugggaaccugccuauuuuaggccaccaguuagagauaauaaacugcccuuucaggacuuccuguaucucauugguucugcuagguugcaguuuuguuuuauuugauucuaggaaucuuuaaauauccugauuucuuuaguucccugcuguucauucaaaaguguauuguacagucuccaaguguuguuaucucugagcuuucucuugauguugauuuacucagacuguugucugaugagauauaggcaugaguucagacuuucuuguauuuaaggcuuacauuauggcccaaaaucugaucagauuuggagaacauuguacaaacugcuaacaagaacaugugaucccucucuguugauuagaauauuugucuauagcauaauuuagcucugaaauuucuuugguauuauuuuuauuguaugacuuacguaaauuugcuaauuggguaucaaaguuucauacuacgauugugugugagaccuguaugaccuguuguuauacuuguacuauuuguuuuaugaaacuguaguuguaagauuggauacauaguuauucauagguguuagcuucuuaaagaauuguuccuguuauuaauaguaacaguagccuucuuuaucucuucugaagauuucuaguuuagagucuacuuucccagauaugugagucauugugccagccuuucacagcuugcacuuaccugcauccuuuggcucucuuacguucuccuagcuaaguguguuucuuaggcagcagauagcugaaauacuuuuaaaauccaguuuguuuauaauuggugaguuaggcuguuugccauaagauuauuauuuuaagggcugugcuauuucuagugauuuuguuacuugauuuuguggcugguuggauuauuucugguuuucuucuuccuuccaaguuaguuuuagacauauguuggauaugaucagcuguguucuugcuuuccuugguuaaucuguucuucucauggaacguauuguuugcuguguuuucaugaguaagacugccuuucuucuccauguuuagcacuauuuuaauaauacucuucugagcugcguuggcuucuguauuuugcccucguuuuguuugucuugaaauggucuuauuuuuccaauuuuugucagugugaagauaacuguacuugcuuuacugaccuugguugaaaguuacuuaaauucaaaacucaagagauggcugggugaauggauagauggaaauagauagauacauagauauagauagauagauagauagauagauagauagauagauagauagauagauaaguagaugauagauagguaaauagguagcuagauaaauauaaaagucauucugugcuuuccuaacuugggauagggguugaugcaacaugugauauuauucuagcacuuguguuuugucugugauugacauuuuauaugauucuugcuuucuguuuugaacauccucacuagagagcuguggggauccucuucucugguccuguuuacacuucuaaauucuucuuuguuguaaugccucuccucccauuacccuuaagguuauaggacauuuucugcuguuauuugauugaauccauugucuguaccuuugaacuuccacucaauuuauucuagcucacggauuuuuagauuuggcaucuuuaauguucauaagcauuggugagcccauuaauauuuaaaaacauguuucugaauggauuguuauuuugacuuugucuccccuuaaauucauuuuuaucuuuagcuuguucaugaaccauucuuuuuuaaauauugcaguauaauugacauauauuucuauuguuucuguuuaguuccuccucagugucucaauuucuugguugauuuuuauucuccauguuuuuaaaaguuucagcuccaaguccccaaccauuuaauucacugugguuacuuucuugucuguguccugaauggauccccauauuuuguucaucugcuuaauugaguggccuuuauggccauugauuuuuuuguuuguuuguuuguuaauucuuucucugaaauuuuagcuaucuuagggucuuuguuuugcauuuuugugguguugggagguuacaggugugcuauggagaguugucucauucuuuguauuucucuguuguauuuugugcaccuguuaggauggaugugucuuuuuguuuuacuuuauuccuuuuccuauuauuuuauuuugauuuguuuuauaugaguccuuaagagagguagaagaggagucuucguugcaaacuauagucucuacuucuauuuauuugguuguaguaaaaaaucguuguguuuuccuagugcccgagugacuguuuugacauugcucucaauagaacacucuagugucucugauuugauccagaaauagcagcaguggggaaaauuaaguugauaguuuuuuuuguuuguuuguuuguuuguuuguuuugguuuugguuuuuuuaaggcugggcugucaauauugcuauguaggaaguugagaauugauugggaaagaauauaaagggaggggaggcugugaauggguagaaauguauauggauugaacugugcaagauagaguacuguagaucuggaaguagagagaagauuuuuguaguucaaaaaaagggaaggccagacuuugaaguccucucuuaucuuauauaucugccuuccuuccuuccuuccuuccuuccuuccuuccuuccuuccuuccuuccuucauuuuucuuuuuauucguaagcaagcaauuuaaaaaacacagcucaguaacuuaaaaaugcuaauaaaaauuaaaauuauagaaaaaaauugagcaaccaagaauuaaaaauaaaaauauacaauaacauaagaauagcaucuauuauguauuugguuauuuuuucccugucauuuguauuagguucuacaguuugggaaggauggagaguuucaauaauucagacagugugcccaugcagaaaaguagaauuuugugagcuuccauuguuuuauuucagaaucuucaggccagaaucugcccuagacuucugauuuuauucauccauuuaccaagacucagcuucuaauccagcaucuuaccuagauuuccacauuuuauugccauacgaauaccuuaauuaccugaaaauaaacacauugccccuggcauucuucuuccucccucucucuauacuucucaccugcuuccgguguaccaacuuugauuucuuccuagaaguaacauuauguuuccauaaucaaauacauuucuuuuuaaauagcauuugggcauauucuucuuucuuuccagcuccucccuaccccaaccaguuuagagugauccuccucauagaacaguguuucacgucaaccuggaccuagcuucucuuucacaguccgcuuccacuauacagggcagcagcgcccauuauuuuccauauaguauuguaugaugaaugccauauaauguuuuugauacugaggaaaaacaucccugaacgaguacuugcugcuugguuguuuuauuugaauuuauuuagaucauuggcacuuauaaaaaguuaguaaguuucugcuauucuaguggauauucaacucucuccauaguuaauaguauagcugauguucaccuauuuguuagguagguuuagggccuccugcagcuugaucguaacauuucuaagauaaauuuaaacuacuguaggcauuuauaccaaaugaaaaagaugcuuuucacuuaaaccuuauucucugagaaaauaaauaacuuuguagaagcuucuagaaguagcuucgcuguuagcugucauugcuucugacagugaaugcugaguggccacagaagcugagaguguggguucucauaucuuucaggucugugugacagaagcuagguggccguagaaaggggcacuuaggauagauguuaagagagucugucacagucguuccucauuugugcagguuuacaguaguucagcggguguuguuauacucccuagagggaugugacuuugagcuagggcagcagaucgccucugagaagcccuuuaugacucagucaagaaauugguacaaacauuaaauaauugcugauaaaugcugugauuuguuuguauguuucuguccuaaauucuuuacauugccaacugcauuucauagugcacuuuuacaucuauuagccuguguaugugaguuaugugaguaccaagaacaaaggguaccuugugagaauagguuuuucccucuuaccauguuggcuucaggaauaucaggcgugguggcauacgccugugacugauaagccacaggcuccuuuguucuuuauuguacauauuuaaccaucccauguaauaaauacaaguuaaaugaauuuaugucauuugaaaacuauagaaaaauaucauuuuuaaaguugauucuuuaaauuuauaagaauuguuuaagugcaaaacugauuccaaagaaacugucuagugcuaacacauauuuucuguggccacuaguucaguugauuagaucauggcuaaugaggucuaggucaugaguucacuugcuacaaaguccaauuagcuuugaucuggacugugugggccuagauugcaucuccaauuccaaggaucaugucacagugagcacucuuggucaggggagaagaugugccuuuuaaaaccccucauuacuagcaaauauacauuuugaauaggaguucugaaguauccccuuuacaaucaacaaggaaaugccaucaucuugcugugaauuauauccaggauuuuagugaguagaugacuaugaauauuuuucucaggcaucaaaauaauuacuuuuucaucauaagccauuugaaucuuucuguaauuuuauauuacagccauuagacugcauacaguucguggaucagaugcccaucugaggucauuuguauucuuaguuuuuauuuaauagacuuccauauguguuaggaaaguaugaucuucauucuucuguugugucacacugaauuaauaggcaguuaguauuugaucucugacuuagaccucagagucccacuucuguguauaauaaccacguuuugcuaaugauacuccuagaggagagggacucugaucauugccaugaacuuucaagcacccaauauaugacccuacaaccugcacacucuuaggaagucuggucucuaagccuguguuaccagcauucucauuucauguagacauaauguacagggucucacucaggaggugaugacagcacucacagaugcguguaaucacuuaugagaauguguaaucaucauaauuugcugaaacuaaaguguuuaccugguucuugcugugaauauugacaauuacugcuagcauaacaggcuuaacaguguggguuagcaaguaggcauggauuucaauugaacaauugagacuauuuuaccuugcuggcuguugacacagaaucauugcuuuugacucaagggaaaggguaauaacuccauccauucuucagcuuauuuuauucauguucuggaggaaccuaagcuguaucucccaaagauauuuccccaaaaucuaggccauaguuauauuuuuguacaaauucuuaaaacuuacaauuuccagucaucuguguuacuguaauugaacuagccaaggaauaucucauaccacaaucagagaguucuuuugcagucacaaucucuugguuaguaauaaaucagauauauauauauauauauauauauauauauauauauauauauauauauauauauauauuuaaacagaucuugccucaaguugauuuguaaaaacagcaugggauacuggucaucuguaaauagcguguggguagaugugucacagccaaccaucugucuucacauuggcaggaaccuuuucuauggggccuucacaggggccugggcaccuuugggagccugagcuggagcuacggccucugccuugaugugaaccuugggcuuugguuggcagagccuaugccccuuggccacguagcuucgaaucugcuucccaagcuuggagugagcgaugaaagccaggcagcugaguuugcggcuggggcccuuuggcaucuuggguuugauggccugaggcuucaccagggucuugauggccucugcgcgugcacucacugccuuugcauugcuggccugcaucuucuucaggccuuucuugugcuucuuggcaaagcgcauguuccucagcaacuuggggucaacccccuuaagagauucguaucuuugugaccggguuucuugaugccguuucugugccauuugcgggacugguuguguguggugugguucuuggacuuggccaugucugcacgguaacccgcggcucccgcagcgccugagaccagaagagaugaaaucagaucuuuaaaauaaaagucuuuuucugcguuguuccuuccucuuuugacuucuacccucccccacagucaugcaccaugauuuucagaguggaaagaaucuuguaaucuaaacuauggcaaaauuaggaagucuguuuuauaauggcuuuuaaaaaugugagccauaaaugaaaauugucuguuguuuagaggugaucauucuuuaggauguaaaggcauccauuguuugcacagcugugaaggcugugggucaacucugucaccguucuucuugagauaguacauuugucaucaacuaauggaagacauuucccaaacuaucuucuauaaaguaugaguuccuuaaaagcauacugugcuuagacaagugguaaaaaauguguaacaguauucaugaagauccccaauaacuaauagagcuauugagguuuuaaaaauccugcauuugggagaaaagaaagucaguauuuaggaaagaaacucaguauuuccaaaacuuuuacacaguauacuuuggaagaugauacuuuugacauuuguaauuuauuuaaaauccauaagcaugagaacaaaaugggacucaauuuucuugaaacucuuaugguuaguacauugucugaagguccccacuuaccucucccaucuacuucaaaugauuaauaagaaaccacuucaacuuauucuuuuccuccuuaaguaacacagccgaauuucagaauuugcagguaaaauuagguuuucuuauuaucuaucaaaucaucuuuccuuagaagaaaugaguucauggaguuucuguaacuaaggggagaugaugcuuucuucguuuguguuucuaccgaugcauagucuaagaugugcaggagcuggugugggcauccacuuccaauuuagagcucaccagcucacugguucauuggaagccuucuuggagggagaaaugaccuugugugagaagaacuuuuaugucucuucacaauuagagaaaggcuucugguguuaucuacauaaauacucccaucucuccaaagaugaaaggcauucaaaugucgcugcuuagcaugucagaguuggaaagacugauaucauuucuuccuaccccuuucacagacaaauaaacugaagcgcagugguggaagccagcuggcuugccuccagugugcauugcuuuuuagugaucuacagagacugacuuauuugaaguuuuuugaaugcugauuucuuucuuuuucuuuucucucuuucuuucuagaaauguuauauauaguauuuacauaguuacuguagaaagaaacaaaacuugcaauauuuaaaaacuaauuauuaaaaaucacuauuauaccuauuaaacucuaugguuuuuauuaaauuagcaucuacuccuuuaaguuuagaucuauuuuguaaauauucaaggaaaauaaauguauuguuuggguaguaucagaccguguaggaaagccuaucuuuagugaguuuguaacauuagaauugucccauuacuauauuauauuuuuaaauucaauuuaugguaugaaauuuacacgcuauuuauuuucuuaauuuacucauaucaucuuguuggauuuuauaauggcaauucuauuauuggcaugauauucaaaaccuugauaaaaugcaaaguacguaauuuagagguauuguauuauggacuuauauaugaggcucuagaaccugaaaaaaauggaauaaagaugguuaaaccuuagcucaguuggcuuagucauucuaaugaauaagcaaguagagaauauucagagguaugcuuaaccaugguguaugccaaggcagcauuaacuaacugaauuaaaagggugagacuccuggcguuuauguagagcauagauugaacucugaggaagcuucugccagaaaacaaacaacacacacacacacacacacacacgcacgcacgcaugcacgcacgcacgcacgcacacacacacacacacacacacacacacacacacacacacacacacacauccaugcuuccacauccauuuuaaaauguggauacauaugaggauaauagcaagguuuugcuuuagcuguagaagucaugugaugagucauauucacaacucuuagccuuuggcaguuugucugaaacaaacaaaguggacauaggacaucuuucuaaugugcauaaagcugccuagaaauuuggcuauuucaggaaaguucagucaagaaaaagacaccuaacagaccauaccugagauuuuccucgaauguguuuaggagauuucugaggaaaauaauauucaagcaagaaaugaaggggaaaaaaaugaaagaugcauucaguguuuauaguaugaaaaacugauugugguacccaaagagccacuucuuccaguacagaaugacuucauuucucuugguguuuuaaaacaaucacucuucaaagcugagugugaugacacauaccugucuggcaugugagaggcugacuuggagaaucucgaguccagucaggccuagauuacacugugagaaucgucucauaaacaccaaaaccacacaacccaaauagcagugguggugguagugguucuggugaugauggugauacauucuagggacugauuuaggagcuuuaacauuuaaauuuaguaagauuuguagguguugugaguuacuuuaguuucauuugggcucucaagauaccauuuaacaagguaauguuugcuucccaaagauuaaaaucaaugaggauauuauagccuacuucuaguaucaacucaguauuugaaagucauugugugugugugugugugugugugugugugugugugugugugugaucagaucaagaucaaaauuagacaauccaugccccuccuuuccuaauuauguuuuuuuuauacucauuuagacauggcaugucuuaaauacuaugugucuaugaaacaacuaagccaacuuugugguucauacauggugcucuguaaccuugguaugcucuuuggugccugcucccuucucuuguucuaugacuauuuucuagcccguggaucauucccagcuagaagaaaaugugaaaacuagaguagcuugcuuuccauagccaauuuucaugcugacuggaggguuauguagcaauauccauauugauaaaacugcuggaauuaacacaggcuucuuucuaucuucuuaccugccucugacuucucuaucagcccuucuucagcauugagggucccacucugaguaagaagaguuguaacugaggaaaugcaauucuaaaucacaacagaaaaaucuaagaaccuguuacuauccuuuagaauggucccuucuuaguuauuuguagauauaauuuauguguguaaagucauaaguucuuuccauaagauucagaacaugagcugaguuugaguguuaaaucuuuguuucauaaauguuuaacuuuggucaaauccuuugaauugauccaaauuguauuuacucagauuaugugugaaacaugaguuguaucagucaaaaaaucaccauacaaauuaaagaacgcaugacucuggcuguucaacucaauguccuuuccaagcugacucacucaauguggcuucucuaggcuucucacugaauaagcgaucccuguaaaacugucccaguaaaacucuccucucucuuucugccugacucucuuaaguuaccucucugcuuuucuugugagaguugggcauauccuuaucucugauccauuccgucaaagcuuucucugauuugucauuuugucugccccucaauuagaugucacucucaaacauggcugguuccuacaaacuaaccuuacuuuuuauuguuugggauuaaagguauguauuaaguacuugucuauauuccagcuagaccauacuguaacuccagaguaugcguucuccagcugaaucacauagaucuaaaagguuuuuggauaugaucccuuaccagagcagccuuguugauagguuaaaauuccucuaugacuauguagaauguguugcauaguaaauagucaaaacccaugagcugucuuuagcuguuacugugucuguaauuuguaaagcaucuccauagagugcauacucacauaucacucuuagccucugaaaaaagaagccaugucuucuuuauaucaguauuuauugcccuguauguauuuauaacaacucauuugacuauaauuuacgccaacaucagguugucuugauuuauuuuauuaaaugaggcucuuuuauauucaguggacauaaauuagcaugaacuucucuuucuuucaauauaaaugugaaaucaacauggcuaucuuuauuuuauuaaauauagaagacuucuaguuugggaaauuauggcaaugauaagaauuuuacauauauuuuaaauggcauuuucaguuuuuuaaaaauauucuuugcaaacagauacugauuguauauagcuucuuuguuaggggugcaagccugugcucaccuccccuucucauugcuggggccauaucugguauguacauguacaggccccacgagugcugccacagucucugaguucauaugagcaucaguccuguugugucuggaaaacacuauuucauugcacucaucccuucucaguuuuccauacagaugccugggcccugaggaaggguuuaaagaaugcaucucauuuaguauugacugauccaaagccucucacucugcacuuuauccagucuccuguuaguucccaucaacuacaagacgcuucucgcaugauggcugagugagacacuagucugugguuagagcagaaugucaugaggagucaugaaaauuaacauucauauaauuuauauaaauugcaaguauugugauggguuaaauuuucucauugaaaauguaaaagucuuagcuucacacaauuucuuaugauuaacaaaacuuugaaaauguuuauugaaauuuauaaagcagaauauuauggccaauagaaguuguguuuaaguuacuggcuauucacugugcucacucuguauagggacuguauuguguugcgauuauagauagaagugauguacccuuucaugcaaguacagauacuugagugaguuagcagucagccuuuuggaagcuguauuauagccauacaaaguggcugugguaagccaagaugcagaaaauaagucugagaugaggagcuuaugcugaaccuguaagggugauuagaacaaagggagagauuugggagaaauaacaaaguucuccaagcaaagcaaaaagacuggagaaaaugguacuuucugaaggaaaaugguagccauuguguuguuauugaaguaagcauuuaagaacaugaccauuacugaguucugagguuaugugcaaacuaauccuggugcuuccuguaaaguuuugagcaguuuuugaagguaaggaagacuuuugaaagcaggagucaugggaagauuuuuuuuuuaguaaaauuuuguuuccauauuuauauuuuagaaaaauucccauggcagcaaaauuggaggaaaacuggcagagauccagguuugaagaaggaaaaccaaguagaaggcagcuauaauaaauaguguugugaauuaaggauuaugaggauggaaaggcauauuguagaauuccaugauuuauuuaaaaggaaauuuuaggauuuaguggcuuauaacagcauaaaggaagcauuagcuugaaugucaaaaacugguguuggagguauuauucucugcucuaagaagggcauaaaagaacaagaacuuuugaggguacuuaauagcauagauuuuucucuucucuuuguccuuuuuauugaaaauagauucuuuucucauguaauauauccuaauuacaguuucuacucccucucccucuccuccuccgaguugcucaccuccgcccucugcucuggauccagucccuuccagccucucauuuaaaaaaggccaggcuucuaaaagaucacaaccaaaccuaacaaaauaaaauauuagauaaagcaaaaagcagcagguugaggcaacccaacagaaggaaauggccuucaagaaugggcgcaagaaucaaggaccuacucaucacacacuugggggucccauaaagaauacuauauauaauauauacacagaagaccuggugcagaucucugucagcucuguggugcugcuucagucucuugaguucauaugagcuuugcucagaugauucagagauccuuguucugccggugucuuucauccccuuuggcucuuacacucuuuccaucucuuuaacauuuuucccugaacucuaugggaagggauuugaugaauacacuccauuuagugcuguguguuccaaggacucuauuuguaaugucuggcuauggguaucugcaucuguucccaucuacuauaggaggcagucucccugauaacaagugaauaaggcauugaucuaugaguacagcaaaauauuauuaggagucauuuuauugauccauuuuuagugcuuuuucuuaagucucuuggcuguguagucucugguucuuggucacccaagcaguguuggguauggguucugucucacagagugagugggccauaagucaauaagacauugguuggcuacugccaugaguucugugccauauuuccuuagcuuguaauuuagacaggacugauuauaggaaaaagguuuuguggcugauuucguguuugcauuuuucuuuuuguagccuagcgaguuccuucccacaccaaagacagaacauagaggucaauucugugggugucuagaaauaacuguugacucuuagaaacuuagauauuaaaauucuuaaauuagaacuugaaaagaaaaguuuccuaacucuagauagcuuaacaugaguacaugugugucuuguggaacgugauaaaggccugugguuuaagguaaauuaacaagaaaugcagcaagcacaaacacuagcauauugaacacaccaggaauauggagaucaaaaaagagguuugaguguuaacagugcauguaaggaguggucaugaaaugccccagaaaacaaagcacuguccuaguugauacccaaaggacuugaugccuacccaauagucagguuuggccacaguaggaauggagcuagagaauagcaagaacuggaaauguuaguuuagccuuugaauuugagcaugugaaguguuuguggcuguacauuuuuauauuucugugcuuuuguaaugucuugugagcuuuugcauauuacaaaauaaaagaaauguaaaaguauguuauaauguaagaugucaucaacugaaaguaaaagaaucagauaagcuuaaucagaacagacaaagaggaaaggggcgacauggaguggucagcagugucacucugcaggcaggucaaagagacaaggcugacgggagccuucuaaccugguauuuacauuaggucacaagugaccuuauuaaaagccauuucacuggaaggcuaaggucagaggcuugaccagaccuuuugggaaauggaaaguaagcacaugaaggcggcacagucauuaaguguagaguguaaacgagaaagcugccagauagaagugcacacugugucagcuccagauccuucuucagacaugaaggaugaucacuagucauccagggauggagguggccgagagauggacugucagccagcucccuguguugcagauccuagucuuccuaacacucacacauaccugagauuucaaaugaaaggaaggaauugcuuaacagacuugcagagaauugaccuauucuuaguuggagaugugcuccuauagugaguauaacacuguaguacaaaaccaaguuaagguucucuuuaaagaaacagacauuuaauuugaauauccaaccauugguagaaauaguauuucacagaaaaaauauaaauuuuaacaggauucagaggcuauauauuauugauguauuuuaaaauauauugguauuaaagagaacaaucaugauauaaacaagcuaauaaauuucuucuuuguuuucuucuaaagccgaacaacaacuuaucccuacacagaaacacagauguacagccaaaacacuggaggaaauuacuuugauacucaaggaaguucugcccaggugacaacugugguguccucccacaguaugguggguacuggugggauucagaugggcgucacaggaggacaacucaucagcagcucgggaggaaccuauuugaucggcaauucaauggagaacucuggucacucagugacacacacaacucgggccuccccagcaacagugaguguuuaagguuuaauuuacauuagcuccuguggcuucucguguacuguuuuucucuauggagagaaacaaaucacauaaauaugaguugggcaaauugugugaagcaguuuuccuauccuggcacauuagaagauguaacagguagcauuaugaaaagaacauuacugacauguauaccccaguucaguaaguaggaagcuuuuuaucaguaauagaaagcuagauuuagauaaaugaauuuuucuaaugcaaauauugacuuuguugcuuggggcucuggaguucuagcacacagagauugaggcaaaacaauugcagagaagucaaggccagccugaguuauauaccaccuguacuauauuuuauuuaauauauauuuaaaaacccgguuuuccuuuacaacagaaagccacaugugcuugauuugccuauugauauuaguacuaaaccuaaaacaauuguguggaugcaugccugucagucauccuagcucaugggagggagggauaugaggauuggaaguuugaggccagucugagcuaugucaugugacccucuggucacaaagaaagccucugggaaacucugaugacaggugacucacaugugagucacuugugcuggugcucaucacagguaugggcaaaugauagcauaaggccacaucuuugcauagcacuuuucaaguauuuaaauuuaaauaugcaguuugacacaaaagcaugacaugucagcaugagaguauuaauuuauugaaaugcugucagaaauagaggaaguuaggugccauuugauaccaucaagcuguaaccucaacuaugcauaaaaaagaaugaucaucuaagauagcaguggaauuaauugauuugugcuugagcucuaugaacuagucaugcuggugggccagggcuguagcucaguggcaucaugacagucguccugaguuacagaagugggagugcagugcuggggaucugaaugaauccacacacuguccucauggugucucucuccauggccauuguucuugaagugaaaggagacagugaguaggggagagaacagcagcagugagaggcuuagaccuuucacugggcaggauucuucaugauguucucuguacauuguaauaaugaugcuuccaucauuauuauugccuuuuuccuauucaaauuuuaaaccacuauuuuaauucaguguuuuucuaacauuugaacagcuguucuuaguguacagagguuuuguuuuguuuuguuuuguuuuguuuucagccaauaucaaauuaaauggagagauacuugaagcaaucccacuauuuucuacauauuuuccaaguguucuuuauauguauugucccuuguuucuaauaauuuuacaauuguaaauuuucagucauacaaauauuuauauucauugcaaaauaaaguugccacuacuuggccauacccucucuggccgugccacuguaccaacaaagcacagugcugugcuaaaggauuaggagacauagacaaaccacuagguuuacauuuguuacaagaggaaaacgaccccagcagcuaauagcaugccuauucagauaugugucagaugcugucugcagugcuaagggagucccugcgguuucucaaaccucgugugcugucuccucuguguuucacccauucucucauacucacgugcccucuugggaucccauccuuuccugcucagcucugagagccauuuccguuugccuucaugccuggguuagcucccuaaauauccucaguaacaacuugauuaauguuuacuuaauuuauaagcucuggugcugaauuauguaaauaucauaguucaggucauuuuaauauauaguuauaaguacuaaaaaggacaacuguaucauuuuuuuucaaccguggaugccuuuguuuuucuauacagaguauacaagauguuacuccuagaguuuccacuguacgacuuggaagaguuuauuauuauaucagcuuucaauuaagccuuuuuacauuaauacuuccuuuaaaccaaaaagcgcauaaaaguugacuaugaagagaaauacuguaucugcgggcucucauugaaauccaugauaguuaucuguauguccaagccucucuacgcaucugccaggcuuuacuaugucuccuuagauugaucacugagcuacauauuugauuuguaucacacuucaguaaugcugcacauauuagcucaaaucacagugugauuucucuugucauuuuauaguuuuauuuuaguauagcacacuagcagaauuuaaguguucuuuagcccuggaacuuuccguaguguucuccuccugccaaaugcugaaaacaauacauuuuucuaguauuuugauucuuagaaaucaggcaugcuuuuaguaggugcugagucaccaaaugacuuucuugcugucauuuuuuuuuccagucgccauaaaaccuuagaaaagcgugucugugagcaguguuuggcagcuucuuguugguugagauucaagugugucucuuuacaaugaggcauaugcucuaugccauuuaaguucaggauuuuucuggcuggucuuaugcuuguaauguguagcauaaauaauauaagugacuguaggaaucacugaugcuuuagcucaaacgucggcugcagaaaauagagucaccucucuccaucuguguauuucaucugcauggauucaacuuaacucgcagaaaauacuuaggaaauuauuuuggugaacauguacauacuuucugcuugugauugcccgcccaaaugguauaguauauuaacuauuuuucuagcauauuuauguagcuuuaaguauuauaaguaauccagagacaauauaaaucaucuggcaugugagauagcucagcaccuaaaaguauguuccaccauaccugauggccuggagaaaagaaguggacucucaaaaguugcccucuuacuuccacacguguauacacacacacacauacuacacacacacauuucuuuuucuuuuuuuuuaaagaaaguauacagaguguucugguagacuauauguaacuauuaccauaucuuuaucuauaagagcaucugguaucugacgaauaucaugggaaacaaggacaaccauagucaacuacugugccauuacugaagagcugagcagcaagugcagaacaucauuaauucacuccauuccauugauaggaaaucauuuaagucauuuaugacacuugggaagagcagcuaaacaccaugacucauuuccuugccagcggugcucugucuugguccucagcauaacuuccuugaugaugcuuuuacacaauuaacuugugucuguacggaaauauucucauuuaagauuauuaggaauaacaccacuuucuaagaaaaguuuaaugugcaaauagcucccuaugacauacugaugaagaaggaugauaacugaacauaaagaccacccccugggauacuuugcugcccagcugaaaaacuauuguuggaaucauuuuugcucuacugcagucaucucuggauuauccguagaauuuucauuucaaguauaauuacuuuugcuuuauaacuuuaaauggaaaaaagcuuuauuagagugauauaauaguucauauuuggcuugugauaaugauaaugacuuuuauauuacauuaugguacaaacuaucaauauucguugaaaauaguaccauuccuuuuacuuuaucauguaguuaauaagagcccauauucuuauaaauuauauacguauaugucucuauguguacauauauauuuuauauauacauauauaaaagacuuucugcugauacuaagacguuuaagaaauauuaacaguuuuguuggaguccagcuaaguugcagugugaauaaguauuuuaguuuauauucaguuuaaauuaggaaucuguuguugcaauuucauagaccuuaacauuuugggagucgguuguuauugugaguugggacuuacuacaccccugcccugugacuauaucacuauuuucuucauuuuauuugaaauucuugauuuuauuuuuaguuagaaucuuuuuuuauagaauuuugaacucugauagugaaacaguuuucauuuauagaacaaaaacuugucaauacagugauauuuuuguucccacccaagcauauuugaucguacccuuuuccaaacaguaaauaguaauauguuuuaagaagcuuaaucacuccucuguuaagucaccuuuggguuuuauaaucaguauugcuuuuauucuucuuaacuagauacuaucccauuaagcauuuuaagacagugauauaaaauuuuaggauuuauguguaauaguauuuauauacauuuaaaagguuuugaaaaaauuagauccugucaaggagcaugagaaaaauauauugaauguaauauuauauaucucuucuaguuaauguaaaauauaauauaccuuaacuauuuggaggaaacuucagugauuaucuacuauuaugugauaaaauuuagacuaacucauauaauuuggaggaaucuaaggguucauuuuaaaauuguaggugcuccuuuuccccuaggcuuuaaguuuccaugaauccaguguaagguaugcucuuccuaaaacaauaaguauuuuuaacuccccagaaaauuugccuccuuauuaccuucugaauauuucaagauuucaguuaauuuuauaugaauuauucaaauuacacauugaaaaggucaaauaacacgcgugcuaugacuaccucucaccuccaaccucuuuugucuucucagaagcacucaaugcuaccaaguuuuuaaguuucauucuagaaauauuucaguaaccuugcaaacagaauaauugguuaauuuuuuuagagaaaugauaacaaaaauaauuuuuugccucuaacaaggaccuuuucuaucaguuuauauauagcuuuauuuauaaaaauaguuacauuaaacauagccaguuaguuggucgauuuaucuugccuaucggaagauauuuaauaguggucuuugggccauagcauaggcauauaaaacaauguagucauauaacauggaaauugcuuuguuuauguaaggcuaagcugggggaagauaauuuuuaaauugggaauaugaauaacuguauaugucaggcuuuuuacuauaugaaaaugauuuaguguuccaacuaggauaagcguuuaagaaacaguaccuauaugagcaaaagcacacaugaccuuaacauuucguauuaagaccaaacugagcccucaagugaaacuuuagaguaccaagaaucuucugcuuucaacacaaaaucauaaauugagaaggcuucuggaaccucguuuuuaaaguacuuaauaaagugggacugggacuggccugcagucuucauuucuacauccauguuccauucagccgucaguuccagcagcuccagccccagcagaugagaaguagaggcaguaaguucacguuuaagguuuaggacauuccuguccuacaaauaucgauaaaccagaauggcaugccuccagucuucugugcagacagaguuuuccugaauugagacaagaguuuauaguaaugacuaguauuuggaggggauauaguuuguauugauuggcacagcauuucaaaggcauaaauauaucauaauauuccagaaaaagcuucauuuuacuuauacaaacucugaauuaggaagauuaauuaaagcuuacagaaagggaaauacauuguaucucucauacccacuuguauuguuuuuggcuucaucuuccuuagauuuauaaaucaaacuucagauguacuaguugaaaguacuauaagcuuugaagggaaaaucacuaacuuaaugguucauucauaaaaaugugguauauagauaaagaaugauauauuaaaacacuguuuucuauaacgucuaagucagcauuagauccauaaaguugacuacuucuccccaauuuaguggggaacugcaacacaugcauauggauaauuagcaguucuguugugagcaggauuuccucaugugcccguguuuagaaguucaguuuccucaacaugagugugacugcauuugcugugugcuuaguuacaguuauguuuacuguccauagaacuagcuucuuuaucguguuguauuuugcuuauguagauaagguucaacucuuacugugguaaauuucauagcauagaagguuuauaauauagccacagauguuaugaaucauuuuacacauucauuucauuuuggggauauaaguuuagugaguuuuccauuugauaagaucuuguuacucaguguuuuuagacaaguacuuuuuuuguuuguuuguuuucgagacaggguuucucuguguaguccuggcuguccuggaacucacuuuguagaccaggcuggccuugaacucagaaauccaccugcuucugccucccgagugcugggauuaaaggcaugugccacuaagccuggcuagacaaauacuuuuuguguagccaaggucagacuacuuauccucuguguacauaucccuggagcuagcuucauacaccugugcaaccuaccacacauaacaagguuugauuguuuuuuuuucuuuaaugugcucucaaaaguaaaggaaaaaguaauuaagcaagaaccugcaacaaaauauaaaaaugaaggggaaacuuaaaaaucagaauuugagaugaugugacuguaucuauuacauuaucuguaucauacaauuacagagaaucaaaugcaaccauuuuaagagauuuagugaaguagcuucaaacucuggcaucaauaauuuaaaaugcaggcaguguuaggagauacagugggaacaaaguuauaacguacaguuuagcagugauaaauuuuuaucacuuuuaauaaauauaguuaaaaauacucugagguacuaagauugaaauuaaacccaaguuucagguagugcuccucgauuagacuguuggaaguuuugagaaugaaaacaaggucuaaauuuaauuuaaaaacucaaaacuagacgggcuugguggcgcaugccuuuauucccagcacuugggaggcagaggcagguggauuucugaguucgaggccagccuggucuacaaaaugaguuccaggacacccagggcuacacagagaaacccugucucgaaaaacaaaaacaaaaaacaaacaaacaaacaaaaccucaaaacuauuccaguucaaacuuuugaguugacagugacuguuuuguauuuguuuucauguaugaguuugaauuaucucuucuuccauauuuguaacauuucacagaaacacuaugugugugcaugcaugugcgcaugugaguguguggaugcuuucuggacuuugaacugagagucaugugcaugcuaagcugugcucuauuacugaacaaucucaccagcuucuuaguuauuuucuuuugcugccaucuucaucagucaucugaaugaccccaagcuguguccccauagacuacguccauggaacuagcuccauuucugaaggcaagaguggaaaucuauccuuaaaaccccaggcugcuuuguauccucccucucucucucucauuguaucacuuuuaaaguacaaugucaaacuuuuaaaauuuuuacuagauuaauuuuuuugagucaccaaaaucaugguugucuucuagugguuuugcuaauguuacguguaaaguugccuaaaaagggaaagcucaaaccaaauaauacuuagaugucaaagucucucuuuaaauagagcacuugccugcuuaugcugcuuuaguaguagcaauaguuugacuuuggcaaagaggaaggaaacccuuugauugcauuugagugcaguguuccuaguauagacucuacaaagcaucacuggcccccauccccagagcugcgacuuagugacugugggcaagaggcccaggauuugcaguucuaacaaauuauaguaauuacugauauugcagugauuauacagacugcauacaauaguaaaguuguuguuaguucucagaauaaacugggaaaggcuaggaccauuugcaaacauaagcuugaucuuaagccccaucauuucagcagaguccuaaaggauaauucuagccccgagcuucuuuaguggguccgucaucauagccugguuuuauuggacucauagauggggaagcaguagggucacagaguaaucacaggacacccagccaaaacaaugcuuuuauuucacaaucaucuaaauuuaaacagcaacuguuaacagaauauaucugaauaauauacauuucugauccacacguuuucuucuuuuucuccuaaauacuuucagaagaacuucagguaauaaaauaaaaucacaacccagcuuaaaccuguguucauauauuuuacaaauucucuaaauucauaaaacugucaauuaaaauuggaaagauuucauauauuacaauguuuguaagcccuaaaacuuguuuguccuaauugcuuagcuguaacugucagcauaccaucguucauuauuuucugaacaaagauguaaaguaaaauuuuggcuagauguguuucuggacaccuucagguuuuuuugaagaauuaaaucaaaaaccuguuuugaaucucucaucagcuucuucugaguauuguaucgucugaucaacacuuugccugaagguagaguuuuaagagcaguauuagagccgaugccuucgcuuccucgguaggagaaaggcagguuuuugugcauuucucggaccucuugggaggaaaaggcucuaaguggaucuuuagaaaacacuccaccauuugcccugagcugcuggugguuuaacaaccuccuguaaggcuuuggaaauuuuucacuuccaugagacaugccuuuacauugauacccaggccguuuguuuguaagugcauaugcucauauaugucuuugugucagugugcauauacgugacugaaaccaaaacuccuccaagugauaucuagaccauguguagugagcuaugcuuauucccugcucugaugaauuucuuuaaacacauagccacacugcucgggaggcuuucaaugguuauagcaccuucagaauucugguucuccaccgcagcuuaaguuccacuuuuacaaccucucuaaagggagucugauccugccguauaucuccuaaucaauacaucugggaagaguuguacaagacuugaugauuccuucagucuuacaucuuucaugccagaaaaaccacugucauguggaugauuaugugcaugugugugugucuguguggugcauguguguaucuguguggggguaagguaugcccaugagugcagcuucccacagaagccaaagcagucacaucauccuggagcuagacuuacuucugaugugaacugccuaaugugguuccugagagcucagacucugaaagagcagacugcacuuuuagguucuaagccuuuaagucaugaugcugucaacauagguaaguauggugaauaauuaccaugcugcaaacuaaaugcgaccagccuuaauaugucuuacaugaaaugaguuaaccauuaauuuuaaguuuagcccugcuuaaguuuuuuguauuaaagcagaauaaagucagauucuuuucuagcauauaaccuuaaugaccucuagucuauuuaucaauagaguccuacugcccucucugaaaccuaaugauugagggcucuccuauuccugucucacucucucucuuuuuuaauuaauuaauuaauuaguuaguuuguuuguuuguuuguuuguuuuuucgagacaggguuucucuguauagcccuggcuguccuggaacuuacucuguagaccaggcugaccuugaacucagaaauccaccugccucugccucccgaaugcugagauucccucuuaguugcuccucuguuaugucucacagaccacccuagagguacacuuuacucuccuaggugcuucauaauguagucagguuaacagucaagaugcugcaucacggguuucuaucccggacaagcugccuucauuauccuuuuccuaauuugagcacacccucugcuuuuuugcuuccugacucacuucagcuccugcuuccuagcacacacuuuccuaguguguucacuagggaauacuuuuauuuuaguacgaauuuuaaauucagggaaaauguaaaggaugagaaaauauguacagguuuauaacucuucugaaauauauuuugucucaguacagggcuaacaguuuugaucauauucucagaaguuguuauauuguagggauaaauuauaaaaaaccaauaccucccagacaaucaguauaucuauccugguggauguagcuggaccuguuucuguuugccauuuugccuuguuucccagagcuccuugcuacuggccccagaaaguaucgaggguggauugguucuuuuccugacaaccuggccuugcagagaaucaaauaccaccacagcagcaacuuuaguaaaggaaagagauuccuaaggaagccaguugcuggcugaucucacuuaacacugcugucucucaaacccuuagugaggauuuauucuugaaugugauucagcuguuuuaauucugauaauuuuugccuuuuacuuaaacccauaaaaucacguuauuuauuuauuaaaauguaaucucaguucaaauuuucacccucaaacuuaaaaaaaaauguaaacaauuuagcaaaguacaguuuugagagcacguuauucuuaggugugcuuuguuaucacaggagugauuccagcuaucuuaugcucuugucuuuucugagauuuaaaaccaggcugaagagaugacucagcaguuaugagcauugacugcucuuccagaggacucagguucauuucccagcgcccauauggcagcuuggcagcucacaacugucuguaacuccaguaucuaacacccucgugcagacauacaugcaggcaaaacaccagugcacaugaaauaaaaauaaauaauauuuaaaauauggguuuaauuaaaaguguucauuuaacuccuuaaguauauauaauauguauauucuaaaaugugaucuuuuuaaauguaaacaauagcacuucuguuuguuuucaaguuuaaugcucucuguuagcaucucaauugguguagagaaugauuuaaaaggcacuuugccugguuuuaugaucucaaaaacagauaacuauagaauaaauuauugcacguuuguuaugaauuuauaacugcuucacuaaauugucgauauaaucauauuguuaaaaauaaggaaauuuauuuucucaaauugcauaacgaaaguuuuaauuaucugguauuuuacucuacaucaguuuccaaaugcauacuuuucagucccuaucuugauagcaugugucacggugcugugagcaggaggacagcugucuuacguaggaggucaucaagacugccuggggcuugucccuggaagcucuggcuuaagcaugaguuugugacugcccaugguggagugggauuacagugaauagaacugacucuguucuuguccauuuuuugcuggcucugaguuauuuucucuucuauuccuuuuccugcuguuauuucuaauauuucugcuucaucaucauguccuaaaauauaauagagaccauagccacaucggauugcucaccugacugaccuucccuuccaaguuucacugcuagaguaaaagaaggauguguagauuuaccagcuuuuagaguuuuuguagcuugcauuaaaauacuaaugcauauuaaauucagauuccguuuuaugauuuuuauuuugugacagaauagaacaaauguuaaacaugcuuuagggaugagacuauagagagaggggcuaauaccccacaucuugaaccaugcaaguaaaaaaauaguuucuuauaacuagaaagaccugcccggguucuugauccuucggucuccguacugacuuuaauuacaaaguguuuagaaaggauuacucuuguaauugagguuauuauuaaugugcauauuauauuucauucucuagggacagaaaagcuguggggggaacacauuuagugauagcuauucauuagccaucguggaagaaugaauuagacuuuaagaaucgaucaaaacuucucuggucagccuuuuauuacuaucuugucuugagcccuuuuuuuuaaugacauuuauuaucagauugaaauggcgauugagacgcugcaaaagucugacggucuguccacucacagaagcucucuucucaacagccauguaaguugccucuucauguacacuaaucucuugcuaguucugcauguguugcuugccucuaagugcuuguuuuauuuauuuacuuauuuauuuugcuucuuaaccuucucuucucaagccucuucagacucuacuuauugaaugccuguguuacacaguggggugucucagaacagacccagugugcugcuugcuuucccggguguuuguacuucccguccagauauacagaacuucaaguuaaugacaagccacuaauuauuucuaaaauguaguuaauagugaucuuaaacauuuaaagauuuuuguuagccaaauuuauuuccucugaagcaaaacuuuguaguacacaucuucaugucugagacacaaaagcaauaaccaugucuaccguguggcuaagagucuuuaaaugcauaagugaucacuaaugucaaaagcaguggaaaacuaugacaaauguauuuacugcucagaguguaaaguaggcaggucacguccuaaacacugaagagaaagaaauaugggccaaaagugaaguuguauguaagucgugaguugcucauacccgagacaggcagaguggucucgcugcuuccuggaguucuugguguucccaggcuugcuguaacacugguaaguuuugugaaauaaacacugucaccgucuguucaaauuugaggaaaucaaugaaaaugcuuccuauaagaaacaauagaagggcauuauuuuuagaagguuucugaauuaugagaaaaugaaugggcauaugacuuaaguuguagauaaagaaauuggcauuaguaacauuugaguaagaauuagaaauuucuuuccuaauuuuuuuuauguacggauaaauuauugugauuucuuaauuuuucuuaauauuuuaugacuaaaaaguuuaaaaguaagaucacugaaauaucuguaguauuuuuaacaaucauauacuuuauaggaaauaugucacuguguuuuccuuaaaaaaauauuugaacuuugaacuguuuuuggaggggguguuuugauucauucccuuuucaacagaaguaucuuggcaaacaaaacaugugagcccauucaaagaagccuuugaccacagugaggauuacagagagcaguuuuaaaauaaggguauauauuuugucaccucuuucuuaaaaacuauuugaacacucuuuuccacucuuuguucuuaaauauauucugcuuauuggaaugagucucugguuguguuaaaggcuagucuaccauaugguauuaggaugaauuugccaguuuguauauugaaaauagcaagugaaaaugcuuaucacuuccaaccagaaaugugcaggcauauaaguauuucuaaaaauaaauagaaauuuccaguugcucuuuugaaauuuucaguuuucuaaauggacucugaaagucgguucuuaucucacucuggaaauaugaaguguaucauaauguguggcuuaaauuuaacuucagucacccagccuuauugauacuuccauaaacaauaaugcagguauauaccauguuuuaaaaauaugucuauguguuugaaacuuuugaaauauauuggauuaucuuaaauuauuuucuuuaguuaacuuaagaacuaacguucguuaucaaugacuguaaaugaagcagcucaaacaacacagugaugugguuucccugaguuugaguuucuacugcauaguuuagcaaaucuuccauguguuuaagccuacuugcuggauuagcaagaguggccacaaaguuugcuccuaugguggcaauauuuguuuccuggccucauucauuuuuacuacaucucugaaguagucaccuuuguucaaaccugcauauagagcccaguuuugugagcagaagccacagguucaguguuuuccugaugccaggggcuuaguuucuccuggaaugcagaaaagguuuccuuugucuuuuccuugggauguuaaugaugcuccugccuuucacuggguccccaacagcuggaacaaaaugcugcucagugugugucugugcuuagccuguuuauaaugucaaccugguggcauuaugccagcaucauagacaaccaguaaauauuuauuagcgaguuaaaacaaaaaaaaaaacaaacaaaaaacaacaaaaaaaagauuuuuaugguuugucuuguaauggagucguccuacauagaagagugcuagcacauaguaguagaugcauauuaacuauuugcagaauagaugcauauaagaacaauagaagggcauaggccuuaucguuaauguuguagauuuccuuucccagucucaugaugccuauuuggaacacauacauagaugguauuggcuucucuuuuuguccccaaauauucuucagucaauauguaugugcugguagugaguuuucucauggcuuucuaacuaaaugaagaauaugugggucacuuuaaaauuuuccacauacacccuaaagauuaagaauaacuuauuuucuuucaaccuaauccuuuaaaaaguuguaccccaaaaugauaucacucaucucuuugcauuuuagaauaugcuuuauuuucguuuuauaaaauuuuuuuguuuauauuuuauuuuuaaauuuuguguaugugaagauguuguuaauaaauuuuauagaucucccuaaguccaaagcauaucuaauucuuuuaguugcaggcauaagcuugucccguacugucaacuguaauuaauauacauuuucauuuaguguuuuauuauguccaauuuaggguacuuuacagguaaauuucagcugagaauuguugauaaauuaauuguuacuagcuuccacauagugccuuuaugcauguauuucuuuuuaauuccacuuaauguauaugaaaccucuaggcauuuauguuuugggaaucuucauaaucuagcagacuguuaauucauaaugcuuacuacugaaauauauuaagcuuaaaguaaaaucuugguuuuuagucuucgcccacugcuguugugacuauauuguaaauaacaguuacuauaggcaugucaaaauguauaccaucaguuaggugaacuuaaagugauuccuaagugauaauaauccaccuggaacuggaacacuaaauguuacauuuagauguuaauuaggcaaaacgucauuuauuuaauuuuauuugucaaucaguguuucccuuuaggaaaaacaggaacuauucaucucuguaaucuguucugaugaauacagauuacaugcaaaggucgaaagauacaauuaucuugcuuucugcccuuagauaaguauauguugguccauuaguauaauaauuagguuuaaagauaaaggcuaaaagauucuaugaaauuuuacaaucuuuaaaguauuucccaggcuuguaaauauacuuaauuuauaaauaguuuauuaaaagaauuaaauaagagaaacagauaguuguauuuucaacuacuaaauguucagaaaauuggguucuacaguuccaauacauuaaagagaacacugcaugaaacagucuuugcuuuagaagaauuauucgguuccuuuggguagauagcacaugggacauagcauaaucuuuuacuuuagaguacauauauguagcuguuuaguuucucuaauaauaauauguaauccuaugguuuagauucaauauaugauuuagaauuucaucaugugucaaaaccugaaaauuaaacauuauguaaacaguauguaaaauguagcugaaauguuccggcuguauugccaagucucuugggguguagucuagauagugugcugcuucuauaguaaguuuauaagagaauagucacaggugugguuguuagccaucuucccagcagggacccuguggcagcagaccagccgccuccaucuucagggcuuuuauuuccaugcacuccucuuuccuucacacgcucaccaugcuucugcaaggaacccagggccuccuuuugaugagguggaggcggaacaaauuuagcuuugcuagugccaaguucuagucagcaagauagcuguccaaccaaucacagcuggguggugcuuagugugcaucuguaugccuauuuguguguguucauauuaaugaaauuaauauuuuuaaaagcuaguuuaaacauaaaacauuuugggaauguaaauaauauaagaagaacuaaguaaauauuacaaggagagacuguuacacaacuaugguaguauuaaacauuucauuucugcaucuaaguaauuauuuucauuuguuugcauuacauuaaaauuguugauuuauuuuuauuuguauauucuaguuaugaaguucacauuuuaaaauuaacuuccuuuucuaggggaaauguccuuuaaacuaagauuuucuauauaaauauaucaccugcugacuaacaaaggaaaguacauagaauuauuucacuucccuuucuuaauuguguuacgauguuagagaauggggacacacacacacacacacacaucuuaaguaguuucuauuuaaauguguucuacaauguacacugugaauaugagaacuuuguuacauuauuuguaacugcuaaaaauauguucacuucauacaaaauccuuucaggagcuuuuuugguuauuguuguuguuaacccuugauagcaagggucuguauuccuauuuuuaacauguuaugaauaccaauagaagguagcugugccuugcucuaucucuaucuggcaccugugugggagacgguagcacacuuugaugcaguacaguucacaguggcuacuugaauccacuggaagugcuuucacagccuguaaguugucuggggcuuauggauaagauuagaagcagguuuguauugcugugucuugucuuucuuccuuguguuuuauauuuuaaacucuugagauuuaaaaaaggaaaaacucuaaagaagccugcuagcccacugauuuuaaucucaguaacuuaaugcaugagugaguuuacuuugauguuucauauuaaauacauguuuagagagaaccuauucugugcguuauuuucaauacacacacacucauguuugagugucucuguaaaauguuuuacuuauaugaaggcuaaaaguaaauacuaugaaaaaauucuuuaugaacuguaauauuuuucugucaguguauaaaggagagcuaauuuucuguaaucucuagugucuuguggcguuaaauuauauaugacacaauauuaauauguauuuuuaaguuuauuuauauggcuauauguuccuuaggaaacuauaaguuuuccuuaucgggacauacuuuuauuuguauaaguaucuccuaugcauugugguguauuuucuaugccauuaacuacuacaaguuugaugauacauauuuaaccauuuaaugauuacuuggggauauuugaagcuaaaaugcucuggaaaauucaguugucauaguacaaaaaaaauaagauaauuugauaaauuuuuauacaaacccugaaaauucagguucaaaguuuaaucaaaagucuuaaaauacacagauaaaauagaauaaaaucuuugacuuacuugaaugcccaggucauuaucaccuuuagccuuugacuaaauacgcagaggacauguauagucccauucaucuuuguuauuuuacuuccauaauucacauuuaacuacaaucuuggguucaauguuugcucuuuaugauaccauuuauaaaugccauggaaauuguugagacaacuaaaaugaggcauuugcugcucugaugaccuguuuagaaaacaagaguuagaaaccaugcucagacauugagacaauauauaaccuuaggaaaauuauuuacauuuauuucauuucuuuugcaagaaaugaauaaguagagauuuaauaauagacauccagcagagauucuucuuguauuuuaaucuguaagcauuauuuuuuuaaaaacaaaguauaauauaaaauuugagguaaaaagacaccucaacuuuaagguagaaaauugaugauuguaaaaaauauugccuuucaucaucuugcaguuauuuguaagcucuggcaaggguccuucuuugggcggaagagugacuacauuuuaccuaucuacaucauuugucccaggagauaaaauguuauuguguuaucuaauaguuauuugaaauaaguuaauuagaguucuguaaaaaugaaugaaaucuuaacucauacaaguaagccuacuguuuauuguaacaaaucaauguaaagaguaaauuagguguuauguugccagguuuacuucuguuuuauagcaauuauaagugauagguuuauauugugaauuuugaccagugaaugcuguuauuuuaauucuuuguaaaaagaaaaaaagaaaugcguaucucaggaauauagucaauauagggaaauuuuaauaucucuagucaugcuggaaaauuugaagaaaagauauugucuaaacugauaacugcugugauguuucccauaucccagcuucugaauuaucauagucuauccugagaguuaaggaagagauuccaaguagcugugcauauauuguaccuugcugagguuuuggcaauuccaugaauucucugcuuauucucucucaccucaacagcugcaauggcugcuggacaauuaugagacagcggagggagugagccugccgaggagcacgcuguacaaccacuaccuucgacacugccaggagcacaagcuggacccggucaaugccgccucuuucggaaaacuaauaagguccauuuuuauggggcuacgaacuaggagauuaggcacuagguuaguacugacagucgacauaauuaguucuucucucugauucuauuagagcaguguuggaaagugagcaaaaacguacuugauaacagaaaaaaagcaaggagaaaacuauagaauggaccuccucuauaaaguccauaggaaaugaacauuauuauucaauggcucucaccccuuagauuuucaaacuacauagaaguuagaagccaacuuaagauuugcauauaacauauuauacacgaauacaguugaauaguaaauggaaaacuaaucauuuccuuagugcuuuaaaauacguuuaguuguuuugugaaaacuauuugacuugcagaaguuaaggcugaagucuccacuuuauuuugugauuuugaguucacugaaaaggauuugguaagguuacaaagugcacauauuugaaguucuuucugaugguucuauuuuaccucuuccuagccuucuaagcuuuccacuugucucuuguucuugauugugaaaacaggcauauaugggagggaacuguggaggauuuccauuauagagaacacuuaucugagggagggacuugccauguuauggguuucuuuccuucagaagcaaugauuuuccuucagaagugauuuuucuaagcaaacaugaugaaaagaaaauuuagagccuuggagcuucauuucuauuuucuacgauauuuuacaaauugagaacucauauuuuaagcaguuagguaaaauacauuaauccauugacucucuaagacauauggggaucauaaacaaaacauuaaguuagagaugccauucuguacauugauugauggcacauuaguuagaaucacagccucaaagacuuucuguacaaaggauaggaggagcaucaauaggaacuaaccaguacccccagagcuccuuugagcuauaccaccaaucaaagaaaacacaugguggaacuuauggcucaagcugcauauguagcagaggauggccuagucggucaucaauggcaggagaggcccuugguccugugaagguucuaugccccaguauaggggaaugccaggaccaggaauggcaguggguggguuggggaucagggggagggggaagugauaggggacuuucagaggggaaaguaggaaaggggauaauauuugaaauguaaauaaagaaaauaucuuuuuuaaaaaaucucuggaaaagaagagauacaguaauaauuaacaucaguaggcauuuaugcugagagaaaaagcaaaugucagagagaaaagacuaauguauccuuccucauuuccagauacacagguaagaucccuguaacaaaacacaguuuaucaugggaaauacauacccauuuguucuaacugcuuuucuauuacuguguugaaauauuguaaccaaaaacagcuuuagaaaggaaaaggguuucuuuguuugcacuuuuuggucucaauuuauuucugagagaauucaggaccaggaacuaaaggcaaggaccgggaggcaugaacaucccauggaggggugcuucuugcugccucacucacaggcucuccuuagcugcuuccuuacacagaccaagaccaccuaucuuuacauggugcacccuucaguaucaauucauaauccacacauccucccaaaugcccacaggccaaucugaucuaagcaguuucucagcgggggcuuucuucucagaugacccaaguugaaaauuaaaguaugaaaugauuucugugguauaauuuuuauagagagugaugccuuuauauauaaagagucagagaaauggaaaauugugguuuguuuguuuguuuccuaacccaaaugaagucgacacuucuguaguagcaugauuggacaaaaugguguaaucuaaaaucauaaauaguaugaaggguggcccagaaaagcccuucaugcuguuuccucagaggagaaaauacucuuuuguccugaugcagaaaggccucuuuggcaugaggguccuaaauccaauuuaccaaggacagucagcuguguuuaucacccauucacuggagaacaagugagagaaguuuuucuacucuccauggcccauuucugcuguuuucucuaaugccaacuaccauauuuuggggcaguaugcccagaaccucauuacuguguuaguuuuagaagaguugguuguguuugaacugugaauuuuuuuuucuuuuacuugcuuugaagcaaacgugcaacuuucaaauugcuggagguucaguucuuucauaaauauauucucauacugguacuucaaaagacaguauauuuuaaauugcagaaugugauugucuauucagacuaaagaaacugccuuucauuccuuuguaaaaaagaacuuuuuauuucucuaguaucugcaccccugccuccucacccccccaaaaaaaaacaggaaaaucauuacuuagaaaccuaaccuggugucuccuagcugauggcucacuaguuacauauauugugccaauauuuugaaacucugagcuuuagucaacauucuaaucgcuguauuguugcgcugcuuuuguuacugaaaagauuucaaugaguccuauuuugaagcucuuuucaaacguugaaacacaucuuuaaaauagaaagggacaaaauuggaguuguuuggguuugcgacugaguagacuccauacucuguaaguacauucugcaauacugaagcucuuacagucaauucucaguaugaggugcuugcaauugagcuggaaaggaagccuaagacuaaggagggaguaaaugcugugaguugagauuuacaaugaaguguuuggaaacugggaggaugcuaaugggaaaagcugguggcgcaggguaagcguccagagacucugcuguggauccugcucuggaccuuucacuccuaguccaagggguggaagaaaaaccaguacaaaucaagaggcagauaaaaucccacgugguugucuuuuaagugaacauucuaugcaagcauuauuugucaacagaagugucuaacggaauuauccaaaccagagcaaacuuccuuuagcacuuaaguagacaaaaauaaaaccauugcauuucuaucaaaggcaauuugaagggcgaagaugcccuucuaacacaaggguguuagaucccuuauccagggggaguaagucugacaggcucacccugggugugcuucucuucucaggccauuccaggugggaggaaaggaacuuccucucacuccaaccacagugcuaaucuguaagaaacugagucuaagaguaggaacaucaauuuauguguguuuuccccaugacuaauggcuccugcuuucuacccuaccuuuacuccaaauagcuucuacuuugucuggaauacuacagggugugguuuggguagguuguauuguaggcuuuugcucaaauuucaguggguucuauaaacauagcuaauuucucaaguggaagauauuaaguuuucauuuuuauuuucaugaaauuacagggguuugauuaccuuaaugucucuucagauauauggcuaaucuaauguguguuuuuaguuuuagaaguaaaauuaucuauuuucauuaaaaauauuuaauccacacaccacuugcauuucucuuuguaaaugaaagaaaaauuggaagauugcucacagacauauugcuauauauagacuuguuauaaaauggucucucugcaagaacuuacauauuuaaaauguuauuuuguaagaacuugcaaguuucauucagaauaaaaaauaccauuucuaauaucaagcaugguauuuuuuauuucugaagaauuugcaaaauuuuuauuccaggaugaccucaccauuuuuacaggaacauauccccaucuuuuaugcgguaucuaauuaguaaacaacagauaugaaucaauaaaagcagagacuaauaaaauguuuuuuaaaauacauauauuaaguaccuucuucuuuugucuguuucaaaauacuaaaaauaaaccaucauauaauauaacaauaauauuauaucacuguuucuaaaguaaacacaaaaagaacccaaaacuacagaaugaaguuggguuuuuuuccccucugaguuuauugcaauuugcugucuaauguacagugauuugugcuguguauuggcccaaccuucuaaauuaccuucucagcuaaacuugaaauauguauuagaaaauaaaugacgugaguggggcauauaggccuuguguggauacauaaguaagggcggaaggagcugugcaccaugagguuguggggugguuauuuaggaaucuuauuuucaucuuuggaauaucacuauagaaauauaacagcauccagaaaagauaaauuauaaaugugaaauguugguauaauauuuucacccauuuuuuucugcgugaaguuaauggcuaauauuaguuuuacugacuuuucauguuuccauauuuauuguucuuuugugaagaggaaacuccaaauaccauuacuaugggauucgugugaagccagauucuccucuuaaccgucuacaagaagauaugcaguacauggcuaugaggcagcagcccaugcaacagaagcaaagguacaaucugcguuguugugucaaagcuacauacauauuaacuccauaggucuucuuaucucugagcaaagagaacggacaagcgcacaggaaggggugcuaccauugacaugcuuuugcugugaauuguguuagaauaucauuuagaauuccagugaucccucucucaauuuuuaaaaaauaacuuagucuucaguguuuuggguccgcauagaguuaaaugccccaaacuaccguucauacagggaaaugucacacaaagaucaagaaguacaucuaggcagauagcaccuuuggagaaauuuaauuuuaguauccaugagacaugcuauucuuacauccuucaaauaauuuuaaguuuuauuuauugcauaugcaaauguaucucucucucucucugugugugugugugugugugugugugugugugugugugaaggggggugagauauauuugugaagguggguguguggaggucagagaauaauuuucaggauuugguucucuuuuuccacauggguuccauccagugcaggucaucagggaugcagcuuuaccuugugagccacuuugcccacgccagcuaauucuuucucaccaagucugaguucuuguaggaucuuugggauuucuuacaauccuuggaaucacgucuucaccaacauagaccuuagagcuuuaagagaucuuacauucauggauggauggaugcauggguggaugaaugaaucagaagacgaaugggaagauggauggauggauggauggauggauggauggauggauggauggaugggugcuagaauuauaaaucaugggauugaaaagaaccaacucugucugaucugugcucauaauccuugacaaucaaagcauuagcagccaugguuuucaggaagcuuaaguggaauacacagcccacugcacuguugugaagagccuuccagucacuuaggacucgugucacaauuuacaguaaagaaacauuuugugaacucgcccuuuuuaccaguauagcuuacauaugcucuguaguuauaacuguccuuuccuacugaagugauagaaguacuagcaaaaaggaaugguuucccuggcuucuucauuauucuaaagugguuauguguguaggcaagaucuccucauccacacuaguguaguaugcagcauggguucuaagucauagaaagacaacaucacauaauaggcuuuccucuggucaagagacacugauuaaaggcauacuaugugcuggguccuaaacucaaggguaagacauagucucuacuuuugaaaauauaaagugugugaggaaugaggggaauaaaguaaugcaauguccugugccaaaguccaguguuagucaaagaacuguagaauacugaguaauuguacaaacccugggagagagagaauuaggaaacauaauugagaaagugaugcuugggaagggacuaagagugagaaaaagaagggagucucgagguagaagggaaauguucccaugagcacauggagguaaagggugaggcuggcaguggcccaugguuugguuaaguuguuuugcagaaguagaguugcaaagaugcuuaaguagagagugaaagaggcaauaucuacagcaguuugagcauacauuaagggauuuaguguuacuugcagguaauuaaguuugaggguuuuuguguguagaaauagcuuuaaagcuaucuaaagcuuuuaagcaaaagaauggaauuuugauuuuucuagaaagaaauuuuugauuugggauaagacauaacuaauggggaaaaaacuggaggcaaggacucuuuguuaacaaaguagcuucagcagagucagaauucccaguguguccuagcucagcauugcaguucaaggcuggccaccuuauuuuaaaaaacaaaaacaaaugcacagauucucaauuuuguuuuucaucacuaguuauuauuauuuuuuaaucuauagguagaaaaaugaauuuuaaaauacugaagaaaacacaauaaaacauguauuaguaccuuauaugauggcaauaguuuauuuuuuauaguaaacuacuaugaucuuaagguuuugguuauuuuucuacuuauuaagaacagaauuuauagcacuuacuuucugaugugcucucugccccccaacuuagcagcaaaacaaaguagaugauggugaaaucaagaaaagcuugauuuagaaauaacauauucaaauguaauuaacagaagcuugauaaauugugccuaagacaaguaaagccaguuucuucuugugauuuuucaagaggaaaucuaguaagcuuucgugaauguaaauuuuccaaagacagucuuuauaaaaagcaucucacuggaggccccaccaagucuagaauucugguuggguuggggguggguaguggggacauccuuguggagaagagggagcaccagggaggaaguaugggauguggaacagucaggguggacaggggcagggggaauagaaucuggaguguaaguaaguaaguaaguaaguaaguaaguaaguaaauaaauaaauaaauaaauaaauaaauaaauggaaaagaaacuuuuuaaaaaccugaacuggguaaguacagguuguuuuuauuuuuguuuuguucucuuucuuuuuucugaauuaccucccacuaaacagacuccagagcuaucaagguuaaggagucaugaaaaucuuuuauguauauguauuauauauauaaucugcuggugguaauaauugcuguaagaaaaagacacaauaugaacauguuuauggagauauaaaauucuuauuauaguaguaaagucugccaguaucagugucuugaguagucugccuucuccucagugaagaacaguagaauacugaagauggacuggauguaguagauuuuguuuucucuccuggcguuuuuuuuuuuuuuuuuuuuuuuaaauuuauuugggucucacuauauagucucagcaggccuguaacauuuaugcagaugaggcuggccucaaacagagauccaccugcuucugacuccugagugcugggauuaaaggugugcaccacugugccugacaaggggcuugcucuugcagugacaccuagagaauaacagcaguguuugugcugaguccucgggcucugcacugcuauacccaaagggcuucagcuugcugaaggaucauacauacugcacacugucuccauccuugaauuuagacauaagggucaaauuaggaguuuguugaaaugaugggaaaauagucauuuuuaucauuuaucugaauuuuuuuucuuugcugaugugagucaggauuguucucuguaguccuggcugucguggaacucucucuguagaccacgguggccucaaacuccaaggaaucugcuugucucuguuuccugagugcugggauuaaagguguacacuucuacuccccaaccccugauagcuuuuuaauaucuggauaauuucaagauucaaauuauucuaaugaauuaaaauucacaaagaaaauauacucuuguuaaacuauaaaugguguguggaagauuuaaaauauuuaauaacaguaguauuaaacaauucaguauauucggauuaaauaucucaugauuuaugacuguaccuauaguaccaguuauaauuaaaggucaaguauguguguucauuguuuugauaauuuaaguuugggcauucaguuuuauauaucuaguuugaaaacuugauaggauaauagggauaauuuccaugucugugcaaaucagauguucuucaaagcugccauacggagcauagccaaucagagcguagccauauggaguguagcugagcaccaagagauaaaugaaaaggagguaugguugagaaguccauaguuucccauacuugagagaugaaucagucuucaaaccauuuaccuaaaauaaaggagcagauuagagccuccuugauucaaaggcaauggugggguauagcuauugacaaaagaaaauuauaaguagucagggucauguuuccuugggacuuacucgauggaugccauggucuguggaccuucagugacgagcaaaugagcuaaggcacuucuagcagcccuuauuccuguuucucugcuaauuagagucaggguaccaaaaugcuauaaauuccuccaaaaguaguguuagcuguggacaguacaaaggaggaaauggcugaacuagcuucuguugaaagagaacuuugcauuugaaugaaguggacuccaguuuuuaaggaaauuuacucauguacuaaauucuuauccuaauuuacacagcauauaaacuaggcuaucaaggagcaaaaggagagggauaauuuuuagcacuuaaagaaauccauagaacuuguuggcacauauauguuagcuauucuuucauauccuuguuucugaauugguagagagaaacugcauguuuuugacaaugugccugaccaugagugaucccaguguccacucucaguuaaaauuuaucauuucugaacaauuucauguaguugucaguugcuuacaaaauaauaacaucauguguaaaagagagcauaaaaugaacaaggguagaaagaaauaaaucaguuuacacgaaaacaaugucuacauaggauagaugacucgccauuuuagcaaccuugacaagaauccacccucuuaucuuuauacuuguaugaauucuguccuugaagacacagguaacuuaaaccaggcacuuaccaaaaaacuucauagcagaguguggaggaucauggcucccuucuuuuucuuccucccugucccucaucaucucuuucccuuucccucucacauggaagaccgaggcaagagaauuucuccaagcuugagcacagcaucaacuaccuagugggacuuuuuccaaaaaugcacaugaaauacagggcaaaaucacauuguagugaggauguguuaaucaagagggaaaugugucaucuuugcuuucacaugcucccuugcuaggaagaggaguuggaaagacagccuuuguggugcuggaggaaagauaagagcuguuguaggaagggggacaggaagacuccauauacuucagauguuaggaaggacauccaaggacguuugcaauuagagcuuucuuaaugucaggagcuguggacaggugaaacaacucugcacuuaaaaguggagaauacagauuucauuguagaugacaucacaccgagccucaguuucuucaucuaaaaauggaaacaucuaaaaacuaucauuuuauaguucaaguggaaaaaguaaaauauuuuaagcuggaagcauugaaguguuauucuucuuuaugguaccaugcuguuauaagcauuuugaaggagaaggcacccggagguguaguagauguggcuuguuuguucuucagagcuaguaguucccagcuuuaaccaauguuaauaguucaucauacuuucccugggccacaaauucucugggauuauuacaaagcuaaacuuggaggacugggucauucccuugaggcagguacuaagucuuaagugagcaacugcucuguuaaguguucgauuuggucugagacaacacugaggaaaccugacggugacugcugaaguaguuaucauuaguacacugcaguaguagcucaugaugucaugauccacugaagucaaggggaucauaaagaaccacuccucaaucauuaauugaacucaaggaauguacacaacgucuaaugaauugucauagucaccaucuaguacucuucuaaguggucgcuggacuuuauacuccucuucagucucauuuuauaugauagggcucauuuggaaacuauauuguaauuuacuuacaaaaaagcccuguuuaauugugcuuuagacaagaaucgcaacaauuuauuuuuuccuagacagucuuaggggcuuuuacuuuuuguugacaucagguggaacaggauugugauuaucuaaauaaagaaguggaagguauauuuuagaaucucuguaacagagccagcuguaaacaauagaugagcuacauacacucaaauuauguuugccagaauaucaucacuauucuaggcuucuuaaguauguaagcugcuggugcuaagggggcucaguaaggaaauucaggaauucagacuugccucuuucagcauuaccuccucagcaccuccugagcacauucgcuaaagaaugagcgguccacaucagucacucgcaguugagacaacagccacaugugaacuuuguuuaauuuucuugcaucacugcaaauguaaacuaguaaauagccaaauauucugaguuacuaagaagaauacaaaugaaauucuacccuuagucagcaagguugauauuaugagucacuuugauauuuaauaugauaucgcagacucacuuacuauucauaaguaauggaccuucucaggguacuauuuucuucugauucaucuguguuaugucacuuggcucauuuccaauaucaauuuagggcgcuaaagagaauuacaagacaccaguaaaguagaaaauucuagccucuuguuauuaauaagugagcauuuuuauuuguuuaugcaaauuaguuuuguacuuucaugaaucauaaguacaaauacuaccugccuauauaguugucuugccuuucacuugggcauuuuccagcugcuuugaaagaaaucuuccagauguuuuguuugguguguugaagacucuuuccaguaauggugacuauguaaugcuuuuugccuuccacuggacuucugcagugucugcuugugagauuauugacagaauacuguuucuacaggagaacacagcuguucaaguucuaaauaacagcuacagcuaaccucauggugagagauuccuaacagucuuccagauuuucuuguuagugacagguuucaaauguacacucaguuauuaagacaucagagugucuuucauuucuuaaucauuaacaguguucacucugauuucccauggaguugcaagcuguuaaaaugaucauuugcuccuugcuaauuuugaaaccaagagcuuaugccuccuuuaauaaaauucaggucucuccuaugaacaugcauaacucaacagcucuaagggcccgugacaggaaaacuuaaccuagagauaauuugggaaguaaauggaaguacauggaggguauaguucucaauacugaagaguccauuauuuucacaggauuugauacacagguuuggugguaguguguuuucaguuucuccuaccuuuuacaguguaguauuuuuuaugacuauuuaaugaagaguaaggagaggcaaaaaauucaaacauucaucucuuaauaauaaaaaauuucaccagaauuaaaauaauguagaauuauuauguuagaccaauaaaauauuuaaauacuuaaaaauauuaauguuuauccuuugccuggcuaaaacagccugcacauaucacauguaguacucaauuaauaucugauuaauugaucuaauuauguuacaacaauugauagugugaucuuaucuguucauuuaaaauuuauauuauaggaaaaaauaaaauuuaugugguuuuaggggaauguaugcugucugauguuggguauauuucuacaacaugggauucaagguguccguuuugugauaagaaguucuguggacuaggcccaugcaagcuacucaggaaaucuuuuagaaggguaaaaccaacucuaagccccacucucaaagacauuguuuacuagauguugaguaaggcuaggcucuuguggauaauauccuagauauugauaaagcuuuagaaugaccaguauauauccucuuuagccaucucuucaaguaagaauaagcaaucauaagucuuuguuuaggcucuguugagugugacugucuuggugcuccugcuuuggggaaauccagacagcuaaauuaauugauccuauauucccuuagaaucaagagaaugaacaucuggacuuccugaauccaaaaauuuucaacuuugaagauaucuuccaaggacugacuaaaugcuaaacuguaauacaaugaauaugugacagugugguuauugccuuacacacagcauagagagcaaaaguuaguacuucagaggagcucuuucauguguccuugcucacacuagcccucuuggccaugagccaucuuccauucauuacugacacaaaccccucccagaauuuguccucaaaccuuucaaccuaaggcucaaaaauuucuagcuuguacaguuuguauugcuaucaaagauaaguacacaaaagacauuguuaccugucuuucaacccacugcuguuguuacuguuguaauuauaaugaaaauguucauuuccuaguucuauauuuucuggauuuucucuuuuuuuuucuaaguauugacucaaaaguauuuuuagaauguuuuuguauaacucuuuuucucccauaagcuucuuuucauguguuuuauaucucccacauaauauuguacaccuaauuaguccuucuaacucaaugguauuauuauuacacagucaaguguuaauuguaauucauugugguuugauuacauauuuuaaaauguaauaccccuuucuuuuagagucauccacugccuaugauauuggcaagcucugucuuuccaagggagcaaauaauuuugcuuuuaaauguaagauuugcugaacccuuugugaagguagacugcuguauauggcauguauccuuggaaaaugugcaaucuaagaguaauagcgauuguuucuuuucagguuaaguuucaucuacucuuccuauucaugucaguaagacccagugcuauguagaacaagaagaagaugguuugaaauagcuacaacaagaccagacacauauucacaucaaagcuggcugaggccauccaggaagaggaaaagggucucacagauaggcaaaagacucggagacagaugugacucacacuauuaggacucucacaagaacaccaaacuacauacccacaauguuacauauaugcagauuaacuagguuagucauagguuuuguguguguguguguguguguguguguguguguguguguguguguguguguuuaauauggggaaugaagaaaaguacauucugauuaaaagaaaaaaauacauaccuacugcauauauagucugugcuuguuugucuggggagauuugcagaggcuccuggaggcucaugcuaaugcuugugguggugugggagugcuuaugguagugaugccugugguggugugggaguacugauguuggugaugguggugaugcuugugguggugugggagugcugauguuggugaugguagugaugcuaguagugcugaugguaaggauggcauguuuuaugguguauggugauauuuuugcugguggugcuuauacuggugguaguagugaugcugcugaugguggugcugaugcuggugcugaugguguaaugccugugaugguggcaauggugcuacugguggugcugguaguaaugguaaugaugguggugcugaugauuguaaggaugguguggugaugguauagugcugguaggauacugauguaauguuuggccucauuuguagcacauuuugucuauuuuauuagcaaagaauguacauaaaguuuggaaguagaaccuaaaaguuuucugacuuugauuacuuuuuaugcauaugaugauuuuucccuggucuuagggggaacccagggccuugugcuugcuagucaagugucccaacacugagagcuaaacccuacccuaaguccucuaacaucuaauuagguaaacuagguuuauagaugacuucuuguuuuguugcauacugaagcuucuggccuuuguaugugcagcuguugauaagaaucaagggagaugaauguguugagaugcauacgagacuuuaggaaaugugaaaagcaguauaagguuuuagguggaucuuauuuuaagucuauuaacugaaagccuccauugacauuucuuugcaaacucuuugaucuugguuuagaaugaaguuccaauguauuuauauguuuuaccuggagccaauggccacuauaaguuacguucacaauauguacuacaacuacacaagcaucuuugccucugcugucaaagaaauaucucacaauuauuucauucuuacaucaauuucuggacuuucacaaaugaauuuauuucugauugcccuccccuuuuucauuucacaauuggaaaaaaaugucuacacagaacuucaugaguguaucaagaagaaacauucaacaaguaucuggaaauuagcagaacuagauuaaaaccgaacgccuuaaaagauuggguaguguaauaaagcaaggaauaauuugguuuguuuguuuguuuguuucccgucuaauauuuuuagguacaagccuaugcagaaaguggaugggguugcagaugguuucacaggaaguggccaacagacaggcacaucuguugagcaaacuguaauugcccaaagucaacaucaucaacaguuuuuagguauguuaagguguaaugcguauuaguugcuauuaggauuuugaagagaaaaauaguagucucuuuuccaaguagaauguugucagauguuaacuccacauaaagggggaggugauuuggugcugaaacuaugacguuaaaugauaguucugguucaucucuuuugaaauauuaagcuauauggaaucuugaaugcaucugccuuaaaaucucaguguguuaaaaucaaguguuuucaagaguuuauauuacaguuggcuuuugugaucaaaaucauguuguguacuuuagaaguaaugucaaauccaaaagaauucucauuuccugcacacaaaguugcauauccauauguuaaauucaaaaaguuauaaaguuaaaauauuuuauucuuuuaaaauuaauugcagugcuuccuauguuuauaauuuuauagaaauaauauacauuucuuguuccugaaaguguuuacaaguagaacuugaacauuugaauauuuaugcuagagcccaaggaacaaaaguggaaguucaauuggcagcuauuauauagaugagaauacauaaucuccaaacccugggucaagauaaagaguugcuuucagaguguauguguauacauauguguguguauguguuuguguaucuaugugcacauauguguugucugugugugcuuguauaugugucuguauguauguaugugugcaugugugucuuuguauguauguaugcaugugugucugcgugcauguaugugcguguguguguguguaugugugugugugugugugcaagcacgcaugguguguguguguaugugaauugccaacagaaauagcuggauuagacuuucagguuagaaaacuucugagccugaaacuguuaaggcagcauuuucuaaaccaaagugcucagauauaauauauuugaccauugagcuuuaaacaauauuacuuuuuuauuuuguaguuauaauucagcuuugguauucaaagaauguaaaacauuuuauauuuauuuccuagagcuuaugaaugaauaccauucuucauuuaauuuugaauuuaugguaaagaacauaccaaguacauuuccaauugucuagggcuaaugagaaaagagaaagaguaugugcuuguaaauuacauugucaucaagagagggcuaaaugagcaacagcaaguguccuagugauuugaauacaggcguguguuggggaagguagccaccagaaagcagaggcugguguaaaugugauccucaagagacuugugcuacagucaucgacaccauguucauguugugagacauaauuugauuacaggauaguaucauccaucacaucaaauuaauguucuuaauuuaaugcuauuuuuguacuuugggcuguuuaguuuuauagcuuucaucuuaugauuauuuaaaagaugaacauaauaaguuuaaggcuauguuuauuuuuauguaguuggauagcauaauaauaaaaauaacuaaaauuccuacuggcaagcucaggugguuuuucuuuuccuaagagccuauacaaugcccauuuuaauuaguguaaagcuuaguuaauacaaaauucauaaguauacuccauucauucuuccaucauaugcugaaaauguuucuaagucuggcuagaaaauauuagcuugaaagucagugaucuuuggcccucuggucuccgcauuuucuuuccuuuuagucuucugaaauuuucccucauuaaucuguaauugacaccauccacaauagcuuuuuuucuguuguguugucaugguaacagaugcaucucgagcacuuccagaguuuggagaaguugaaaucucuucucugccagaugguacuaccuuugaggauaucaagucacugcagagucuuuaucgagagcacugugagguaagacuuucaaguguagucugagcacaugcuaaguuuugccacauaacuuguuaagacaaaauaaucaaguuuuuuucccuagagaacagaguaguucuacuagcuauuuugagcauuucuuugaacacuaauaaaaauccuucuucuuucuugucucaguggaaagugaagggugagugagaguuagaacccauuuuauucucuaaaacugaucauuauaucucuuacuacagcaauucuacuucucggucucuguccuacagaaauacuuacauauggguaacacgucaaauguacaaggguauauugcauuauucuuuugaucaaagagaucgcuuauagcuucaauaagucuacuauaaccuauaugucaaauuauuauaugcugauaggauugaaaacaauaaauuaucuaaaaugaggugagcucuaggguuuaauauuaaagcaaaaggaaaaaugcagaauacucauauaacauguuggccuuuaagugaaagagaccuuacauaaauaucuccauaagaaagaauaagaaaauguuaacaauaucuguggugguuuaaaucacuccauacucuuggguaccuaaacacuuuguccaagugggcagugguuuuuuuagggaauccuagaaauuguggccuuauuaguaugucacugccugugggcuuggagaguuuaaauauuugugccauuucaaguuugugccuucugcuuugugacuaugguucaaguugugaacucuucacuuucuacuccugauuccauacuguggggcuccauacugugggacuaaucaucuggaaccacuaucccaaauaaacucuuucuucuauaagugucuugauuaugguguugaaccacaacagaaaaguaacuaauacagaaauugguuccagagaguaggguauugcugugaagaaucugaccauguuguuuucuggaagaacaugaaaacuauggaacuuuggguaagaaaacugguuaaagcagugcugagagcuguguggacugucauggccuagcuaaagaggcuucagaguguaacaauaucagcaagugaacuauagauuguucugugauauuuaggcaaagaauuggcugcuuucugcccaugcccuaagaacuugccugaggcuagauuuaaaaguaaggaacucauuuuauuagcagaggagauugccacacaucacaauaucaacugaaucucuuauuuauuuguaaucacuccuaacaggucuaaaaugagaaagaacaaaaggugcagaaagaaauacaaaaugcagagaccaaagaauacuaauaagcuuaguguuguugacaaggcuuauacagagagacugcaauuauuaaggagauuccacccuuuaggauagucagaucuacaauccaauaaagggaaggugcucucagagcaagaacucauccagcuaagcuacaacuuauccaaaaagcauaagguguuuucuugggcuccuggaaagcaaccucugucaaaagcugcugccaaugcaaaucaaggggucaggguauauccugagccagcagccuaacuuuucaauguuggccuuguggggguggcuugugaugucaugaaagauggagacguuguggaaucuuacucuguuuucacagagcugacgaggccaaguaaacgaggcagucccuaccuagaaguucugagagggaagggaccugaaaggccauuguuugaaacuauaaacgaacggugccuuagaguggagacccuaaaauguuggaaauggcagguucaugagacaccugccaaggagagcugcacuugaaguguggaaccagcucaagagaggacacaagcaauagaauuggaggugcaaagauaucuaagccuauugacauuaguuagugacaucagagaguuugauguuugccgugccauuuuucagucauguuuugauacaguauuaucuugcuauugcccauuuugccucuuggaauagugauauauauucugugcccguauauguuagaagugugugauuuugauuuuacaagggauuacaauuaagagauugcuuugaaucucagaagaaacucugggcuugaacuuuugagcacuguugugacugaaaaacuaugagaacuuuaaaaauucaacuaaauguauuuugcuuuaugauauggcuaugcuaauaugagggucagaaagugaauauaguuugagugaugugcccuguacucuuguguauuugaauccuuugucccaguuagugcugcuauuuggggaagcuuaggagguguagucuucauggggaaugaaugucacuggagaugggccuuaagaguucaaaggcccccacuauuuuuuguuugcucuuucuguuuugugcaggcaauucaaaaugagcccuuuucuuauugcuccugccaccaugccuuuguuccacuauuaugggcucuaacccucuggaaccauaagcccaaaugaacuuucuucuguaaagugucuugaucgugguguuucaucacaguaaugaagaaguaacuaaugaagaacuuuacaacaucauguuuaggagagucagucuuucaguggacccuuuugaauaccacaaaugugugguucuauuaaaaacaauguaaaaauauuuaauacgugcuuuuggucuucucuugggggggguggauucuuuagacugacuuuagaaugcaaguaucuuuaucuuaggcgcauuugugaugugccugcaauuuaaggauuacccagugauuucuagaaaaucccucugugcguugacagugaauggugaaauaagaaauguugcuuaaaacacacauagauugcuugaggguuacuuaggguuuucuuggugguuuauaacucuacuccugcucucucagucaucagaucugugucauugucuaggaggagggcuuucuccauucuaguacaucaguguaucuugaauucaccugguagaaaggagcuaauauguugcauagaggucucuuaagugguuuuaaauuuuaaguagcuuuauccuaguagauuuguaagaucugccugcaaauuacagaguagccugugguuucuagucaauuccuccugacaguugacagugaaggauaaaauaagaaguuucaguuuaaagcauguauagauuuuuccccccuugguccagaaauaagauugcuugagugaacccaagugcuugucagagaugcuagguuauugacauucuaggacaaguccucuucuuaucaacaucuugcugaauugaguguucuccaucucaccuuacuuauuuccagcacuucugacaugauauaagccagcugguauucaucccccauugauauuucuuugaguauugggguguuucuacgucauuuuuauauaugugagaaaaaucucacaacuguuauauucagugagaaugauuugaagauucuuuaaacaacuccucaguuaucugcauucagauuaaacugacuguaaguagcuuauuagcuuauaaaaauauaauucagagguuuugagugacucauauuuauucggcguauaaauuggaguauaauuauuuacauugcuaaggaguguacagugagaucauucuaagcaacagacuccuccaaaaagauugaaauagucuuuaaauuauaaaauuuucaugaaaauucuuguuguaaugaauaaauauacauaugacgacauaggggcucucaucauuuuucuauguaguauaugacaguccacacaaugaacccugccaucucucauggaacagagugguggacuuagaaaacaaaauucuaauuuuauuuucuguuacaugucaaaauuuuaaauaaagcugccuggaucucagauugaauccuguagucauuugccauaaaccaguagaauauagacuauuuuaauuucuguuugccuaaauauuuggaaaauaaucauaguuuagucacuuacaaagcugccuuggaugaggcugguguuguuaccauuuccaaggucauuggcaaauaauuagagcauacuaauuuuugccauauuucacuucauaucuucuaugauuuauuuuuuaaggaagaauuauuaugcuauuuggaauucuuguaauauguuuauuaagguauuuuuaaagacaucucauggaacaugccuaagcugcaguuguaagaauuuccuucuggagguuuugauuuuuccauguguuuacuuuguuuucagagcaggccuuguuuuguguuuuguguuuugguuuuuugggguguuuuuuuuuucuuuuuaaucuuacugaagguuuuauauuuagauuacuucguuuucacuaugugacaauguauagcauuuccugcuaguucucagaacaugucucccgcacccaugcuuaaugucugaguuagccugagcguguucucuagcauauucuucaaggcccgagcaucacgcgugacacauacacuagaauuaugauguuacauuuuacuuuuuccuaaaaacucagaugggcccuagguuauccccauuuucucugccuucugggcacuuucauaaauccugaugggauucuucuuaguucucaguuauugaugggaucaaacccauuuuacugacucacacugcuuacacuucggccuuuuaacauucagcauaaucacagaauuaaauuuucuuugacuccauguuuguuguuaucugaagguucuauuacaaagugguuucaguggcagaaugaaauuaagugugcucaucaaaaguuaguagagggaauuacaguuacuaacaucaucaauagaagaaaacagaaaguugauacaccuagaaaauaguucuggaaacuaaauuugaauuaaaacucaaggcaaggaccccacaguuagaaaaccauaauuaaagcugauuuuauauauauaaaggaguauaaguaaaauuguaugcucucggggggauuaaaaguuauuauauagccaaauauagcucuguggauaucccuuuucaucccagaaagaugucagugcauggaggccucuugacuccuguuuauguuaccucugccuggugaggacccaugauccacagccuuggaagacuuagcucaaccuuaucccccaucuuccacacuugaguaucugaccacucuuaaccucugcuuucuuggauggccagugguuauccaccuaagaacacagauguuuggaauacuuuguccuuccuggucuggaguagguagugauguguguguguguguguguguguguguguguguguguguguguguauaacaguuucagcugucaacuugucaaguucucuagaaugauccuggaugagagucucaaugagggauuauuuagaucagguuagccugugggcauguuuguguggaauguacugauuacauuaccuuggauuagauauggaauguaacauggaagcaagauaagauauuaauuacuuucacauuuaauagguuuuuaauguuauaucuugugauuucaaaauugaauaugaagauuauaaacagauuauuaauuuucacuucuuuucccaagccuuugaaauguuacacggcauuaaagggaugcaauacauaaaccauuuaucaaugauuguaucaccuuuucuauauuugagauucaauuugcaucaccgaaaaugaaaagaauaagaacaaaauauuaacuuuuaaauccaguugauuacauaacuggguuguuuuguuuguuuguuuguuuguuuguuuuucuauugaugcaauacaacaccaugacuuagaaacuuagagaagaauuuauuugguuuauggucuccaaggggacugucauggcagggagacauggcagcuagcagaggcggggcagcaugaacaagaagcuaaagguucauaucuugaaucaugagcacagaacacagagaacuugaaauagcacaagucuuuaaagucucaaagucugccuucagugacauauguccuccaggaaggccacaccuccuaagcuucccuaaauagugcugccaauugaggacuaaauauucaaaugcccaagaauacugggagacaucacacaaaccaccaaacaaccugaaauauacaguauguuauuucagcauggaagcaauauaaacauuaguagguaguguuugcacuuuuguuuuggaguauuuaaauuuuaaucuauuuucaugucaacaagaacacacuauacaggcaaaucaucacuccuuauuuuuaguucuucuguuacugaaacauuggaauauaaugcuguuaguauuucagaauguaaaugauugaccaaauuauuacuugauuuuuauauuguuuuacuauaucuccaaaaugcaauauguugucauuucaauaugaaauuaauguaauagcuaguuagguauugucuguccuuuguaucuuacaaagucuugaauaugcagugugucuuuggugcuuuuuaucauuagacauugcuuuuuggaguggccagauuucuaagauucaggagacaaauguggauaguguaaaucacugcaaaccagguaucaguccugaaaagggucaaauacauaugggaugauuuauaucccauaggaaguauagccaccuuagcagaaaaaagcuuaugguaaaguaaaagaccaggagaaguaaaggaaguauuaugguuuggucauuuuguuucuaggcaauacuggacguuguugugaaucuucaguuuagccugauagaaaaacuguggcaaacauucuggcgcuauuccccaucuacuccagccgacggcacuaccaucacggaaucaaggucagaaucaauaggccuuucugauuuauuuucacgaugaaguagaugucgcugcuaaugagcuagagauguguauguauaccaguugugaacgucaccugauaacacugaguagacugacgcuuugaccaaaucuaauaagccagacugcucgccugagauuuuaauaugugcggcucccaucuuagugauuuggggacuauuagcucuaugucacgcuaauggacuacuauccuaucugccucucagaccauaagaaaauauuaauguacauaaguagcccugggggugcguuuguauauauacauccauauauauccagccauaugacaccagugcaaugaugguauaguucuaaccucaguaauauuugauaaauuauuuuuaaaguccauuuucuguuuuauccucauuugccaucuauucauuugcaacauuuauucacaccagcaaucugagugaaauagaaagucgacuuccgaaagcaaagcugauaacucugugcaaacaugagucuauccugaaauggauguguaacugugaccaugggauguaccaggcuuugguggagauucucauccccgacguccuuagacccauuccuaguaaguuaaauggagacaacuacggaugcuuuuguucucauacauaccacccaagaaauuuuggggauugauguugcaaucaggagugauccuaauuuuauuuaaauuugucaaauaaaaaccauacagcauauagaauauugcauguaagaagcuuagagugacauugcagugaaggggaacugaccuaucuuccagucuuuuccaauauuauuuuuaaaagcuaagcuacaguuaugacaccuuuaauaaacuaauugcaagaacacugagaaucuagucgaccaugcagaauuauucuacucaagacuaaaguccucugcauauagccaaaaaauacucagaccucuaauugcagaccauucccuuucauuguugccuagcauuugaaaagaguugauugugguuucaaguagaguucaaauccuguauaaaaacacauacucucucaccugugucaucuucagaacuacaaacucaguuuccguuaacgcucaagguugacuaggauuugaggaaaaaauaauaacugcacaagcagugcacccaccaugaagugacuggaaacugcguagaucacgcauaacuuuuucaguaaucacuuuguaacaaacagagaguucuucuguaauuguagauguaaaugcuacuacacauauuguuagaaguaguuggcacuauguuacaccuacauucaaugagccuuacuaguaaccugaacuuuuaaagaaaugggauucuuuccacucugacauuaauaaaauaaaagcagucuuuuugcucaugacauuggcagcuauguacauuaaauaugcuauucaccaauuauuuguuauguuauuguggaaaauauauaaauaggcuuuaguggaaggaaagcggaagauguuaacauuuguguguuuguauuuacaaaggcaaagacccagugaaagguguaaauucuuuuacacauucacuaccuuaaaaagagaugcuuauacacauuuauauauuauaccagucaaucuacauuaauauauggaggagaaaguaaaaaaaaaaaagaaacaaaagaaacaaaagaaaucccacuggcauuaucuuaacacuuuauaaauuacuaauguguuucacacuaaacacaccagguuacccaacuaaaaguuugauagaaauugauauugucauagaaaauuucacuuuggcaauuuccacugguuuuuguucuagaauuugauuuuuucccccuacucuccugcccgcugugcuccaaguguuagucucuagagauguuuaaaagauguugcauaggcuagcucauuagccuaugacaucuggcuaccaacauacaguuucucucaggagauacaagaagggauguuagcgagugcuuugcuuuccgaggcaagucaguagcaucaauauuaauuaaacaauucagaaauugugugcuuuugucuuagcaucuuaagaauuuagcaguucccaaauuuaaguuauucaucaguuuuaguuuacuuuaaaccuuagaauuaaguauaugauacacuugcccuuugucuuuugaaaaaugugauuagaaaaaccuguuauucuaucaaagaauuugucucuacaacucacuggaaagugaaaucguuuuauuucucugaaauuacaagauauauuaauguacuacucuacaaaagaaauuuggggaauucaauuuccauuuuacaguaaggcucaacaauguauugcguaaaauacaaugaagauagcuguugcugggugagguacauuuuaauacugaucuugagcaggcugaggcagcucagcuuuggaauagauuuuuaaauaccaaaccauccauuucugagucuuuagaagcugucagaaucagucugcacaauucugauuuuauaugaaucccuacagagagaagaaacuuaauuuuauuuuuaaaaauuguauuucuuggcuacuagugcuucacucuaccauuuucuguccagaugggauuucuuuuuuuagcuaaaaagucugcacaucauacuaauuuaaagucagccugaaggcgccauauucuaaaauacauucacccgaaacacggaaaaaggaaauuaagugugaauuauugaauaagaacucaacugguaacacuguauuauauuuccagcugcccaucauuuaguuaaacaauaaguaaauaccugaacuuuuuaauaugcccaauguacuuuuuaucuuauaaucuccugccaucaaguuugucuaaaagagggcauuaugaaaugcuuuaaaaugacguuagaaguuaugggggucuuuuucaaauuaagucauuguuauacuaauuagagaacaaauguaaaauguagauugccauauugaaccuuaaacaaaacuguacugaguuucagaaaggccguuaaugcuugucacucuuuuccuuuccguucacaccugcacuccaugacucuaggacgugaaaugacagagagacacgcuucuuucuuuuuucucuccuaguuaagauggggcgcuuuagagauuccaagagauugccucucaagaaauuuccaguucaaguaugcauucuuuccuaaucaauauuuaggcaauuucaaucucuacuauccagcuaaacaacaaagagucaguugguuauuauugggguauuaaaucuuauaucuguugugaguaauuugaauagucuaaaugcacucuaaaaucuauuuuggcagaagauagagugcacuucagcauagaaaggaaagcccaggacuuugguccugcuuuagauucuugggggcagauagccaaaauaggcuucuuucccauggucuaccacagaucugcauagcuaccagauaguauggaaccuacagagauuagcuuguguuaugggugcuuuaaacauuaaauacccaaaucuauuccccacagcauguaacccuaggcaccaaggaauuuaagcaccauugacuaaaugacacagugagcagaucccuuguaauauggcuagcagugauaacugaaggcacuucuggacacuucacggccacuauaaaguucugucgugggaccugucccuauuuuaggcuuuuaacacaauaggguuggcugucuugguaauaucuuaguaacauugcuccugugacagcaauuguauuacacuuuagcucuaccuaccaugugaaauucaaauaguaaucugaaacuuuuguugagacaauuauacauuuuguucuauuuucaacaaauaaauacuccaauucauaggcuuuaugguaaaacaucauacauagagacaaaaauaauauuuugcacuguguuucauuuuaaccaacaagauaaaauaagguugauuuggggaccaaaauggaaaauuuacaaagcaaauucuuagucuugaucacaaaacucuugcugcaguuuuguccaaggcagaaauccuccaucaagucuauucacaacugguauaugagcaugagcaccaaguucugaugucuuccuuuccagcaggcggcaucagugucugagaacaggggaguucuaaaagccgagucuaguauuuugagacgcacuaagaaauuagaaauuauguuacuuuuuaaucagugaagauaauagaaauuuuucuaugugcuauuaaaguagcauaaacauauuucucuuguuccaguuuaaaaugaaugguauugcauaucuuuauuguucuacuuuucuuuuucugucauucaggugccuugacccaagccauucgaaauuucgcaaaaagccuagaagguuggcuuucaaaugccaugaacaauauuccacagagaaugauucaaaccaagguaugguuauguccuuugugugugugugugcauguguguguuuacacuugcuuaaggaacuauuucuucaauaauuuucucguaacuaaucuuuauacauaaauaacacagaauauuaugcagaacuagcauauggauucugucguucagagcuguuacucaugccuugaggauuccagauucuacauuaucccuuucuggcauaugccuguggcaagauuggacagaggcaauacuuugauuuugcugucccccaaaaaucacauuuguggcuuuugguuagguagcuguuuccaagauuagacuccaagaguauaucuuuacuuucaaaaucuguuguauuccuaaaauaauaccucaaauugcuacaaucacacucuucgcacuauuaucaaaaugaaugccccagcagcuugccugcaguauuguccaccuugcugaguuuuagguuuaaccugaaugguuaccacugcagagcacagcuucugcucuucugccguugcauauaugcaguuguuuuccugccgaacuuucugucaaugagacaguuuaccccgacugaggaaagagcugucuagugaguggugauagcacuuaaaugccuggguuccaaucuguacagucuuacacaagccacuuaaccccucuaaaauauaccauguugagaugguaguugaaccauguaauauauguaugaggcacuuaaccugcugccuggugucuguguguguguguguguguguguauguauauaaaccagagaaccauguucucuacaaguguauauaagcuugcuugaguauuccauacaguccuaauauaucucauuuucaaaguagucuccucuacagugucaaccaauuauucuacucaaccaacuaguucuucaaauauaugcuuauauacccauaaaauacuauaaauauguuaagguuucuggcauauuuugaaagacucaagucauaccuacuaugcaucuaauauuucuaugagaucaugaaaacuagguauucauuuaguguuuuuuuuuccauuaucuuugguacuuuucaacauagacuagcucauuuagucucauucagaaagugauggaugaccagcuagggcaguagaacauuugaccaguaugcauaauguucuggguucaauccauuauaauaguuguagagaagaaagaaaagaaaaaaagucuauggaaagaguguauggaaugacugaauugauuucuaagcaugcuaacagaguugacuaagcuaaugauuaagcacaucacagcuagcaauaaugagaagucaccagcaaguguaagggcugacguucacagcauuaggaaacgucuuuccguguuuccccaccuguagccuuagaacagagaagaacgcaguuuuugaggagugagcgcucugaccacugugguuuguccuuuggucuccuaacaaugcccacccuugauuaaaucguccugugagcuugagugcuugucaucuagggcauggaggaaaauggagaggagguuuuugagagauaaauguggauuaggucaugacaccuuugaacuuauuuauuucaccaucaagucuaccaacuuguaaacuagugguguaaaugaacucauaaugguagaugugaaugacacugcucugaaaaguguuuuuucaaauuaucguuugcuuuuccaaauaaaaagaaauguucauacuugucuaauuguuaguuuuccuaaaaagagugggggaggaaaagaaagcaaacauuuuucuacuuuuuuaaacaauguaauuucuuguuguuguuugguaauuaucuuccaagacuggcuuaauuauugcugcacucagaugucagaaaauaugggaguuuguuuuaguguugaccucacuucacucaaaacuaauucuuuguuuaagaaucugaaaugguauauaauuuacaaguuaacuauuaccaaauuaauuugaaauauaucuaaggaaaacuguuaaaguugacugaaguaaaaugagauuuggagauuguaguaguuucuuuuaugagagaaaggagauagguuggggaggaagaagaacaacaacaaaaaaaaagacagcccaccccagcuugcuuggguuucuauagguugccgcuguaagugccuuugcucagacucugcgaagauacacaucgcucaaucaccuggcccaggcagcccgcgcagugcuucagaacacuucccagaucaaccagaugcucagugaccucaaccgcguugacuuugccaauguccagguacucugccucccugcauauccugucucuuaaagaauggugacaauguucuaaaccaggaccauccgacugugcacuggcacuguguguucacaguuucuacaaagcuagaguuucacccagacagagcuucauugaccccauuuguuuuguggguaaaguaggcaacagaauacauccagguuugccaagaaguuaaacagauaaucaagaucagagucauugaaaucugacaaaaaaauauuaggcuagucuaugucugugagaaucugaaaaacugcuuggcugcucuuguuucauuuuccaggauauaacaacuaccuuagguuguuuaaauagugauuuguaagcauucaagcagguacuucuguuacuauaguaacccaccuugaaaaacuaagcaucucuauuacagaguauauugcagauacaugagaaaauucucucacuuaaagaauuaacugcaguaaguuuggauguuuaguucacaugaaauauauuuucuaacaccaguugcucuguauuuuaugcuuggaaaugaauaauguaggcuccaugcaaaagucuaacaaauauuuuauuuaugauacuaaaguagcaaaauuaguuguuacuuuuaaaaugacaacacuucuaaccuaaaguaaaaccaacaaaguaaagaaaaaaaaaaaagcauaauuaaacacaauccaaauuuaaaacuuuuggaauuaaaaagagacuauauaaugaauauuuuaaaaaugcaaagaaugucagaaauucaaauagccugacuuuuggcuacuuuguggguucuuuccuucuuccccccuucaccaucccccuucuuccucccuuucaaccccugauacuaggagagaaaaaggauagaagggaaaagugcugaggagauccguagacuacuuccuuccugcugauuaggaggggguuaaguuccuuggagcaaauuugaucuugucuucaggauauccaauuucuuccccucucuuuacacacgaccacuugacaaaaggcaacaacggcaaccagcagcagcaggaggagcuacagagacuacagccccucuugaugcucuagcauuucuauacccuuucaagaguccccagauauuccaauguuauacacuugcagaaacuaucugcagcuagcaaaaucacaaaagacaaaucauagucagcugcugugcacaaucugaagcagcccauaucccacacuugggauuaaaacaaaaacauuccuauaauauuucuguguuuuuaaagagaccaaaauucucacuacaaguauccuauacauuauauauaauuguguguguguguguguguguguguguguguguguguguguguguuuacuacucugaaacccauuaauaaaaagccacuugauuuuaaaauggcaauagacaagugccuaguaaacauaggaagggauucucagcauuggcuaccaggggaacaggaguuuaaaccaugaguaaauaauauuuaugaacacugaaauggaugugguugaagauauaaaaucuaaguuuuuggucccuggagaacuggagaaauuagcacuucauaagcuguugaugagaauguaaaagccacaaccacugagacgcuagcauuuccucaaagagauaaauauacauuaccauaugccugagcaguccagggcucagcaaauagcuauaagaaagagaaacauggccacacaaguugaccaguccuugacuaaaaugcuugcacuggaaggcucagauguuuuuguauuuaauagaguuuaccacauaauuaucccuaaaaucuguacucuaaaaaugcuccaaaacaguuuuucugaucauccaaccuuguaugaucuccucagacuagagauaacucaauguucaugguauccuucaguguucauagcaucaugguucagaugagacagcccagguggucauuaacaaauaaaugaacauguguuuuauucauacaauggaccacugcugagcaauggaaagaaauuaagauuugauugagccuuggaaacaugaugaaggaaagucauuacaugcuuccauuuguaugaaauggccugaauagacauuagcaacagaaaauagguuucuggcuggauagggcuaggguauuauaauagcagauacaauggguaugggacuuccuuuugaguaaaagucuaccuuaaguaggugaauuguacagucugucuuuccagaucauuacuguauuaauacgaaauuuaaucucuacaucaugucuggcuuuauuauuuaaaauuuauuccauaaaaccauuugagcuugauucauuuauaguacaaugaauuguguucauuaugacauuuaaugaauuaggcucauguuucugauagcuauuuuuucagucucuuucccauguaucuguccaucuacuaccaacuauauguauauaaacagacacuugcauguacaagcaugcagucauguagccuuuacaagagcagucuuguauuuauaaaacggucuauguguguaaauagauuuacacuaucucauuuaccaaacauauuaagcaauuauaucuugaaguacacuaauauuugcuucaaaucuucauuuuaaaaagauauguuuaaaaauuaccuuauaaaaacugagguaaaauaaucuugaagucagaauaauaagacaacguugguuaauuucaacucaguaacaguaauuuuuauaaagaaugauuuuaauuaauauaugaaaaaagcauuaacuguuauuguauuaauauuuuugugaguucucaaacauggcuucauuauuuuuguauugaauugaauauguauaaaaaugagcccacucacuggcuagaagcagcugucuucaggacaucuuuguauguagucaacugcacaucuaccacucauccuuacucagcaacuucgagacuacuccuucucucccuuccuugucaacugucaaguuguguguguguguguguguguguguguguguguguguguguguguguguguguguugugucuaucauggcagccauuacaacuggaaacugcauacuuaagcauccgucccccagaacacuuuuccucucuucagagguucauagcaguggugagccauucaguuuacccuacacuuuauuuguuuguacguucugacaaauccucaagugaguauagauuauuuucaccuuccuugcaucuuuauuucuuccaagcuuugguaggcuucuccaguguacccugcuucccaucccgcucucaugaccuuuuccugucacuugaaaccugccccugccucuucuaagaugagucucaguaaggcugauaaacgaguaaaauucuugcacuaaggacacuuugguuugaagcaauuuguguguauuaguuuuggagcacgucaagagcaugggcguuccaucaggagaagcacuuauucuucucccuguuucaucuucuucucagcaaaugucuuugcauucaagucauuuagucuauugcauguugaucggcuugcuuucuuaauuaaugauuuacaaugguauuguuuucuaaacguucuguguaaguggaugcauuucuauguaaauuauaaauuagguagauuuugguggucuaaccugauaacuuaagcauugaauauuuauugaggauacagugugauuuugaacuuuguuacuauguaccauguugaauauuauuuuuauauaaguuaagaaugucuucagguguuuguuuucagcuuuuuccauuauaaaauugaggaaauugaauuucugucuaaaggacuacuuacugaguaagcuauuguuacugugagauccauagacuagugaaacagaacauuaugaaagggugggaaaaguggcuuauugagcuguggucuuauuucuccaauuagguuuuagauuacugucuuuccuugccaaaaauaauuucacauaaagaguggguuggaauuuuugguaagaagggaaauuccuucuuguaaaucaguaagauccugauccuagagcuagggccaacaaggacacacccuucacauggagcgcaggcuccuucauuugcacaaugaaaagguucuggaggcuggaugcugcauacaguccacauauuuagcagugauguacaauauacagagaaagagucaaauguauuuuaaaaaaaacuuacaugcuaauggggaaaaccuucuccugguaacuacuguuaugucuaaacuucucuggguacucagggucugaaagccauuuaacacuauuaaaagaucuuaacuguucuuauauaaauauauuauacagaaauaaaugaaagcauaagaaaauguaguuaacaacauagcuaauucaaacuuuauacuaguaaaauauuagagcaaauaaauggcuagcuauauggaauugguuauuuaauaauguauucaugcagugacacaaguuuauugaugagcaaauaaauacagcuguauauuugucuacacggaauaguagguacuguugauaagcagaauauugaguaaaauguaugauauuuauuauauuuauauacuuaauuuaauucauguuaaaauuacauauguauaagcauaaauaaacacgaauaaaugaguaauguauauauaaauaugcaauauguauucauaaaaauagagcacauauuguaugugaaaaacuuaaagaguagguauauucacguuuugaccuacccucauacucuuuuauugucuuuuuucuuuuuuauguugauauuuuucuaugaucacauuuuaguguauuuuaacuauuuacaaaugcuguuuaagaggcaacaucuaugggagugggcagguggauggaagagcacccuucuggaggcagggagaagaggggugggauggugguuguuggagaggaagccuccgggaaggggauaacauuugaaauguaaauaagcaaaauaaccaauaaaaauaauaauuaaaaaaaagaggcaacaucuaaaaacaagucucgaaguugcuaucaccagcugagauguggaagcaacugagguuucccagagaaauagaaugaaugacuuagaugcaguuugccuuuaaaacgucuaagcuuaaaugauccuuuaaugugauaaguguguaggaucagcagagauguuagcacuggaaagauggcauuagggaugcauugauuugaaauuucaauuugaauuaacuucaccucagagcuuacauagaauaaacucuacagacacuguuuauaaaaauauccauguagucuauguuuuauauuggagcuuuauagaugccuucaaagacacuuaucuuaaaauuacuauaaugaaugccacuuaaaaacucuuauuaauuuucacuugucugauuuauugcauaggaaacuagagcccacacugaccuaauaaauugcuugaacuaaguuuggcaaguuagggacugggcacacacacaaacacacgcacacacgcacacacacacacacacacacacacguuugccuuuugauuaucugccaagcaguuucuugucaaauaauuauauuucaauccugagugauauuuuucuuuuaaucuuaaaauaccguauagcacuagaaguaucauaaaacuuagacaaucacugagaaguaacuuuaaaauuuccuauuuuuauuguuacaaaauaugaagcuucccaaccagaagcagaaggaaaauuacaguaaucagguuucuuggcagguagcaugucuacauuuucucaaaagagguuuuguuguuguuuucaguucugugaauuaauuugcauuuguugguuugaauugauaacccuugagauuucuguuccccauccauaaacucacacagcauauguuucuaccuaguaccauucaguguuuguuuuucuuuuaaucuuuagggaccacuuuuggccuauugaauccauuuauuccucugacuuacucuaaaucuucuaaaaugguuuuaaauuuuuaucugaugggguagauaaaaccuugaaguagugagaaaacaggauguuccgugcugcuggcccaaacaccugucuuccuuauuaacuguucuggucuugcgcaaggccuggccagaguagaacaccuagucagacacugcaucccauaaagguagggaaagacgcuaagcccugaggaugguaaauacauugaguucauuaaguacuggucaugauguguuugcguccccuguugauguccucccugugacacccuguguauguucugugaugaugcucuguaggaagcugcugaguugaacuuugcuuucuaucugugaccuguccuaggagcaggcuuccugggugugccagugugaugacaacaugguucagagacuagaaacagacuucaagaugacccugcagcagcagagcacucuggagcagugggcugcuuggcuggacaaugugaugaugcaagcgcugaagcccuaugaaggaaggcccagcuucccgaaggcugcucggcaguuucugcucaaguggucuuucuacagguagcauugaaauugcacugaguuuucgucaugcucuguaaauguguguauguccacacuauucacauaaaaaagaagucagcuuagacuugguggguuagccagcucuaugacuaugauguguacaaauuaaugggaaauuuauugaaaugaacauuuuugcuaggaaaggagaccuuucucaaagcugagaaguuuuccgcgaguuaucucugaaagucuagcuugauggguguuuuucaaccugugggucaugacccucuugguugucaagcaugcuuucacauggguuaccuaagaccacacacacguuuacauuacaguucauaacaguagcaaaauuagagcuaugaaguagcaacaaaaauuaguuuuugauugggaguuaccaccacaugaggaauuauaguaaagggucuccguauuaggaagguuaagaaacacuagacuaggugauguuuucaggaaccauuggaaaaguucucuaguccucccucugcuccuguagguacccuuguuccuuuucaguggcucucguuagaccguggccucacauccacuuagaaacauuagaaauguucauuauuaggucacuccacaagucuacuugagucagaauccacuaggaaaggccuaguaaucugagcucugagacccucugggcaguuccaguuugcacucaaaacuaccuaguuaauguauuaauucugucaauuguauuuaucuucaaaccaggcuaaguaucagagaguagaacuuacaugguuuuuuuagcccuugguuacuucugagacucuguaacucauucauacccuugcugguuggaggucauauuuaaaaggacaauuggaaucauucauuuucuugugacuaugaugcaugacuagaaucuaggaaguaguaacauauauauacuuacaaugcaccuuuucaacuaaaauacuucagauggaaauacauggcguuuuuuguggacauauaaucagcccuaaagggaaagggcuuacuaauuauaugauauaugaugggaaaauugaaaagguuuguuggccccaaguuuaaacaaacauuuauaagauguuauugaucauaacuugugccacaucuguguagaauggaauggucagauggauuucugccuggaaucuacguuaggggcaguuuauauaucucaguacauacagguuuuaggcccaggucagugguauuaucccaaaugaagaaguaaacauuuguaguuuuacuaaagggucaaauaccaccaucaaaaauuugaauuaucuaacuugauaucucacaaaauauggauccauuugucauauaauucaaaacuuuaauuuggaaguacauuuuauuguuguuguuuuuggcuuuuuuuuucauacaaggucucucuacauggcuuugguuauccuagaacucacuauguagaucaagcugaucuugaagucauacagagaucaaccuggcucugucuccaccgugcugcgacuaaagucaugugccaugauacauggcagaaauuguuuucuugaucucuugaaacucaauauucaauuuuguucaucugaauuuguaugcucaugacuaguggaugaaucaguuaaacugucugacucuuuccaaaucucucaugaccaauggcagaauacccaccuauauagcaauagaagagagaugcaacacgaugcaacacacacacacgcacacgcacacacacacacacacacgcacacacacaugcacacacacacacacacacacgcacgcacacacacacacacacacacacuuccucuuuauguucuguguuaguggcaugcuugcccuucuucguguguguguguguaugugugugugugugugugugugugugugugugcaugugugugugugugugugugugugugugugugugugaaaguugacuucauuuuagaaauacaccccugggagccuuugucacuacagagaucuauuguaggaauccugaaaagaaaaaaaauuacucacuugaauuucguguuuucuguagauacagaaaccuaguagaucaucacuugccugcccucuguccucucugaguuagagauaauugacuugucauuauuagacacuauuaugguuauuauuuucauuucaaaaagauuugaagacuuacaguucagcgccacugaggaaagagacaaacagaugcauacuuccugcugguaggcagguaauaucagaacuguuuuccacugaggcauaagaacuguugaguaaugaaaacugggcauacgguggucauuucuuaaaugcaguggauagguacccagagauguaccaagucuauuccaaaagcagacagugcugaauagcaccccacaaagcugcuaaagcgauccuggccucaccucuauacaaagccugcuugaaguagggaguuguguuugugacauuuaaggccauguaaauacaugucauaagcuuguaacauauguaauguuuucuuagccuuuauucuacaaaaauaagacuauuuuuagugugaauuugacgaauguaagaccaugaacuguuuuuuguuuuuuuguuuuuuuaaaucuuauggccuaauuuugaaggucuccaguuuuuaaaagguugcccuugugcuuaagugccagagugaaucaauguaacugaugugugaaaucuguuguauugaguuuuuauaacugaaaagauuuaagcuacauuucuugguuuuuuuuuaagagauauaaagauguaggacaaaacuuccuccccaaccauuuuaaacccaaagacucauuuuggcuuuaucaacccuaagucaccccugauauuugugcaacccucauuuauggcaaagggaaaaagucucuugugugauuaaaccaaguaacaguuaacuucucaaucuuuaugagcagaagagcuaaauuguguuuucuccauuaaguucagagcaagaguccaagucaaacauugaguauccuaaaggacaaguucacaaaacugugaucugacugaaaaauaaaauucauaaauaaaaaaaaaaagaaaacugggcauaaaucauuaaagaagcagaauuggaaaggauuuuuaugucuuagcauuguaauuaaaauuguaaauucacagagaauauaauaaauuugacagccacaaauacagaccuucauguuuagaaaucugauacuuaaccuagaaauuucuaaaauugucuucacaucuaugugcauagccguauagagacagccugaccaggacgccgcucccagcagcugcuaugcugcugcucagacucugccccaucaggggcugccuacuuaagcuauagcagaauggccaacauugacuuugggaaauccagaaaugcaaauuuuauguguacuauuuuuuuucuucuguguuuuaugaauaagacaaaagagcuucccuagugacuacagugaagaucauucaagcauuccuaguugggggcgagcucagagguugcugcagucaaaacuaacuuugcucaaugucuaaauuuuuagaauuagaauuacaaaggucaguggguugacauuuugauaacgacugucauguuccuucuacagaagccucaggaauacuuguagauacgguaguuuuuguuuuguuuuguuuuguuuucagucccucucuaaucuccaaucucacagggcaguagacaccagguguucucuuuaaccugucuguguuuacuuuugaauaauauuagccuuguguuuguaucuuuguuagccacuugucaucccuaggcugcauuuuaaauaucugucuuuauucagcaacaugguuggaguuguaacugaauacucaacucuuggauuccuuucaagaugacugacauugaguucaguguuacuugguauuuaaucauuauguuacauuguuuuucuucuugugugcggaagauucucugcuuuaauuuuuuuucucauagaaaaaauauuuacuuucaaacaauuacuauguuauauucauguaaauuauuugacaaguggaagauaauguaucauuggcacaugaacuauucuuccauuuguaauaauacauuuauguauuaguuauaaaaauuuaaggagguuuaagguauuuuauugacacacagaaaccauugccuccaacuguguauuguaaugaauauagcauuaacucuaguauaugcuuuacucuauuaauguccaguuuuguuaagaucccucacauguuagaugcccuugccugcauggcuggauccuggaagccuuacugggaggcaugggagauuaagaaaaaacagcauaauugaaguaugucguuggguagacuguacacuuagauguagauacaucacuagcccagauacacagcauauuuauuauacauauuauaucauggaggaaggaaagggucucugaaguggaagagucucagggagccaugaacauaaaguuaucugggaugagggagcugugguuaguacucuuugcaaauacuguuuuuagcugaaggucaauaguuagucaacauuuguacucagacuauagaagagccuuaccauucuccugagucugaccuaggaagccuugccauuacccugaauccaagacaaggaaggccuggucauuacugccagcccgaggcauuagcacugccauggccaugcucauguggaugcucguucauacaggaguguucuccaccuuauccaugaggcuauagccuaggacaggugcuugaaaccaccaauauuucucaaccuaagggguggauaccugcucaugcaugcuguggcuauaaccuuugcaguuugaauuaugacagcaaaccuaguacauauuuacgucccuuucucucaauugcacagauagaagauucauucuuacugucauucccaucucagcagucaauauuguuuuccauuuuaagcuucuuauuuuaaggagccauuuugcaguaaugugguagacugacuuguugacaucacuguucuuguacucuggagccauuauacaacuuggacuuacuggacaauaagagcuguuucccaugugguagggaccagagagcagacuucaucacucuacgcagaaggacuugugcgaugaaagcuguugauuauuucuagaauuugcauuucauauuuacaguggcuggcaagaaaaucaaaacuguagauaaagggaacuaacugcuauguguugcuucauuugacacucagagcaacuuaaaagccuuaaaaauggcuaugugguuguaagcaagacuacaaaggccaccuguaaccuccuagacaggaggcugagacaagaagauugauggagaugccaauccaagcuauauaaugagaugugggccagccugggcuaaauugugagguccuggcuuguuuguuugucuuaaggcauacuauaaaugaguuuagcuagcuguauagcuuuaccucuucuucuguuuuuacaaugauuaaaaaaauaaauaagucuucagucuuucauaaacaaauuauaaauaacccuuucaguccuauauuauaauaaauuauaguuguuguauucuauuuacucauaaguuguuuaauauucuuuaauucauuuuuuccuugaaguaacuguaaguuagcuaagacuaaaaauccugcuuucacuuucccuagagaaaacaaccucagggagauugcuuauuugagguuaagagucaaguagcaaagagccagcaucagaagccagagcuucugcccucacgucucagcucaugcucugucacuugccagagugcacauaaggaauggacggauuuaaaaucugugcuuucaaaagguugaaaaaugaagcugaaaacuaaaguaaagccuacuuguaauucuuuuauuugccuggaauuuuauaauugguuauuauaaaauaaggcuuuaauuuauggcauuuugcaucuuucuccugagaauauaaugacaguuuauaagccaaaaaaaaaaaauccucagaaaaaggcaacuaaguaaaaacugguaugaaacuucauaaaugcauacauuauucuuacugugagucacagacaccauauauauauuugaaguaugaaacaagcuuacuaguugguauauuuuugguaaagcuacaauuuauuuggacuuauuuguauuuuuaauguaaaggaguuuauuguuauuauucuaucaauauagcucauauuucuauaauauauaucaaauguucaugcuuuaagauuuaauacuuuaauaccuuuuaaagucaucucuacucccuggcucuagggggugggggguggggcaaaucaccuuaauuuaaaugaaaaucaccgagaaauuagaguuaguaauugccacauuauuccaauuagacugacagcuucagggaacggcuaguauuuuuauauggaaccuggcacaaaguccucucuauggaucauugucauuuagcaaugacaaaugucaagcaucaucaaucaaauguucacuuugaguugauuuuucuuauaccagggaugaauuuucaaccuuuccaaaauugucucuauucggcuguaauccaccuguaaguacaacagaaggggcaaacauggcaguaaugaggaaaggucuguccuacccagcucuagaucuagaagaucagggucaagucuuagagaacaggaccucucucucaccauuggaaugaguugagccaacugcuuucaacaaugaaauugaucugucacagguuuuauacuauaaaagccugugcuuucaguuagucucccaacuuaacugcuuuuaaaaguacuggaacuauaaccauggucacuaaugguggcuuccucucugcccuuucucuugaacagcuccaugguuauccgggacuuaaccuugcgcagugcugcuagcuuuggcuccuuucaccugauccggcugcucuaugaugaguacauguucuacuuaguagagcaucguguugcucaagugacaggagagacaccgauagcagugaugggugagguaagagggccuucaugggcuguuugguuuuuuuauuacacuucuaaaugauugccugaagagcuucaguucuacaagggacugauugugugugugguuucaaucacagaauuuuaagguugaagguucuaucaugucaguggaauguuuugauccauuauaugcacccacaauaaaaacaacaacaaaacaaauaaaauuuugagaaacacgagacuuuaaaaaaaaaacuauuuaaaaagaaagaaagaaagaaagaaagaaagaaagaaagaaagaaagaaagaaagaaagaaagaaagagagaaaaaccauugauuggagaugaagaccaaaaucuauguaaaagcuaaccucucccccccaaaaaucaagaguuaaguccguauuuuguaggcucucuccuagccuucaagaaggaaaugaauuggguuugcuucaggacacuuaugaugagguaaugacaaguccaucuuguguugcaagcaugguucuaagguauugcauauaauaaaacacuuagcaauguauuacaauccucugaaaugaagugauucuuuuuccuacguugucagugugcaccuaagguuagugcaguaaacaccgggacagagaugcucagugguucuauagcuaguaaacacuagauacauuuugcugaacagauggucugacuuuucaagcccguguucuugaucacuaacguuguuucuagaauuucuagguaauuauaaaaauggcuuguccacacucagugucagaaagcagagauucuuacaagaacaugaauaagaauugguuaauauaauuagcacuaaguacaaaggcugaaauaacucagcucuggcucauuugauuacauugaguuagaguaagcuguaugugaaacaaguccuuuuuaaaauuguuauaaguguaugagugcuuugucuguguaugucugugucccauguauaugccuggugcacagggaagccaaauaggaggccagaugcccuaaggcuggugguguagacagcugagagcuaccaugugggugcuggagugaacccagguccucuggaagagcagcucauuguccuaauggcugagcugucgcucuagcccuaaauguccaauauuucuaacauuuuuaauagucaucuuucccauuuuaaaaauagcauccuuuacaauuucaugaucuauacaucuuuguaugauuauguuuaaaugaugcuggauagcuguauguaagauggaacaagaaaugcuguagcuuuuaaauaauagaccaaacaauuuggauguuucuuaaauucaacuaucuuuacuuuagcucuauagauaucuucuuacaagauacccauuuggaaugaaagauuucuuaccucagggcucaacacuucugaauagaucugucuuuuagugcauuuaacauuuuguucucuggaucuuuaucagaaugaacaagauaaugagagcggugauucuuauugucaccauguggcuucuccuguauggucuuugcuucccuugugucucuaaagaacaaagguaugagcccaucuugcugaaggcuuagcuaccucuucacaugagccugcagccaguaggagcucuacagaauucaagggagacacacugucagcacuggcacacaaucauuguaauagacacucuuagcuacaugaauaggcugcaaaugaauaagauaaauuacagcacaaugcaaagauauauuaauaaaauaugggugcaacaauaagauguaaauuagagcuucuguaaaaucagagcucuaaauguaauccuggucuauaugcuuacuguacccugacccaguugguaagaaaauccuuuuuuaguaucuauaauaaugcaacauucagucuacagagcaaacuaaggccaguuuucuccacugaaucccccauggcacuauacuucagaggcuauucagcuagcauaggcuuugggccuuaauccuacuaucuuaucuaaaauuauuuuguaucuguggaaaggagauggauugucaagaaacagaaagucaccucccacugccauccacuccuuucgcccccuggucuccagccaccucauguccuucucauagauuauccuaaacuuacccucacuuugcccuuuggaauuucucuuuccaaagaucuucuaggcaugguggaacaugcaugccaguaaccccggcacuugggaaauagaggcagggagagcacagaaucaaggccggccugauccagauaucaaauuuaaggaaccagucucuacugcaugaguauugucucaaugaaugaaugaauguguguguguauguguaggggggguggggagagggaagaaagagggagagggucgagggugggagagauagcuuagugguuaagagcacuaacugcucuuacagagguccugaauucaauucccagcaaccauuuguuggcuugcaaccaucucuagugagacgcuauucucuuaaguguggacuuuuacuuuuuguuuuaaagcuuacacgaugauaacugcaugcuucucuaugugguuuguauaauugaagaugggaaggcugaaaaguuaaguaacacagaacuuuuaggucaaaagaacugaauuuggggccauccauguuucccuguguugacuuuugucucuaaaauuaguugacucacuaguuaacaacucuguucuaguuagauaugacaguaaacaaaauggauuuugacucugucuucaaggaauuuucauugcaauggagacacauauguaaggguugcuuuuauuuccucugaugauggaaugagaugagagccguaccaaagcuguaugaauacacagcuugggcugagccuagagcauuucuuucucuguucuaacuaucccuaggccuaggcuuggaagauucuagccuccauacaaucugaucuuucaagcugacugauucaaacuggcuucucucagcuucucacuguuuggccucagaauaacucuggcaaugguucuaaaucuucuggcuucuuauucucuggcuucaacggccucugcugaccuguacugaaaugcaugaaaaugaccccaaauccacugcacugacucccaacuaacagccucucucagacugaacuucucuuaaauaacuucucuuccuguacuguaugaacugucucgugagaguugaucauauccuaucucugacuaugcugucaaauauuucucuaaccaucacuuugucuguaccucaauuagaggucacuuucauacauggcugcuuccuucuacaaacuaauauaccuuagugguuuguacuaauggugugucuguauuccagccagagggauuaaaggugugugcugugucugcauuccagccaggucacacagaccuuugguugugaucgcuugucagugcagccguauugcuggauuaaaauuccucuacauaaauauuuauugagcacucuguaacuacauggcuacacauucucagugcuacaaagagagggcuuagaagauuaggagguacuugaagcaagggacaguuacucuugccugggaaggccauaugaggcuuucucaaggaaauaauauugagaugaaaaaugaaauacuccuguuugguuugguuugguuugguuugguuugguuugguuuggcuuggcuugguuugguuugccuacaugauagaaaacagaguuuauuuacagccagaauuuaugcaauuuucacauguuuauauaaguauuuuaagugugcccauaagcucucuggcaguggugagguuuuacuugugggcaugauagacaaguuacaccugucgcacaccuguuacaccugguaaaugaaaauuucaaaaaccauaaaguacucugacagggcaaauugagaaaaaaaaaaaccuuuuaaaaauaguguggcuauuuagaaucuguucagaagucugugguguguaugucuuacaucguaaauacauaguuuaguaacacucacugaacauguacaggucagguugcuucauaaaaugauucuccaugauaagcauuuuauauuguauauuuaaaauuaauuauauuguaauuauucuuaucaugacuaugcccacguauuacuaguuuuaaaccuucucaguagccaacauuugaaaaggaaaaaacaaaauggugaccgaggcacggcaccacacaccuagagugugggcauuucaagcacgaggcaaaggauugugaguuugaggguagccuguauuauaguaauaaaauccugauucaaaaucuaagaguaaaaacaaaaugauccucuaauuguuuaguucuaaacacaaauauggaaaauaaccuaccuaauaauaccaucuggggaaaauauuuuuccagauucauugaaguuaauauauauucaggaugaaaaggagggguuaaaaaauaccuaaaaaccaacgagaaagaguuaagaauucaucagaaagucuuuagaguaaguguggguagaggguucccuuucagagaagccaagcacagagcaugggaaccuaacaucagccaagggcagucaaugucaaugagcaggacccugcggcaguggguguacacuggagcucugccugagggacagccgacuuacuuuaaagcauguuguaaaagcaggauuuguauuacaaguugacguugagguuugguuuuuuuuuguggggggggcgcuuggguuuuuuuuuuuuuuuaaagauuuauuucuuuauuauauguaaguacacuguagcugucuucagacacuccagaagagacagucagaucuuguuacggaugguugugagcuacuaugugguugcugggauuugaauucaggaccuuuggaagagcaguuggugcucuuaaccacugagccaucucuccagccuacaaguugagguuuuuacagggaguaaaaacuauuuguauagcaguaacuuaaagauguauggaguacuugucaaaagcuaugcugucauuuguauagagcuuaccauaacuugcuaucauuuuaguugaaaucauauccugucacuuugcuaggguucugaguucacauuuauuauuaccccaaaccuugcaaaggauucauuggugucagcugucaccacuaaggucagccagagucaaagucacccaugagaaauagcaagugcuaacagcuaacuggacaaaauguuuccaucucagugaccacugcugguaauccacacuuggcuuuaucaucgugaaaaucgcuugcauauauuuuccaaauagggacuauguuauuaaccuuguauccauaccauacauaauaccccaaacaugccacccagacacaaaugcaugugcauccucucugauagccuguauaccagaucccuacuagguaacauuguauccuuuuguucuagggcuuccuucuuggguuuucauggaugucucuuggucauccuccuacccugucuuuccauuuuucuaagauauuuagaaugugcaaacuaaaugcaguauuaacuuaagaaauuugcaauuagaaacugaauuagaaaacaacaaauuauaccuuucagcuccuuccugcccugcucuaccacacacacuccaguccuaaaugauguuuuuuuuuuuuuuccagaaccuguaguuugauuucagcucuguuugcuuuucuguauuaguucagacgaccuagaaguaaacaaugagucugccacccuggaggacuugugaagaagccuucuugugucccuccauccacucgauuccuaggguuggcaguuugaaacccuuccaguguuuccuaccuuucuccagcuucuuucucuucuuuucucuuugcauaugagaaaauugccugcuuauuacagcacaagagaaagacuugauuuugauuguauuaugaguccaaacccuccccucaggaucccugcccucagcccacuuccuguguuucuucuccuuuccugcuggcucguaccuacaaccucucuguccccuccucuaugggaguagagaguauccaacaauaaguacugaaaaauagucauucaggguuaaacaaagugaugagaggacagucugccaacuuacagaacugcucauugguucucaugggucauauauaagauguauuuacucaauaaaguucccaggucaagugggccuucuucuagaauauuucagagacccucuccaagguguuagguucuuguuuaaauguuuaagccugaauugcucaagugaggaaaaaagcaaaacuagaaauucaagauugcuuaaaacacuugaacaacugaaauagucacuaaggaccugagugacuccucagcacauaguccucuucagcagugccugucacuggauccuuuagagauuuugacugguggcuucuuggacacacccacaaggcaaagacauagccacagauuaugcaucacagcgccaccuacugacguguguaccauacuccaugauccugagccuaccuaccccaagugacccuaaggagugucuauuguauuguauguaguccuuuguuguuaugaaggcgaugguaaacuccauuguucaaagugggaaaggucuuugugucguuuauuucuucuguuuugugacaggaacuugcuuuguaauucauguuagccugcaguucauugcaauccuccugccucagcccucucagugcugauauuacaggugugugucugauuuaaaguaggaaaguuauuuucuuaaggaaacuacauuaugucauuguuuuacuaaaauacagcaauaaaagugucaggaaagauguucucaacaagaauaugggccaugacugaaaauaguguaagcucuauaaaucuaacucauauuuaucuugaagagaacauguuuccaacacccucaaucucguugucucugcagguaaucacugcugguguaguaguuugaauaaaaaugguccccuuaggcucuuagggagaggcauuauuugaguggauuaggauauguggcuuuguuggaguggauguggucuugggguggguguggccuuguuggaggaagugugucacugaggcguugagguuucagaagcucaaaccaggcccagugucacucucucuuccucucagcugugaauccaaauguagaacucucagcuucuuguccagcaccuugucugccuacaagccaccauauuuccuggcgugaugauaauggacuaaacuucugaacuguaagccaaccccaauuaaauguuuuccuuuaugagaguugccaugguuguggucucucuucacagcaauaaagcccuaaccucagacagcugguuauaaucaaucuacacuccuucucuccuguaauaaauuaaggcuguucuuugcuauuagauauuauguaugagcucagugggaacuaaucaguucaagagcaggcuugcuuucucuucuguacauaguuuuuuauuugcauaaagcguguucuuccagccucaaccuaacauuugcaggaccaggggcaucauaugucuaaguauuucagacauuuugaaccaacuguaaguaaaaucugcuccauccaucuacuuuuaacagauuagcuugauaacuaaggacauauggcuuauauuuaacgucccaucucuuccaauguccaugccaggaaauagagacacagaugcagccagccucugcccuuacauaccugucuuccauuucacucuucccaucuuaucaugugugaaccccucaggcuaacguucaggauuuuucugcaccucgcaaaugaguuagcuacacacuucacccccaugucugaagagguuugcauagaccugagaaggaacucagggccauggggcagggaauucugagauuccagaaaacagcaguauuguagaaagguagacuguaggagggaaccaagcuccaaagggcacccuccaccugaguccugggggaaauaccacagggaaaggcaaagcaguacucucaagugggcucccugcuguggcuuuggccuggugacaauggucaauauuccuacauuugaaacuguuuccuuuccaaagcagcuguggccugaauugccuugcacuccacuaagcacaugcucucuagugacugguuuuuagagauuugaaacauugugaagauaugugugcuacuauauccccaggggagaaagagcaugaaugguuagaguuguauguuaaguaugcugcagcguguggggauauauaggcagauugccaccgccccaggccagccucaaagagcauuagcaaugaaaacugccaugguauggaggaaagugacauaaaucuuugucuuuuugucaguuucagugacaacucugagagaauauauagaaaggcacauguauaggagaaaccauccaaagaacccaguacuguuccaauaaacaugaguauuuccugcagaauaaagugggaaauuacuguaagucugcaacuccccugucucaguugagaaacccuguaccaaugcuaacugcaaaacgguucucauuugguagauauuuaagaaaaauaaugcucagaacaccuuaaaauucaaaguuuaaagccuauuucuccucaaucaaaaucaucugagauaguugccacugccugaccuuagccuuaguuaacaaaacauaaagcacugccgagcugcccgugacuuacaaacucuagaguguucaaaauucaagccaguaacagaguguuaaaauuaagacuaugacuggcuccgcaaguucuaaaucugcucgugaacaguuucccuacgucugugugggaagcuuuaaagggccauauuucuucccucacuucucagaguggaagaagaagcaauuggccaaacucaccugagccacccaccguuucuaguuguucugccuucucugaaaacacugcaugugugugccguguccaugugcaggcccggccuucucaggguguuuguguccaucguaaaauuauuaaucaauguaaaaccauuaguuccagccccaguccugcauagaguguacaggucagcaacuucaagccaaagccuagcaggcuaggucggauuccuacagccucuucaacugagagguauucaucuugaaaucauccucuaaagauuacagaacaaaauguuaggguucuacccacaguguugggaaacugagugugaagacaaucugguuuugucucuguucuaugccauuugauaaauguacauauuuaauugcgaugauaacccugucuaauucagagaagucaggcucuugaugaguguaacuggcuuauaauggcagaauugugauuuaaauacagccacgauggucuauagcuuguguuuccuuguccugcuccacuuaccacuuaaauuuaaacugcauaguuaaaacguuacauuuauucuugcuugagucuuaguucugucaucaucaaaauaaaccuaaagacuauuucuagaacuauugugaggguuaaguuaggggaacugaaggugaagucauacaauaagagcaggauacagccuuguccuccaggcucuuucccaagucccaagccacaucaccauugcagcaacaaagaaagaccuugggaaguucacuuguguuagcaccaugcugugauguugugaggucuacaguguuagagcuccccagaggcccaguugcuagcaguaugguguagacagaguagauagagaagcagacugacacauaguaaguacuugaucuuaguuccauucuauucccuuugcauaaguucauaaauauugaaauucugugcauugcucaagauuguauuagauugccuuuuauuaagauuuagauuuuuuaauugauuguguacuuauuaucucaagcaauaauuuguauaauuagaccaucacuuuuugggucaacaagagugaacucgggcacuaaaauaaacagaaaaaauaacaacacauaaugcaagcauuaauaauauuguauugugacaggaaaauagcccacgguuuuugaauacugaaucaaauaauccauagaauuacaaagaaucuagcagcauucuuugguauauagccaaagugauaaucagagacaaauuaauucagugauuugaaaaacacaaccaacaaaauagaauggagaaauaagacaauuagaaagaaaaugccagaguuggggaagggcauugauauaauuaagucuagauagucauagccaggcuugaauucaaaguuaacuaagaggaaugauugaaaugcuuucuaagugcauauaaaauggcagcaguaaggggagagagucuguauggacuuuauguaaacuaaaugccauuggacugcacaucugugaucuuagcacucuggaauguggaggcagggaauaggauguucuaggccaaccucagauaaacagagaguucagggcuaagcugggcuacaugagcuccuuucucaagaugaacaaaaggacaagugagcaaauagaaaccauguuaagagaaacguguaguucuacgagugcauuggugcaugccuuuaauccuagaagucaggaggcagaggcagguggacucugaguaagaggccagccuacucuaaauaguaaguuccaggacagccaggccuauauagagagaagacccugucucaaccaccaaacccagacacuauugcacaugccagcaagauuuugccgacaggacccugauauagcugacucuugugaggcuaugccagugccuggcaaauacagaaguggaugcucaaagucagcuauuggauggaacacagggcccccaaugaaggagcuagagaaugugcccaaggagcugaaagggucugcaacccuauagguggaacaacaauaugaacuaaccaguacccccaccaccaccucccagagcuugugucucuacuugcauauguagcugaggauggccuaauuggccaucauugggaggagaggcccuuggucuugcaaagauuauaugccccaauacaggggaauaccagggccaggaagugggagugaguggguuggaaagcaggguggggggaggguauaagggacuuuugggauagcauuugaauuguaaaugaagaaaauauuaauaaaaauuuguuaaaaaauaaaauaaaaacaaaacuaaauuagauccagaguaacaacaacaaaaugagagagaaagagagagagagagaaugaaugagaauuaauuaauuuuauaauuaaugugcauuuuggugccuauuagaacuuaaggaucuuggucagcaguaacuagcaaaauacauacaucuauguauacauccacaugucuucccacauagguguaugugaaguuguaacuccugccagcaccagccuacacuauaaggccagcauccccuucguccugagucuguagacuaccccugcaguaacugacucuuguagaggaguaggcuucugcaguugaguuuuuaaucacucuaugucuuaucagcugcuggugaucaggguugguaggaaugcucacgagggugugguaacauuuauuguggauucugccauauauauggccuguaguccuuucacaugccagcaacuuggcaucugacugugucuguuauacaguguagaccucguacagucaugggggggggggaguaaggaggguugcuaacaaaccaggcuauccuaucccuuauaauauggcuuuaauguuagaguugcucucuaggccuucauugagauggaagaguuuaaggguguucuggucuuccagcccauacaucuuaacauucucaauuuuagcuucuacuucguucuccagacugacuuccuaucaucacccugagaguuuucacuucugugauccuaauaaacuucuuaggcacaugaaaccucugcacccuggcaagaacuacuucucaacugcuuggucuccaucaggcucgucccuggccucuuggagaccuacugaagagguguccugcccauguggagcuucccccucacuucagagccauuggugcuaucaccgugaacuuacagucccucagggggccacaggcuauagcaauuauauauccucuugggcuucuggaccucuuaggggaauccaguauugugcucucugguuaggguuuacaggaaguaguuucucagaaaagaagucuuuuuccucaaaaacaacagagcaagucugcaugucauccauaccaugccuucucuguaacgcagucugcuucucacuuuacaauauuuccuguacaucuggcugacagaauuuuaauucccauguauugaaugccauacauuuucuacaaaaguguuuuuaaaucccuuaauuuauauauuuauauuccuuacuaaaagguucuauauccaucucacuuucccacucccaaaaucuguuucuccuucauaacauuaagaugggcaugccugaccuaaugugauaccacauauuugcugugauguuaggccaaucaaaucccuggcuuccauagcuagagaauaaaacgugguuucucugucuugacacagaggugguuugguuugguuugugaggcugaaaugagggagucagugcauauguuugauaagcacguguuuauuccucacugaguauguugagcacuucauggagauuuggagugcauugaugacaaaguccucacgcaggcucaccuguauuauaguuagaaaacacacauuaaaugaaugaaugaagucagcacugcagguuccugcagacagccaugagaggcacaugauggagcaguuacugggagcccuggggaugagguacuuuuggugggugucagggagagacuucuugaaguguauggagaaagaacccaugaggcaagaccuuccuggaaaaaaagcacaccauaugcugaaccagcaauaaauacagucuguacaugccacauagacgagcaguggcuccucucugcuccaguccucucugcaauaggaaacuucuggaacuaggccuuuccagaacccugagcuuucuuguguguccccuaguuaguuuccauccacaccugcauugcuucuuucucuuauguggcuucuuuauuggccgaauagagguccuugucaucugccugcuuuccaugccucugugcucuuugagccccaccucccauguucuuucuacugcuucuuugaucuuaagccuguacaguugauuuccguuuucucuucagccccaugcuucaaaccuuccuuggagucccuuuggcggccucccuucccugcuagccuacccauccuucauagaagaagccacuucuuacaguuacuuccgugagaaugaggaauugcccagagcauccgacuggcauugccuggauaagugcucacuaaauguuuauccagaaaaggggacagaugaacugacucugacucuuucccagcucaacuggauagggucgaaggucauucccccugcaauuuaccuguacauagacaucuauaguccucacaugucaaugcauagaaaauaucucuccaugggcuuuuaaaacaucuccucuucuauauuggauucuuucauuucacauguacuguccucauuugcuguguguguagaacuucaucauuaaucccagagauaguguuuggcagggccucugcugcucugugcguuauucagcacaggaaucaugaaaaacuugugugugugugugcuugcaugcguuuuauuuccagcauuauaaauaaccaaccacuuucaaguuaaacauaaacuuucucagguaaaccuuuguuuuugguaacagucaacuuugaacuuuuuuucauuaacaagugcaauauaauuugaaccaccuuauuccaaaaguuaauaguauuucaaaauuuggugguucugagugccccuauaacacuacaagccaaccacccugacuucaugugaugucaaaauuuggguacauuaaaaauauuauuuaagauugccaucaggcuagcuauauaaauuguauagguccaaccuguaauauauauaugcacguauuuuaauauuggagucucugaaaucugaaacccuuguguccccaagcauucagacaagggaugcacagccuguccugaccuuuuuucauaagcagugaugugcuuagagcuauaacuguccauuuguuucaagaacuagauucuaagaauuauuaaaugaaaauccaaaugugccgccagucagagauaacauacugacucucagcuuugaacguucucuguuuauaguccuacauguuuaacuaagauccaaggugaaguaaaucucugugacuauuuguugcuuguuuuauauucugugauugaaaacucauauaugacuuauauugugcucuuuauuuaaauggacaucagguucuggcccaugugcucaggauccucuucagaacagcagugcaguagcugggauuguguugcccagaaaccuguaacugugaagcagugggaggccagcuccagccagugcaggaggcuccagccagugcaggaggcuccagccagugcaggaggcuccagccagugcaggaggcuccagccagugcacuugaccuggaggccucuucccuuagaagcacucaccuaggaaagcggugcauuuauuccaggaaagcugcuuaccagcggccuagccacggaguggggugccucuccuuacucuucuucugcagcucuaagaagcacagggaguaacuauccagaacuguggcaacggugaauuugauuugaacauggaacucuuuauaagcaaguaagaaaguccacguccaaguauaguaaauaaaaauaccaacucauaauuggaagugagauggucauaggaacuuucuggaaugaugccuaagcuuccucugaagugacugucagugaggaauauuccagaacccagaccuucaaauaaauguauaugcucccaagguagccacuguggaacauaauguuuguuuagguggaaaaagaaacaaugugugcguguuugcaaaauaagaucaguuuuauuacuuuauagacauaccuuguagaugaaauauauacuccuauuauggaacucuuuauaagcaaacuucugaauguaaguagaauuucugucucauccuuuuuaagucuguugagaaaucugaauuucuaauaacuacuuugaaaaaaauaccguugacucuuuucuaaaagcagaggcuuugcgucgcacuucgcuucuuuuggauuaacuuuguaccuccgcuagucaguuuuuuauuuaguguaucuaucuuuguucccccagagagacucaaaauguacuuucuugcuguuaaauuaucaucaagcuauugaaccaaaguagaaaggaacaccaaugcccauggcuauuaauuguuccacgauguugagaacucuuucacauuguuuuuagcaagugccuuuccuuuugugaaaguggggcccugguaucuuaguaaaccaaaguaucaauuuagagaagggucagcuuuuguaaaugugagcucccaccagauuugucacucucacggaugagagagccccaccacuccuagaccaugcuccagcaauggugaaggggccagcuggcucaccggcuggaccgagcauggggagaggaccuuacuuacguaggcugcuuggcuggggcuuuuccacauuuauuucaccacauccaucauccugggcagucaguccugauucuucauugcugaauugaaauuaaaguaaaacggagccuggaagccaaagaacauugugagccuuucucaaagagaugaagacagcucaauugcgacauauuuuaaacgucagauuugacacauuugauuggaaaauugugugaccuguguaguuagggaucaaaauggucaccgguucacacuuuuaaaaagucauggaaugauguuuuuaccacagacugauagaauacuauuuuauucugucaaguaguaacuauuacacaaaugucuauuauuuugcaguuuggcgauuuaaaugcuguaucucccggaaaucuggauaaagguaagaacugaaaauucugaagggcuuuuugacugagcuccugugagaggagacagcauaacugugcagcgcucugauccucugggcguagcaaacagaccccgugugagaccaguggcugucuguggaguccguccugacgcugcuguuccuucccuccguccucaagucuuccacugaacuguauugaaugcagaaggcuggauuuaagugcagucccagacuucuuucaacuucuugacagaagcucaauauaaauaacaaauuauugaccauggccaaaauccuggagugaaauuuuaaaauucgacaagagguuuuagucaagacaagaaaaaggccccuuaccuuacccuguagucagcuaacuuuacaguggagaaagaacucagagguaguagugguguucacggcuaaaagcaggaucagcaguaguuugguggaaaaggauacauggauucuaaccagagccucuggagaaacaggccaaggaagggcuugggagucugugaggagacugucauuauugugcuuggcuuaauuuccuucuaguauccgaacaggaaaauuagaaaguuagacuccccccauauguuauuguuucaaagguacaaccuguauaauugcaauaauaacccucagaaaaaucaaugggucgcucauuguagcuuuuguacagcagauuccauaaacucuagugggauccaggacuggaagcacaaaugucuguaggcuugcacucgcuguccugagagacaggacuggaagcacaaaugucuguaggcuugcacucgcuguccugagagacuggaauggaagcacaaaugucuguaggcuugcacucgcuguccugagagacuggaauggaagcacaaaugucuguaggcuugcacucgcuguccugagagacuggaauggaagcacaaaugucuguaggcuugcacucgcuguccugagagacuggaauggaagcacaaaugucuguaggcuugcacucgcuguccugagagacuggagaaagugcuugccuuacagguugcuuuguugucuaccugaagaaucgcugucacucagacaccacacccgagucaggcagaccuggaacucuugucauuguucugaguguuuucucagggcuguuuccaaaugcccugccauuccauuccauucuucccaugccugcccugcucaccacuucucccuacaugcuuuugaugguguuucuguuuggaaagcagaggccagaacaugucaucugccaucaccuuucugauggggcucagcugguucuguuuaccccuaauccucgggcuucccaaggcuacaagugaaaugugaaguuuugugugcuuuuuaaaauuugguaguaaaaguaaauguauuauauguuuaauuucuaggaaugaauugcaauuacuuaugguauuaauccugccaagaaacaaguccuuugugccauuuuuaaaucucacauuaccacuucauuauagcuuuuuucuuagcauaugaauuaagaauuuauucaauuugguguuugcuaucuguacagcaauuguuauacaauagugauaucacaagucauacugcaguaguuccucugggauggcacaggcccagcugcaguaagucaucgaggaaagaacguagucgguguagauuugugugugugcccccacccccaagugacuccuuuaugaugcaacaaauuaugccauuauuuaauacagaaauuauauauaaauuuccagacaucuaaaagaauuguggauuucucacuauggcacugauggauauaaauucccaugagaggaaagccuaugaguccucccguagggagcacggaggucucagagcgagcuggcgcacugagccgguacggcagcgugcacugacgucuguuucucuuuugucuccugcuggucucugucugugcagaugaaggcagcgaagucgaaagugagacggaugaagaucuggaugauucuucagagccucgggccaaaagggagaaaacggagcugagccaggcguucccaguaggcugcaugcagccuguucuggagagugcugugcagcccagccuccugaacccccuacacagcgagcacaucgucacaaguacacagaccaucaggcagugcagcgccacaggcaacaccuacacugcagucuaacagcaggaaagcagaguuuuccagcuuacucuaaccccauugauacugggcuuaagcugaaauuuuaacaagccugaagguugacuguugucaaaagucuaucugugcugaacauuaccuuuuuggaguugugaaauggaauggguguauguauuuuuccaggucuuuuuuuuuuuaacacaaauuauuugccuuuuaauaauagagccccuccccccuuaguuucaggugucaagaaggauuuauacaacacuuaaugucauuguuuuuguuuucucauaauuaaaaaguaauuuacauuuuguagcuuaaaauauuuuauuguugauuguuagucuugguguaugauuuuauguguaaguuuuuuaauuagaugcacuucugugaaauaucaaaagaaaugaauuucuuugauuuacacuggaggcaugcccauuuggcagcagaugcaucaaauuugcuucugaaaggugcuuuucauuggacagaaccauaagacacuauuuugauaacauuuuggaguauggagagaauacagagcguuuuuauuauagugguagaggguugggaaggucaucuauuuuucucugaaaaaaauugagcugugcauuuaucaguucaggauaaaugacagaauugcaagagauuaugcuaauauguacauaauuuguguacauaauuauuaaaccacguuaacaaugcaagcuuccguuagacauugacuuuuaacuauuauuuguguaccaauuccucuguuuaaagacuacugauucuguauuggaaccacuguacagaugcauucugcuguuaaguggggcuguuauaguuagauacugcagcugaaaaaaugacuugacuuuuuuuuuaaguguacaugcuacuuauacugagcuggacauacaggaaaccauuccauuuggaugacuuucuuuuauuccaggucuuuuuucuaauaguaguucaauaugcugcuauuauaaaagaaaauguauagaaugcaaggaauguagcgaccugcauauuguuauuuccugguuucuaaaauacauggauuuaaauuuuacacagaaccugaaggcagugugacuggcacaccucacuguugcugaccccgacucuguaggauuuggauagguggcuggauggaccauugccauuggagaacguacaucagggaucaucguaccucggcuauuacauggugccuuaaaacagaacugagcuaagguuuaguaagguuuauuuuguuugugugaauaacucuucaauccauucgguaacgugugccugucaugcucagauuccugaaguaaagacaggucacauguucuucaaggggaauuuaggggaaauuaagcaaaacaaagagacaaaaacuucaguuucucucugagggacugugaguggacuugucuagguuuuauccuuggagcugaauaucacuuuauaacaaaucagauugcuaaggguguggacuagcaguuuucauccaaacauguuacauaaagaucauguguuguagaccauucuuauuuagcuauaauucuagaaaguuaacaggauuagcagguacuuauugaagugcaucuuuucagucuaaaugucugucugugugucugggugucucuguguacacacaaacacacacauacauacacacacacacacacacacacacacacacacacacguggaacuggagucugcuacagucagaaggugagauccuaaagagcacagcucaucccauuuuacuuugcaugaaaagccaagguucuuuuaacucaagcugucaacagcagcaacaacauggggcauagccuuucauuuaaguaauuauaaaauuaaaucagugcaagucaauaaggaauuaagucaauaaagccaaaaaauggaaaggaaagcacaaaaugacacacagaucacuacugaggccauguuaagcugaagacuucaucuuuccaguuggauugggugagggguauaguuaaggagaagagacugugccaaucuggaaaguuaaaaauagcaaauggcuuaucaggaaacacagucuauugaaacuguuauugccugauugucucaaacuucugaaaaucaacagcauuucuuaagugaaauuuaaaugucuuacauauaauuuuaauggauucagauuuuguauggaucaaccuacucacacacaagacuucacuggcauccaagcauuacuucauuacugaagaucccaaggcaaugaauuugcaagccccuccccuccaucauccaucauaagcuacaaaagaccauggaccuacuucauugugaguuagaaaauguuuacacauaaaauucaaaucauaaacuagcucucuucaucuugccucucccuccugaggucuuucagucuccugucccuccuugucaccccagacgacaucaugucuguauuggaccaaauguauuuacugguuucacuguguuuauugguugacuuuuuaaaauguauuuguaucauuguuucauuuaauuuaauuuuggagauauuuguaucaugagaggaaucagcuaacaauugacagacauagauucaugagagggagggacugaauggcccuccagaauucaacauuucuuccaguuguucaugguuuguuccaaauuaggacagaguagaaauuaacaaguauuguuaugguugaaauugacuccaaaauauucugaacuuuuagaaauauuuaggaacauuaauccuuuuacaccaguguagauagcucuaaccaauacacaaaaaagaauacccauggcuuaugauacuucuagcuauuuguaguauauugugcacacaucaauuuuggauuugaauugugaacuauauuagaaaacaaaaacaguaauuuaugugcaggcaaaauuuauaacaaucacauuugucuuaguuauuuaacauuuuguuucuguuuuuccauuuauugaaacuggcuuuucuaaauaauaucagccaccaacagucucguaguagacguguugacacaacacacuuuuuaaggacuugcugguauuucuuggcauuauaauaaugccugucuugaaauacauguaugugaaucaaguacuacacuccugguacagagaagggaagggaggugcaugagcuaucagugcguuucagaggagauucccauguaauacacuugagucucauagguauaguuuuauaucggcaaauacuuugagaauuauagccaaaagagcuacacuuccaaaaccagugaacaauggaugaaaugggugaaacuucuccugggaacacagggcccaguuuuauauuuccccuuuggauuuaccaaguuacuaagaacuucgggacuugcguccaaaucuugacuguaugacucuuacugccuuuuuugaaaucugcguuccuuuuugugacuuuuuuccuuguacuguauagcacgguucaugcaccucucuuuagaugguguacuuuaaaaacagaaguaaaauacacaaaugguuuucucgcugcauaccuaaaguuaguagugugcaacauuagcugccuuuaauuuguaguaggugagcgagaaugagcacauucuugcagaaugcuguagacgucagucaggagugagcacagcucccaugcugugguccugggccuuuuuacauggacacacucucuacaagugcuaaaugcauuuucaguuuggaaagauuauuaucacauuauuaucauuaauauuauuauuuaaaaugucuaagauaaugcugugcuugaaacaucugugugaaagaaaacacgugugucgcugugaugguccucguugcauggacauaguagaaagucaaaagcuugacguguuacgcuugcacacgaguuaaggcagugguuauagacaacauacugacuuugucauaaccuccccuccucaaguucuuuugaacaaaucacgaucauccagaaacuaaaaucaggacuuuucugaucuccguggaucacagcagaguuugggggaggaagguugucaaugcaguguuguucaacaucgggcugugacuggaucagagcaacaaccuccauguacaugguagaacaaacucauuaacagaacccuaguauuucugugagucuggugauuuuaaaagacugggacugaagcauugauucagcgcuuaguucuaguauuagaaaagcccuuugcuguaaugccuuguauuaacccuuugagcauuguaagauauacaaugggggaugaaagccuuucagaucauuuauuuagacuuaaaaaaguaaaauagccucuauauccaaaugucuaauuacacuguuuuuuaaagggggggucggaaaagaaagugucuccaugccgaacacuugcauuuuauauacaacucuuaauuuuccuucaagagggcuggauagauuuauucccaaauauucacugccaucuaaguaaguguacuguuuacagaagauaaaaucaacuuuucuagcaucacaugacucucuagaaaaggaggacgcauacaugggccuaugcuggccuauguaguaacugauuucugcacacuggagguaccuguuugccuuuaaaagguaugauaaaauaaaggguuauguuuugucuuuuuucccaaaacaaaagaucucauuuauuuagcuuuagaaaguacaaaugaagccuuagaaggagugaguuccacuacacacagcuggacucugagguacuuaggcucuuuggaguugcaucuaucaugaaauauuguuuggaaaucaugcggggcauaauuuuaucuaugcuccagaacauuaauacuuugucauaagauauagagaggcagaguggcgagcaagacacucacuugcucuaagcucuucugccaggagaugcugugacuacugcuucagcuaucucugaaugucauucugcuuacaacauuugcugauuucuuugagggaauuucuggacaguugaucugguccuccccuaugugacagaacacggagcaguguugugcucagauacguccacacugcccucgcugagcacagacaggagcaugaccuacuccgcggcgucugccaacauccauagcauagugcaaguguccguacguugcuuucuaggcaguugaggaagucagaccaugcaaauuacucauguguuaacaugcaaauuacucauguguugacaugcaauacucaaaggguuuuacuuuagcucucuccuuuugacucuucacgaugaguuacuguaaaugcuucucaguuugcaugccuugcccauugcugcuagugauuuuaugugccaguagaccugaguuuaguuuaccaauuuuacuuaaauaguaaaagccacuuacaaagugacugccuaggguugauucuccuuuuguuuaaagggauuggugauacgucgucguucuaaaagaaauguuuggucucuucuauuugguucugauguuugaaucuuuucccccucuuuccuuuguucuuuuuauuuuuucuuucuuuccuucucucuuucuuucuuucuuucuuucuuuccuucuuucuuucuuucuuucuuucuuucuuucuuucuaaauaaaguaugauguugggauuggaagcccugaguaaugaaauauuugguaaggaucauuucauguagcucaauaaucaugacagcaaaccucugugagaagguugauucuggggaggaaagcaaaacuacaaaaacucugauugacuuuugaugaccaaguaaauuuuccuugaauaaauuagcauuucugaacaaaugguugccuugcuuuauccuacauacacaauuuuauaggacccaaugaggaagguauuaaauuguauucguuugaaaagcaucuuuuguaccaaagcaaauucuuuucccugcucaucuccaucaucgauuuggaccuuugguggcgaccaaugagucgguuccagaaacuuaagugagugccuugagaacgcuugggaacugugccugaggugguaaacucuuaauuagguuaacuguagcgcuuaccaaucaguaacuacacuaucacucagggcuuucguaccuucuagguaaaacuccuuucauugugguuuuuuuuuuuuuuuaauacuguauuuuuuuuuaagugccaucauuuaaaauucacuuaguaaguggcagauuacauuauucagucccacaagcacacaaacauaguaacacuaggagauauuugagcauuuauuuuacaaucgacugaauauauaauguaaaugagguaaguaacuuuuguagagauuguaugugugagauaauguaauguucuuuuccaguuuuuggacuacaguugaauaaacuuuuuaauuauuuaaaaacaucuuugccgaauaacaugugauggguuuuuuguauaauguauuugauuuuguaaauacguauuuccugaugugauuuuugugagaaacgcuaaaucuuuuaguauaccauguccucugaagauuggcaggagcuaaauacuaguuugugggcgauuuguauuguguacuguacaauaacuggggaacuuuuauaauuauaaaaauauauauuaacuuuuaguguguuguuuaaacaaaugacuggaacauacuaaagauauuaguaggauuuuuucugaauauuucagacuugaacucaggcuagcuuucuuguguuuuucaaaacaaaaaauggugucuugucuuuuaaaaaucaauaaauuuguuuccuuguuacaaacauuuga

SEQ ID NO: 9228 - RNA, 458 nt, Mus musculus
augcuccagugagagaggagacgggggaagagggagaaagaggagaagggaggaggggaggaaagguuagaaauugagagagauagaauuuggaggucucuggcuggcuggcuggcuggcuagaaacugaugugacuugagaacuugguucugcugggagucaggcuguaaaaggcaguguugauguugcuuaggcacuugggcucuuuggaugcuauuagguucacuuaagcccaguucuuaaagagcugagauguuagagcuccccugggcuugcuuucuuuuucacuuuagauugucucguggcuguauauugucucucugaucuaucauagcaguguguacaaguacuuagucauggcacaggcaggcaaaagaacugaaucaccucuaagauuauguucucguuugccaggcuagccuuccugguuggugaguuuucccacuugggaaagcgg

SEQ ID NO: 9229 - RNA, 4003 nt, Mus musculus
gcaucugcugucaccugauuuuuuuuccacaguccacaaaggcuuuuuauuuaugcuuuacauuuaaaaaaagaaucccaggauuuucccuccuguauguuuucgucuugccucuucauggucuaugaugccagccaagguugucagcacaaugaagccaaacugccguaaagggagcagauuguucugccauuuaucuaggucuuugaguugaacaucaaaucuaaggcuuauaacuccacacuuguucaaccuuccugugagguucacaacgaucuucccaucucugugaucaucaaugaucucgaauucaccaguguacccgugcuucaucaucacgguuaaaaaccaaacgaugacuuuagaacacggccugaugaggaccuggcguuugccucucuucucagcguuguugaugcucuugagagcaucugccagaacauucauucgcaccaugguggcggcgagggaagauggcagaaagagagugggcugggcccugaguuuuugaucuuagccauucugacuggugugagguagaaucucaggguuguuuugauuugcauuucacugauaaucuuuuucaaacaaugaccucaugagagggagauaauuaugaccaaguaggccagaggggcaagccauggcauugggaaguuuugcucacccugugccuuugugccaugagucccaggaagcaauacucucguagggagaucaaaauaaggaguugguccuaaaugaauauuuucaggugucauuauggcaaaaauuaauauucuuagcauggaaaaccaaucauggaaagauuugaaaacauuuuagaaaauuuaccacgauagcuguggucaaacccauguccuuggaccuguauauaguucuagcuaucuuccucugcagcuccaucccuagcucaaguccuuuugaguauaaacacucacucuggagacugagauauggaacccucuugcccuaucagaaugcuagcuuguaggaguucagugggucaaugauuugauuaggaaacauuucgagcuucaaguauggcaguuaccuuccaagaguuagcuuugucuucugauccccgaguuaacaaacacaguucugccucucuuccguucuaagagacaccuuguauugacacuccugugccauugaaggcuaaaacugcugaggcaaagaugaccagauucuaugccucaccagccaggcaaaaccacaagcuggauuguagacaucaguaguccagcaagcccucaaagccucccuuggcugguugccugugaacuugcuugcuguaugaucugcucugaugacaucucagucuucugaccucaggcacuuugcuuuaaaauaugagaggguggucuaggaguucacuggcggcaaagcccaucaagucuauugagcaucaggguuuccaagugucaaggcuagguuugccucuggacucagcccagcucagaaaugacuaaggcauuuccagaacugcugcugaacauuggccaaggucauucuguguuugguguagugccaacagaacuaaggacugcacucugguuccuugcccagaagugucucucggcugcuccaaagugaagacgaaaaggggccuuaagucugaggcagcuuguccaguaaagcacacaaggagauaguucucagcuguuccuccuagacuuucauguggcuugcagggagcuauguguucagaauccuaugugugcugcuuaaguugguuucucucauucuauucauuugcuuucauuucuuauaaucuccuaaguguuacuccagagacauccuuacuaaccaagaagacaauuuuuaaaaagaguaucauugcugggagguagugacacacaccuuuaaucccagcacuugggaggcagaggcaggcagaucuuuugugaguuccaggcuaaccugaucuacaaaggcaguuucaggacagccagggcuacacaguaagcuagccuugaaaaccaaccaaccaaccaacuaaacaagcaaacaaaacaaaacaaagcaaaacaaaacaaaacaaaacaaaauuauagcaagcucuaaggucagaagauaggcaaagguaugugaaacaacugagggaaacuccacaagcugucucaggccaccggccuaagcaaaggcaauuaauucacacucuuauaauagaacagccccccucgagcugugggaaggaggacucaacaccccguuagcaggcacaaggacccuauuguaauuguuucugagugagugaguggugagaccccuuucccuuuuccauuauugguccaugccucugcccaggucucacuuugugauggccuaguugcuuugccaccaugaucuaccugcuccaucucauugaaggcacggauuguccuagauccaggcagguacacgugcacccaucugcaauaaugugcuagucccagggcuucuucagacuucuugcuaugguaccaguaauaccucacagaccaggcagaaagaucucacaaacagauguacauggggaacuggaagcaaauuuauaaccuuugcagucuccggugagaugacucagaggguaaaguugcuugcugccaacccggacaaccugaguucaaaaacccucagaacacacguggcagaaggaaagaacugacucuugcaagucguccccugacugccacacucgcaaaauggcauggguguacacagcuucacauauguacacacagaaauaaauacaugcaauuaaggaaaaacacuuuuguuuucaagacaggguuucuuuguauagcuuuggcuguccuagaacuugcucuguagaccaagcuggccuuaaaggcaugcaugcacuaccauugcuaaguaauugcuuaaacauuugguccccucauuuauguccuuuaauaacuacagacauuggcucugagaaacuacuggccuggugucugguaccagcuacucuguuuccagcauagcuucuucaccaauaaugguguguguacauuggggaaagaccagugauaaccaaaacacuagccagggacaaaaaggcuacuuuccagggagaagagaacauaugagaauaguggauaugguuacauagggacacacauuuauuaaaacccauuaacuagccucuuuagcucuguacucaugugcaaauuaaacuuugguaauauuaagcaaaugcuuccgacauucaugagcugguauccauccaagucaacuguguuguuuauauggaaaagggggauuaugaugauacagaguucaacaagaugauucaguaaacacggucugcuuucuuucuuuuuuucauuucagcuucuauguuaugcccacugaguccagcaggcucugagugauuggugcacaauuuaagaggaguagagacugacuuuaugguauauaugugggagaugcagugucuucguauuguaccacagacauucccgccauacucugaagaacacaauugguuuuccacagggauccagacaggcaacaugauugagccacgggcugaggaugagaaguuguaucuggcacgagagauaacagcuuucacauggagaguggagaaaacguuuccuggacaaugagaaugacugacggauauuagaagggaggaaauugaaggccuugccaaguuucgugauaaaaugcaauuucucacgguaaggucaagcugucucuagugcagcuacugcuuuucaaguacaaaggaaacagcagauuggacagagugugguagagguuugcaaagaguuugugaucaaaggccccuuguuucguuuguaaaugaaauuggaugagcaugagaggacuggagcucaucaaggaugcguuuggaaucugccgaugagcuaaaaagcugagagccaucaggaagaaugucccuaaaggcuugaucccaaagccuguggacacaaagugaccgucaauguuugcaagauuacacauguccagggaaaguugaaugugacuuuucaaaggcagcauu

SEQ ID NO: 9230 - RNA, 700 nt, Mus musculus
cuuagauuuuuccauuuuauuuuuauuuuuauuuuuuuauaucuccaacagauuuauuuuuaaaggaaugaccuaagggagaaaaaauggggguacagaaguauggacuagaaaauaaauacaaauguaagcuguuuuacuaauuuuauaaccacagacuuguacagagaaugaggcccuguacacaacacaacagauucaaacgagguguucccuuagcaaggcugaagauucagucucugguauuuggaauuuggaugcaguccuuguuuuuggauggaucacuggguguuuggcacaguccaugcuuuuaaccagauuugaacagaagaauggccaccugacccagguagaaguagaugaagaguuugguuucgugugucacauaacuaccaaaguuucggcccacaaugcagugccagguagaguuguacuucuugucaaaccccuucuugauaugggccacaauaucguucucgauguuguacuucuccaacgccuggguagcgcacuccaccgaguucuguugcaucucuuccgacaugucugcauuuuugaucacugccuuccggucgcacaugguuaccguagagcagaggccagccggcugcugcgagcuccuagggaaggugcgggcgccgcucaagcagcagaggacagccggucgcuaccgaagccguggcgcaucuuuuucccccau

SEQ ID NO: 9231 - RNA, 1057 nt, Mus musculus
acaccccuguagaacuccagguugggcagacugguaggccagguugauguuggugaaaugccuccacaccugggcugucaaggucucaaacaggugcucuaccuccucccgcagcuggacagacuuggcccgcguagucugagcgugucugauguuguuacugcugaacuuggcccagguuucaggaacggagaccguuucgucaaaguucuccaugccacggaagaaguuaauggauucagauguguuuuuuagguuuaaacaucucuccucaauagacugugcagagcucuugucugcgaugucuugcucuagggcauguugaacaucucgauuaucuugcaucugggaaucaauucguuuagcuaauuuucucaucugaucuuggcaacauuuaaguaaaucugcuacccggagaagguuuuucuccccguugucauggaccagguuaaucccgauccuuuucuccuuacuguacagauaguccagggucaccugcaggggacaguucaccuccuuagcggcgcacuccaagcgcaucuugaggguuuucaaguuguugaucuccgccaucagcaugucccgcucaugacacaacccggacuuccagaagcggaugucggagagccucuggcccagguuccggaagguucccucuugcaucuggcgugucagcugcuccuuauccugcaugauccgcagggagucgucugucagccggcuggcgcggagccgcgaugccucugcaauacugaucagcagaucauuagagcggucccauucgcguuggguauaacgauugaagugcggggaguggagcgagggcagaauuguggacagccccuggucgccugcgcuauccuccuggcuuuucugggugguggcgaccuuguagaagacucugggucuccaagcagagcggcagcggggcaggugaaaggauugguagcacuccuguaccucaggguccugcccagcagggggcggccacugcaagccacagucuuucuuggagccacaguaacucgcugucugaaugguuccaagaaauuccauc

SEQ ID NO: 9232 - RNA, 1307 nt, Mus musculus
uauccuggaccgugguggacuccccugugcucgguagauucuacgugugaugggucuacaggaucaggagccacuguucucccuauuggagggcgucuggguggaagucaggauggcuuugccucacugucuuccuccaaaccuuuuccuuuucacugagagagcagugcuguuugcugcugacugaggaugcagaagccagagaucugaccuugagggacaccuggacaugcuggaugcggcccugagcccagagcuuuccauguuaguguucugucuguacauagaugguuuaaaaugaugcucacucaccauuccagagccaguaggucugaaguguggcaggugugguuagcaucucugucuggccucucauaagguugcucucaaggucuuagccccucaagcucucaggcucugggaaaaugaaaaugcagguuucgguguguaggacugaguucuaucuuuuugcuggcuaacaacagcuuugauugguggacucugccagccuccuuuucauuugacuucucccucuucaagcugucaaggcugugucaaauccuuuacauguaaacugacucugacuuccucuugggguaccugauaggacuugaaguaacuugugguauagcacucccacuuagguacuccuccugucaucaggguuagccagucauaguacuaucugaauuaguguuugauuggucaucuuagaauucugccuaucauaauugaagccacugcugguugaaaucagagcuccccaaacagaccuaaguggccacauugucuugaaccugccagauuuucucugauagaggaaguuuuggaaauggugcuguuggucagcaucggggagcauguggaagccugagcagagugucacaaguauuagaggggacacgugugucagucuguaggguacacaagugucggguagguuccaggccucugccccagcugcuccuggaguuggaacauuugggagcagugggggggauuauacugagcagaagggaugaguuauccucuucgcacuuggauaggauguuaguaacuaggccagacuugugauucuucagcucccugaguccgacgaucacaggaaggcaucuccacaaacgcaguguuugcucaaacagccuguucuugaucccuuugcaguuucccaaaagaagcacuaccgcuaggcaggggucgucugccagcuugcugucuguucugugcuugacucugcuacucaccagggcucauguaauaagagcuuaguucugcguuugaguucuguauaaacaucugauuuggga

SEQ ID NO: 9233 - RNA, 1294 nt, Mus musculus
cggcgucuggcucccgcucucacagccauugcaguacauugagcuccauagagacagcgccggggcaagcgcgagccggacgggcacugggcgacucugugccucgcggaggaaaaucaacuaaacaugggcaaaggagauccuaagaagccgagaggcaaaauguccucauaugcauucuuugugcaaacuugccgggaggagcacaagaagaagcacccggaugcuucugucaacuucucagaguucuccaagaagugcucagagagguggaagaccaugucugcuaaagaaaaggggaaauuugaagauauggcaaaggcugacaaggcucguuaugaaagagaaaugaaaaccuacauccccaccaaaggggagaccaaaaagaaguucaaggaccccaaugcacccaagaggccuccuucggccuucuucuuguucuguucugaguaccgccccaaaaucaaaggcgagcauccuggcuuauccauuggugauguugcaaagaaacuaggagagauguggaacaacacugcagcagaugacaagcagcccuaugagaagaaagcugccaagcugaaggagaaguaugagaaggauauugcugccuacagagcuaaaggaaaaccugaugcagcgaaaaaggggguggucaaggcugaaaagagcaagaaaaagaaggaggaggaagaugacgaggaggaugaagaggaugaggaagaggaggaagaagaggaagaugaagaugaagaagaagaugaugaugaugaauaaguugguucuagcgcaguuuuuuuuucuugucuauaaagcauuuaaccccccuguacacaacucacuccuuuuaaagaaaaaaauugaaauguaaggcuguguaagauuuguuuuuaaacuguacagugucuuuuuuuguauaguuaacacacuacagaaugugucuuuagauagcccuguccuggugguauuuucaauagccacuaaccuugccugguacagucuggggguuguaaauuggcauggaaauuuaaagcagguacuuguuggugcacagcacaaauuaguuauauauggggacaguaguuugguuuuuuguuuuguuuuuuuuuuucuuuugguuuucuuuuuggguuuucuuuuuuucaucuucaguugucucugaugcagcuuauacgaagauaauuguuguucuguuaacugaauaccacucuguaauugcaaaaaaaauugcggcuguuuuguugacauucugaaugcuucuaaguaaauacaauuuuuuuuauuaaaaaaaaaaaag

SEQ ID NO: 9234 - RNA, 84126 nt, Mus musculus
caauccagggaucgugcaagugggcccggccgcuccgauugucacugacugagccugucgccucaucccgguccccagcuccacgcgccaggucgccagccagcaaggcgucccgagcccucgacguccugccccgcggccugcguucugacgcggggcgguccgagggagccgggcggagccuccccgcgccgugcggcgugcugacgcgagcggcgagcggggcgggccggccucggcuccucccgccgcgggcccacuggccgcccgccucccccacccucggccggucagcgucccagacugcgucgcgcagcaucgcgucggcccggcccggcccggcccccgggcagaugccccgaguugccgcugucgccgccgccgacucggccgguggcggugugggaggugggcgccuggcccggggccgccgagcgugacagacacggccggggccgccggggggcugucggggccgcgcgcggaccauguauuuccugagcggcuggcccaagaggcugcucugcgcgccgcggagcccggccgaggcgccgcuccacguccagucugacccucggagagcguucuucgccgugcuggccccggcccgccucagcaucugguacagccgaguaaguaggcgccggcgucccgacuucccccgagcggccccuguccggucccgacuuccccagagaggcccggaucuagucccgauucuccccgagcgacccuggccccgucccgacucccuccgaacgaccaccguccggucccaacuaaccccgggcgaacccagaaccauccugaucacccucccuauagugacccuggaacuggcgcgacugccgccgagcgaccccggaccggucccgacuucccccgagcgaccccggccagucccgacucccuccgagggagcgacggcggucccgucccaacuaacuacccccgagcgaccccagccggucccgacuuaccccgagcgacccucgcucucgaguuggagccgcgcgcggacagucuccacugcaccccaguccccgcguggcacccacagccgcgcgccaggccuggagcucccuggcggagcccagacuugccugccucucugcccccauugccgccgagccaaucuguuggagcgucccccagcacuccggcagcuguggcguccccgcucccccaccccccaccccugcuuuaaagguuguuguuuaguggaguuccggaaagccuguuggucuuuaccaagugucagaauuuacaguccugugguaauugauuucugaaaacuuaaagacuuguuggguuugaguguagauaucugguaacuuuagcuccgggucucccccacacaucacggacuccaguccuuuucuuggcugcucuuggacucuggagagcucugcugggaugguuggagagucggggagcucacgucuguccgcgccgcaccuggaaauuauuauuuccaggcuuagaaagagcauggggucagaauucuuugcuuucagccuggcuuuuuuuuuuuuuuccucccgugccuugaguuccgaguagauaagagaauuaacuugaaaaaguaaggggugaaugggcuagcccccguccgguuuuuguugcuccuggacaucuguaaaaauuacagaauucugaguuuuaagauccccccccacacacugcauucagagagacaguacuaauugaugucagaguggugguggucuugaaaagagacuagagguugguugaccuugcccuugcuagauaugugaaacacugguuuugguuugguuaaacccuuuagaucucugcuuauuaccauggugugcugauaaugcccuugauuguccgcacacacagcugugguaaaaccgaugcuagaauuuaagcaauuuaauugguuucucuuuuacuauuacauaguuaggcuauuugucacuaaguuuuggcugaccuaauuuucagaaagguaugaaaaccgcagguuacuaaacaauuacagcaucagcaaugugauacucagauccgugcugaauugaauuuuuaaauaugugcguuguaaauguaaguugguaccuaagugagauccguuuucaauuuaugagcaguugaacaacuuuuauguagugcaacuauuuaaagucaauaguuguuuggaagagcauaauuagaaguugaauuuuacauuguuuccuaaauuuaguaguuuuguucgaauguaacacuuuuaaaaucuaacguuuuaaucauuuuaaccccuaaggauacaaaucugauuuauguaaguuuagcaugguaggccagaagcuuguaggcuaccuucuccacacacaccccacccccacccccacauuaaaaugagucucaguugucuuguggacauugugacauggauaaaaucuguuuggcuugggaguuagauguaguguuauggaacuuaugcauccucuguucauucccuucaaacucccacucuacacaccugagucucacaaaaguaccuugguuacuacugaucucuagugugugaaacuuagaauuucacacacauacaaaacaaucacacacagggaaagaaaacguuuucagaggguagauuucggggaaauauauggguucagaggcauaaagugaaaucaauuucuggacuaugguagggagccuacagggcacucuagguuuagaguuaaccugaaacucugugcacaagcuuugugauuuagaaaaucaugcuuaaaugagaugauucaaagucugauuauguggcugaggagugggaacggugccaggcuccaccugccaagucuccuucucuugggauauaugcuuguagcuuuucuuauccugugagaacguucauuuuaacuuucuuauuuccaaacuuuacaacacaguguuuagguucaaaauauuaaaagcaaaacuaccucuagguaaaucaaagaggcuaucacuuauacccauaauuuggaaugaauugguuuaaaauaccuucauugagaauaugaauguugauuuuauuuauuuaauuuuuagacuauugugaaguucaaaagggguuuacagaguugaagugguaaaaaguuacauuaggacauuugaaggcagcgauagugacucaaaagagaaagaauaauuagauuuuguuuguuugaaauuuuguuaguacucaauaaaguaaacaugcauaagaaaaggguaguuuuaaaagagaaaaccugcuuugaggaagaaaugugcauuuagucucaacugguuauuugcuuguccgaaaaaguugcuguaugugaaauuuugauuacccauuagacuaugggaacauuaaacuaaaaucucuaaaaauaacaguacauuuuaugggucuucuaguaaacuuuuuuuuuuuuuuuuuaaagauuuauuuauuauuauauguaaguacacuguagcugucuucagacacaccagaagagggagucagaucuuguuagggaugguugugagccaccaugugguugcugggauuugaacucuggaccuucagaagagcagucaggugcucuuacccacugagccaucucaccagcccccuuuuuuuuuuuuuuuuuuuuuuuuuuuuuaagaguuauuuauuuuaugugcgugcacuguagcugucuucgguuacaccagaagagggcagcagaucuuauuacagaugguugugagccaccgugugguugcugggaauugaacucaggaccucuggaagagcagucugugcucuuaaccgcugagccaucucuccagcccccucuaguaaacuuuuaugaaccaguuauagcuaccuuuauuauguacuaaauugcuauuugaaauuccaguguuuuagagucauaucuguucagacuaauuuucuagacaaauuuggaagauacaugugaaugcuguuugguuuaugaacaaacauuucuauagauauccacuuugcuuuuugauaauuaaaauagcacauuucaucacuaaauuggguuuguugcuugguuuucagugugauguguuacuagagguuugcccuuuggacacugugauucuaauucggaguucuaaaaccuaguccaggggccagccaggccuaaauacguggcucagcggggagagugcugccugccaucccuggugaugcacauaguaacagcagagggucacuccugcagguuguucucuccuucaugauuaugugcuugcacagccacacagaaauacacuaaauaaauaaguaaacaaacaaacuaguaauuuaaaagccuacuggagucuauaauaguguuacccacacuuuuuggagcuaaacaacagccuaaguggcuguuuuaaaaaaauauuuagaacauggguugguagcuccuuccuguaauccaagcaggacugggagauugggaggaugaggcaggaacugcugugaauuugaggccagccugggcuagcauaagggcuagccuaagacuuuguugaggaaaaggaaggagggugggcuggaaggaaggaggaagagggaagagaaaaagaaaagaaagaaagauuuaguaucuauguuaggaugguauauuucuguuaagagaauuguagaauucagcuggggcauugagcucccccauaaaaugaguauuacaugucaugaacuggguuuuguuguauaaggaggaccguggauauucuuuuaauagacuccuuaacuguaacuaugaacgacuacauaugugaaccuuaaaauauuuaggaugguuucauucugaauuagauacguacucaucucaauuuucaggucacugauuuugaaauauuuaaauuacuuucacaaguuuuuuugaauacuaauuguaaaggauagcauaaauaggcagcacaugaaaguaaugaaguggcuuauuauauagagaaaacauuuugcccaaugauguauguuacuaugaugcaugaaagccuucuguuuuuuguuuuuuugguuuuuuuggguuuuuuugguuuuuuuuugagacagaguuucacuauguaucacuggcugaccuagaacucaccaucacacccagagaaugaaagucuuuugaguuaccacuguggguugcuaauagaaaguugagauuggcaauucauuacugucuccuaaauaauguauuugaguaauccugagcagaaacuugcauuccuguugaugugugcuaauagugcaaaaucccuguuacuguguacauagaaaacacaguaagguagaugucucaagagccaagcuguaaguauauaauuagcuguguccucaggaaggcuguuucauuuccaucuccuuuucuccaauaguuguauuucaccuuuucagcucuguuacugccucuagaggccuuccuuauaaguccacaugucugaaagucuucuaggguucgcuuuuuguuaaggaauaaaguucaaacuccuugguuugauaugagagccacuccuguccuggaggcucucuugccucaugucugauuauuaguauaguaccuauccuucagcuucuguugcaacccgucuuucuccaugagucaucguuaccuaccauaaccggaaggguucauuuauugauaaaguacuguuuugggguuuuuuccuucuugcuuuacugaagcauauauaugacaaaaauuguagaacuuauaugguaaaauguuuuuauauacauguguagugauagcuauaaucaagcuaauaagcaugcccaccaccucacauaguucuuuuaugugugaugaaaacacuuaagaucuaccucaggcuauagagauagccuagugguuaaaagcaccuaacugcucugggaggggagccagauuuaguucacaugcucaugcccucuucuggccucuaugggcauaggguacccauuugguguauauacauacauggaagcacacacucauacauauaaaaaaucuuuuuggccucccucugaccuacacacacacacacacacguacacacacacauguacgcacauuguagcacaugcaugacccucacccaacacacauauuacuauuguauaauaauaaugaacaaauuucaaguuauaauacuauuaccuguagucuccaaacucuucauuaaauuacaaaaauugacuagucuuaaaacuguguauuuguauuugacccaaaucaccccauuccuuccacuccaacuucugguaaucucuguucuagucuugguuuuuauggguuuuacuucuugagauuuuacauauguaguaguuucugcaguauaugccauccuuugucugguuauuauuucacguuauuucauuaaaaguucauuccuauuguacuaaguauccggauuuccuuuaaaaaaaaaagaccgaauaauaucccuuuguauacacaccacauuuccuuuaucaguccaucuguugacagucacuuagauuguuauggugacuggaguaaugcuuuagugaauacaggcaugcagauaacuuuuaaaauacugauuucaauucuuuccuuuguacauguuugaacuaauacucuaucuaugcucaaguguacaugcagauagguacugaaguuauaggauuaugaaacuauaugguucuuuuaaaaauuuguaaauaccccauaugguuuuuccauaucaauuacagucucaccaguuuugagaaguucccucuucuagauccuuaccaacauuuuaucauuugacuucuuggggaaauccauccuaacgaguacagaagcacuaucugacaugacagcuuugaugugcauuucccuuugcacaagcugccuuuucaugucaucagcuguuuuccuugcugguugggagcuuuuuagauucacauauucccacgguucauuugugcuuugguucuuugcuuuuggugccauccaaaacauuuaccaaaaccaguaucagggagcuuucccuccauuuucaucaugaaaugggguguuucaggccccauguuuaauuuaagucuccaguugcccugacuuggccuuguggaugagcgcuuuuccuuuccauuuggauaucgagguuuccuggcaccauuuguugaaaagaccauuuucccuuuuguucagucuuagaguccuuaucaaaggugcagugaggugugugggguuguugggguggggugcuuggugucucuguaagguucucuucuguuccauugaucucugccuugcuucuauccaaauagugugcuaucuugguugcuguaccuauacauuauacuuagaaaccagguaguauuaaugcaguguuguuuucuguuugauugcguucacucuuugguccuuuggauucucuaugaauuuuaagauuguucuguaaaugucuaugaaaaaaaucauuggaauuuuaauagggauuauauugauaguaugcacauuuaaacaaugucagcucguuguccaugaacaugggauaucuuugcauuugugccaugcucagggucuuacaguuucagugucaccugguuaguuacacuuauauacuaguuuacuuuuggaugcuuuuuauaaauaggauugcuuucuuaaguucuuuuucaguuuguuuuuaguguaaagaaacauugguuuugugcuuaguuuuuaugucuuguaaccuuauuggcuuuguguacuuauuuuuaguuguggaaucuuuaggguuuucuguauugcacuucuuccuuggacuucugcuuuuauuguaaauuuuacacuuaugcuuuauuuuuaaagcuaaauuuaaagcuuuuuaggcagcaaaauuagcucauuucauauuagccagggugucuugaacacgguacaagccuguaaauucuggcuacuuaagagguugagauaggauaaucauugcuuuucaagcaaggcuacuuucucauuuuuacccacauuagcuugcuuuugggguuuuaaauauucuuuccuagauuuuucuuguugucuaaaggaagauuaguccaauuauguuucuuugccuuuaccuuaaguuauuucauggaaaagaauuuuguguauuuuuacuuuucugguuuugauagugugggcuguuaccucacuauuguuuaauaguacuuuacuaucaguacaauuuauucuuauuuggccaagguucuaugaaucuuaugugauuggaaaauauuuggaaaccacaaauaucaaaaauauuugguacuuauaguguuaaggcugaaaaaucacuguugcauuugagauccucugguagucgauuguugcauagcaaaagggcucuuuuguuuaaacauuacuuuuuuuuuuuuuuuuagaaaguuuccuauaaugaauguaucagucaggccauuucucuauaggcuugaggaucccuugagcuuuuguugauguuccuucuuuggguauuauuuacccagauuccuuaaaauguuccacugaagucugucuuggcuguguuuuccauuaugaguagguuauaaacuuuauaaaauuacaguuuugguaguuuuuauuauguucuaucuuguaaccuuuaauaggcauugacugaaaucucugugcuucuuauuuuaaaaaaaaaaacuuaauuuuaaaagcagauuuagguuuucaacaaaauuaggcagcaagaacagagaauccucaaauaaccaaaugacccagaccauagcauacagaguauuuggugcaguaaguuauccucaguggucuguguaucuacucauuuccuucuucuagcccucacggcuccuauuuaaaucaacaacaauaaaacccacaaccacaaccaaaaaaaucugucuauccuuuccaaguuaucauauaauuggaacuguagaguauucaucuuuuccaguaauaauguauuuaagguuucuccauguuuuuucauuucuugaugucuggaucugccauagucaaucaguuacugugaagggauaucaugauuacuuccaaguuugggcaaugaauaugaaacuacuauaauguuuguguucuacuuuuguuguuguugccauuuaaacagggccuuucuuacuguguagcccaaguuagucucaaacucacuaacccagacuggccuuaaauucaugauccucucgccucagccucuuaagugcugggagacaccacacuccugucuuuaaacugucuuuuguaugaacauguuuuuagcucccuuggauauaugaguaaaugcuaccuuguaugaucaguguguuuggauuuguaagaaggugccaguuguguaaaguggcuguaaucauuucgcauuuucaauagcaaagaaugugaauuccuacuuuucuaucauauccuugcuagcguuuggugucaaucuucugaauguuaaccauuauaauaauaggcucguuguuuaauuugcuuucucuaaggacaaaggauggugaauaucuugugggaagauuguuuuccauguguauuucuugcuugaugauuguugaucuuuugcccaacuuuuaauuggguuguuuugcuuguuacugaauuuuacacuuguauauuuuuuuauagcaguucauuauuagguguuugcaaacaugucccuucuccaugccuucuguccucauucauucucauucucucucucucucucucucucucuuucucucucucucucucucucucucucuggauuuucgagacaggguuucucuguguagcccuggcuguccuggaacucacucuguagaccaggcuggccucgaacucagaaauccgccugccucugccucccaagugcugggauuaaaggcgugagccaaugcugccuguccuauccucacucucuuaauagcauuuucauagaacagcuuuuaauuuuaaugaaauaugaaccauuuuagauauagacauugacucuuuggaggacgucacugaugaaucugaggucaucuagguuuuuacuaugucgaauuccagagauuuuacacuuuacacauaggauuuugauuuauuuugaauucuugagacuuguguaaggaaugcaucuugaugaauguuugugaauugauuuccauuuauucuagcauuguaugucuuugcucuuugacagugaucagacugugugagucuguuuuuaggcucuccgugcuguuucuuuggucaauuugucucucucugcauguuuacuguggcuuuauggugauaagucuugaacuuaguauuagcauucuacauucuucaucauucuuuguauugaaacucuucaucuaaaguuuagaguuaauuguuggcauccuccaaauaacuacugggauuuggguuaggauugcaguguauuuguagaucaaacuaggaagaauugguauuucgacagcauugacccuuccuguccauuaauauggaauacucauuuauucucugauaucuuucacuaguauuuuguauaauauuucuuauguacauaaccauuagauuuauaacacuaaauauuucauuggauaaugacauauaauuggaaaugugcuuuuuauuauaaaucacacuuuuuuauuauuggaauauauaaaaugauaacucauguauaauuuuguaucuugcagccuugcugucauugcuuaguuacuucagaauuggcuguugcuuuuuugaaauuuuguauaugccacuguuaucugugagugaagacauuuaaaauccacuuggcccuggcacaugguuccuugguagauucaauuugcuaauauuuuguugaaauuuuuugcauacaaauucuugagagucguuggucuguugguuuuuguuuuucauguaguacuuuugucugguuuagguaggauaauguuggauucacaaaaugaauuaggagagcucccuguccacuguugcuucgucuuagggaagguuauagagaacuguuuuuaauuauuuggcuuaauucaccuaugaacauauuugggcaugguuccauuuuggaaaguuacuaauuauguauucaauuuagcuuauucaguagauauaugcauaacuagcagcuugcuuuucuuugguaacuuacauggacuauugaagguugaugauuugauauuaugcaacagcuuaaaauauuucuccuauauucuauaaguaauguuuaaauuuagcuuauauauguuucuaugauauaccacuaaaaucaaauauaucuauuuucuuccagccuaguguguuaauuguaacauacaaggaaccagcuaaaucaucuacucaguuuggaucuuacaaacaagcugaauggagaccggauaguaccaugauagcagugucaguaaguagagcuuucaaauuacuauuauuuguuuaaggaacuauaaaguugcauuuaaauggaauuuucuaagaugaugucauguuagucuuucacacacauuaguuuuucuuuuugugaucuaaagcuguacugauuucccugguccugugcuauccuacucuacccuugcagccacugugccuucuuugucaacuuuaucccuucugccauccccaaacaacacugugucccuuucuuuguaaucuucugagccaccccuuccccuagcccacaguuaauguauguuaagagaaauaagaaaauaagcuauggaacuuaguuuuuauuuacccuaucuuccaucauggagaccacauuggagucuugugaaugcuccacaguggccaaccacuguccacuuacuguucucuucacuguuauuagcucaucugucugcuuggagcuagccucuuucuagucuguggaauaucuuguugacugagcugcucaucugaaaauguuccagaugaccaaaaguaccaaguaguucugugcuucuuguagcagaguugcagaccucacagccacauaacagacccugccuuuagccucugagccaucucuucagccccaguuguucaauucuugaugaguuaucaaauugucuaguacugcuguuagaguuuauuuguagugccagcgcugagugugagaagcugagaaucacuuggugcggcaccgccuguauagagcaucuccagauucauaaaauacucacucaaguuaagaaaacuaauuauuaauucagaacaaacuaaguggauuccacugagaagagcauuaauugaaagcaaaaauaacauaauggaacaggaaaggacauaguuggacagauuccggggcuugugaaacuccgacuuuuaagcccgugauugauuguuuuuggguuuuugauagagauaacagcugaaugucuggacuaguguugcccgacagcuguuugauggcuuaguggugguaaggguuuguuguaaacuuuuuuagcuuuuggcugaaacuaacauuguuuugaacacaaagaagucaucuacuuaauagggaaugagugacucugggaaacagcuguuuuugugugugcuggguuuaaaccuaggguaacauacaugccacgguaacuacucuaccacuaaguuauaccccuugcauggaaaauagcuuuuguuauagauuugauaaacauugaauucacucuaaaacuguaaacaggccccaucuagaaaacugaugcauuguaauuucagugacaaacuaacaaaauuguuugaaucauauguagugucagacugcuuuuaauaguuacaauacuuucagaagucagaaaagaaaauuuguaucccauauggaauuaucaggaaauuaauuaucaggaaauaucacaauucaaauagcauucuuacaaccuugauacaaaugcaaagaaaaguuuuuguaaaaaaauuuuuuuuaguugugcauaagagaaacuucuaagcuucuacuguuucuuggaucauacaucuauaaucccagcacuugggaggcuaaagcucaacuguugcaaguucaaaauaagccugggcuacauagcaggguccaguccagccagggcuacauacuuagcaagagcuagacuguguguggugcggggagcucauaugaaaagaguuuuuagaugugauauauguaaauucucauuacuggcaagcauugauaaagcuuugcauucaguuugaucacuaggaauaauagcuuuaaauccuaauuaaccaacagacugugacaauuauaaaacuuaaaaaaaauucuuccucuguuuugaucaugguuuuuaauuuucuguaauuuggaaacucugacaucuugggucuuuguuuucacaggaaaaauugccuuuaacucuguuuaucugagagccaaguaccagaguccagugauauuauucaagguagccaauacuaagcuucuuugcuuugcuccacccauuucuucccaugugauuugggcuuuuuauugcugugauaaaacaccauaaccaaaagggagaggaaaggguuuguuuuagcuuacuauccucaggucacacuugaucaccaagggaagcugacucagggcugaaacaggagccauggaggggugcugcucgcuggcuuccuccuaugacuugcucagccugcuuuccuaaagcagccaggaucaccugcccagugguagcacugccuucaaugagccgucccacauaaccacuaauucagaagauaugcuauagacuuagcuacagcucagacuuacuggagauuuuuuuuuuuuuuuucuucccaauugacaguccucuucccagauuacuggagaagaccuaaaacuauccgggcucccauguaaaccaagagaaugaugugguuuuccccuuucuucugugcuuucugaaagucucuggaacuucuuaugguguggcauguuuguguaccuuacuccccaaacuguaaauggcaaauucucuguucuauggcaguuguuuccugaccuguugaccucacaacaccucaacaacagcaacagcgauagguccauggccucuuuuagcucaucgaacauacuuucgccugcugauuuaaugguuuugauuggcuacacagagaaacccuauuucaaaaaauccaaaacaaauaaagaaugucaauccuuggacuugcucagugaugguuuuugacauauccuuuauuuuuuucuugugguuguaucuuacuuuacuguuucuuuguauggguuuuaaauuuuaaugaauauuauauguuguuguuuuuaaaagaauuaucuauuuuauguauaugaguacuguagcugucuucagacacaccagaagagggcgucagaucccauuacagaugguugugagccaccacgugguugcugggaauugaacucacgaccucagaaagagcagucagugcucuuaaccacugagccaucucuccagccccaaauguuguauuauuguaacucuaaaaaacacaaauucucccagcuuucagaguuggguuuugguucuuauuugcuaaaaccucccauuauaacagugguucuccaccucugggucauggggguugaacgacccuuucacaggaguugccuaagaccauuagaaaacaugauauuuacauuacacuucauaacaguaucaaaauuauaguuaugacguagcaauaaaaauaauuuuauggcugagggucaccaccacaugaggaacuguauuaaagggucccagcacuagcaagguuggggaccgcuuuccccagucacuucuugugugugcauucacuguaguuucucuucucuugguagccagguaucuaagguuucuuugcaucuuguaaggagggacuaggggauaaguuaugucuccaaaaaccuccucuugcccagaagccaccucauuaccuggaagugcaccuccccacccccguaaucaaaagugucaagucauggggaaaaauauugcccacccuuacuccaaccagacacaugugacaagaguugaccaaauauggauagcuagaauggauagaccugaccaacuccauccagcucuuuccuguguguuguaaguguuccacuuagauuguguuugaugucaucauuuuagcucgcucuugucaaguuugauagugauuuuuuaaaagauuuauuuauuauauguaaguacacuguagcugucuucagacacuccagaagagggcaucagaucucaucauggaugguugugagccaccauguggcugggauuugaacucgggaccuucagaagagccagucagugcucuuaaccgcugaaccgucuccagccccgugacuuuuuuuuuuuuuuuuuuuuuuguuagaauuucugugccgucuuccauaauguaacccucucuagucuuaaagauguuuuggcauaucuauuacuaauuguaauugaaauucauauacaagaagaaaguuccaggaguaaaauacucugugagaucacuggcaaagugguggaguuuuauaaacaacuggggaacauuuucccaguguuuaguuggguuucguuuacuuucccuucuugacuuuuuugaacaaccagcagacuuauuuugauauaaaaauucaaauuccuuuguucuguggccauugugauuaaagauaaaaucgucgcugcucaguuccauucuggaacggaggguagccgaagcuccagcaucuuaggaugcugcuggcucucugcacugucagugugaggcguguagucacgugcgugcacaccuaaugucuguaaggaaaggaaagggauugggggggaguuacaugcuuuaauuugaaauaaagucagaauuaacuuuuuucccuuaguuuaucucugggccuuaaauuuuucuucaguugguguacuaguuuuguguggcuaguuuugugucaacuugacacagcuggaguuaucacagagaaaggagcuucaguugaggaaaugccuccaugagauccagcuguaaggcauuuucucaauuagugaccaagggggaagguccccuuguggguggugccaucucugggcuggcauucuuggguucuauaagagagcaggcugagcaagccaggagaggcaagccaguaaagaacaucccuccauggccucugcaucagcuccugcuuccugaccugcuuguguuccuguccugacuuccuuuggugaugaacagcaauguggaauuguaagcugaauaaacccuuuccuccccaacuugcuucuuggucaugauguuugugcaggaauagaaacucugacuaagacaguuggauuaaaaaaguauaacauugaauuaaaguggguaacaaugucaaaaacaucgaucugcuguaguaaauaauauuuggugguuucuaucuuaccuuagaucauuuaguuuccaaauuaaagacacaaaaccuuuauguuuagaauaaaccuuaaagcauuagaagugggcagaaacuccucuaagcuaguguguccacuucccugucaagccugagcgucacuugccauauuccgccugggccacuccuacugcaccgugacaguccucauggccgugcucucaccuacacugugguggcugcuuccugcugcucugugcuccucacaucccuccucuuuucauggccccugucuggaacccccgagccuggaacccccgagccuggggucuugaaguucugccuaucucucuucugcccaguuaucuguaggcaucuuuauuaaccaauuguggguaacuuacagggcaaguuuuauacaauaaaagcuguauaugugaggaucugcucaucuugaagcaacuagaucuuagaaaauuaagcauuugaauauguagcagcacauugaucuuuuaaacaaaaauuuguaauuagaggccacacacauccuaagaucaauacugauaacugaaaauauuuuauauaauggaaacuuauaaauuauauuacauugaaauauuaguauuaaauuauuuaacuuauugcaaguuuuguagguguaagagaaguugagacauauucauucucuuguugagcacuccuggagucccuguauauuacagguagcauguaaucaauggagaaguuuucuugacucauagagcaugauggggcuguacagagcauguguggagggcaaagaacaaauuacaggagucuguguucuuccaccauggugguccuagggauccaauucagguuguuagguuuggcagcauguauguaccuuuaaccagugagugcucuugcuggcuuagaauacauucauucuuugagccagggccucagaaccuuccauguaaacuagguuggucucaacacacagagaucugcuugauucugucuccccauuguugauuagagcugugugucaccaugccuagcuaggaagaauaauuuuugauaaaugcugaucaaauuaaaggacgugcaucaccuuguuucagcauguuuguuauccuaccauguuccauuuguguuuauugaugucucuauguccaguagguccguugcuaucuugggagacuggugucauuugugaucuacaugcuuucuuauuccuaacauguauaauaaagaccuugaaagugaaaauggaauuuacauugcagucugcuauuucauaguuauugaagagaaauuauuaaauugugaaugguuauauauauaacauauguuuguuaucagagggaacuaagauugauacaugaaaaggcuaagcaaugguuacaugcuuucuugauaucauuugggaguccuggagaaaggucauuauaauagugcauaguaacagauuuggugacuauuaaagagacaucauuuauuacuaagacuuuaacaauuguucaaaggcagaacuguuugugaaaugucaguaguagaugccauugagauuuaaaaguuuacaauguuuguuauacacaaaaguuugaaauauuuauuuaaaaugauugauaccaaauaucaaauaguaaaucaauauauuauuuguguuuucaguauuguauuagaugaaaugcuaguacaaagugaugcuuuauucucauugucauuauaguccuggguaugcuuuauuauuuugcuguguauuuuauuagcauuugagugucugaaguguugaacauuuugaccuucgagugacugaucuucccgacaguauuuauguuaauguuacaaucuuaagagcugaccauucuuuuugccuuuccugcacuuaugagguggcaguaaaaguuuacaaguugugauucugugugggguaggaaguauuuaugaccugugcugugguuugauuugaagucauuagccuuuugauuuucuauugcaagaauguaaaauugucauggagaauuugaaagauaaucuuuccugaacaaucuuuauuuucuuguuuauauccuaguaaguuaaacuaguuuuugaaaugauauuacagaagaauaagcuauaguuacccauggcugcccugggaagucuguuuccuuucauuccauaacagaaaagcaggaagcuagcgcugggaagaaauaggaaguccugggugauuucuuugguuuggaucauuucuacuuuggauacaucuucacuugccucugaguuaauagaauucaguauuuggguaaagaagauuagagggaaaacugccacuucacucuauugcuugauuuuauacggaaagugucuucuaagagcagcaauucauaguauuuaacauguuuauguaaauguaauacaacaauguuuuuguauuguuuguguuuuuguuuuuuaguuuuauuuuugagcuagaaucucuuaggguagccuaggacagguagaaaccugcuucaguuacucaaaacuacaauuuuuuaaaauuuaauuucuauuuuuauaacauuuaguuacuuuagaaauuuagauguuuauauuugaacuucaaauguuggaaauguucaaaucuuggaaauuagagauugacuuagcugaugcuuauauuuuaaauuuucaagguuugcucuuaucauuuuuccuagugucucacaguauguuuuauaguaagagguuaaauuuuuuuauuuuuaacuauauaaauuaugcuguuuugauaaaugauaguuuuagggguacagucaggcauuuugugcuuuuacuguuugguuauauugcuuuucgaacuuagaauaauuauuugccacacuuuuguagaguugaaagagugcuguguauuuuacauaguuucauaaaauauuucaauuuucaguuacauaguuuauaaaauauuuuuaaaauuuguugaacacuuuuuuaaauggcuuauauuaaacaucauuuuguguauauaaagagacuauaauucuccagaggagguauuguaguccuguaaaauuagagcccaagaugauaguuacaacauucuaauucaugguuaauaaacuucucuuucagacagcaaauggcuacaucuuguuuuuucauauuacaucuucaagaggggauaaauaccuuuaugaaccaguguaucccaaguaaguuuauucacuuuuauucuuuuaaugcauggcuugcaugcuuaguauuuuuuaaaaaauuguacuuuggguuaucuaaagucauuaagauguuaaguugccaacauuucuaaaauggugcuucagaaauuacuagucuuugaacugucauguuuuaaauuuaagaaauaugugguucaguaagucaggguacacugaguaaacauacuccagucagaugcuuucuagucuucauuagaaugcagagcuaagagaugagauaaagagggggcucuuagucagugacaggcuccuuugccugugucugcauauacauaggagaagacacacaguugcuaccuccuaauucaacuuugggggacauggacuauuguuccuuaagucuuuaaacuaucauuguguuuuacacaucuccuccacagaaugcuucacuuuuaaauaaaacaacauauaauuuuaaaauacauauuuucuucuggggguggucuaccuauaugucagaaguuugcuugauguuacaugagagauugcugccaauaugauuaaaaggaaacugcugagaagauuaaaaaacccauauauacacauacacacauauauauauacauauauauaauuuauauauuauaauauagccauauauugauauauaauauuaaacaacauguuaaaauauauucuaaaauguagauauauuauuuauauguuauauacaacauauuaaaauuauauauauuaaaaugacuuacugaagaugaauaagcccaguuaugcaaagaaaaccaggggugugaaguaaaugugcccaacacuguacuacuauaaggauugucccaaauucuaguugcacugagcuguuuauaauuguuuauauuagacagauaccacagcauaccaguuguauuagcauaauguccugauuucacauuuaguuugcacauuauucgagaccuauagauaaauuucuucuagugugagcaauauuucauuaguccagaaaaguggcuuagucagggaagaccuaagaucaguccccagaacccacauaaaagugccaggcaugguggcacgugcuuguuauccuggacuggggaaguggaagcaggcggagcuugcuggagcuugcuggagcuugcugccuagccagcuuaggccacuuggauccucugaccaacacacaacuuugacacacaaaagauggugacauuuugaaccuuucuuuuuuauaaagcaauuucugccuagcuuauuguccaguuaacaucacugaauuuuucagaauucacauugucaguaaaauaacuuaagaaaaguuuuauguaauagaauaagugaaauaugaucuguuuucgugaacgaggaucuggaaaaagccaacuuggaguuaauguacugagugggguugagccuuggaguugagcaguguggcggcuggcucagcguggguggaacuggcucucuuaaaugaacacaaggauuugcucuuuuguuuugcuuuaaacauuuuaaaucucagcuuuuaguaugucgucuaggugcuugguuacugccugguuuguagggauuucuuuucuuuucucuucuuuucuuuucuuuuuuuuuuuuugagagaaauauagcuagccaauugaaaaauagccuuucaguuguguauaagaaucagaaaaagaaucaucauggaugacuaccaguaugucugcuguuagauaugacagggaaaaugcaucuaugaacucucaacacuguagcugccuaagcaagacuggcauaaugacaauaccaguugacaugccaaaguagaugggggaagcccauaagaccccacccuagagaggagccacaggagguccgugggugcugggaagggagaaucaguuuccuacaagaacaagcuccaguguaggauuccagccccuggugcucacccagcucacguguacauacaagaugugcuaaacagacacgauagggcacaugcgcacuaaguguguguugcauauacacuauggaacaguaaucauuaagaagcuaugauuuuggugggggugagacaugggaggcguugggggggagcaggagugauauaaauuuagucaucuuauaugaguuucucaaaaaaauguuuuuaaaguaagcucaaaagaaaaaccuuagaaaauaaaauacacauauaaucuuuuuauuugccagaauacaacuuuuaguaacuacucuaugaauuacugguacaaauacaguuuuguugccuaaagccagccugauguguauuuguguaugccaguacuuucuagaguugcuuauuuuaguaaguuuucugaagaaacuguaaaaugguaucaaaaguguaauuuucuucuaauugauaggaguuguuucaaaccugaaaaguuucgaucauauagggguuggggggggggguaagggacagggagggaugguucugucaguguugucaugagugccauuguaagcacaucugugaagaugucugucauacagacugcugcacacaaaagccacccaucauccuagcucaugccgucacagaugagagccaagucagguggugccauaguccccagucuguagugcuuagccucugauaccacacuacuucagccuuguuugugccucauccagcaaucuacuacuuaagauuuaucugaggaauaaggaauagaaaaaagcaaaugaaaaugguuuguaauagucuggaagguagaggccggcgguaaacugucuccucuucaguuauagaaguagcacugucucuuguuucaccucucuacaucuuagaagucuaucacaugaacuuuauuucuagggcaucucgacuuuccuguauuacaugacagcaucuuaaccucagacugucugucauuuuccauuacaguccaaaugaguacacggcucaggugucgcuauguuuaauagcuuccgccuaguguuccuaccauuccuguauaugcagggagccaaucuucaacaaccauggcagucuuacucacuaacuccuugcauuucaaaugucacuuauucuuugauauucucuuuaucuuuuguaucuuuacaaaauccaccuuacauuaagcuaucucuucaucuuuacccagaccaguaugcagacuggccauaggcuuuaauguuuuguuuuacauuuucagauuugcaguaaaauuugugauggaaacuuugccacagauaaaccagaaauaauuacauuuagcuuugaaauucauuuaauuaacuaugcuuggauaugaguauaggagauuugaaauuucuuguaauucuuauuucuucauaaugaaaauaauuuuagcaaauuaguuuucauguacuguuuuggggguuuuuguuuuuggaggaguuuaguuuuuguuuguuuguuugguugguugguuuuuguuuuuugagacaggguccuuguguagcccuggaugucuggaauccacuauguagaagcagcuggcguucauauagucuuucaggagcaaagcucuccuccuucacucaucuuuccaccacaauuaacuuugguuugucugauuuugaggugaggcuucauuguguugcccaggcuuguggcucaaaugauccucccagcucagccucugaagugcuaagaguauaagcacaugcuaccauguucaacuuaaacuuuuuuaaaagauauauuuacuuacuuuauguauaugaguacacuguagcugucuucagacacaccagaagagaguaucagaucccauuacagaugguugugagccaccacgugguugcugggaacugaacucaggaccucaggaagagcagucagugcucuuaacuguugagccaucucuccagcccccuaaauuuaaacuuaaaacaaaaaacaaaaaacaaaaaaaaacaaaagaagcaguuuuauugaguccaauguucacugggcccaagguugugguucagugcuuuugucugcuugccuaucauguacaaggccuuggauuugauaaccagcucugcaaaaauuaaauaauaguacuaaacuuugggguguuuaauuaacugauauugaagacauagguacucagcucuccacuggaaaauauucucccauagcaaucacuaucagcgcuguaccuuauugugcguuacuuauuucuuccuaacacagcucaucagauaugugaaacuucuuaccagaguugcugucugugaguuagugcugguuggaaagagaggaaauugagauuaacaguugcucuuauuaaguuuuuauguccaaaaauccagcaguuauuuuuguagaagaagccuacauugugggccagaaauguccacuaacucauaucgcauauagaagacaaaggagaccagaauuaguuauguacacuaaaguuuccucaagauccauuuacagucauauaucauuguaagacaaggacaugucugagaaaugugagcacuucacuggucagaauguuacagaggauucuucuaagaauauaggugcuauaguguauggaucuacagcuguuacagccacaguuacaacuugcacagcauauuacugugcugaaacuguaaacaauuuauaccacuguacaaugguauuuguguauuuauacauauauaaaaauagaaaagguaucuuuuugccuuuacauuuuuaugagcacaguuuugauaucuuuagauaucagcaccaggaacuucacuuccauacaacugacaaucagcaagcuuguuuauauuagcaucagcaucaccacaaggaccuggugauguguugugcuccuguuaacaauggcugcaauaucacuaagauaugggaauuucccacccugucuuaauuuuaugggacuacuacuuuauaugaaauccauccauuauugaaacauuuuggugcacauuuuugugccuuuuuuauuauugcuaauaagucauugauaauagguuuugagagagaagauuuuaacuaauuuuucuuccuucuaauagauaccuuguuugggauauagaugguaguggucuuaaaaauguuucucuuugagcaucucauaaccuuacauugauuucagcaugcaucuguagauguacaugugugacuuuuagcugaacuuuguauauaucauguauccauuuaugaauacauuguaauuguacuagcauuuauuaguaggauggguuaaaauauuauuacuuaauucaaaaacuccucuuguagccauauccaauggugccaucugagugcagagacugauagaaucauuagaugagcgaagcagcucguagaaccucaugcuguugguguuacaauacuacugccgcuagcagauuaagucaggaggacucugugcucacuuguaguagcuuuugucuuuuuuuuaaaaaaaaaagucucuaggaauuguuguagcugcuagcugcuagggauguagcagugggguggggacuggggcaauaaagcagccuuacuuauauagcuugguaauuauaacauuguauguuacacaggcaaauaaagcaggguuagggaaugaggcguggaaccacagcuugaaauugaauccuuagucucuucacugagaaguuaacauguaaaaggaugcaaaggagucuguggggaacacaacauacacuuagggcaaugacauuuggggauaaaugagacaauauuguaaguuguagacccuaacaaagaauuuauaaguagucagaagggauguuuuauguaauuaaaaaugaaauacuaugcugugguauuuuuuaaaguaacuuaaucgcagaugaguauaaagccaguuaguagucuucuguccagagaacuagcauguccuugaauggauacacucucccuuuugaaacacauaguagccagucugugaaguccacuucagucaugccuuccauugccuccuaauucccaacaagacuuucuuaguuugaaacuugaaaguuuuuucuggauuauuauaucuuuuauaacuuaccucuaaaugauuuaaacauauaauuugcuugccuuuucccuauauacaauuucuugugguuuucuguagguuuuaggauuaguuauguugcuuuuauuuuuuuuuuuuccauuuugcucaucugauaaguggaucuaacacugucuaucccaugaauuugucagugagcuuaaacugggacucucguuauaguacuuaagccgugcuucaguguuuucuagagguuugggagggggguguuuuguuucuguguuccguguucucgcuaccuuuaacuaaguauguaaguaggugagcucuaugauuaaaucaauuuaagugguucaguaagcuucaacuucgugauguuugaaccguacccguuaccuccuguggcucacuggagagugccaguuagugcagugugagcaaacucucuggccuggcucuggagcucagagcagccuucugcuuuauucuaguuucuucccagcacuuuuguccuccaugagcucaagaagucacuaauucucaauaaacauucccauaguauauuuuaaauuuuuaucccagcaaucagugauauguuuuaguugaaaaacuagacugugagaaguguaguuuuaaaauguggauuuugcuuuuucagauuguaauccaacucuacucgccacuuguccuauaucucuuggguaaaucaauacccucguguagaaauccugggucguaucacauguccaguaacuuuaguuuggaugcugacaucauccuuaguaugaucuacauacuauuacuauacaucuaugguauaguauaguaaucaccauacuauuaauuauagucuuuguguuuuccauuugaauaguuuucaggguuuuguuuuuuguuuuguuugguuugguuugguuuuucgagacaggguuucucuguguagcccuggcuguccugaaacucacuuuguagaccaggcuggcgucgaacucagaaauccaccugccucugccucccgagugcugggauuaaaggcgugugccaccaugcccggcuaguuuucagguuuuacaauaaagaaugguaaaguuugcuauggguaacaaguuacuuggaaaauacccugacaaauuugcagcuuguuuguucguaugcucauagggguagauugagccuucacuuuaccuugucuuccaaggucuugucacucgcuccgcagagugagagccuuccuccaggauguccaaaaccuuagugguuuauucuuagucuggcuuuggggucacauggaagaauggcuuaauaucuagugcugcaaagaagaauagagguuucuagaagccuuugucaguguaacuccagcauuucugcuauucugcuccauacauuugucucccugagcauuggguucucccacuguaugugguagccuggaaagugacuuuuguuagaaaacuuguuuuuuucuguuugugacaaguucucacuuuguagccuaagcuagccuugcaauucuucugccugcccuugggugacuggaguguuucauguauuuuguccaguuuuuguguuuguuuucuggcugaauaauuuggaaccauuuacucuauuaaaaucauaaaagugacuaccuaccuguaggaucaucagucaguuugaacaauuuccaguuauuuuccacuggaguauauuuauuuaagcacaugcaaauauugugcuuaaauauuuaaauauguaaauauagucuauuucaucagaaauauuuucauaaguuaugggcauauugguaaauaauuacaguaguauaucucaguaguggcuauauuaaguauggcuuagcgugcacgaggcccuguauucaucccuagaaaggaaaccaaucaaauugucuacagcugaugaaaugugugauguagagaaagaacacugucagcuucagagcugggguugaacaggcaaagccucucagucgcagagcuugugagacagccaggacucccuagaucaaaacuggcacagucuugacucaucuuccauuugggauucaugucuguuacuauaacugaaaacuuagcaugucccuacucuaacuugucaggcauuuguuauuaaaugguccucaagaggccucugguacuaauaacgaaguaaaguuaaugccagggucuggagggcagggguguagcaguggucgagcacucgcagacaugcacaaggccuugggaucccucagcaccacaaaaaaaguaguuuaaaaauaaauggaugggggaaaaaaaaagaaaugaauguccugagaagucacacuaguauuucaugagugcuuaugaggagaggagaguuucauagguuaaaaaaauauauaguuguuugcuuggggugggggggugaagacaggccugaaguaaguucugauggaaagaacacacuguauaguugauuguacuguacugguuuguuuucuuuugcuuugcucugugacucagucucccugugcagcccagacugcucuggcacuccauuuaugguucaccugaaugcaguaaucauagccaugaaccaccacaucugacuuuuaacugaacucuugacauguauguccuguaccccaaauccauuguauuaucugccuuguuauucuuuucuuuaaguaguauuuaauaguauuuaagguccugcaccugagaauuuguucaaacagaagccuauugaauauguguuguagcaguuaacuguaucauugcuguagcccuccaggguguauuugauugacauuaaaagugaucuuaguuuuuuucuacauaauauuaugguacauuugaaaauaguguaugccuuaguuaggguuuccauggcugagaagagauacccugaucacgacauuuaauuggggcugggguacagguucagagguucaguccauuaccaucaugggaggaugcauggcugcguccaggcagacacagugcuggagaaggagccaagaguucuacaucuugauccgaagauagucaggagaagacucuccuccaggcagcaguaguagggucucuuaggucagccucacugugacacacuuccuccaacaaggucacaccucuaacagcaguacucccuaugggccaagcauauucaaaacaccgcagugugauuuugagucuuagggaacuuacuccugaagacaguuacacacuugagcaguaauagagcuacaccaacccccauacuuucucaguguucuuuguugacaugaaugccagaauuuucaagugagauuaguuucauuuuuugccuucauuaugugugucuuuggcuuaacucauaagcaaccauuuggauaugugcaaggggguguguuguauuucacaucaacugcuuuucaguuuagguucuucuuugacauagaaggggcacuuuuaaauuacucuuugccuuuaauaauuauuuauguguauaaaaugagaaaaauaacaguuaaauucuacuaaaucauaccuagcauuguugucuagguugccuuuuaaguuguuuacagugccuccaguggacacuuaagacuauucauaugugcucagaauaaagggaauucuuguuaauuaaauaugaagaguuauagugagcuccacucugaaaaauaauaaaucuuacagaagcuaucuaaaaguaguuauucuaaaacgugucaaauuggcucacaucaaauaugagcaaugacaauuucguuucaaaaaauacauaaugccugaaaaugcaaaauauuuugaaaauaugcauuuuuaguaucauauuuugcuuauuuauucuauugauacuuuuaaaauaugguuaauauggcauuaaaguuugguuauauagauauguaacacuuucuaagauguuccauagggaagcauuccacauacaaauaguaaaggcagcuaaaugucucuagauauauauguucuguuuggucacuagguuuuuaacaagucucguagagauuauauuguaaagugaaauuaucaaacuuuuccuaucuugaauuuuugcaguaaucugaggcuuuuaucuguuuuugguguuuguguaguuugguucugaaacuagauuuaucugauuggaacuuguguguugaagucaggggcaguuuacuaaauaaacuuuucagaccaggucuuggugugagacuaaggcugccuugaacucauucuuggugauucuuuugccuucaucuccagaguguggugauuucauucugugguuuuguuuuuguuuuaagacuuauaaagagauuuuaaacaacuuuuuguuuccagauguguacacugcacuccuggcagauauauuugucuuuuuuauacauuuauuucaucgcuuuguaguuuaguuuaaaugcaaaauuuaacuuaaaaauaaauuuuauuuugaaagguuaguuuuucuuggcauaucagucauucucuucuggaguuucacugaaucuuaacucugcagauuuugcacuaauguuuauggaugugguagcuaucacgcauguaauguauuuuuagugguaaagccaacguuccuuuaacuaucuauugauguuucaauucagaaguauauaacuaauaaaauacaaaacuacugauaacguuaauaaacuaauugaagcacauauacauauccaucgaacuugugcaaagaucacguguguauccagugucaucacuuagucaccccaaauaaacaagauuugagaaaugagacugcagaaaggaugcagagaagcuaaagguagugcuggccuguagaugagaugcuuuuaucauuugauuguuuaagacaucaagugcuaaguaguccuucuaagaaggacugaagcaucuacacuguggacuuccuucuucuugaguuucauguguuuugcagauuguaucuuggauauucuaaguuucugggcuacuauccgcuuaucagugagugcauaucauguguguacuuuugugauuggguuaccucacucaggaugauguccuccagaugcaucuauuugccuaagaauuucaugaauucauuguuuguuuguuuguucuuuuuuuauuagauauuuucuuuauuuacauuucaaaugcuaucccaaaaguucccuauacccucucccagcccugcuccccuacccacccacuuccacuucuuggcccuggcauuccccuguacuggggcauauaaaguuugcaagacuaaggggacucucuucccagugauggccaacuaggucaucuucugcuacauaugcagcuagagacaugagcucuggggguacugguuaguucauauuguuguuccaccuauaggguugcagauuccucauacaaaauagcuauaucagggucucuuuagcaaaaucuugcuggcauaugcaauagugucuggguuugguggaugauuauggguuagauuccugugugggguagucuccggaugguucauccuuucgucuuagcuccaaacuuugucucuguaacuccuuucauggguauuuuguucccuguucuaaggaggaauaaaaaaaaaaaaaaacacacacacacacacacaaaaaaguuuuucaggugcuucuuagccauucgguauuccucaguugagaauucuuuuuuuaguucugaaccccauuuuuaauguuuuuuuuuauuuucugcacucuaucuucuuaauuuuuuauauauaucggauauucgucuccuaucugauuuaggauugugcccauaucuucgaggcuuuuccccacuuucuccucucuaaguuucagugucucugguuuuauguggaguuccuugauccacuuagucuugagcuuugagaugauaagaauggaucaauuccuuuucuucuacaugcuaaccacaaauugaccauuuguugaagauagagucuucuuuccacuggaugguuuuagcuccuuugucaaagaucaagugaccauagguguguggguucauuucuggguauucaaaucucuuccauuggucuaccugucuguugcuguaccaguaccaugcaguuuuuaaucacaauugcucuguaguacagcuugaggucaggcauggugauuccaccagagguucuuuuaucauugagaauaguuuuugcuauuuguuauuacagaugaauuugcaaauuguccuuucuaacucuguggagaauugaguuggaauuuugauggggauugaguugaauuuguagauugcuuuuggcaagauaggcauuuugacuauguuaauccugccaauccaugagcauagaucuuuccaucuucugagaucuucuucgauuucuuucuucagagacuucuuaucauauagaucuuucucuuccuuaguuagauucacaccgagguacuuuauuuguuauuauugugaaguauguuguuucccuaauuucuuucucagccuguuuauccuuuguguagagaaaggccauugacuuguuugaguuaauuuaauauccagcuacuucacugaagcuguuuaucagguuuaggaguucccugguggaauuuuuagggucacuuauauauacuaucauaucaucugcaaauauuuugacuucuuccuuuccaauuuguauccccuuggccuccuuuuguugucuaauugcucuggcuaagaauucaaguacuauauugaauagguagggagaaaguggguagccuugucuagucucugauuuuagugggauugcuuccagcuucuuaccauuuacuuugauguuggcuacugguuugcuguauauugcuuuuguuauguuuagguauggaccuugaauuccugaucuuuccaagacuuuuaucaugaauggguguuggauuuugucaaacgcuuucucagcaucuaacgagaugaucaugugguuuuugucuuugagauuguuuauauaguggaguguguugauggauuuccauauauuaaacuaucccugcaucccuggaaugaagcuuacuuggucaugauggaugaucuuuugauguuuucuuggauucaguuuucgagaauuuuauugaguauuuuuacaucaauauucauaagggaaauuggucugaaguucucuuuguugggucuuuaugugguuuagguaucagaguaauuguggcuucuuagaaugaguuggguagaguaccuucuguuucuauuuuguggaauaguuugaggagaauuggaauuagcucuucuuugaaggccugauagaacucugcacuaaacccaucugguucuggacuuuuuuugguugggagacuauuaaugacugcuucuauuucuuuaggggauaugggacuguuuaggucuuuaaucugauccugauuuaacuuugguaccugguaucugucuaggaaguuguccauuucguccagguuuucuaguuuuguugaguauagccuuuuguaguaggaucugaugauguuuuggauuuccucagguucuauuguuaugucucauuuuucauuuuugacuuuguuaauuaggauacugucccugugcccucuaguuagucuggcuaaggauuuaucuauauuguugauuuuucucaaagaacuggcuccucguuugguugauucuuugaauaguucuucuuguuuccacuugguugauuucgccccugaguuugauuauuuccugcugucuacuccucuugggugaauuugcuuccuuuuguucuagagcuuuuaggugugcuguccaagcugcuaguguaugcucucucuaguuucuuuuuggaggcacccagagcuauggguuuuccucuuaggaaugcuuucauugugucccauaaguuugggucuauuguggcuucauuuucauuaaacucuaaaaagucuuuaauuucuuucuuuauuucuuccuugaccaaguuaucauugaguagaguguuguucagcuuccacaugaauguuggcuuucuuauuuguguuguuauugaugaucagccuuagucugugguggucugauaggaugcaugggauacuuucaauauuuuuguaucuguuggggccuguuuugugaccaauuauauggucaguuuuggagaagguaccaggaggugcuaagaagaagguauauccuuuuauuuuaagauaaacuguacuguagauaucuguuaaauccauuuguuuuguaacuucuguuaguuucaaugugucucuguuuaguuucuguuuccaagaucuguccauugaugugagugggguguugaaaucucccacuauuauugugugaggugcaaugugugcuuugagcuuuacuauaguuucuuuaaugaauguagauacccuugcauuugaaaucauagauauuuagaauugagaauucaucuuggaagauuuuaucuuugaugaguaugaaguccuugucuuuuuugauaacuuuggguucgaagucgauuuuauucaauauuagaauggcuacucuagcuuguuucuucggacaauuugcuuggaaaauuguuuuccagccuuuuacucugagauaguaucugucuuuuucccugagguggguuuccuauaagcagcaaaaaguuggguccuguuuauguagccagucuguuagucuaugucuuuuuauuggguaauugaguccauugauauuaagagauauuaaggaaaaguaauuguugcuuccuguuauuuuuguuguuaaggguugggauucuguucuuguggcugucuucuuuuagguuuguugaaggauuacuuucuugcuuuuucuaggguguaguuuccaaccuuguguugauguuuucccuuuacuauccuuugaagggcuggauucguggaaagauauugugugaauuugguuuuaucguggaauaguuuguuuucuccaucuaugguaauugagaguuuggcuggguauaguagccugggcugacauuuguguucucuuagugucugcauaacaucuguccaggaucuucuggcuuucauagucucuggugaaaagucugguguaauucugauaggccuuccuuuauauguuacuugaccuuuuucccuuacugcuuuuaauauucugucuuuauuuagugcauuuguuguucugauuauuaugugucgggaggaauuucuuuucugguccagucuauuuggaguucuguagguuucuuguauguucaagggugucucuuucuuuagguuagggaaguuuucuucuauaauuuugcugaagauauuuacuggcccuuuaaguugggaaucgucacucuuuuagguuuggucuucucauuguguccuggauuuccuggauguuuuggguuaggaucuuuuugcauuuugcauuuucuuugauuguuguguccaugcucucuauggaaucuucugcaccugagauucucucuuccaucucuuguauucuguugcugaugcucgcaucuaugauuccugauuucuuuccuaggguuucuaucuccagaguugucucccuuuugguuuucuucauuguuucuacuuucacuuuuagaucuuggaugguuuguucaauuccaucaccuguuugguuguguuuuccuguaauucuuuaagggauuuuuuguguuucuucuuuaaggccuucuaccucuuuagcaguuuuuuuuccuguaauucuuuaagugagucauuaaugcccuucuuaaaauccucuaccagcaucaugagauuugauuuuaaauccaaaucuugcuuuuuggguguguugggguauccaggacucucugugguggguguacuggguucugaugaugcccaguggucuugguuucuguuaguaagauucuuucguuugccuuucgccgucugguaaucucuggugugagauguucuagcugucucuggcuggagcuuguuccuccugugguucuuuagccucugucagcacuccugggagaccaacucucuccugagucccaguggucagaacacucugcaggcaagcucuccucuuacagggaaggugcacagaagccuggagcucagauccaccuccugauuccuggggacagaguccuccuuggaggcugacucuccucuggcagggaaggugcccaggggucugggucucagcucugucuccuggcugaggaugaaggcccgaagagacccuguccacgaagcucuguugcuucugcugcccacgugcucuccugaguagacuggucucagugaucccaagauucugggugugcuagggccugccuuuguccuuugacccuguagcugcuugcacaagacccucuggguuuuuuggaacagauguugcguuccauucaccagugaucucaagauccugggugugcuagggugcgugcagcguggagaguccucuggggaccuuggaacccucugcugagaucgaugggcacaggcaggaguguuucuuccugauuacugcuaucauuuucuuuguucuucauucauuguguaucuugauucacuugugguuuguucucuuuguccauuguagcuaguuucuuagugguuaucuugaauaguuaacauuuugcacauauaacugcuuagucugauugaguaaccauugaacaccaguggucccagaccagacauuuuuauuugucaccuucuuauggugcuguugucacagagauguuuacauauugugugcauauuggcacagauucacacguauuguuuuauucaccuguuuuucaaaucauacagaaauaaaugcuuuucuaaagcaaaagcauauuuccagcuuuaauguuuuuaacaugauuugaauuacuguuuccucucuucauucaccccaaaagguuucaucuagugucucucgccuaugacaaacccuuaauuauuuuagaucccugaaccucuuacuuucucugucaguuuuuuaagaguacuuuguccagauguucuguucuucuuuaaccuuuuuucuuucagcuguaaaguauguuauucuagugcuuuuuguccuccauaagaucagaagaggaaaugucaguuauguugagaauucuuuauaugugagagagacacuuggcacuuucaggauucucuuugauaguucaaguguuauauaucuuuguuucaaucuuuucauauguuucugacuugaaguuuguuaaguucccuagauguuuauauuuacauaucaaucaaauuuuuaaaauguucuauugcuuucucaaauauucuuucugcagaaguuuucuuuccuugccuuuggacucuucuuacacacauguuggucugcauguacuuauagaaguucuauuacuuugaaaauuuagaacugacuacaaaguaaagaaaaaaguaggggcuccaauauugaugggggagggauggagauaaaaucugugaguaaaacugccacugagagugagaggccuauugcucaggcuagaccacuuauaugcacaaggcuagaccacgcucuggaagaagaguuaccauuuucuuuagagguguugccauuaauagauguguuuauuaugccaguagauagcccccacugauauacaggcaagcaccuagaacuccucuggcaggcauggaucagaacaggaagggacuuguugggaagaugaagcuuugcacuggaagagaaggugugcagcuauaaugcauuggggaucaaauccaaguuaaauccaauagugaauucauccugcauuaaggaaagaaauaagaagcacuucuccuuggagucauguaacuaagagcaaguccagacuugcauuuucugcgccauauuuccucugucugucuguuuuaugagucugagucucugccugaaugcugucuugggacucuguuuugaaccuguuugucucuauguuucacucuguauguguccuaauguguaccugucugauguguaugaguguguaguaucugucugucugugagcagugugacuguccauaauaauggacuuuucucucuguuuauugaacagcauagaaaauaucacauggagaaggaaugggauacuuuacagauaucuuuaacggaguuuuaaaagcauuaggucacugauuucaacugaccagauagcaaaugucauuguuuaucaaccaguaaccauaaaugguugcuuucaaccuuuaugguacauuuuaggaagucuuucaacuucuguaucugcugcuuucagcaaagauacaccugcaauaucuaagucaagggcauggaacaguaccugauguaagaauguagcuaugcaauagcuuaaguuauacaaguugaauacauaggcaauccaagacaaguaaggaugguuguucaguuguucucuuaaaggcagguaaaauaaacagacucugaguaaacaguaggcuagcagucuuaacucuuaggugaugucaagauauacuauuaacuugggcugugaggagaaauucuagucuuuuagaauguuaagagauauucucagaauauuauaucaccagaagaaagaacauagaaaaggguaauguuuaaaaaugaccaaauuuuaauuuauauacacaugaaauuaucaaaaacaaaaguguacucagacacaguaacauaaaauuguaauauaugcauuuugagagguggagacauaauagcacagguuuuaaacugucauggguugcauagugagaucaccucaacucacucacucacucacucacuuucucucucucucucucacacacacacacacacacacacacacacacacacacucaggggaggggcaaagcuuuugagauacaaagguaaaaaaaauuacuuugagggcuggagagauggcucugugguuaagagcacugacuguucuuccagagguccugaguucaauucccagcaaccagaugcuggcucacaaccaucugugaugggaucaaaugcccuuuucuggugugucugaggacagcuauaguacauaaauaaauauuuuuuaaaaacguuaaaaaaaugcuuugagcaugugugacaugauuuuucuuacauacaagagaaaacuauagcauucgcucagguucccaccaugacugucucugaagugcauaguuuuaaagugaccggccucucaggagucuccauuuuauuuaacuuggggcuuucucuaagguuagcuuguuaucagaaucuccaaagauuacauucuuuuuuccuuuuuccugagucuuccagcacuauuugaagcuuaaguacuacuuuuuaaaguaaaauuagcuuuaaaaacacuuagacuuggcgaauguccucggacagugaccacagagugcaugauuaccacuuucaaugugacucugguaaauuagucucucauuuucuuuuuaaagaucguuguuacauuaaccuuaaugguugaguaucaaccugcuuagccugccagacauagaaagacgcaaauauuccugguuaccacagcagcaagaugacaauacacuaccaucuagcuuaucuagggggguggggggagaaaaaaaaagaaauccacaaacaaaaagaaagcaaagcagguuucugagcagcaaaguaaagugauuucucacaaacauuagaaacuucaaaagcuauuguaguguuaacaaauugaauugcagggugggaggugauuagaaagagaagugaugugauauaagcaggacaguuguugucaaaauugauagcugccacaaaagauaguguguugguuagguuuaugucaacuucacacaagcuagagucgucucggaaggaggacucucaguugaaagaaugccugggaagaguggccuuuaggcaaaucuguguagagcauuuucuugguuaaugaucgaugugaaagagcccagccuauuguagcugguacagaagaaaguaggcugagcaagacaugagaaagccaauaugcaccuuccuucauggccccugcauuaguuccugcuuucagguuccugcccuggguuccuugccugacuuucuucaaugauggcugugauguggaaguagaagcaaagugaacccuuucuuccccaggcugcuuuaggucacagucuuucucauagcaauaaaacccugaguagacccauaacugucaagucccuacacaggcgaagaguuguagucugcugauagcaugugcagaugaggaauccaagacacuucuguaguccucuuaggaggugugugcucaguuuccugacauuggccuaccuauucuugugcggccacuaaucaccauggauuuaaauacacacaccauuuguuauuuagugccaagucauuugugaaauaaccaaauacaucccugaaucugacguuaauccugaagaaaagccacagacuaggaaucaaagauaaggugugagguaaggugaaauaaaugaacaguuucgaccauauaguacugcguauggaaugaaacauugcuucuguaauuuccuagguaggaaagcacucuuagucauuuuaaacaaaauugguucucuugagaguucaacuuaauucuccccuucccuccccuuuucucccuuccuccuuuccuccaucugcuuuuuacucucagccccccaacacaaguuaaauuacucaagcuuccauauaucuaguugguauauaaauguaucuacugugauagaauucaaguuugacuuucauuuuuaaaucuauaaaaugagcacauagucuguaaauugguuauauuuauuuaauugaaugccuauuagguacagauugggggaaaaaauaaauaucuuugucuuaaccuugugcuauuucucuuagaggaaguccacaaaugaaggggauaccucauuuuaaggaagaacauugugccccagcauugaauuuagaaaugaagaaaauacuggauuugcaagcacccauuaugagguaugguaugcugguuaaguuugagauuuucugaccacaaaagaccauguaguugauuaaaucauaugacaaacaagaaaauuguuugcauuucaaaauguauaaauuaacuguuugauuguauggaaugauaacauacuaaaagauucaaauaaaaucauguaugagaagaaaagagggagcugucgcucucugcagccuccauguguuucuuggaaguacgaguacacuugaaggaguguuaagcuuucugauugcagugugaguagaugucgugugacaaggcaguaagaacuacuaaagcacagaacucuauucucaauguuuuuuuuuuuuuucaguuucacuuuacuaucuuaagugcuucauggcuggccuuuuauuuauuaccguccuucccucugcauacaugauuuuugugaacaguacacagcugugaaaacaaaugaggcucaaucuuuaagagacuuuccagauacacuguugguuaaagagcaagguguauacagugguaagaaugcuuggucuuaaaugguauuagaaguuuguugucuagaagaguacauaaguuagugggacagguuuagggaaaaguuuuuuuauuagguaccuuucagacguauuaagccauggaccaggaagauguagguaaaagugcuugcuuccaaaccuaaugaguuacuuccccagugcccacgugguaggaaugaagaauugauucccaagguuggccucugcccuucaaacaugcaccguggcauguccaagcacccacaccccagauaaauaaauaaaaguguaacaauuuuaaaaacaaaaagacugagcauauuacuguaguauggagcuauuggacuauauaaaaauguaauuccaacauuuuaaaagaccucucugauuuauaguucaaacgaagggcaucuuucaccauuuuguuguuguuguuaaaccaccacucacuagaacaaacagcagaguugacauuugagccgugagcuguugucauucccuuguguagucugugcucuuauccuuuagucuccgaguggagaagaaagucuuuguuacuugcuuaaaugagauuaaacugaaacauuuuaguuuaguauguucacuguguugaucaaagguuacugaucacuucagauuuuauuugcucaugauaaaagcccuuuuuaaagaaugcaacuugaaguagcucaguguguaagaguguuugccucauacgcaugauacccaaguacaaauacucuaccccacauaaaaauauguguggaaucacagccaagccuguaacucuagugcugacgugggcagaaggauugcuagggacugcuggcugccagccuagcuccaguucuguggaagacccuuucucaggggagugagguacagugugauagagcaguauacuccuuggccgccauaugugugaacauagaugugcauacaccacacacacgcacacgcacacgcacacaaacacacacacacacacacacacuauuaaaguuagaagacuugaugcagaaggaauuuugaauguaugugggcaccaaacaaggcaggacaauacaacuugguuuuauggcuccaccuggugguaaagccauguagcacauggaaacaggauagaaagucuuuacaaaaagaaugucuggaccgggaggggacucaauaguagagcauguuuucaccaugcucauggcccagaguucuaauucuggcaccaccaaagggaagggaggaauugcuuccaaauuuuaugacauugcuggauaguuuaugugaaccugacacaagcuaaagucaucugagaagggaaaaugcuuccauaaaaaaggcuuguagacagucuauaaaguguuuuucuuaauuagugauugaugggguagggcccagccugugugaguagugccacccuuggguugguuguccuggguucuauaagaaagcaggcugaacaagccauaaggagcaagccaguaagcagcaccccuccauggccucugcacgaacuccugccuccagguuccugcccuguuugaauuccuauccugacuucucugaugaugaacagugauuuugaagugugagccaaauaaacccuuuccuccucaacuugcuuuuuggucauaguguuucauagaagcaauagaaacucuaacuaagacaauggcuuccaccuguauaagaguaggguucugcaaguuuagaugguuggcaaucucaguuuucucucaaacauccaaagaaagaauuacauuuuaaacaccauuagcuggucaaauacauacuucuuggaaauucccuaucccuauuaacacuuguaaauaagagagaagacacuaaaagacuauacaaucagcuauuuucuacuaucacaaccaauguaaucaauuaaaauuaggaauaaugguuaucuucuugcauauaggagcaaaaguacugucaccuuuucuuuuugaucaaauaaaaaguaaagauuauuguuaaguauccaucuuucauuauuacuugaauauagagcauguuuaaaagauaaauauuuguaauuaugaguuuuaauaauugguuaaucagaaauacuauucuauuucaaauuagaugugacagaaugugaugcauccaugauauuccuuauuuaccauauuaauaaaauccuuuagaacucagucagaaaccuaaauugaaaaauacccauguuugagaaaugugaggcaugguggggcaucauuuuggguauaugcccaagaguaguauagcugggucuucagguagauauauuuccaauuaucugaggaaccuccagauugauuuccagagugaauguaccaguuugcaaucccaccagcaauggaggaguguuccucuuucuccaaauccucaccaacauguauuguuaccugaguuuuuuaucuuagcuauucugauuggugcaagguggaaucucagggucauuuugauuugcauuucccugaugacuaaagacuuugaacauuucuuuaaaugcuucucaacauucaagauuauguuguuauaaauucuguuuuguucuacaccccauuuuuuugauugguuuguuugguuucuuggagguuagcuucuugaguucuuuauauauuuuggauauuaacccucuaucggaugugagguuagugaagauuuucuuucccaauauguagguugccaguuuguccuauuggccauguccuaugcuuuucaaaagaagcuuuccaguuucaugagguuccacuuaucaauucuugaucuuagagccuaagccauuggaguucuguuuaggaaauuucccacugugccaguguaacuuuuauauguacuuaaaacuaaggaugauauucagaacauuuuaaaaaccaguacagcaugaaaagaccuaauuuguugggcuugacauuuauccuaaaauuaauugagaguggcaauuggguagcuugggacaaagcccauuuuucaacauuuugaagaacuauucauuaacgauggacaccagccauuguucaacaaguuguuuacuuuuaauugagguaaauagaguaucuuauguagauucuccugggggggggggcgggagugacaucuguugcucuccaucauauuccuuuuuuuaaaaaaagauuuauuuacuuauuuuguauauguguacacuguagcugucuucagacacaccagaaaagggcaucggauucauuacaguugguugugagccaccaugugguuccuggaaauugaacucaggacuuguagaagagcaguccaugcucuuaaccauugaaccaucucucuaucgccccaccccaccccccuuuuuuaaugguuucucuagaggguuucuuuguguaaccuuggcuguucuagaacuuacucuguagaucagccuggccucaaauucagagaaauuuaccugccucugccucccaagugcugggaucgaaggcaugcaucgcuacuacuuggcuccaucacauuauuuugagauggggucacucacuaaaccuggagcccagugauuuguuuagccuggcuggcuggccagcugacgugggagcugugccuaugcauguccccagcacuccagugcuagaucucagauacaugcuacuacaccuagccuuuuaugugggcaccaggaacagaaucugaccuuucccugggaaagagcauugcagggggggggggggggacagacuggcaacugcacgacccugaccuuacucggguuguucuuccaaaccugggagaggcaggaaucaccaacugagcugucuucucagucuucaucuagauuuuuuuucauuuauaucacaguuauuuuaucugcuaauccaacauugggauuguauaauagucuauuuauauugauggacuuuucuuuuucuucugauucauauuuuucugucuguaugucuggucaguuguuacaguuuuuuauuauagagauuaugaacucuauuaauuuccaggcauauagucacuauguguggcugcugaaguugaaaacuuuuaagacugguagaggaugguuccauggccucucugugguuucaauuuaucaucuucugaaucguuacaccucuucuuccucuuccauaucuucuucagucacaccacacugacaccccauuugucuuuaauuuguugccucaauauuuguacuuucuagccuagauuaaauuauacuaaaguuguagacagguaguguucuguaaggauaugaugauuggcucugcuaaagcauuuuccuucugucauuuuuguuguuuuguuuuagaagacagagucucauugucugacuccugaccagccuagaccagaguguguacaccaggcggacuugcagaguuuuaaggccuccugccuuacugaugcucagccuugcuuacagaacuucucccucuccuucucccucuccccacccccccaagccaugugugugugugugcgugcacccaccugccucugccuccugagugcuagaauuaaaggugugcaccacaauagcuagcuugcagaagcaauuuuugaaagccauuauauuuauacucauugcuuucccaguaugcugucuugcaagguaauugacuugaguugcuugcuuccguccaguuugcagucugugcuggaagaucuccuuguugcaacuucugauggacuucuucaucuuauucauugggaaggaaugacaaauggaagaaaagccaucaaucugucuacaguaccauuuucaguagaccuccagucauccagagguaguuauacuuuguauaugagauagaaccaguuguuuaauauuggguguaugguaguacuacccaaauaugugauacaauagcuuauuauaacccuacucuauuuauguguuuuucaucaguugguucauuccucggcuuugcagaugugcacauuaaagauauggaauacugugccacacuugauggauuugcuguuguguuuaaugaugguaaaguuggauuuauuacaccaguauccaguagauuuacggcagagguguguauuguacauuuuaaauuauuuuauuuugcauauauuaauuuugcuuuguuuucaaauccuaugcucucuuaguucacauaauuuuuauuccuacuauauagacaguugcaggguuauugacuuuauccuauggaaaaugaccauuugcuucaaucuucuucaaccccaacacacucauaaaucuuuucaauaagguuauuauuguaaugagauuauuauccauuguuuauagauuagucagcaaauaaauucuguuaauaccaaacuauauaauaugccaaugacuaguuuuuccuuuucugcagaguuuuauuuccacuaggaguuaauaauuguuuguuucuuuauguuuaguuguacuuuguauaugcauguaugccuuugcuuaugcacacauguguguuuguguauguggaggguguguguguguguguguguguguguguguguguuguggagaccagaggucaaccuaggcucccauuccucagucacugucaagagcuagagcuugaaguagacuaaacuaacuagccaacuaguuuagagacccaccuguccuaaccuuuuuauguacugaaauuacaaguacauaaaaccaaacuuggccuuuuacauaggcucuggggaucgaacucagguccugaugcuugcaaagcaagcacuuuacccaaugaguugucaccuagcccuguguuagcguauucuuuaugaacuuacuucuuaaccccaaaccgacuguccauuugguuuuucauuagguguuuguuuaaucuucuuuaagaauuuucuguuagagcucuauggccugcuccagacagacuucuccagauugguagcuuacacuagaccuuuaacuaagauguauuuucuggguuuucgucuucaucaucauuugcaucaucucaaggagacucuuucuucucuuuuuccuuuuaauuguauauccuuuaaaagcuauugcuuuuuuauuuuuagauaguaaauauauagauuuugcugcuaugcagagacccaaaguaaaauuacuauuuucuguuuuaauauauuguugacugguuauuuauuuaaaggguccuauccauccuuugguuccuucccuccucauuucucuuccucuauucuuuuuucuuccucuccucuuuuguuuucuccacuguuccuuaaaaagaauccuauagucccuuccagaggguacauagaccugacuaccccaauauuuugagcuuuggaagacuuaaaagcuagaagguucaagguguaaucuuggacuuuucuuuaaugugcacacaaaggaaaaauguuuagcuuucuauuggaguggaaguuguucuuuguuggcuguucacauuaggaauaugcucagcaaggaaccaagucuuccuaaguagacucugacccaacucuaccguucuuucagagacccccaaacucccaggcauuuugugugcccaacauggagaaugagcuaguucuaagcucucuuuauuauuucucagcuucuaacucgaaugcuuuccauuucuccuuugucuuuacuguuuuaugcuucuugagggaaaauauuuagaugauagucuuugugagaaauuucuuaugcagguaaaaccaaaugauaccuuguuaaauugaaucuuuuucgaauuauaauuauuggaucaacaguaaguuuagggaaacgcuuuuuaagcuuuaacucuuugucuuaauguagcaacuucauggaguuuggccacaagauguuauugaugggacuuguguugcaguaaacaacaaauaccgacugauggccuuuggcugugcaagguaauugauaacuaaguuaaaguaagguaucuuaacauacuuggguaccugauuaugccugucauaauuaucauucaucuuaauauaugacauaaagguguuuuauuauuuugaaacaaagguaaagaacugauuucccacacugaacauuugaauuuguaaaaguaagguguuucaacuguagaaaguugagauacucauuauaaagaauaaacauuaaaauuuaggaucuuuacuguucauccuguaagacaucaggauuauuguuaauuccuuaauauaucugaggaggacgucuucagaaacaccaucugccuuuugaaaccgugucucucacuugccuggagcucacuaauuagacuagacuggccagcuagccccaaagauucaccugucuccagcucccugguguacaguguacggcacugggccugccuuuucauguggguucuggggauuaaacucaugcuuaugcuuauguagcaaggaccuuacaugaugaguaugucauuuuauuuaauuaguagauauucauaaagcucacauguaaaauuaguuggguuuuuuauauuguuuugggguuuuguuuguuuguuuguuuuugcugugacccaugccauggagaguuuuaaaauugaaccgugaacauuuaugacacauuuauaauccuagcguucgaggggcugaggcaauaggauugugaauuugaggauauugauuauagccugggcuacauaguaaagucuagaccagucuuaguaaauuccuuuaaaaagggagggugggagggcaaaaauaaauggggaggaggagagggaaauuuuauauucaugauuugauuuauccauauuuuacuuaggauuuaaaaaauguguggucaucccuauuaugugugucuccuaaagcaagcagaagaggagggugccuauguguggaacacacacauuugcugcccagguugaugcauaucgcuaaagcucuuccuuuucaauguuauagacaugauacuguaagaauauaccacuguuuuccuuccucuuguugcuauguguucagauuguuuccauuguuuuguaauuuuauauaguagagugaacaauauauguguuuccuggaaaauguuaggaauuucuagaauauuuagaaaggaaauagccaucacugccuaagcauuuguucgggcuaaugagaugacuaauuacuuacagaaugguuuucuacuuuguacaccuuucacuagaacauagauucccaugauagugccuuucuguuuauauuggucauuuuucacuaacaguauuuguuuucacaguggcugugugcagguuuauacaaucgacaacacuacaggagccaugcugcugucccauaaacuagagcucacagcaaagcaguauccuggugaguacuaguaaggucugucuucgucugugagguuggaucccagcacugccaccucuccaacucuguauacugauccuuacacauaaaggcuuguggcaguguuucuuuuauaaauuaggcauaagcagagauaaccuguauauucauuacuuuucucauugcugugacaaaauacuguacaaaauuaacuuaggaugggaugcucagcggcugaaagcugcugcccuuccagaggaccugugugugguucccagcacacauggcagcuccaacuaucuauaguuucaguuccaggagaaaagugcugucuccuggcuucuacaggcaccagacaugaaagugguccauagacaugcaugcaggcaaaacacccaugugcauaaaguauuuuugaaagagaaaggaagcuguguacucuggcuugcaguuucaggaaguacagccugccgugcagggaaagcauggggcugggagcauggggcagcuggguccagcaugucuguugucaggaacagagagcgaggggaauucugcagcuuagcuugcuuucugguuucugucugguccggggcuccaggugcugcccacucuccucaaggaggccuuuuuggaaacauccucauguauacccagagcuguguucccauggugauucuaaacuagucaagcugaucccccuuuugauaauuacacuguauucauguauugaacuaucgcaguguguuccauaaacaacacaguuaaaaaaccaaaacuuuuuaaaauaagugguaauaaaauagaaaaauuauaacugaauggggccuuucucaaacauuuggguggggguggagagauguggguucuuggcuaugucugucuacuacacccgauuuuaagcccucagguaucacagcauuagaguuaaucuaugauuauauuucauguuuugucccagaagacucaaagggaagaagacuuuuuguaggugaugccccuuucucuuagcucaaguucuuccacuccgugagcaucuuggcagccucuucuccauuggcagauguagcaaccgcgcucucucucucucucucucucucaucuuuccaucauccaucugucuucccuacuuuucagucugucuauaacauauguuguguacauacauauuaguuuuccagugcaaaccuauuuucaauucucugucacugucugaugccuaaaaaaugacagauguugggggccgaaaacaguacagaauucuuuuuccuaaguuuuacaugagaagaaagucuuucccauguuagcccaggcugucugaaacucacuguauagcccagguuggccuugagauuauagcagucauccuacgucaaccucccaaguaaaaaagauuuguucuuaacaaucaaagucaacauacagguuuuuuuuuucuuucauuaagacccuucaccucugcaguuauaacaguguuuccauguucucuuauacauguuggaaaugccaacacccuugugcuuuguggccauuaagaaaaauaaggguuucacgaacacaagcucugcuauacugaaacaguguguguaauucaauuuugaaguuuuuacuucuugaauuuuuccacuuaauacuuugaggccacaguuaaucuuggguaguuauuaaguaugaaaaugaaaccacugauaaagggaacuacuguacugguaaugcuaagcuuaacaaaucuaacuuucaauucaauaauguagcacuaaguaaauauuguuaagaaauauaugauaagagucuggcccaagaauuguguauaaagagaauuaaaggggcccugggauagccuuucaucccucacugugucugguccucacuuaauuuaguuuuagcuucuaguuuucuugucuagaccucucugcaaucuuuaccugauuucaauuuauucucccaaauacugaguacuaaacugcauguuagaucaugaucauaaaauagcccugaguuccaaccuuuacuuuuuggcauuugcaugaagaaggaagcaaucaagauauauucugauuuuuguauuuaaagugagaaacggaaaggucucccagaauuagcucuaucuacuccaacuuucuccuucuaauugaucauagguaugucuuauagcuauguuaggcuuuaagaaaaccuuggaaguaguuuuggacaagagaggaggguggcaccagaauuggagucugucuccagcagugucucaguuuaugcagcacauuaagagcugccaaauccccauugugcuuucuuuauguuuacuaucucugugguuguuauguaaguuaugccaaagguuuuguuuguuaaguuauuggcuuuaaccuaccuaauaucgcuguucuaguaauuuaauaacguuuuuaagugcccauaaauagaauaauauuugaucucauuuuuuaacauuuuugugcuaauggaauggguacacuuauuggauuggaaauaaccaucacuugucuuccucggguacuuucuagcuuaguuuucgugacacgauuccucacagacucuggagcuugcccaggucaaccagacugcaaaccccagagaucuuccugucucugccccccaccccuguuacuggaauggaaggcacagggcaccaugccuagcauuuaugugggcucugugaaccaaauuuagguuucagucucaaugcuuacccagugagcaucuuauaaucugagccaucacccaacuuuugucuuacuucauuuauuauugaggagggagggaagacagucacagcaugcuugucgugggcagggggcagcuuggaggauugguucuccccagcgugggcucuagggaucaagcucagguccgugacuuggcauaacaagcacuuuucuccaccacagcaccugacagcccuuuugcuucuuucgcuguaagaagagugguuguuuuaugcugugucugcacuaaccugauauccagagacuuugaaucuaccucugcuuugacauaccucuugggauuugauuauuuauauauuuuagcauuguuuacuaagagcugauguuucuugacaguuaaguuuguggaugcuucaggacuugcacugcacuguaagagcacuuggguuacuauuagaacccuuuaaauuguguucucuauauaagugguguauuuuguuuuguuuuuuaacuauauuaauuacacaaauuaugagucaugugugacugaggacugugacgggacuuuuguuucuguucuguguauuggaugaaacauggaaaaauugccccucaucuacauggcagguucucucuuuccuuugugccauggaugcagcuucuaucaucuuggcauuaccugguauccuuacuagauuuccaggugugggcaagcucugaucuuuaucuccugacccucacaugcugugagagucaccaguaaugaugaagagucucagaguuuggcagauaaauucagagggaaaguacuuucuccaguauuuuaagacauucaacaucaugguuucagugugaaaaaucauguaggauauugucugguguaccacaaagacagaucacacgugcuacauaaaauguuugcugcaaccuuaucccaauguuacagaaacugguuuauaugaaacaaaaggcuuugaggauuacacagugguaguuauucaagcuaauccagaaggccagccuucacuucccauaauucaccugcuuccugagguguucaggccaaggcugaugguggccuuaguuuucaguacccuccacagacggguucauccuaguuagaauucaaguagucugugcccuucugcuuguucagauuuggauauauggcuuguaaaaaguacuaaguauuucuggacaaucuuuuuuaacccuucucacuaucuuuucacagacaucuggaacaaaacaggagcuguuaaauugauuagauggucuccugacaacagcgcuguaauaguaaccugggaauauggaggucuuucucuguggaguguguuuggagcccagcugauauguacacuuggaggagacuucgcgugaguggagagagagagagagagagagagggagagggagagagagagagagagagagagagagacuuuagauaagugacccauuguuucccugacagcucauauauucauuaaugcaggucauagaacuaccuuuauuuaaaauuuuuaaaaaaaaaacuguuuuacuguuaaaaaauuuuaauaguguacaaaauaguugccaacauucgagcuuaggauuccaucccaugcccaucagggcacugugcucagaucucccucucacuaaacacccccacugccuucuugccguguggcauucguaugugaaucuagacugcaugcaugguagagaccaugguguuuucucugucgcuccucaguuccacuaccccucucacuccuccugucuucuuucuuccaggacauacuucucucauagcccccucucacuccaugccuguguauagauucugcguaggagagacugugggacgcucugucugucugaguuugguauaccucacuuaacgugaccucuagucccauccacccuguuuuacucugacaccaaaacaauugauaaagcucagauuuaccuuauugagaauauauugauuuuucaaacaauauauugagaauauauugacccaccuaaaacuacaguugauuuaguaaaaauguauuuagugacccaaacacuaggagaaauaaacuucuuuuugugagcacaguuauguauaugaccucaugucaaggccagcuugggcuacauaauaagacccugccucaaaaauagcaccguggaaagcuaaaccaaaaagugcugcuuuaaaauagaaauauguaauaaugcauaaguguuucaguuuuguguacuauuaauguauuuuuacuuuaaaagaacaaagucaauugauuuuuauuuuaagcugaagcuaaggguauguauauuauaggccauggaagacaaucaaguuucuguuguguuuuaguuacaggucagaugguaccaaaaaagauccccuuaagaucaacuccauggugaguacuuucuguuuaaacacaggugcagcuuguaaaccucuacacccuauaaaccucagggccuuuucuuuuucucacauugauuucacaaaaucagagaggaguuuugucucaguagauauuuucccauauaguucauuuuugaugaaauguauuuacuugcauauguaagaugagguuucuugcucuguaaccaaggcuggccucaaaguacauagaccaggcuagccuugacccaauaauccucuugcccuugccuuugccuuugcaaugacucugucuuuaaaaaaaaaggguagacgcuucugagaaaugaccucuucuggcuucuguauacacacacacacauacacacacacagaguugugcauucacccuccacaugccucacacaaacacaaguuuucauacuaguuagugucuuuaaauuucauauauuaacuauuauuaucagguucauuaaguugguauuucaacuacaaacuaaagauccaagcaguuagcuccagguuuacagagacccuaucucaaagaaaucaauagaaagcaauagaacaggguaucaucuugcuuccauguguaccuaugcacaaacagauucacacauauauacauacacacaugaaauaaacaauuauuuagcuuuuguuuuuuccuauuucuuuuuucuuuuuguuuuuuugagacagguuuucuccguuuagcuuugccuguccugaaacuugcucuguagaccaggcuauccucaaacugccucggccucuuucucccaagugcugggauuauaggcguguguuaccauuaaacaauuugcagcaguuugugaaguugcuuacauauuaaaaauuacuagcuucaaaaauucuaugguggaaccuaguuacagaaugucaauauugauugggcuuagaggaauauauuuaaaucuuuuacuguacauuucucaacugaagaaaccucuaucuaaagaaacuagguaccuugaccaacacaguauuacuaaacaaggucaagcugaaauaagaacaagugucagagccaacagccaacucagggcuccuugcuguauacaaaggucacaucuguuauaaacacuuucucacugagcuucuagucauagucagagcucaaaaccaggucaauuaaauugagauguuacgaaagaauuuuaggacuguaguccugaaguugaagcugagacguuauauaguguuuucccacucuuaaguagaaggcaaugacggugaguuccccgggcgagaguuaagauguacuagaugacaagaaucauugauucuguuuuuuuuuuuuuuuuaaauaauuacuuugugugucuguauagaugauguggaugauguguguaugugugagcagguucccauguggaugccagaggacagccuuauggaguuggcucucuccaucauuccguggauucuggggaucaggcucagauucgcucacuuucacaccgagcaucuugaccugcugagccaguugucuuacccuggaugugggucuugucuguuauuugucaugguugcuccaguauucagaagacaagaauugugccagggguuauuucauacauugacuguuuucaguauuuaacugagguuauaaaagaaaucaaaauaacuuuguguugcuuugauuuuuuuuuucuuuuccuucaagagcuggggugcagaaggcuaucacuuauggguaaucagugggcugggcucucagcacacucagauugagaccgaccucaggagcacaguuaaagagcccagcauucugcuguuucaguuuaucaagaguguacucacugugaacccuuguaugguaagugauuaaaacugggguugguuuguuuguuuguuuguuuuguuuuguuuugaucugaaugccucuuagggcagaauuuuagaccauuuucuaugucccacagauuuuaauauauuucuaaaauuauuaacuguacuuucuauguauauuuucugugauucaaauauuucuauaaaaugccaaaaucuuauuucugaacauguuuuggacuugguuuuuguuuguuuguuuguuuguuuguuuggcaugggauggggauuguuuguguuugauguuuuauucuuuuacaaaaaaauaaugcuacaagcaauuugaaagaagccauacuuacauguaagauaacuuagccuuuaucuggguaagauauccaaaguauguucuacuuagauacuacuucaaaauauuaauaggugggggcuggagagauggcuaagcgguuaagagcacuaacugcucuuuuagagguccugaguucaauucccagcaaccacauaguggcucacaaccaucuguaaugggaucugauguccuccuuuggugugucugaagacagcgacaguguauucacauacauuaaauaaauaaaacuuaaaaacauguuucaggugguuggggggauggcuuaguccauaaagagcuugcugcacaagcuugaggaccuggggggaagguuggucaugauagggugugccuguaaccuugacccugggaagguggaaacaagagucagcgagcuccagguacaaaacaccagguggagagugauugaggaagaccuucacuucacacucucauacaggcacucguaaagcacucaugaacacucaugcacacacaugcagagagaacaaaaauucugagaccagggcauaauggcacacacuuguaauccuacacacuugggaggcugaagcaaggggaccacaaugaugauguauguuaauaugcuacaguuauaugcuauggguacauaucucggcaccauuaucaauggcuuuuuaaugcuaagugguguaacaagaaauuuaauuuuacaauacauugaaaauuaaugugaaaauaacccagaucucagaacucuauacuauaguaaggauccacagaaaaauaagaagagaguauauuuccugcccuuucccauuccagauauuuuuagagcccccuucugggcuggggugauggaucagugagugggugagagcugaauucugagugcccagaauccacggaaaagccaggugggcauggcagccaucuguaaguccagcaggaaggagguaggcauggggcauuccagagcaagcuagcucaucuaccuagccagaguggcaaucuucagguccagcaaaagaccuugcuucaguguauaaggcagagaagaacuguuaaggaagagaccugacaucaaucuugagucaccacauacacaugcacacgugcaaacacacaugcauacaugcauaccacacauacauguauacaaaaagauacgcacacgcgcguguguguguaugugugugugugugugugguaauuuggacuaaaugggaaaggaauagaauauacacugucugauuugaauauaagaaucuuuucaucuugagagcacuggugcucuaauuaaaacucaaggcauaauuaacuaaaagcaggcacuguugcaccucugaguaaauauagaaaauugcacagucaguuguaagcaaucuguauuuacauguaguuuuucagguauaguucucagagugucaccaugugaggugcugguggaagguacgguucaaacaauugggacaaaacacacuguacaaaaaacguauuugaacuaagaaucacuaaaauauugacucgucucuaaauguaacauacaagaucauuauguagguucugucaugugaaaaaaaaucaguauugauuuaugguacucguucaguaauaaaacuaagacggcuuguuacucaguugucccugccuauugcuagguaucuucauuuguuuucccuuuuggccuuauuucuccaucuagaguaaccaagagcagguguugcuucagggagaagaucgcuuguacuugaacuguggagaagccucacaggcccagaauccgaaguacucuucagcacgugcugagcguaugcccaggcaugagaagagcccauuugcagauggaggucuggaggcuccgggauuaagcacuuuacuuggucaucggcauuggcauguugugcaggugaguguucauuuacugacugcugcugacucccugauuagaaacggaucacuuggaagguuucuaauuauuuucaucgcuaucucucucucaaugcuuugguuucuuuccuugccuuuuuucuuuccauuugauagaguauauucuaaaaguuauuucuuuuucccucagugaagauuacuuuacuuugacccucuguuuugcuuacucuaacacaguggacuugcauagcccaaaguauauccacugcauggcaagagauggcuugacuggcaccuaguacagcugacuuuauggcuucagcaguuaaucacuuacacuugacccaaagugcaacccucugaacauuugagaaauuuauugcucauaauuuuauuuugauuuaauguuuuuccaaauuauggauucauccugauagcacauuuaaauuagaauguucauuuaguaacuuugacagauugacauuugaaauggaucaauucugaauuuugaugucaauuaagauuaauuuggugcaguagauaaauugaaauuucuuguaauaaauuuguaugcauaguuucaaaguuuuaaguauuuucuuucuccuucuaguaccaaaaugacagagccugcucuuggauuaguuucuuuuagucaauuuauuuuucauuuucuuuuuccuuuccuuuccuuuugagauagaauccugcuaugugguuggucccgaauggugggaccuuacgcgaguacuacuacacgagcuucucuuaaucaguuucuguuuucauaaccccuugccuucccucugcuuauaucuuacuaguuugcuucagcucucauaucguuuucaguugauuuugagaaaaugaaagacagaaaaguggucauucucugagguuaaaugaggaauagcuccuacauugacuuguaguaugcgcugaaaaaaauguauuuaacauacauuaauaaccucaugagaucaaaacaauguacauaccauuuuauaauuaguaacauuuuaaaauauagaacugcaucagcuacuucuuugacuaaaauuuuccacugcucccuucucuccuauagccauuucucugcuauuuucauuuccccauacuuugaacuauucauucuacacugaccuagaaucaaugccacuucugccuagccaggucuguguuaccagagagccaaguagagcagaggaucgaagaagguaggucuggaacuaaaacauccaucaggcaauaacaaaauugaauuuccuuccagcucaaaaauucaaugacucuuagccgucucuaaagcauuccacugaacaagcacacagcacugauuuuaggacuguagguagcacaggcugucgucugaacgcuaacuguacucacuugcccagaugaaguuuuaaguguggauuuaccuaggucucuucaauucuuuauucaucucuguucuuuuaguuuuaaauaaagauaaaaugguuugguaagauauuuguaaaugguuagcuuacuuaccauuagguuaaacaaauaguucacaaaaaauaaauuaaaaaugccuaaaacuuuauuuugcuuuggaacgcucauaaacccuaaugagaaauaaacacuuaaaaaccaauaaagauauaaauaaagauagcugugcguccaagacauuuaccuugaaguagaauuuuaauuucaaguuucauagaauguuuagaguuagaaggagccugaaggucaucuaguccaacagacucugcaugagggaguucccgcgacuccugcagcauuauaggguacacuacacuggcuuacguagccucggaacggccuacauugaagaauccgguguacuuuaaaaucuaauuaauaguguugagucuuagaauuuacuauugaccuuguacuaaaacuuagaauuugcccuuguagcuuuuuuuuuuaaugugagagucacccugcucuuugcuugcugacaccggagccugaaugcagagugacaguggucuuugugggaacuggcuaugugcagaagcucugcccucuaagcguccccaucugucaugaggacgucccguccccuucccucucacccucucauggaggguaagaccacguucucuauuaaagucgauuuggugaugugcuuucuauuuugugugcuuacuguauuauuuaaaguucaucuaaugagcuucacuaauucugcugugcuuucugcccaucaucuggaacacugcaguuuguuucuuuuguuuguucaacccuucugugucauauaacuuacguuccagauuagaagguuuuguuaguuauaugucucuagccaaacuaaaugcauacauacuuguuagaagcaaaguuaguagccagcuguauagacagugccuuucucaguuuauuuuugauauuuaauuuucuuaauuacaaauuuagaaaguaacacauuggaacacaaggugaaauuuuuaaaaacccuucuaguuuuggcuguguucuuuguuggguucaguguuuuauauaaacauugguuucuacaaggucuugaagagagacuggcaaacccuccuaagaugggcaagacuuuucugugccccagcucaguuucccagugauguggcauaacgccugagcccuaacuauacuucccuuuauggccagguuucuccauucuuuauuaguuucccucuaccuugacaccauuucuacacacagcauuaagucuauaguacaaaguccaaaugacacauagauaaaagaagguaaccuuaggggaaaauguacaguuuguucuaguaauaaaacaagacaaaauuaaagagcauauuauuuuaacucaacaucguuuauaauuuguaguauuucauagacuuuugaagguuaaaacaauagguuagguuugcggguuauucuguuuuggguuuguagggauauacguaagagugucauaauuugauaagcucuuuccgacccuuuuuauguuggaauuauuuuuacagugaugcccuagcucacacaucacauuucauacgaaauagugaaagaugaagguuuggggaggggaggguucuuuuuuuauuaucuuauccgguggcagugugcugcuuauucuggugcaccuguuacauccuuucuuaaguaacggacagcuauucauucacugauacuuuuaagcugacugucuggagagcugcgguuuaauacucuaugaguuaauuuuauugagaauagugcaagugcuuugcguucauugcuuuuacuugauucuccucuauaggcaacuuacuagauuugauuacuucacauaguuuuugauuuggguuucuuuucuguauauauccaguguucuugagucaaauuaaaagaaauuugaauaaacugaaauuuuucuuauuccaggagcagaagacucuuccauuucuguuuuucuguuaauucacacuccgcuuccuccagcugcucaugaaagcuaauuaauagaguaggaguguauagcacuaaacuuacuccacauaaauagcccacaauuggcucugcauuugaacauaguguccuagcacugauaaagugacaccaugcacaaaggcucaagcuggaggccauggggacuguggucacacuggugcucaggauggaggccugaugucuauauuguguaaaggguucuugugggucagucagguucacagccaaauagggaaagaguagguuaaguguauucacacagcucuguggguggucugcucucuuaagaaauaagccaggugcuauucugaagcaacacaguuuuuguuuguuuuuacauugauuuuauauucauugcuuuuuuuuuuuccaaucacaacgguacaaaaacaacgaagauuuccauuacaacccaaaauuccugccgaagcugccauuuauuugggggugggucuacgucagcugacagacgcuguuggcugcaguuuguggcuaccaucccgugcuucuuugucagugauauugagguuaauauuagaaacaagcaguucugugguggagaaggaagugugggucuuacaaccuugaaaggauuaagauaggagauguaaauauugguucauaaacagaugcucaguucucagggcucucuuacugaagcuaguauucaugcaggaagcugaaucucagcuugugugcuaaguuaaugcuuuaauuuggaauauauuucauaagucuuaccaagcugauauguuauuuccuauagauuuccagcaccuaucuagaaagcaauuggccuauacgggugagugugucuuuuguugguauuguguggucauucugggaggugagcccuuguggauucauugcaaagcucagugcuucaucugcugggcauuacuagugggucuccgccacacuuugucaauauuuaggcuuuuaguuuaguauuuuauauuuaaaucacuuagcaaacauguauuuauagucucuucacuuuauauuuuauuaaguacuuuauaccaugugcaggaaagagauuuuaauuuuuuuuaaaguuuucagcuauugauaaacuuggacaaaauauugcuguggcuggcaaguuuggauuugcucauuauucucuacucaccaaaaaauggaaacuuuuuggaaacauuacucagguuaguccuuucuuuuuuuuuuuuuuuuuuaagaaaaauaaauuucaagauacaaagcauaaaaaaagaaaaaagaaagugguacugcggcuggagauauagcucaacuguaaagugcuugcuguauucacagguucuuggagggaugagaagugggaagagaaacugacauuugauaauugcuaauaagucccuuuugauaaaauacuugauauuugauaaaggcucuuucauugaguuaauuggcuuuucauucuuguuaagaccauugacaaggccugggagauggcucagcuauuauaguguuuuauauaaaagcaaggaaccugagcucagaugcccagaggccacuuagaugcucaguggaaauggcaagucauguguaaugccauccuuggaagggaaaggugaggcagcccuggagcaagcagccuggagaagcuagucauagcagccaguagcucugacugagagaugucaccucaaagaauaagguagaagauccaucaaagaagaauucagaccucaagcccugguguacauacacacacacacacacacacacacacacacacacacaucucuuaacagguacaugaaaagaaggaaaaaaagauuaguagcaauaauuauuuagcauaggguuuaauauuaucuuuaagacugaguugucuaauguggggaaacuaaguguccacaaaauuagagggcauucuguaugugauaugugcgucuggauagcaggaggugggggguggaggcucagagggagaauguuugauuuuaugagagucagaugggaaggaguggagaaaguuaacauaggugucuuguguaccagggcuuuaaauggguugguguuaucagcccaguuaggacacuaauacuaucauuugccaaaagaucaggauucacgcacuugucugcugaggaguaaagccagaauuuaaaucaaguuguuuuagauguaagauuaauaaugcuauauaguacugagauauuuugaaugacacagcuguuucuuuuaggaauauguaauuuuuuaaaggacaggauaugauacauuguuaauaaaaguccuggagaaauaauuuugcaagagagaauaaagcagaaauaaucagagcuuucuaagaguauuauauuuguugaaaguuugaguaauauaauuaagguaagugcaucugaaauuuuucuuuuaaggagcaaaauaugauugugacugguggcuuagccuggugggaugacuuuaugguccuugcguguuacaacuuaagugaccgucaagaagagguaacuuuuuuucuuucucagaaauaauagagauuuaauuuuagguagacaauaagccauuaaaaacggaacaaagcauuuugucucaauaacuuagcuuaucacaauaguagacuuacuguuuagguucuuccuguucuuuuuuacagugacaaguugaauuuguaagauaacuauuuauauuauagcugagacaggaggauugagaauucagcuccauucugagcuaaauauuagcccugucucagaaguaacuaaaccuaaaaagaauaaccuuuuagguagaaaauaaacucuaaggauugauaaugaaacauuuaaaaguaaaaaauauaugagugacuguucuuaaggauagccuuauuaguauauugacuuauggugguuuugaggaaguaguagucucauuaauuggguuugaguacacagaucugauacguggucucauaauucuacauucacucuugaucacuuuaucuuugguuauuuaugaagaauuagcuugccaaaauauaaacauuaauuuuuuugcaaaacuguuguucauucuucugacugguguuucuuuaaagugagcuggggaggagucuggauaaagauggacggccugagagccuaagcaugcuugguuacccucugauuuauaugugcacuucuuuccuucuucagcucagaaucuaccuacgaacauccaaccuggacaaugccuuugcucaugucaccaaagcaccaauggaaacauuacugcuuagugucuuccgcgacauggugguaguguuucgagcagacuguucaauaugccuuuacaguauugaaagaaaauccgaugggugaguuauaacagggggugagucucucuugcuccucuuuaucagguuucuaaaccccuuuuuccaucuucauauuuuguuucauuauaaggaguuuuggugguaguaguugaagaaaagcacaagaaccugcuuuucucccuguguuauggggaggaagacuagcauuuuagcugagcuaagccuuagauacuuuuucccacaacucacacguugggggcuaauaaacuuuccagguccugugggaagguaaggagcuauccccaggaagcucccuucaucccugcuacaguggauauuguacugcagcccagaaaccuuauaguguugacuuggucaacuugcagcauguaggccacggggauauuguccuuuguucuuaaaaguauauauuuuuuaauaaguaaaugaauuaggugugaacugaaguaaugugauggauuaaguaaugcaaagauaaaaaauuagaacaucacuacuucaguagguaaacuuuuguuuuuucaaccacacuguugcccugaccuccagcuccccggguauuucuguuugaaugccuacugcugguuuggggauguucuguguugugguuuuauuuuuccugcuuucuagcauuuuacugccuuucacugucuuauuuuccuguauauggucuuuaagucucucaacauuaaauauauauauaugaaugaguacacugucacugucuucagacacacacuagaagagggcaucagaucccauuacagauguuugggagccaccaugugguugcugggaauugaacuuaagaccucuggaagagcagucagugcucuuaaccacugagccaucucuagccccaauauuaauaauauuaauggaggaauauuuggggaggaaagaacaauggggagaagacauuugggucugcuguguagacauaaaauguacugucauauagcaacugcaaaggaaaaaaaucugaacaucguugagcuaugaaggguuuuuuguuuauuuuucaguuccaauacuacagcuaguguccagguucuucaggaggucuccaugucacgguacauuccucaccccuuccugguagugucugucacgcugacgucagugaguacagagaauggcaucagcuugaaaaugccgcagcagguacuaaugccuuuuccgagcucuuagggggguuacauuucagucuguagugucuuaggccgguguuugugucuguuuauuuguugaacaaaugcaugcuaagugucuguaauguaccuugcaugaagaugcugaguuuuaguggcaagccaaggagaccagugucuggucaacauuaacaagucaguacaaauauacagacugcucugggagcauauacuagaaaccuggaauagucuguuuaaucaaucagaaaacucuuauauaccauuugauuugaagccuggaacacauguaggagaguucuaaacaaacagaaagacauucgggcagucaugcaaaaguuuacagacaagagacaacaugauucaaucagggguugaaaauuuuuaguguuuagagcuaagggcauaagaaaagagaagucuuaauaggaucagaggugagaaggacacaucugucccaacacuaccagaaguaacuuggaccagaagaauccagagacacaggaaccccaccugaccaguggcacagguuccuuccagucaggguugguguccugaacagaccuugggccugaacucugcagccagucccacaacacccagaggaagcucuacucccagacacucuaacaugcccagugucuuagucaggguuucuauuccugcacaaacaucaugaccaagaagcaaguuggggaggaaaggguuuauucggcuuacacuuccauacugcuguucaucaccaaggaagucaggacuggaacucaagcaggucagaaagcaggagccgaugcagaggccauggagggauguucuuuacuggcuugccuccccuggcuugcucagccugcucucuuauagaacccaagacuaccagcccagagauggucccacccacaaggggccuuuuccccuugaucacuaauugagaaaaaugccuuagaguuggaucucauggaggcauuuccucaacugaagcuccuuucucugugauaacuccagcugugucaaguugacacaaaacuagccaguacacccaggaucccaggaacuuaucacaccagaaucuuagggucugagagucagcuugacuuccaggagcucugacacacccaggaucacaggaucacagaggcagcuggacucugaggagcucugacacaaccaggaucacaggaaggacgggcuccaguaagauacagugaggacagguagcgcuagcaagaaccaaauggcgggaggcaagcauaaggacauaagcaacagaaaccaaaguuacuuggcaucaucagaacccaguucuuccuacauagcaaguccuggauacaccaucacacaggaaaagcaagauucaggucuaaaaucacuuuucaugaugaugauagaggacuuuaagaaggacauaaauaacuucuuuuaaaaaauacagguuaaacaguuagaaacccuuaaagaggaaacacaaaaaucccuuaaagaauuauaagaaaacacaaucaaacaggcgaagaaaaugaacaaaaccacccaagaucuuaaaauagaaauagaaacaauaaagaaaucacacagagagacaucccuggaguuagaaaaccuaggaaagagaccaggagucauagaugaagcaucaccaacagaaaacaagagaaagaagagagaaucucaggugcaaaagauaccauagaaaacauugacacaaaagucaaagaaaaugcaaaaagcaaaaagcuccuaacccaaaacauucaggaaauccaggacagaaugaaaagacuaaacauaaggauaacagguauagaagagagugaagauucccaacuuaaagggccaguaaauaucuucaacaaaaguauagaagaaaacuucccuagccuaaagaaagagaagcccaugaacauacaagaagccuacagaacuccaaaauagacuggaccagaaaagaaaauccucucaucacauaauaaucaaaacaccaaaugcacuaaacaaagaaagaauauuaaaagcaguaagggaaaaaaagucaaguaacauauaaaggcagaccugucagaauuacaccagacuucucaccagagacugugaaagcuagaagauccuggcagaugaaaacuacaaggaggaaaacuacaccccagaaaaagcaagaaaguaaucuuucaacaaacccaaaagaagauagccacacaaacauaauuccaccucuaacaacaaaaaugacagggaguaacaaucacuuuuccuuaauaucucuuaacaucaauggacuugacuccucaauaaaaagacauagacagacagacuggguacguaaacaggacucagaauuuugcugcauacaggaaacacaccucagugacaaaggcagacacuaccucagaguaaaagguuggaauuuuccaagcaaauggucccaagaaacaagcuggaguagccauuuuaauaccaaacaaaauugacucaaaagaagcagauauauaaaaguugggggucauagacagaugcccuuagcacuuaaaacgagcagaauacauagaaacacuuauccaagacuaauaggcuauucugggucuuuuguuguuccauaucaaauugaggauuuucuuccuauuuaugugaagaaugagaugaggauguugauugugauuucauugaaucaguaaauuguuuugguaggaaggucuuucuucacaauguuaauuauaucaagcuauacucuugggaggucuucaaauucuaguauguuucuuaaucucuuccuucacauauuuaaaguuuucauuguagaggguuuuuuuuuuaccucuuuuguuauguauauucuaaauauuuuauuuaagaaacugggaagaggagcguguccaugaucucuuucucagcaugcuuguuauuaugucauauguauuaagacugguaaauuuuauaagucaauuauguaucauacacuuugcugaaauuauugauaauuucuacaauuuuucuagucaaauuuugggaacauuggcuaugagauaaucuucaauugaaaacaauuugacuugauauuuucccauuuguaucccuucucuugccuuauugcuccagcuaaugcuucaaucacguuauggaugagcaguagggauagugggcaguccucucccauuauugauuuuaauggggcuuauuaaugguuuuauucauuuaugaugauauuggccaugggguugucauacauaaucuuuauuguguuggaauauguuuccuacaguccuauuuguucuagggcuuuaauuaagaaugcauguugaauccuaucaaagacuuuuucuuuuuuucuuuuuugcuuccauugagaugaucauaugauucuuguauuuuuugugcauguauuugguuuauuacauuuauuauauguguuaaagaaauaaaauaaaaagaaaagagaagucuuguggauaauauuggucgcuuuagacauuuauuucagaucuuaguauuuauucuauacagaggaaagugaaguugaagcagaacuugaugaaggagaauacuggagaggaugcuguacugacuguauugugugguguuaguggcggggccguagggaggagaggggagagggaaggaaguaaagugaacuuuggguguggaggacgccuggcaguuaggagggaagagcgagggugaucccacaguggucagguguggugaccagguaugccgugccagggcguugggaucgcucggguugcaggcacuuccuguuccaaggcuacccagcaguuuccacaguguauguaacugagagccuguccugcaggggaaguucuguaauagaaccuuguccuguucuauccaucuuuuucuucuaauuuagguccaucauuaaacuugagcauucucauaaaauuauggggaauuuaacuacuuacuuggagggccauuuuacacuacauuuauaagaauuuauaaggauucucuauuauuuggaauaauaaauuaauaagagcaacuuucuuccaugagaagcucuacaauauuuuaacucacugucauucucuucuccccuacacuuuucucuguaguauugcaucugcgcgccagcagccccauguccccaacucugccgcacuugucauaugcauuuguuguaugcucauccacugcucugggcuccuuuuuaaacuuaauuccuuucuuccuuacagcucagcuccauucccucuguaagcucuguugugguggccaccuagccuuggcugauaaaguucuguuucacauaggucccacuacaagauuuuaaagaaacgugaaaauuacagagucaccauuuuaugucccaagaaaauaacugauucagcaaugguuauuacaugaaacuuuauaucacagugaagccuuagucaucagaaagucaaugaugugugaaacaaaugucuguuuccuaaggugggauaauaggaaguucauaugaagauuucucaccaaaaauagaggcuaaauggaauuaugucuaaaaucaucuuucauucucagaaauuauagagauagagaauuagucuaauuauaccauaaggaagaagagcauagguuagcuauaaaugaaccacucagugcaauguugguaagcugcauuaugaaaaaaguguggccaggcggugguggcgcacgccuuuaaucccagcacuugggaggcagaggcagguggauuucugaguuugaggccagucuggucuacagaaugaguuccaggacagccagggcuacacagagaaacccugucucgaaacccccccccaaaagaaaaacaaaaaaacaccauugcaauaauuaacaauaaauaagaacugagagaaaaauuuuaaaaauuauugcuucauuaacauuguaguuuaaggaaaaugccuacauauuuuaggauugaauuagauaucagagaauagagagcagaguaucuugcuuugaaauaccuuggcuuugaaauaaaagggaaaaucuguguaugagcuagauaacaguggugaucaguagcuucauuaguaaagggugcagcaauuuaagagggcuucacaacgagguauuaccuuagugaagaacagauuagaaaggugaaauauaauaggagggaaauaaauagacagaauugaaucucuuggagcuggaguuagaagcuauucugaacagucagcaaggguccugagaacagaacucacgucccccgcaaggucaguaaauacccuuaacugcugaggcacugcuccagcagcagaccccauuuuccauaccucacuuagaucuuauaccaugaagcccucuuugguucagacaugccuuuucuguuccgucaucccagguuggcagcaaguucuguuuguuucuaagucagacuaauccccccuuacgaugaaugacaugacuuaccugacagcuggcugaaggcaguguuucuuaaacucccacuguguccuuauuuaaguggagggaguggguuuaaccgugauaauuacagacucuuuagcauuugauuaaaauguccauaauaaaauacaguaauucguccugacuaagugggauuuuuuuaaugauucuuucauuugagagguaugcaaggugguuuguagcugcagaccucugggucugcguggaaagggucucugggugcagaugggcaaggaguuggcgagugacagacagaccaacacgcgagauuguguaaaaucugaauguauugucacaaagugaacaccagucuuauauaguacagaaaauaaaggggguaggaagucacagcaggcaaaguacauugaaguugccugacacaaaacaaaggaaugacuacaaagggacuuacaggaaccagguaaaaguuuacaguaagauaaagcaguccugccuagggucagcuuaaugacagguaaggagcccugugaaggcuagcaccaggggguucugcucuuagcagaaugcccuccuauuuccuaggccuugcuaaauuauuauaugaguguaacuuuuaaguaucuggagaaucuucauuugucagaagaauucaccaacuugcuucuaauaugcaauguagccuguacugaagauuucuaucucagugggauacccuggcucuuucaugcuaaacacucugcagaccagcuuugagcuguuggcucugucuuuuguaaugcuuaauuaguuacugaauagguaacuuccuucuggcacauuggaacacuggugggggcuuacauaugucagaauucaaucuuaaaaggcacuuauaauaagauaauacuaaaagagagcacguggauccauacagcagacgaacucagaaauaggguaugaguauacggguuaaugagaacgccaaagcuccaggaggugaguuuccaugaaacucuuugccuccugagugcuuccaggcuccucagccugccaagcagacuucacuggagugugcguggcaguuuguaucccgcugcugcccagcuaggaggucauucucgcaguucccaguauagcucuucuguccuagcuacaugugucugcuuacauuucgugcuuagguuaaaauauaauauuuuccuacuacgucugacuuccugguguuucauccuuuuaaccccucucuagugacagcaccuagaucacugaggucauuuccagcgugaguguguguguguguguguguguguguguguguguguguguguguguguguguguguuugugugcgcguggaguucuccuaguuuuuucaggaguucugcacucauuggucacuaaccacauaauguuauacuuugucuaucuuguccaggaaacuuguuuucccacagagccuagcaaaauggcugugcauagugcaaccccaguaaaugcuguugguuuguuuaacccauaaauuuuacuagguggugaggaaugccaagaucacuauaugccuaaaaaucaguauugaucaauuucaggcucgugaugcagagagcauaaugcugaaccuugcgggacagcucaucaugaugcagagggacaggucaggcccgcagauccgggagaaggacagccacccuaaccaaaggaagcuugugaguacagcuagacggcacuuccagcccgaggagggacggugaugagcuuaggguuuaugaguagagcggcuuaaggggagagugguguguugugacuuaggcaccaagaacauacauaaagcucaucuuacaaaccagagaaguuggucauuguagggguuuuggguuuguuuuuuuuuauagauuucaauacauauacuuugaaagauuacuauuaucucuaauucuaaauaaagccccuuuaaaaaaaaaacacuuauuuugaaugucuacaaagcuaguaccuaugaacuuuagaaccuccauauuuaauaggaaaaccaaacuucagcaauucuugugucuccuucagcugccguucuguccuccuguuguacuagcccagucgguggaaaaugucuggacuaccugucgagcaaacaaacaaaagcgucaccuucuggaggcccucuggcugagcugugguggugcggggaugaagguuuggcucccucucuuccccagggaucaucgcaagccccacuccuuccugucccagcggaucaugcugccguuucauaucaacauuuacccccuggccguucuguuugaagacgcguugguccuuggugcugucaacgacacucuccucuaugauucucuguauacccggagcagugccagggagcagcuggaggugcucuuucccuucuguguuguggagaggaccucucagaucuaccuccaccauauccuccgccagcuccuggucaggaaccugggcgagcaggcgcuccuccuggcucaguccugcgcugcguuaccuuacuucccucacguguuggagcugaugcuccacgaggugcuggaggaagaagcuaccucccgggagcccauucccgacccgcugcugcccaccguggccaaguucaucaccgaguucccccucuuccuucagacagucgugcacugugccaggaagacugaguaugcucuguggaauuaccuuuuugcagcugucggaaaccccaaggauuuauuugaggaauguuugauggcucaggauuuggacacagcugccucuuaccuuauuaucuuacagguaacacgcguccuuaugaagggauaaggauuaauggucuuaauuuuaggagggaaagguauguccuuaugauaggauuuauggaauuauacucuuauggaauggucauauuuucucugugguguaugucuuucauucuaaagaacucagacuugccaagugaccagagauuuccuuuuccuuuacuguuuuaaaagugacauuccuaaauauuuugguugguugucccuaaaagggccuaaaacagauuaaugauuucagaacauaauuuuaaauaacauugaguguauacauauguucagaugagcaugucccuucgcauauagaagucagaggacucucaaguguugacucuugcuuucagccuucuuugagacacugucuccagcuuuucccuucugcagaagccaggaaagcuggguuuuaugcaucuguggauucuccugucuccaccucccauaucuuagugugaguucccagagacuacagagguuuuacguggauucuaaauucaggucaucaggcuugcguaggaagaacuuagcuacuaagccaucugugagcucaaauguucuuauauauaauauauauggugcauauguuccaucagcaauacuagacuagacuaauaacugagaaaaaugauacugugggcauuagugcaugggucugaguuacucacaauaauagguguauauucuuacaacguaaaauuacugaaaggauucuaaauaaaccagggcuuaacacagcauccaaucuuagccuagcuguacacagcuaaggaugcucaugacacauuuuuuucucaaaacagacccugaaaaacuuauuucguuauuugauaaguaggcucaaaaguuugguacugcuguaaaucugaaaggcuauuuuaaaguucuuucauauuacuacaaaguaguuuucauuuauacaaaaagguagccauaagccuaguuagaaucucauacugaagcagauaucuugucaacauauuugcuucaugacaaguaacugaaaccagagauguccaagcagaggcgaguggccccaagagucugggguuuacuuagcccuaauggaagaagcaccaucauaaaaagagucaaagucagugcagcugggguuucuucugcugcccucaggcccucagagcucccccuagcuguggagcugggaguuuccucuagcuggggcggggcuggggcucagccuaucaggcagcuucccaggaaagcaggcaaggugcuaggcugugaagaaagagcuaaggaugcucuguguggagcagugcugaucagcccugccugaagcaacaguuacagucagaucuucagaaagugcuagaggacacagaccuaagguuuugggggucaggaaaaccuagauuuaucuugccuuucuauugaucuucaacaauguaguuaacucuguuuccauuuccuguaaagugggaauggugugacuuuccagucaaagggaaagaaaggcaacgaugaaugucgguguguauuguuagcuaagguguaacaggaguacagggaacuguagugugaucuaagcaagcagagcaacugccucacuccugcauaucuggaacuuucaaaugcuccuuuuaaucuuauuauuaaauugcccccagccugccuguuccucagacugagagaagugucaagaaaagaauugcucugucacccaaaauugugucguauaaauggaauguuaucugcguugguuguuuuuauagaauauggaagucccagcaguaaguaggcagcaugcuacccugcuguucaacacagcacuggaacagggcaaaugggaccugugccgacacaugauucgauuucuuaaagccauugguucuggagaaucugagaccccuccauccacaccuacaucucagguuaguauaaauuauacagcuuuuguagggcauacacccacagagcaucuuugacuaaaaccacuguaugcuguguaaccacaggagcccaguucaagugguggguuugaguucuucaggaaucggagcaucaguuuaucccagucagcugagaauguuccuccugguaaauucggcuuacagaaaacacuaaguaugccaacugguccuucugggaaaagguaaaagaauaaagagcaguuacugguucagagcuuuuguccgcugcauuucaaagcauuuauaacaucaaaucuuaagaaaauauuucauucuguugcaaauccuuuuuucauuugccaaaggcuuacggaaggcuucuguguuucucuuuacuuuuuuccuuccuguugaguucacuucuguucucuguaauuucuaucuuuguacuaaauuggauuuggaugcacuuguucuaaauaauuaauguaaauuacuucuaaugauggaggacucaaauaaaaaaaucuuaguaaugggagugcugaaaaacugguccauuuugaagaccaaaaacuacaucugucauaaguggaaaauugucucuagugguguggcuuguaaacucagugaucuugacagauuguuggaguuuccucugguuaggaaauuccuguacugcuucugguguuagcuguucuuggcucucguauuuucuuuucccggaguguuuuguguuuuuuguuuugguuuuguuuguuugcuuuuugucuuuuuuuuuuuuuuuuuuccugagacaggguuucucuguauagcccuggcuguccuggaacucacuuuguggacuaggcuggccucgaacucagaaaucugcgugccucugccucccgagugcugggauuaaaggcaugugccaccacgcccggcacuuacugucuuuauguguuuuuauuuuuacugcaauacuuagcacaugccaagagucaacauguuuuauuaugauauuuuacuuuuuucuccugucccaaugauuaacaguccuccccuaguacaaauacacaaacacagaugaacgucaccaguagagccauaggaggaucaacaguugccagccacggucugaaguuaaaugcuggucagucccuuaccaagagcucacugugugcugcccacuauuccaagugucugcacgcucacuucuuaguccugacaacuccguagggucauaacucacugugcaggugaaaaaacagaggcucagaaagacacuggacuuuguucacacagcuaguggagggcagagaccagaucugagaaguccugccucugaugcugggcucuccugucccguggucuacgucucacuuagagcugcuaguugguuccuccugguuacacauuugcucauauugacaagagugacagacuauacuuacuugucauugauuuuuauaagguuuauuuucauauaucuauaaagugcaagaagagauuucauucuuucaucuuucacugguguguacacaccaccucuuccuggucuggcuucuuuugucuccuguuuauucuuauucccuacauucaauucuacaaauuggucuuacgaggcaacuuugugccuugcauggugguguauuccuguaauccagcaauugagaagcagaggcaggaggauguuugaguuugaggccauccuggucuguauaucgaacuccaggacuacacagagagacgcuguuuuaaaacugaaaggggugugggcaaaguuaacucugugcugcauguuuacuaggcuguggugugaugugggaaggccccggagcuuuuccuuccuauucagacacaauuagauauggaacucuugcuuccuuuucaacuuuaucaaugcuaccuaaaagugggguucuccagggggguuauucuuucgcuuucuucuguuucuuacagauggagcaaagacagugaaugugcugagaacauguauauugacaugaugcuguggagacaugcgcggcgccuccuagaagaggugcgcuuaaaggaccuuggcugcuuugcagcccagcuaggcuuugaacugaucaguuggcuuugcaaagaacguacccgagcugcccguguagacaacuuuguaguagcccugaagagacuucacaaggauuuccuguggccacuucccauuaucccagccucuuccauaaguuccccuuucaaaaaugggaaaugccgagcagguaauguagacuugagacguguuuacaaaauuauuuauuuuagauauuuggacauguuaucauugguugacauucaaggagcucuuuucauugcaaauguaagcagauaaaagccaauuugugguacaccaguuagaauagcucccaguugaccaaagauauaaaugaagucgaaacuaaucuuucuuaagucuuuuuggcuugaaguuuagcucacaaaucuaaucauaauaaauuguaaacagguugaaaaugaauguagaaacuccuacauuuaccuuauugugguaacaaauuuagcaugaguuagucaggagccgccaauaaagugugcugucgucauuuaccaucaccuugacaucuguguccuuuccuaaacuuggagaggacaaagccaaacugaguuaaaaacaauccgauauuuaauuaagauucuaguuguucaaacaaaaccauuuuauuaugguguuuaggaacuuuaggucaucuuaagagucaaggcgagucauucaaaucagaagacuccaguguggccuaguuacaggaagaguuucugagagucucuucuguaaguucacaucccuaguuuuggauaaaagaaacaguauacaaugacaauuggcuuugaacagauaguauugugaauugcagcgagagcaucuugaauacaccuuuuuugcuucuggacuuaccaugcagugggagagcagauguuaaagucucagucagcugacccuuuuauuaccccugagauggacgcuggcaucucuaacauccaacgaagucagagcuggcucagcaacauuggucccacccaucgugacacagacagagccucaucuccuggaccacaaaugcaagaugcuuucuugucuccauuaucuaauaaagguauuuaucuaacaguggaacaaguuguagcucuucuugaguuuuguuugggaaacgauuguaccauagcauccuaagguacagcaucauucuuuccuaaagaauuagccauuaaauaucugccuacauaggaaaauaaggacaaauuggcuuugccugggcuuuagcauauuuauuuuagauauaugaaauacagguaaacauuuaauaaaucuuugcaaucaaguuuuaaaauguuuaucaguguagaagaguacacauaugaaagucaggacaacuuugugugaugaaaccuucuaauuuuuuuguagguuuccaagauaaaacuccgcuugucugucagguuugguagcaagcaccuuuacccucugagcuguuuugcuggcccuuugcaauuaauuuugauaagcaaauacuaucuuugaaauccaguuaacauuaaaauguuaaaaggaauucuauuuuuagaauaaguagacuuuugucauaaaaucaaacuucuaucacuaguuuuuauuucauuaauaaagcuuaugaaagaauucauuguuaaauauaaugucccucauuuuaccucuuagcuuucaaagccugaacuauuuauuaugugaucauuuauaaaaacaguauaguaguuucugcuauguaguuaugauuaaauuacaaaugaaagagguuuugaaacaauuucuguugcuauaggguuauaaaauacuaaaucuuccauaguaacugggcagauuuugguuuggggggauuguugucauuguuuugguggaggaugggagagccaauccuggggauugaaccuaggacccccugaaugcuaagcaagcacuccccuccauuuucacaggcuguccuugaacaugagguccuccugucucagccacaaguaauugagacuacagaucugcauuacaagcccagauuauuuuuuuuuucuaacagcuuucuuaauggccaggcauuuaccuaguauugggcuaucauuuuaucaucacugcugggugaagcuuuugucaugugugaaggcucccaacugcuauuaauuuuaauuguaaaauuagaauauuuucccauccuaaggcauauaauuuuuuguuguucauauaauggcuauuuuagcaguagauugaauguuuuuacuuugaaaucuugaagagaagcuagcauuuuaaaagcaacauuuauaaugaaagggaaaacacucauuugugaaaugaaaagcucacuuaauaacuugugcgauuucuuugucaggggaugagugcagcauuggcucagcuacagaccugacugaaagcagcuccgugguggauggagacuggacaaugguggaugaaaacuucuccacccucagcuugacccagucugagcuagagcacaucuccauggaguuggcgaguaaaggaccccauaaaucucagguccagcuucggugagugucuccgaguuugagaacacagagagcccggaggucucugugcagauggaucccucugcguacuugcugcccucccuuugugugugucagcuauugucauucauacagauccuuguguugcugcuuuaugucuagcuauuugcugcacauuuucauggaggcgggaugucuggacugguguguugucaucggccugauucucagagaauccucaguggucagucagcuucuugggauugcucagucuuccgagauggauggagagauguuacagaacauaaaaucagggcugcaagcaguggaccgcugggccucuacagacuggugagugaaugcugcuuuccauaauaagcaugguauccuuuggcgaaugauggcuuugucacauuaggaccauuauaacugccagguagguagcacaucccuuaagucccagcacuuggaaggcagaagcaggcagaccucuguggguuugcgguaagccuaaucuaaauagcaggcuucccgucauccagaacugcauaugauaccugucccaaaaaagcaagaacuuaaaguucacucauuuggacaguuuuaaguuuauggaacuuaaaaaauacuuucauacuuauguuuuaaaguaguuuuccuuuaaccaauuuguacucaggcucuugaauggguacuguccauugaauagcuuauaauguugguuaguuuauaacgugaacauauaaugcuggcuuaaaauuuaugccauacaaguggucaugaggcuagaacuuagauugguaguucuguggcuaaguauucagaaagacagguuauguagucuauguaaaugucaaggcuccaugacagcuacuagcaucucccaguuagaagcagcaggugggagugagguccuguccuugucagcagucaaguauagauuugaagcucuuuucuucccuuagaucugguuuucuguaauugcaaaaugaguuuaaguuagauacuuugcaaugaucccuuagagucuaaagucuuucguuccuuguuucuuauugugcacuuaaccaaguugugcuuguggguacuuugcauugguacuugugcacaugugcaaaagauaaaggucggcuucuggugucauuucccaggagcuauugacuuuguuguuuaagacggaucucucccugggaccuggggcucacugauugggcuaggcuggcuggcuguccagcaugccuccagaaauccuaucugugucuugucagcaccagcacaccagcuuugucgguggguccuagggaucgaacucaagaccgcgugccugcacaacaggcacuuuaucaacuaacagccaucuccuuagcuagccccucuaucaagucuuuugaauuauagcagaugacagcuaauuuuucccccuuuacucagcccuggauauaagccauuuuuaaacaucauuaagccacaacugcagaagcucagugagauaacagaagaacugguccagccugacaccuuccagccaguaacaguggguaagacuccugaacagaccaguccccgggcagaggagaacagaggcucuugcagccaugggagcaucucucagagugagccugggaguaacaacguggucagccggaaagaagaggacacaacacaggcggaugaggaggagccacuucaggauggggcuuaugacuguucuguguccugacagcagugagcacggcacagcgggcaguauuagucacagcagcuugcaacugagucauuguggccugccgaaugacuuaacagguaaaagaacuugggucagaacucuuucguaaaguauuauaauuuaaugaacucuuccucuaaaucucuuugacuccuuaaaaaaaagugugguaucaaagcaucuuucauaagaaaaauuuaagcugcaauagaaaguagugaacaguauauagaugcacacauggaauauuuugauuuuauuuacaacagauugguaguuguagggauuauucuuaacaggagggauuauuuugccccaagcgagcuuacuuuuucacuacuuacagcuuauauauuuucugguuuagugugugucuagacugguuuuguuuuugugggguggguuguuuguuuuuaacuuucuuuuaaauauguguuaaggugcuguagcucaucagguaacugagcuacuuguuugcuuccuuguauagagucagcgggacucugauugguccuuugaauccuacucuugcacagugugggucaguggacagagacccuuuggcuuugguacucuguugacuagcaguccugaaugacggaagcuauuuaccugugaguuaaugugccuguuuuagcaagcuuaauuuccuacuagaucaaugugggcagagggugaggggguucuuaucaauuaugcugacaccacuaaauuuuguaucaaagaacuguaucuuuuugugaauauucauguaaauauacucaaaggcacuguccauauuuuuaaugcguguauuauaauguguaagguuuuacgcuggauucugcaugacuauacucacucuuggaauaaagacaagacuuuuucuucuuuccaaaaugagcaguugucauagaggaagacagguuuguuggcccagcuguaaaguaguggucaucccacugaucaugaggcggaacagguuuugugcaaauuaauguaguuucuuauuuauugcuuuuguaaauugaauaaaaacgggcuuuuauguaaauagacugugggauccuguauuaucagcuacuaaaaauuaguuuguaaauucuuuauuauaaaguuuaaaaauauuuuauguauuucuagaugugacuuaaauuuuaguuuuucauacauuaugaaagcagaacuacauauucaguugcuucagacuaaacacauaccuaucacauguaauucuaauuauuaauaacaguauuacuuuagauagcuuauuuguacugugcaauuugaacaaggaaugcaauguuauuuuuuauaaaaucuuguuuauuuuuauaacaacaauguauuugauguggaccaaauucguaccaccauguaaaacagccucucuucuaaugcagauauagcuuagaaguggaguucagcccucuaucccugccuuuuaaacuagagagauagacgagguccucuuaggcaguaucuuuuagaggaaaccucagcauuauuuugaaauuauuucaaauuucaccaacuaguuaaaauuauugaauuuaguaauuacuguuauuuacuuucuacauuagaagugcaauaauuuuacauaauaaaauuacuggaugggugaaauauguuauugguaccugguccuucuggugcuauuuuuauuuaaguuguaucaaaccaccaccuuguucugaauuuuaaaauagagaauaagguuuccuauauacguagaugcaguguugcaaaauaaaugaauaaauaaauaaagcaagcugaaauuucuucugucccauuccauuagggaaaaaaaagccagcaauucuuuuguauguagucaguuucuaauguaaguauuuaguuauuaaaacaguguagcauaguaagcagcaguggucuuuccgaugucucaccugagugccacugagcucaucugacucugugguaggugcaguauuaaggaugagcagggggccgcucagcuaagcaggugucccacgaguaaguuagagcccacaacccc

SEQ ID NO: 9235 - RNA, 40209 nt, Mus musculus
auuuugaguuaauuuuuguauauuugagagacucucuuacucuuuuacauauggauggauauucaauguuuugaguacaauuuaugaaaagauuuuuuuuucccaacugaacugucaaaaacacuauaaugcggguuuuuuauggacacacuauaaaugugcagucuuccuucugggugauucuugcuucauaggaagcuguggagguucaaguacugucuauauuuaucucaaggcugcuccggcuguuguaggacuccuguggugccgucugaauuucggaugaacuuuucaguggcucuguagagauggucugcauauguaagcaaaccuguuugaagaauucaguccuuuuuaguauccugcuucccaggccaugaaugucucauucauuuuagcccuuugauuccuuucagcaacauuuuguacucuuuugccuuuauucuguuucauucuucuugguauucuuauaaauggaaugcuuaauuucaucuuugcauuuuuuugauuuucuauguaaaugaucaugucauuugcaaccagauaucauuuuagcucugcacuucagaucuggauguuuuguccuuucuugccagguuguccugccuggagccaccagaaugauggucaauaggagaggcaauugacauugucuucucccugucuuaagucuuuuaucaugaaguaugaugcucuggguucucacugaagaccuuuaccagauagaaucugggcugcguuugacggauaaaauauauaauguguacuaacagaacuaggaaacaccaaggcaagaaaucuggcauuaugaaaauuauucuuugguuguuguauacuuuuuuaaaaguuuuguuuugcuccauuugguucagcauaacuacuugaaaguuaauauaguuaaauuucuuucugauauccaaaugauguuuugguaggaccuacugaucccacuuggucaggauauuggauuacagaaauucucauuaaauuuugcaaucaaaugguuuuuuuuuuuaaguucaauuuacugaggcauaugugcauuaugacuuuauuggcccuaaaaugagaacaaaaaugaaaaaacaccuugaacugcuaugacagaaucuccucagaaaacaaaaaaagccaggugugaugguuuguauauucuuggaccagggaguggcaccauuuggaaguguggccuuguuggaauaggugugaccugguuggaguaggugugucacugugggugugggcuuagacucucccuccaguugccuggaagucagucuuccacuagcagccuuuggaugaagagguagaacucucagcucugccugcgccaugacagccuggauguugccaugcucccacauugaugauaauggacugaaccucugaaccuguaaacuagccccaauuaaauguuguuuuuauaagacuugccuuggucauggugucuguucacagcaguaaaacccuaacuaagacaccagggaaaaugcuacgggcuuugucaggggucagccuuccuguggguggcgagaagucccuguaugucugcaguguagcuucucugccugcucuuauaccuagccacaguuuuaaaaaagcuuccuguugugacuuccucucucaguggagaagauuuaaaccuaaauauacuccggaucuucccauuugcuaaacagguucuuuuuauuucucugaaauucagaugcacaguuucauuccagggaaaaaagauuccagaugaagugaccauuucuaucgaguucuuugcuuauaccacuuauuaaaauagcaguaauucucaagcuauauagagcauuuuaaagauaguacacacacacacacacacacgagagagagagagagagagagagagagagagagagagagagagagacggagacagacagacacuagggauaaaaaauagccuuaaaauauggagauagaauaaaaagcaguuguaaaagauccauuuuuuccaaccaguguguuaaaaaguuuauuucaguaacauuguaaggcaacgauuaacccucaacaagucagcaaauaagugaaaaugagauggacagacauguucuuccaacagcuuccugagucaccuaggcuggcuuguggucuaaucucuuucacagcaaaaucaggguugggggaaaucucagacauuuaguuauagcugcuaagcuggaaacgcuguguagaacaaucuuucaguucuucauacuugucccuagugugcugcuucuguuuauacucuucugggggaugcauuacuuagaccuugaaacuaucuuuugagaagugaauuacacaagugaucagauaaccuuuaaagguaggaggcuagugauaacuacagagugugcuuuuuaaaagccaugaauacugcauguaauugccugaccauuucuggccguuaagcaugccugaaacugaacaucuuguuagugguugcauaauaguguuagagaaaaugaaaaucguuugcauagagaaacaacccaaagacagaaagaaaaccaugauugauuacacugaaaaggugccugccaaagggaaggaagucagagagcauccuuguccuagugaacuuccucagcaugacauguugcucuccucccccauaauuucuaguaaucaguuucagauuaacccgggcacagaacauaagcccguauuuugaaauucauugagcuaucaguacuguuacucagcugugguucucuacaagcuagacauaaacccucaacccuuuaaguacgaccugacagagaauacacacacagcaggagccagacacuugaagcacuagugagauaagauuucugugaguccagcaaaacacugacuccacuuuaagugucaccacuugugacagucagcauguuacuaucagcuccagccgcagcguuuuuaaggcguuauagauuaggcaggcaauacaaggaacacgauuaagaaacugacacguaccacacgagcaauuuccagaggcuccucuucugcggugcacacguaacagugcucuuguugacauucagacaguucugagggccacucugagaggcgccuuccuguucucaccugacaaggauauuguuugguuugguuugguuugguuuugccuuacuauggcuuuucuuucaacuacauuuugugucaugcuuguuagcuaacucaaauuuugucuuuguauauuuacuacuguaaaauuagaauaauuuacuguucaucucauccucugucacugauggaaccuagagacgccacaagagccacugccgugacauaccucacaagcuacaucccugucuucaaaaugaaaagcaccauuaagucugacugcugcccuuaugcgggaucuaaaaauuaacaaauacagguauaguugucuccuguguaagcuacaaccucaacaucaggacagccgguucucacugacggcaaguuacaacaacuuagucaccugcuagaaaacagaaaacccaaugcagcaauaaagaacuugugcuaaaggauuaaucuuauauauaacagaauaaauauuauaaaauccccaguccucccagcccuccuccucuuccaccucagcagcuaugcuggcaauucagugcucuggggaagaaguuuuaaguucugugcuugcacaaauaaagcaacccaugaaauguaagaagaaaauguagcugaaaaaaauguucucuuccccagguaaaugacaggaauguguuugagggaaaagcagacacugaaugcuacucaggagucaggccucugcaucagggcuuaggcuuccaaacagacaaaaaaaaucugaacggcugccugaagaaacagcgcucgaacaucuaaggugcugcagcggcuuccaccuuuguggcauuuacuucccaguacuacaguuguagcgcacagagaggcaucuuacccaccuccacuggcaaguggacuugccuauuucauuagcaguggucuaagagccuacaucuuucuugauccucacaggaaagcugcucaagaggcaugcugcugaguccuuagucaugagugacaugauuggcaauauccacaugugcuuaguugucagaaaacaggaaguuucaaccggcauggccagguaucacuguccccaaguuuaacccauacaguacuuagcccugaagaguguuaucccaaaagcucuuugaacauaugcucaguagaguucauugacuuguauuacaaacauccuuguaucaugggagagaaacuaucccaugcaauguucaggggacauguacucaaaguccauccgcgagauuaaaacacaaagagacuguagguggaaacccacgccgaaggaaaggaccagucugggaacuucuucuucagagcauccagcugagaggaucuuuuguucuccccugauagauagugggcagcaauggccacagucaccauuccuucugccuguucuucugagaccugcuggggaaaaagcaguuaguucucugaagccacaacacuggccuccaagguuguuacguacugucuagaagccugggaaaucccaccugcacuucuauccagaaccgccaugcagaagccuggaguccaugggaauaaaacacaaaguagucuccuccucugcuugugacugggaugccguugccaagagaccacugggaaaguguugauccuuuguggguucgaacauagaaagacauauggcuugguccugcaagaggaacauugaagucaaugugcagugacaauacuguuagguucaucugugaugacuuuagacgggcucuuuacaaagcucaaggagguuagcaguuuggacaagguuaaguaaggagagaacggaaaugagaaagguaacuugguaacugcugauauaauuuaccuaucuccagcccugccccccuccccaacaaguugcaggcagagugcaaagguaaucugccuguggugagguccuuaagacucucaguguuuggaggagggaaacucaucagccagacucaaauccacuauuuacauguuaucagaaaaugucaagguacuacagucuagccaaauauacaaaguuagccaucacauuuccacauuaccuauuagcuuuauacaaaugacccagaaugcucugcuaagacaucgagucacuaggcuggagagauggcucagcaguuaagagaauugacugcucuuccaggggucccagcuaccacgugguggaucacaaucaucugugguaggaucugaggcccucuucuggugugucugaagacagcuauaacauacucguguacauagaguaaauaaauaaaacuuuaaagaagcaauaguagaaguagucuagacauucugcaagcacuguguuuucuuaagguggaaaguaacaaucaaauguaguaaauccgcaggcaguagugugggggaaagccuaggacaagacuuacagggacgucacugguugggaucugcaagagcuacuaguuuuuaacguggaaaggugaacagaauguagcaagaaaagaaaauguuuggaacagugcagaucuguuugauaacaaacuaacacuaagacuuccaguaagguuucuuaaaagucauaacugggccgggcaauagcggcacaugccuuuagucccugcacuggggaggcagaggccgaucuaucucugaccuccaggccagugugaucuacagaacaaguuccaggacugccaggugacacagcagcaggugaucuuaauagcaaugccaccaaaugcugccugaaacacacuggcucaaauucacuaguaauuggacuaugaauuaguauuuauacuguccauggaaaaguuuauccucuuacagaaacauaacagucauacacuguaaauguuuuuuuaaccuucauucaucaacauguaaauaccagaucucaguaucuguggacuggaguguguuagacuuuaauuuucagacuugcugucugaguuccugacaaauuucauuuauaguuguuacaugaaucuugucuuggggcuaggacaaauuuugcaguuucuuaaaugacucuaaagauacuucugccauuuugaacuacauauuuacucagauaugcuacaaauuuauucagaguggaacucucagcaccgaugauuauaaagucgaagaauugauuagcuuuugaaaauacagaaggcacccuaaccccuaugauaggguguacucaggugucauuccucauguaaaacagcaugugaacagccuugugucuuucauaaccagcaaaauccuauguacaacaaagaacuguuuccaaguaaguuucucugacuuaucaguaaguguuugauuugaacaccuauuuuauagccucggagccaaauauaaauuucucagguguaaaaauuacaaguguaaaaauugaauacugccuaagcaguauucaaaaggaaauuuauagcaccgaaugcauauauuaggaauaacaaccuaagugggguaauuuuuuuuuuagcauagaauagaauuuauucaggacaugggaggggaguuaagaggguaguagaggcagagagaagaggagaauagagaaauagaggccagccaugaccauguggagagagggggggaggaagggaguggggagagagggggagcaagagggcaagagagaagcaggaauaagagaguaagagagcuaagugggauaauuuacgcuuccacuucaguagacacagaaaggaagagaaacaguaggaaaagguacaaucuagacuggaacucagggugaacagaagcuggguguuagggagcaaugaccagacuugacaagcuuuaaccuguacuuucugcucaauauguuugugaucugaaacuguucuaagcaauaaaacauaggagauuuuccuaaguaacuuucagccgcuauuaaaaauacuguaagaaaaagagccugaggaaggagaagaugacagagacagcgccaauggggaggaggacucuuaagcacauaguggagcuuagaaaucuuaucccauuagucauuuaccuaggcgcuugugagagaugaaaguaacaccaggucaucuccccuggggucuuuugcagguucucacuguugucccgccuuacccuuccuguguucauuucuucaugauugcccugcgccuaguuacaguuccacuuccuuugaugcucuguaguacuuucguuaagucucacccuguaaguuuugcuuuaauuuugauaccucuuugacuugacaauaaaaaguuguaugguuuuuaucaaaaaaaaacaaaaaaaaaacaaaacuguaauguacaaggagugacagugcauggcuccagcacucagcaggcaggcuaaggcaggaagaccaugaucacaggccagccuggcucucggugagacacccgaaucggucagucagucagucagucaguguuucucugauaugucucgcgggaagccauggcagccaacugaaagcgugagaugcgacaugagaaggaaacuggcucaccuguugcuucaaaggucaacuuuaucgaaucccauggcauuuucucuuuggacacaagucugaaaugagcaggguuucuuggagagaccucgggagcuggaagauaccaguuuuuccuauuggaaagacagggugacuauucaggaugcuuuagcagcugacagcaaauuccuaacucacagaaugguucagaacacccaaaggggucugagaagugccugaugcaauaaaugaggcuagcuccucugcuggccagauugcuaacaaaucccucucaacaguuuacaagcccuccuuccagaggacccggauucaguuccaagcauccaugugccggcucacagccaccugugacuccagagccagagauugcgcacucucuucuggccuccacaggcacagggcagacacacugugcacauaaaugauaaauccuuuuaaagacaggaauugcccaggcauuucugcugccuaucccauuccucugaugaauacugaaaugccaucugucugaguaucgcaagcugggaggaagccguaacuguuguauuauacuggucaggagcauagcccuuucuaacuacuacucaaguuucuugaagagagacuuucuuacguuuaaaauagcaaaccaugcuccugaguucauuaucugacuaaagaaauggaaauuuucugguaauauagaaacauuacaaacagcgcuugacugaguuaagguuaaauuucacugaauccugacagugauagaauuugggaacuaaaccccaacuuaagaaaaaguaugaaccaaccugaucaggaagugcacuggaagauaccaagggaagccacagaguggggcauccuccucacagugagcucggauugugucguugaucucaggaaugugagguguuacgugagacauuccaguauaaucaaacccauugauccauauuccagagucucuuuuuacuacgcuuccuucuaaguuaugaaaaguucuacucacgugcugaaaagaacaagacuaaugagaaaacuguucagcuagcucacccacacuccuaccccaauuuaauaaagauaaaaagaccauuccaagaauugauuagagggcuggugagauggcuuagcagguaagagacuguucuucugaagguccugaguucaaaucccagcagccacaugguuggcucacaaccacccauuaggagaucucauguccucuucuggugcaucuaaagccagcuacaguacacuuacguauaauaauaaauaagucuuugggcuggagcaagcaggcacugaccaagcagggguccuaaaaaaauucaauucccagcaaccacaugaaggcucacaaccaucuguacagcuacaguguacucaaauaaauaaauaguaaaaaaaauuuaaaaauugauuagaaacagggaaauaaaaaggagacuuaauaauuacuaaguuacuguuaguggguuuuuuccuuuuaaaauagauggcagacaugcaagugccuuuuauuguaauucacaacuagaguugaaggaauacuuaaaauauauauauaagacuugaucagggacaguguuugugcuuguagucucaauuacuuacaaggcugaaguggcgaggcauuugagcacagaguuaggcaagucuagacaauacuguaagagaaggucucaaagccaaaccaggagcuagagcgaucuuccagugguuacgaacaugcccugcugcucuuccagaagcucccagcacccacaccaggcggcuccuaacagccuauaacuccagcuccagggaacugaugccuacuuuuaaucagccuacagauauuuaugcuauuuguaauuuuaaauggucauggcuucuagauuauacacaugcauauuuuguauacauacauauaugauggaaagugugucuaagagauaagaaugcccacugauggucagugucccuugcuacuuuauacacaaaucuaaaccaaguaaauuaugucaacagcagaaaagucgaguuuuccuguucacuggugaagcucaaaacccacaaggcgcuucucaucuccugaaucucacugcuucugaagagccucccuuaccugaagaaacacucucuuuggcuuuggacucucgggauuagaacuauaugggaaaaaggcuccacugcagacaaggaggaaggugaccgcgcacaccaguauuagagucagaaugguuuucuuugugcuguucacaagguagaugaagguaaucuaaacacaagcacagacacaaauuacgaauucauaacauugguagagagguguuucccaugauauuuuuuaguagguauugucuagaacacaauaaagaaaagcuaguggccugugugaugugcagugaccccaggagauaaagcagcaauuccucaggugugucccuccuaagugagagccuggaaagugacagacggcuucagcaggccaggacagcacuuccugacaguggggcagaaagcaaagggagacuggaaacaaagcacagugacccuguguucagguguccacggaagaaggaccagaaccuauucacagccaagacacugcccuaugugccacaguggccagcaguggccagcccugcucagcaaacaccacagaacugaauccaaccaaugacaguaaagcugccaaacucucaaagguaagguuuuaugccuaagcauguguuucgaugaaauucagauuccacuaguguuuuauaacaugcuaguaggggcuggaggcauauaggcuaguuuuuagauggacccuguagaagucgcauuugaggaaaaacugcaccaugaaacaguacuguccuuuuagguuaaucacugugaacacuaaacaaucugagcuuagagcagcaaacacgaacggcucaguugcaagguuugcauccagaaucagcuuuuuuuauuguaacuaaaucagcaaacugaaaguuuguacacaccaagcgcauucgcagcccacucaguuuugagaaacuaccugaaaguagcuccuaccuuugucucuucaucuuccugccuacccuaagcucaugaagugcaccaaugugaagauauucucaaugagaggaauuuguuuuuaaaaagcaaaauaucaaaguuuaugcaaaguugucuccucuuauauaauguuccuauauccuuuccugagaaauuucaaccaaacgguacuauucuuggaugaaagaccuuaucuuguuagaaaauaaacaccccaggauuuaagguggugagacagcaaaacaacuuguaacccuauuuguucuucuaccaaauggucauaaugcucaaaauguuucaacucucccaccaaguagugagggucaccuaagacaugcugguaaauuuggacacagggcagcuauauagaguucaaggaaaggaaauagcugaaaauuaauauauuuuagcaauauauauuaaauuauaaguauauaauuugaaaauaaauaaaucuuugcuauaauacuguaguucugacacacccaagcuaacuacugccaaaacuguccuaaaauccaacuuuagccgggcaugguggcgcacgccuuuaaucccagcgcucgggaggcaggccagccuggucuacaaagugagcuccaggacagccagagcuauaaagagaaccccugucucaaaaaaaccaaaaaaaaaaaaaaaaaaaaaaaaaaaaauccaacuuuaaacuaccauuuccuauugaaguucccucuucuccaaguuauaaauggacucacagaaugaagaugagggaguagauguaaagugacagugugcuugauucuauaguuaggcacguuuacagguguacucugccuuaaauguaucuuauaucacucuuaagaucuugagugaguacagaucaaaugaagaagcuaagcaugguagcacaauccuguaauuccagcacuugauaaguagaggccagaagaucaggaguucagagucaucuuccaaauguuuaaggcuagccuaggccaugugagaccuugucucaaaucaguaaaccuaaugaggaauggaaccgggaaguuggcuccauagguacgagcacuuccugugcacacgugaggacuucaguuuaaauucccagccauguaaaagccaagcccccagcacugggguggagacaggcucucagguuugccagcguagcugaaagguucggugagaggugcucucucaaggaaauaggugagggcaugguaaggaagguaccugacgccauccugcgcccucagaguguacaugcaccuagcuguuucuugcuaagucuccggaucccaugccuauuaucaggccuauuuuggcucucagccuggcaguauaaccaugauacccaacaaagaauaacuccaaaaagggugauagcuucucacuuaacaagaaugcuaacuguuuucuaaaacauauuuaauaaagccucaaugacuacaagacguguucugagauaaagauuauaguucaguguucuguuaccauggagcaacucauugcaucaagaggcagcugucuuuaaccuguaacaugugaauaaguaaaccaagagaacaguacuaacaacagcucagagucacagucccacuucacauagugacaaaaggaaauacgguuuguaguuuuagaggguuagcauuguucucgcuauauuaccuugucucaacauaaccuacagcucucugucuacaccagccugcccuagggcucagaagugcugucuucacagguacauacuaccaucauacucaguuguaauuaauauuccaagaggugugccuucccaaagccuuccggguaagauuuaccugugauagugcacuuugaucuuguuauggauucaagcacagccaugccuuggggcguuccugaucuccaguuucacagcuucauuauuuucccuuccacaugaucaguggaaaggaauucaaauauccuacuucugaaucgccuuuguagguaccaaaaaugucaaucacuuguacagcgguucucaaacuauggguucuugaccccuuugaagacgggaagauucuuuuacagggucacauaucagguauuuacguuacgauucguaacuagcaaaauuauaguugugaaauagcaacaauauuuauggaugcagucaccacgugaggaacuguauuaaagggucacagcauuaggaagguugaggaccacuacucuaagagaauaaugaaaagcuaauucauaauauaaauaccuucagacuagacucccaucuacagaggacagaaggcugcucuccguggcuguauuauuugcuuuugggacagcaucacaauauguaaucaagguuggcuucaaaguccugaucugccugccccagccucccaagugcugagauuaguuaggugucacugugcccaggccuuucucccuucauccucaacaacaaacuuaccuaccaugguuuaaaugggaaauauucucuucaaguuuuuguguuuaaaccuuuagcugauaagugcuauuugagacgacuauggagauuaaggaggcagggucuaagugaagaaaguagaucucugguggcaaggccucgggucuguuagcccuugauucuugucguggucccacucggaccugccagagauuccugccaccaaaagcaccaccaugccuuucccaccaugaugagcaguacccucaggagccaugacccaaaauaaauuuuuccuuuccuauuuuuaucaaguauuuugucacagugaaaggaaaagcuacuacacuuaacaaauacagaaauacaggguugaagguuuaauaauaaaacuaaaagaaguaagcaacaaacauuagaauuccauccaccucuguaaacaacacuaagagugaagaaugccuuugcagguuuuguuguuuggcccgggggggggggggggggggggagggggagggagggagggcuggagggggaguguucuuuggaguguucuuucaguguuggggaaccuagccuagggaccccuugaugggagggagcacucucuucagugagcuacagccccagccugcacucggguugccaguuaggauguagguuccuuuuaaugcuaguuagccaacagcaagcaugugcauaagaaugacuuuacauggcuacaugugcaaagccacguaugcagggcuuuccugauggacaacacagacuacggcugugguaacuuuagcucccuggguccucagaaccucauuuccacaaggaaugccccuuacuacagugaucugaaaaagcucacuauccugugcaugaaaaccuaagcuguaaagaacuccaaucccugccucuacuuggaucgcuagccucagaucacaagcacuuccuauagcacugcguaaauacuccuuaggagcuggagcagagaugcuuucucuagagaggcucgccaucagccucagacaucauaccacaggaacuuuccugaggggccuggcccaucccgaccaaccaucuuuccuuuccuuuaaggugucccauggggaaagaagcacacagacaaacaaaggugagacuccauaccuacgcaguauacucaagagaccgagaaacaaaagcauguuugguuaucaccccaaggggcaaauucaugaauguugauuugacagcaaugaagaaguaaaugauacugaaaucacuucgaauacacacacacaaccuaaacuacugcgauuuggccucuuacuaacuucaaaacaugcucauagggauuauucuuuacguucagaacagaacaucucaauccacacaucaccugucccacacauuccuaucugcuacaauggaaggcuacuugaagggaggauuuagacacgaggugugaugucucccagcacuugggagguuggggcaggaggaguaccacaagucaaggccauccugguaacccauaguucuaagccagagugagagccugucuccagguuuggaggaagagaggggaaucuggauagcucggaaggcuguguguguguguguguguguguguguguguguguguguguguguguguguguguguguguuuuaacauuaaaacaguaacaacaaaacacggucucaccauguagcccuagcuggucugggacucacagagauccucuugucucuaccuccugagugugggccaccauaucauccuacauuuucuuggcacauuaaccugacagugcacaaacacugaccccaccccucuaguuuaaauucucuuaacaagguaugagcgacauaauuucacagaauccagugcaucucaggcaucacguguauagacaguaaaacaggacgcuuuuccuuacaaaauaggaagagaggaucaucacacagacagccaggauggaggccagcacaacgucgggggggaucuccgacccgcuucuucccaggauaggagugaacaucucaaacacagcccagaugagguagagcccguaaagauaugggauaaacauccccaaaagguacagagcaacaaaucuuccuugggcaccugggggaaaagaaagagaacaagccuauggaauucuagggcacgaugcagggcucaucuucaggguuuaccugcccuggcacuugacagaaacugggucaggugggacucuagucccuugguacaugugaccuagugcacucagucaaugucaccagggaagauaaaagacaaacaguauuaaggcaauauacuagcauauguucagaaaugugagaaugggaugggguauacaguauaagauacuugcauggcauaaaaaauuaaaacaaauauuuuggaaagauaauuuggucaaauaauaucugggagcuuugcauuuuuaacauauuccccauuuuuauaaaaaaacaaaaaaacaaacaaaaaaaaauucccuaccgugcuucuugaaguccuuguacacacaaagcuuugugagcaauggaaaaacuacccagacggcacucaugaaugcagagcaaaacccuugauaaguuaaagcaacaagaaaagcacagugcacgaacagggaggugucgaagaacaguucucccagauacaggucgcuggcauucugaaagaaagagaauacagucucauucacagucauucguaaagaucuuguugcaauuuccaucucaaggucaaaugcaucuuauugucagcagggucagcccugcaaacugaugaaguccaacugcugcacaggauggggcaacucauuaugauaagggagcagaagcaauccugcuccugucauaggaucccuaaaaacacccaucccaugcucugcugcugcugcagcuuccaaacacaguugaaacagugaagagcaguggucugugaaggacauuaccagcugcugcagcgucacagagcacauaucaaaccacaccaucgcagcaaugaccaugggggacauguggcuugauuucccuaucuuuccuccugccacuucaucaccucugaugcugucccaccuuucucuauucuugacacuuccuuacaaaauuuaagguuccuuuuaaagacgugaagcccaagggcaacuuauccuauuucagaagaaagcuguccaaggaacuuuaaacauuuuaccaugugcaugccucgaagucauaacuucagugcauacccaccaaagagggaguggcugccuuuaagcuucuuuucucucauucuuaucucuacuuccucagagaucucugucuuuagagaccccacuuuaaaguucacuggcaaacagguuugacugguuaaauauuuacauguucaacccagcauuagaggcauggucuuaaaaaagaaaauaauucucggaacucaaucugaagguuugauaaggcagugcauuuuuguaaucccagcacuccagaggcugaggugagacaaccugaaguuugaagccaggcuacgguacaaaauucuuaccaacguagcucuaauaagcaagcugcagccugugagagacccaaggggcucucuuccuccuugacuauucuaagccugcagccaucaagaaugacuaaggaacaaccuacacaaggaaguucauggcuaagcaucugcugcagaggaaacaaauggucacugaugcccuucaccuugggcaucaugggaaggcaagaaaccaaagauagaaguuuggagaaagcuagacaaaauguacaaaaccacaccagauaauacaaggucacgguugcccaagggacucccaaaaccuuaaaggcuauuguuaacugguuaccccucacgguagaaaguaaguccuuauuguugaagacaccaugcacagacacgggggccaaacgcuuccuucugaggacuagcucuuaugguagguacuaggcugcagcauacacagcuuccaaaggagggaagcaaccaguaguccuuccuacccagcuaugaugccuaugaaccacaaggaccagcauggcaagagaacccgaagggugcaguaguggcucccacaucucggugguaaccaagcucucuaacuggauguaagaccuacucaacaagagagaaauaaugccugggacaggaaaccuagccagcuacccagggcguguuacaucauggauccuggagaaccuacaaccaccacuuuaccaaaccagaauaaccccuaacuacauacuaaauauuuuuccuuaugcccacauagaacuguaguccuuacccuauaucaaggaaacuuugcaacagauggagaccauuauagaaaaccacaaccaaucaaaauagaaacuuguagaucccaaugccaaugaacacaacuacaaacaacgcuagaaccuaaagcccagagaacauuucaaaaggggacauaaagagcuggaagauaaaggaguuugcuaugacacuaugucuccuaauaaugucaaagcuacauccauauagacccaccaccaucacugcauuaauauuaacugcacaaggacaacaacaauagacaugguaaaguagguaagggaaagaccacaaggccucaacccuacacaaagaacuacaggcaaauaagaaaugcugagagaugggaaauagucuuuccccagaaagagcacaauuggcuaccuaacaccagauggucagcucuaaugcagacacaugaauaauguuauuagccuaaagguuauacuuaugaacauauauacauacaucuauuuaacaacggugacaacagaggcuauggauuugaaagagagcaaggagaggucuauaggagggauuagaagguagaaaggaaagggggaaaugauauaauaucaaaaagaaaagaaaagugaaggaaaaaacaaugaagagaucucacaugcacuauucuuuuaggaaagaggcauuuaugaugucggguuacgucagacauagccuaacacagggaugccucagagaacacugccuaacacggggaugccucggagaacacugccuaacacgggaugccucggagaacacugccuaacacgggaugccucggagaacacugccuaacacgggaugccucggagagcacugccuaacacggggaugccucggagagcacugccuaacacgggaugccucggagaacacugccuaacacgggaugccucggagaacacugaugccucggagaacacugaugccucguugaacacugccuaacaugggaugccucggagaacacugccuaacacgggaugccucggagaacacugccuaacacgggaugccucggagaagucagcagcucccccucaccagccaugcagugcagaggagagcagugauaugcacacugugacuaagugagccagugcgauuggugcauggaaacacuuauagagcaacagaagacgcagagagccaccaagcaagccuuacugccaccaccacucuaaacacugcugagaacacagcuuugcaacaucacuugaauucugcaccccacuucugagaauaaaaaaaguccaggaaauuaacacaauuguggcagcacugucuauagccagcugaacaaugucuaauagcucugaaagaccauacacaauaauuucacuuguuuguccucaguuugugaaagcagcaaaaagaaaacaauaaacacaucagcaacuuaccauauaauaaaaucuuuuugcaagaguaugaaugaauaugauuuuggcgacuguugcaguuccauacaggcaaacggcaauauaaaaguaguuauaccaugagagagacuguccaaugagagagaugaacacugcuauaaugaggacgguaacaaggcuagugaaccagcuaaugaaugugaucccgaguccacacaagaagucucucauguaauuagcaucuaagaaagagaaaacaaaaaguuaacgucaccaucuucaucaaaccaauuacaaaaccaguagacaaaaaccagcuaaaggggcaaauauuaaaaugaaaacucuacugcauaauugaaaauauuaaaugucguaguuaagagaacaguaagacacaagaaugggguaagaauaaagauguucaaggaacacauugagagcccaggauacuaacaauuaagcgauaucucacaggaauucagacacccuccuuacgaaggaaagagguaguaaucacuacuuguagaacgcuucauuuaucaaacuauuagcaagaauuuuaaaggacgcaguuccauauaaacucuugcuaaaagacaguagcauagggcuggcaagaugguccagcagguaagcacuuggccaaccaagccuggcagcgugaguucaauccccagaccccagcaaacuaagccacagcugucuacugacuucacacaagcacacacacacacaaguaaguagguaaauaaauaaauggaaaauguuuuuaaagaugggaaauaauggcagggaagauaacuggugauaaagaauaauuucaauugaugcuaaguacuuauaucaugauaacaugacaauuucaacccugcaacauuucaagcagaaaugauucaggcagaaggggagcagaaagauugcaauugcacccauuuuugugcugcuggccuguagcacagcagaccuccugagacguuucacuaacagucaaccuacaggcccggcaggagagcucagcgggccaaguugaugagcuuaguggauccccaggacccacgugguggaagaagggagccaauucccacagcugcccucugacuuccagacuuacacaugugcccacacacaacaaauaaguuaauauauauauauauuuuuuuuuuuuuuuuaaagucaaccucuacaaaccuuuuuuucuuuuugguuguguaaacuuuaguuuuaacacugguuauagacuuggucauaguauaaaauauuacugaauuuuaagaaauuauuuguuauuaauaaguagagaaacaauucuagcaacucuuuuuuuuuuuuuagaaaagcaaacaccuucuagcacugaaguuccauuucagcauuguuagugauuucacaccuuaacgagagacuggaugaacacagcugcugaaagggugcuugggcagccuccugccgaggccugcagggcacagggcauccacugcauagcagggcuuagcuuuacacagcccugccuucuuacacugcccugccuuccaucaguugggcucaggcagccaauccagcugacuuugcccguuucagggugagugcgugagaauggucaucuucaccaacccucaaagguaaggagcauaccaacuucauacuuaccuaggaauuucuaaaaauguaaagcaagcaaccuccuaagauacuuaaagaaacaaagacaacggcuaaacucuccccagcaagucccacccccaucccagaagcgcacgguaaagggaacgacucacuccugugcuugggccgcagaaguuucuuccccagguacagaaccacggccaugaccaccauguaguugauuauggagccgacacgagaaggguacgcaaugaccagcaggccgagcacaucgaagaacaccaugcucccaugccgguacucagacgaagaagccagggugucagacguagccagguguuuaagaacugcuaaaauguugucaccuuuuauuaagaaaaauaacauggucuaguaagcuacuccauugugacuuccacauacagacgcaugaagcagaagugaaucaggcguuaucugaaaacaacggacccgggaaguacacgagcagacaccucuucccaccccacccuccaccgcuuugcccuuucuuccagaucucccagaugaggucccugcuccugcucuccuuccuccccacuuagaagcucagccguggcccucucauacugcucuucccuaauccaaaugcacagccccagagcuccaccucaagccugcccauggauacacuauaaccaugagacacuaagaccacaaagucaguggauccauuauaaccaugagacacuaagaccacaaaggcaguggauacauuauaaccaugagacacuaagaccacaaagucaguggauacauuauaaccaugagacacuaagaccacaaaggcaguggauacauuauaaccaugagacacuaagaccacaaaggcagugggaaaacgaaaaaaaaacgccucucgugaaguuguuaaagcauguuaagaauuauuaggggguuagagagaugacucagugguuaagagcacugacugcuguacuagaggacuuggguucaauuccaagcauccucauggcagcucacaacugucuguaaguccagcugcaaaggaucuggcacucacaaacaugcacacaggcaaaacaucaauacacacaaaaauaaauaaaucuuuaaaaaaaaauauuaugaaggagaagcaaaggcagaaggaucaugaauucaaggccaaccuauguuacacagcaaguucacagcuggccugagcucuacaacaagaccuugucuuaaaaagaaaacaaaaacaauuuucccuaaaacuaacuggagaguuggcucuggaaccaugauacaaugcuguccugcaaugcaugcacaaggccuggguuugauccccaguccaucaggauaacaaaccagaacaaauaacaaugaaaggcccaguuaggaaggaagcagaaaggcugcaacgucaaggcuagccugggcuacagagugaaauccuacaucaggaaaaaaauguuuuugaagugagccaggaguggggguguaggacuguaaccccagcaucuugaaguagaagcagggagcugacaaguagugaguacuuguagccuggucacuacccuacgcaguaagaaagaauggguaggaacguguagccuggucauugcccuaugcagugaguaagaauggguaggaacguguagccuggucacuacccuacgcagggaguaagaauggguaggaccucacuaaaguaagaaacuguccagauuuuugauauaccauguccgugaagagaggaaaguuacacacacacacaccuacacacacaagaugagagacacuccaaauauucaaaauguaccuaauucccagcaccuuuguuagcgccagucagggcuugucuucauccguauaaacaacugucagaaacucacugcucacucucuacuccgcacuacauggccagaacauaacacuuaacaccaccuuaaugaguucauuaaugaggucaccuuaaugagaccuucaaggauuccuuauuccuuuagguucuuuuugaguuuacacauuguauaucacauucuuauuuccuggggugcugcucaccacagcacacaugcggggaucagaggacaacuuucugcaguugguucgcuccuuccgccaugugggucccagggaucaaacucaggaugcuagguuuggcagcaagagccuuugccugcugagccaucuacucaaccauauuucaaugcuagggauaaacuccaggaucucguacacaucaggcaagcucucuaccuucaaaucccugauaacuuuugaagccaucuagcagccuuaccccaucuauuucaaccucguccccuucuauuucugaaagcacugcuuccguuccagccugacagcacagcacaccuuccguccccuccucccaggucccuccugcucuaugcuaugcuuuuacuuaaaaacguuaucgucucuccgaagcccaaaucccugccaccuuccuaagccucaggugggccuccgcuaaugcuucuagaccuccgggaagcacuguaaugcucugucuacguaagugccucaucuguccucgccacccuaacaagggauccauguaccauucucugcuugcaucugguguacaaacccagguccugaugcuacuacgguucauagcauucacuugucuguggucuuuacuguucaacagcccuccugcagccuggggccacuccuuuguaaguauucacagugacuauuucuaaguuuuuaauugcuaagucagacaucaaagacuaaacuuuuaagcccucaucuuuccacugcaagucuguaacgcauuuggccacauacugucucucucccacacagacuauagaacacuccuaauagaucaucauuguauaucaaaagccaaacugguaaauaccaaccugcucucugaauggaaucuaugagaauccuguccgcugugucauacuuggugugauagauguauccauuuucaauaaaagcuaagucuauuccuaagauagacaauggaaaaagucaucuuacuuuaaagaucagacuuguguuaggccuguuuguuugacauauuaaauucuaaaagacgaaaugucaaaacaagagguuaacugauaucugucauacucaugaauaacauaaaucuuuuucuuacaaaaucuagaaccaggggacgguggggggcaggggcuaauauugggauauaaagugaauaaauaaauuaaauuuuaaaaaucuauaaccaaggucaauaauuuaaaacauuaaggaagcauuaagucacacauuagggggagaaaguuuugaggauggaauuugggcaguuacgaaccaaauuuaaaucuccaacuguaaaaaucaucaaaggaguuggaaaagcaagacagcagcacaggagucaaaacccugaggcucgcuggcaucucuccaucucccacacuggcgcauggugacaccacagaggaggcaggcauuuaaaucacuaugggacuuugaaaagacagcaucaagaacgcugcuuuggugagugugguagauugaauacgcuuggcccagagagugacacuaucagcaaguauggccuuguuggaauaggugugucacugugggugugggcuuuaagacccucauccuagcugaagccagucuucugcuagcagccuucagaugaagauguagaacucucaguucuguccgcaccaugccugccuggaugcugccaugcucccaccuuaaugauaauggacugaaccucugaaccuauaauucaggcccaauuaaauguugcccuuauaagaguuggucauggugucuguucacagcgguaaaaccuuaauuaaaacagugagucagaagauaaauaucucacauauaauguccucucagaagcuauuacaacuuucaagaaauaaaguuuguuuuugauucaacagccugugaccacgaacaaaguaccuggaauguucccaaaaucccuguagauucugaagucggugucagagggaaugaucccacucuggaaaaccuccugagccaccacagaggcaaaaggguguuuagcugccgaaacguaagccuggaccaaccaaggauuuucagggccugaaaugaaacaagacaacacaauacaggauuaaucggauagcucuguucaacagaccacauguggcuggcugcacugaggaaaugugagcgagagcugacuggugaguacagggacuccuuaggaauaauguucuaggagaugcagaguugcucagugguuagagcuuugcugcucaguugucaggagcagggcucagcuccuagcacccaugucagggggcucacagacaccucuaacucuaacucuaacucuaacucuaagggauccgaugacuucuucauaccuuuuucggcagcugcacacacaugcgcccauauucacauacacaugagcauacaagcauaaacaaaucuuuucuuaaaaugcucuagaauuaugauaaugguacacaacuauguggaaaaaccuaaaacacaaucuuaccacaaguggauaaauuacaggacacuuaaauuauaccuuaauaaagccauggauuuuauauauauucuaaggauggcaacaguugcuaaauauuauuccauuuuuaaggaaauaauaugacuauguguucaugcacauaaauacacauuuuuuuuaaaaaucccagggcuggaaagauggcucagugguuaagggcacugacuguucuuccagaggaucaggguucaaaucccagcacccacauagcaguucacaacuaucuauaacuccaagauacacaugcacacaaaacaccaaugcacauaaaauacagguaaaugggcgcuggagaaauggcucagugguuaggagcacugacuucucuuccaaaaguccugaguucaaacccagcaaccacaugguggcucacaaccauccaugagaucugaugcccucuucuggagugucugaagacagcuacaguguacuuacacauaauaaauaaaucuuugggcagagugaguggggcuggaacgagagggaccagagagagaagaaaaaguaucuaaagacaacuacaguguacuuacauauaauaaauauauaaaucuuaaaaaaauacagguaaauaaauuuuaaaaaacuuaaauaagaaaaaauaccuuaaaaaucucaaaaaguuauagagcaaauuagcacugguuugcucagagugguggaaaagccaugagcauaugccuuaccagaauucucguacucaguagaguuuggauuuuucaaaauggggcauauguuaaugguuuacucuguuuaaauguuauaaaguuauauuuuauuaacaucuucaaaaaugaugccaucaggcaucccaaaugagcauuucccucuccagugaccauggagcucuggagaguacaaacuuuuuuaacuggaaagucaggagaagauaagauuucucaccacacagaaagcaagcugagggcagggccaucggacacauggucucagacacaagucuaagucggccagacuagaguacuuguucucuuagucaaaaaugaaaucaacacuaggaacuuucuagaaggcagagccccaagaaagcuagucuucuuuaggcaguguccucagaugugagagacguauccugagaaacacacuggagcaucagaaaauaccuccaaaagcucucaggcacacacuucaaccguuaagauaagcucaacacuagaagcaaagaaugguguaaaauucagcuaagaaggauguucucagcacgauuguuauggguuccuuccaggggaguaagucuuaaaauauucagguuuuagaaugaguaaaauguuuaauuugcacauauacugaggagguacuggggucuuauuaucaaaguaacaaauacacgggaacuacuuaacagcacagagaacugcagaucaggcaggcagggaucugcugugcaccuagcuucacuaugcagcggaaagcucacuggcucuucaugcuccucccccgaccacugccacagccacccuguccuggucccaccagcaaacaccaccuucuaccuguaacuggugcuaacuuuguucguuuguuuccagauaugugaucauuuugaaauuccauguugcuggagauuuuuuuauuuaaagucacauacauuuaguugaggaguaaggacgugggccuaaucagagccagcaaaauggaacacucgauagaagcuaacagagacuucauuuuaggaaagugagcucucaucucuuccaacuaucuauguagacuguacuaauauaugcagaaaaaaacaucaggagucauuuggacuaaaccaugagacuggaugauaucggggcaccagaagauagagcagcugcugcauaacuuaaaggcauggagaugaaggcacuuaaguucacaguacacuucugacaggacacccaggacagcuguugcucuauggagccuggcuuucacagccagugagacucaauguccuugcuuagcgcucucugcugccccuuucugauuugguagguguugaagguguuccuccugcaucaagaaaguggggccagagcagauagcagcuaccuauuccuaaagauauuagaguucagcugcuucucacugauucaagagaaaggagaaaaauuugagagcugaaaagucuuguuguuucucaccuugugcuugugaccuugaauuguguguguguguguauguguguguguguguguguguguaucaguaugugugugucugucugucugucucucucacauacacacacuuuccuaaaauaaagucucggcucaggcagcucucuguuagcaucuaccgaguauucacuuuuucuggcucugauuagacccaaguucuuacuccuuaacuaaauguauguggcuuuagauuuaaaaaaaaaaaaucuccagcaacauggacuuucaaaaugaucacauaucuggaaacaaaugagcauuuuaauucugacucuguguguguguguguuuguguggccaaggugucccuauguagccuuagcugacuuagaauucagagaucugccugucucugccacaugcugggauuaaaagccuaagccaccaaacuggcaacccugaauuucuuaaagguguuaacuaaaauaaaauacaggaucuuuuuaaaaguuuaaaguaaguuugagagaguacugaaauaugauacugucuagguuauaaaaacacuuagugcuuacuguacauucaaaacuuaaauaauacaacaucuuuuaaaaaugcuagagaguaaguuucuauccauuacucacguccucuaaccccucucacccaaaacacuacucacuauuaagacuccuggcaagucaggcaggguacaugccucuaaccccagcacucgaaagguagaggcagagggaucggauucaagggcggcagggaugugaaaugagauggucuagacucacacaacagaggcagcuuuggccaaagcuuuguguguggcgggggcaggagaggaggugggucuuccaaagucaggucuuagcaggcccugcugagcaagucugugcacucucgacuuugcuaaaauggcaagaacaugauguucaacgguuauacccugucaucuucaggaaucauaauccuaaaauuacaacucucucugccuguuacacuuaauggguuuuugggggagguuuuguuuuuuuguuuuuuggguuuuuguuucuuuuguuuuuugacauucaaauuacucacugaugaaauuaaauuccuuaaacugggaguaaauuuucucauuuuaauucuuacuaucauuuuaaaacccuuacauccuaaucaucuauaauuaauaauauucacauuguacuauguccuuauuugcuucucuacuagccaaaaggaacuugaagagacaugggcucauuuggcuuacagguucuggaguccaucacaacagacgcuaggauagggacuccagucaggaguccggaggcuaacuguaaagcacaggcuauaggggacggcucuucuccaugguuugcucagccuucuuauaaaacucaggauucccugcgggaagugguacaucuacagugggcugggcccuuccguaucuaucacuaauccacagagaagaugcccacagacaugcccacaugccagucugauggaggcaacuccucaaccgagcuucucccuucucagauaacucuaguuugaguuauguugucaaaacaauaaauaaaccaaccaaccagcacauauuacaauacaguuacucacugugaaccgacucugagccuucaaauccacugucacauaccaaguauaaaaccuuacaagaaaaacucucaccucgguuccucauccacagagcggaagcccagcagcagguguucaucacacuuugagaacuaaauaacuucguguaacauuuacauauaauaaguacuauacaggagcacaugcugcucacauuauuuugcuuuuuaaaauuaauaaagagcgucaagaaggccccuggaacucaacagccagccagacuagcugaauggauaaguuccagauccagcaagaggcucugucucaaaaaggucgaaugcaaaugaggaagacaccugauauuaacaccucuggcuaccauaagcaagcacacaaggacccggcgcagauacaugcacaugcacauacaugugcacacauaccaucguacauauuaccaaacacauucaugccuuaaaaugcaaccucauucaagagauugcucauuaaaaagguuuuguacccugagaaacuuuccacugucgcacugaccugcucagugcacagccucacauaccuguuuggaacacaaguucuuucccuccgacaccagcagccuccagguuaauaaaugcucgaaucaaacuggcccagggauguugaguaauaaaaccauggcuugccuuaaugaggaaaaaaaaaauguagguuaaacuauguuuuuauuuugcuuauuugcacacagaauggcuaucuuccuauacaaaacgguggguucaguuugccaaguaaaugucacugugaaaauggauaugcagaaguuaagaagaaaggacaggcgagagaauccauaugguuaagcauuagugcuguguaccuuccucaucucucugaugucggggcuuuaaaaggucaggagagggaugccauugagaagcccuugacacacuuuucucguuacagcgacacucagaaagcuggguugggaggaucucaagugccaggccagccuaagagacacagcaaggcccugccucaaagaccagagugaaaacaacgaaagaguccuggggggaugggcaguucucagcugaguuucuagcauacuguacauacuacaugcaugggggguuuuuaaaccacugccagauacagugucuuagucagaguuucuauuccugcacaaacaucaugaccaagaagcaaguuggggaggaaaggguuuauucggcuuacacuuccauacuacuguucaucaccaaggaagucaggacuggaacucaagcaggucaggaagcaggagcugaugcagaggccauggagggauguucuuuacuggcuugcuuccccuggcuugcucagccugcucucuuauagaacccaagacuaccagcccagagauggucccacccacaaggggccuuucccccuugaucacuaguugagaaaaugccuuagaguuggaucucauggagucauuuccucaacugaagcuccuuucucugugauaacuccagcugugucaaguugacacaaaacuagccaguacaauugaccccuugucaacuugacacacaaacacaucacuaguaagccucaacccuuacauucuuauucauccccaaggucuaaguaacuuuaaacaucccacagucuuuacuuauuuuuaaauuuucaaucucuuuaaaauauccaucucuuuuaaaauccaaagucuuuuuacaauuaaaagucucuuaacugugggcuccacuaaaauaguuucuuccuucaagagggaaaauaucagggcacagucacaaucaaaagcauaagucguucuccaacuguccaaugucugggauccaacucacgaucuucugggcuccuccaagggcuugggucauuucuccagccauguccuuuguagcacacgcaucauccucuaggcuccagaugccuguacuccacugcugcugcugcucuugguggucaucucaugguacuggcaucuccaaaacacugcaugaccccgucaguccugggcuaucaauugcaacugaggcugcaccuucaccaauggucuuccauggccucucacagugccgagccucagcuguucugcgugaccccuucaugccuucaaaacuaguaccaccugggugacccuuacauauuaccaagucccacugcagcaggaguacaaccuuggcuaucucuggaacacagccucuuugugcuuucagaaaacacuucauagaaguugucaccucaaugaugcuggucucuucuuaaucaccguuaauuucuuagcuccagcuagccagcaucaauagucccaguaaugcaaagguuuugcuuuaguaguucugguaucuuguuaaucacagcugauucuucagcuccagcuaaccagaaccacagaaucuucacaauccaaaauagcaauggcccugaaaagagucuuuaauuuuuccucugaaauuucacaagccagaccuucaucuucuacacuguucucaacauuaucuucaaaacuucuauacaacaucugacagagcucuuaacaccgaauggcucuucuagcucaaaguuccaaagucacaguccuccccaaaacauggucagguugucacaggaauaccccacuaugcugguaccaauuugucuuagucaggauuucuauuccugcacaaacaucaugaccaagaagcaaguuggggaggaaaggguuuauucagcuuacacuuccaugcugcuguucaucaccacggaagucaggacuggaacucaagcaggagcugauacagaggccauggagggauauuacuugguggcuugcuuccucuggcuugcucagccugcucucuuauagaacccaagacuaccagcccagagauggucccacccacaaggggccuuucccccuugaucacuaauugagaaaaugccuuacaguuggaucucauggagucauuuccucaacugaaacuccuuucucugugauaacuccagcugugucaaguugacacaaaacuagccaguacauaguguuuauuuugcauauuauuuuuaugauacuauucauauuacuaauaaaacguuaccagucauuauuccucucaaaauuuuucaacccaaaugcuuaaaacaauaaaucuuacuugcaagacauuuuccucugcgccauuaaagaggaacaccacagcgugcugcaugggcucuggagacgcugacaugacccggagaacuucgagcaucacugcacagcuaacugcaucgucacuggcaccuugaagucagaaaaacagaggcacuucucagaguuuccccucaaaguggcaucaccauagcugcaugacuggaagcagaacucugucaucacagggugacaacuaugcucaacaaaaacaggcccuggaagacccuugccuggccuccucaaugaugugaccaguggaagcauucguucaguucagacucaauagcuggggcaucaaucagccagauggauccuaaggccaacuggacuggauccuccucccccauccucuggguacuucuggugcucacggcuuccuccucccuaccacauucuuucaaaaucauaaacacuacagcaccuacauuuacagagggaguaacacuggaugcuuuaaguagucuuuccaaagggaucaaguaauggcaaaguacagaggcaccugaaugguaaggcacagaagagugaacugugccuggucccagcacugaaaaggacggcaccaaaaaaaagaaagaaagaaagaaagaaagaaagaaagaaagaaaaggaggaagagagaaagagagagaaagaaagagaaagagagagagagagagagagagagaaagagagagagagagaaagagagaaagaaagaaagaaagagagagagagagagagagagagagagagagaaggauggcaguaagauacuccagccucuacaucagaaaaucuaaagauuaugaaaagaacccuaguacucugauuguuuuuaauuaaaucuguugcuguaacauuuuuauguguuuauugggggagggggggcacacuugccacagagcacauauggaagucagaugacaaugugcaggacuucauucucgccuucugucauguggguccaaacucaagcaagccggcagccuugguggcagguacccuuaagcacuggaccgauuugcugggccccaagugcugauuuuaaaagcaccaugagagguaguuaaagggacuggcuggcuauuugaugacgcuagaagauuauugcuaaauuucuaagugagguaucucauaaaauuguuagcauguuggggggcccucacgccucaccagugcagacugaaccuagaggaagcagugcagccgcggagagaaccaaggaggagggcugagguggaaaagugcaccuagacagauccgcagugggaggcacccuggaggucaggaaacaacucugcuuucugcugaucugauucuuuucauaauaggaagcagacagcgcaguuagagaaaggaaaccccauaacucaggcagcagcacuuccgggaggggguggggggggagugcgaugagucacagcggugagucagggugcucccaaguucagugaggacucaggagcaggaaggauggagggcaaguuuuaucucccucacuccgcucacucuuccgaggucuagaaagcagacugaugauucaaccccacaggccuuuugcacagauuuuacaagaaaacacccauuguuuggcaccugagaaacauccucuguuagcuuucuuccuucucucugaaaacuuaggggaggcucuguaaccagggaaaguaaacacuugcuuuagggcucugcugaauucuaugccccacuucugcucaaaaagaaacaauauuagugacacuagcccuggugauuguuggacgguacuuuagucauuaaugaaagugaaacaaaguaaccguuaccugaucccugcuggggcagggggcacaggcugaucccugcuggggcaggggguauaggcugaucccugcuggggcaggggguacaggcugaucccugcuggggcaggggguauaaucccuguuagggcagggguauaggcugauguaagcagcgugcgucacuucucagaacaugaaauaaacgcuuucuuuccauuugagacuguuauuuuaaaaugaaaagcaagcaguaacacuucucuuuauucagugaagugaaauuaacaacacuuaacuuuauauauagcugauuaacacguuaaacuucccacucaucucccuacucuaaggguaccagugucuuaggagagaacagaagagggucacaacaccuuugagaaugugacaauccaaagacaguaagaaggcuaagugacaaacugacaucucuuuccauuuagaaucacccugaaagugaagccaccccaaaauaacucagauguucaccaaagaccuggcacggcacagcagaccugagaagauaaaugaggcccuucuguagguaacauuacuucuugcuaucaauuccuggguccagcuaugcggcugagaacuuuagaauagcacacacaggaaaacaagcacagccaggcaggccugugauccagcccuggggucacuaaggcagagccgcugcuaagccucaggccagccgagacugcacagcucaggaugccgcaauaacacuccugaggcuggagacagcuugggggcagagcauguacaggugucggguuccacccccaccaugacuggcaugcacaaaagaacacucaggccucggugaguucauccacagacaggauucaggugacaacuauuuucacuugcaugaguuuucacuuaagcuucucuuagcuuauuauugauagauacuuccuucauacuaucaguaggaguauuauacaauuuuagguaagaauuauuucuaaacuagaaauagagcauuugggaguaagcaugcaggaagccauagggacaaucugagaaaaacaaaagucuuuuuagucauuuaaaccaugcauggugacacgcucagaucagaaggcucaaggucagccucagcuauacagcaauaugagacuaguucaaggcuagcuugggcuccaggagauccuuucucuaaaaaaggggcgggggggggggggcuuaaaaaauucuaaugggcugggcggugguggcgcacgccuuuaaucccagcacuugggaggcagaggcaggcggauuucuaaguucgaggccagucugaucuacagagugaguuccaggacagccagagcuacacagagaagcccugucucgaaaaaccaaaaaaaaaaaaaaaauucuaaugguucucuaaacucuuuuucauuaguggacuucacauauaaucuaagggccuggcucuauguuaacagcagcagaaaaugccacucaaaacauguuacuguaacacaaggcucuuugguguuaaaaagaaaucugaagacacaaaaaaagcucucugcucuccccacauuugccuaaaaacggaccguaaaucuaugcagggguuccgccucccugucugccuggaaggaugaagguuaaucuacaaagacaaccauaggcccuggagaggcuacagacccaaagcuuuccccacugggcuugccauucacacgguuucccacauucgcugccacacaggcucuagguccuuucucccuuuuuuuuguuuugugggcuuuuuugcuuugguucgggauucccuccggguugguucauuuguugugcaguucugcagcacuaaagacagaccuggugcugacacaugcuaagcaaucgcucuaccacugagcuacaccccaccugguucucuccuuuugucucaucacuuuucaaaaaaaaaguauuguucuuugaugaagacaauauucaaggcagagaacugacucgccucuuugaaaugauuuguguuccccauguuaucaaacagacacaugugcacacauggcaaugaccugucugucuuuuuuucucuuuacuaucuucucuuacaaucuuaucuuauucccacauaagaauuaugaaaggcaagggacucuacauuugauugauacguacauauccagucuuucuacuauaaugcucuguaacaaucacagcauuauuauaugacccuuuccagaauuuaaucgucugaaaggugagcaaaaggugacucugucuagugucccugacauaguuagggcacaucugccuuguuuuaaaugaauguguggauacugaugucugaauaagcaaaauacauucuaaauauaaagaaaugucuuaucacaauaucauuucaucaagucaaggcuagucuauaucuuauguguuauauuaggccugcuauacauucaagcaaucuagaaguauuguuaccaacaguaccaccaccagaggaagacuuccucugaaagaugcuauccuaaagguuuccuuauacuuaauuugugagcaacauuguuaggaaauuagcuaucaguuuuccauuuacaauuaagaaauuaaagauagauuagguuaagcaauaugccaaaagauggcccaguacucagaugcucuccuccuggucaggacgcccagcacccaccucggcuuggugucuauuagaggagucuucuugaguguauaaucccaggaugccauuguaaaaugucaccuucuuuuuuuuuuuuuuugagacagaguuucucuguguagcccuggcuauccuggaacucacucuguaaaccaggcuggccucgaacucagaaauccaccugccucugccuuccaagugcugggauuaccagagugugccacuacugucuggcugucacuuucuauucuuaacugccuguauuagcuggguuuuuuuguucauauuuuacuugugaauauuuaugugagcauauagagaagaaauuuuagagacaauggacgucaguaguuuagauggacuccugucuagcuuauaaaaaaaauuaugagucauggaaauuuaucaagauuucagaauuuaauacaaugagcaggauucacauauuauuucaauagugauuuuuguuuuacucuauaauucuuuacaaaaacaucaccaacucaaaauaaaaaauaauuuggagagaugacucagcaguuaagacugugggcugcucccuccugaaggaccagaguucggaugccagaacccacagcaaccacaacuguucacagguaacuaaagcagcuccgaggaaucuggcgcccucuucuggucucccagugcucacacacauacacauacacauggcauacaaacacacacuugaacgcgggcaagcacacccacauccacacccacacaaauaaaauguuuaauaaauacauuuuuuuuaaagcaagaaagaauccuuguggugcauaacuacaucggucucuaccucuauauccugggagaacccaaucuccagccuucgggcugacugagucucucuaccuccaaguggccacuguugauugugaugcuucucagacuuacaugggcgcuuacugcuucuuuuggcuuaaguuugggcuaugugcacuucaaccaauacccuaucaaacaacugcacaaaguuucaggugcuuugcuaaccacugcccuugacaaugcagcuugcacuuuuuugugucacugcaaggacaacgagauccagagucuacaaaucauguuucugaaaaaucuuguuuuuaaaacuucaauguaggggauucacuucgauuugacagauauguauugugucagacauugucuugaacaucaaguuuucuaucuugccagugucuauucagaacacaauaguaaguauucuaccuucaguggaccauaauuuuaacagaaacuacuagaacuaauguccucuaauccacguauccuuuaaauacagggaucuuuacccaguacccccaaagccuacugccacccuguaaguauguaagcacuuacaaguggacagacacguugguaaacugaggauaaacuucaguguaccaaaacaucucauguauugccaugggguuugugugccacuauuuaauaauuacaauaacacugauaauaaugaacuuaaaggaauauuacauugcuagacucuaaacauauuaauuagcuuaacuucuaacacaaugagaaaaugcuggucaaagaaaaaugguccuuauauggggcuaaguuaauaaacuuucuggguucuaucuuugugacuuuaaaugacuaaauacaaguaccuaccuggugaauuugccacugagucaaagugacaguuagccaggauagcagacucggcuccaucccggggcuccagcuuuaccacgacauuaguaauguugucauaguagcucgugaagccccccaagaagucaaugcuaaaggaaccggugggccgcuguauaucuacggagaugcugugaaggcuguugcuuugugcuucuaucagcuugaucugcuccaaaagguacuguaccgucagaauuucauuuucugugcuuccuguaguccuggggccaauggccguuauguguuccagauaaucccuggagacaaucagaaggauggugauggcauacacgcacaagccuaacucagcuuggaacaacuccccacugugcuucccucccuccaaccgcagaaaguucagaucuucugacuucucagaaagaaaaagaaaaucacugugccucucuuccaccucuaacucuugagaucuggaacugaaggugcuuuaaaaagagagagagagagacaucucaagaaaaugaucuggaagcuucaucauuuuauacugcguuccaggaacuaaugcuuucacacuuuucuccauugacccauaccaaaucagcaccaagacuagggcuuauucaguauguacgagugcugaaggcaggacaacacagcuucacuggccugacuccagccgauaguuauggauugucccuuacugggucuaaggggcugaagccaucuguauagccaugcaaugccaucaaguaggcaugauuaacuucugaaaagaauaaacaauaaacacaagccucuugcuguacacaccaaaccuaauaacuucaguucaggucaaaauuaacccuacuccaaugagggaugggugggaccggaggagagacugggggugccuuccaaaaagcucuuaagaaaacucaucuaaagaagcaacuuuuaaaacacaauaguaguugaaaacuuucuacuagcuuaaggacucaucugauuuaagaugcaaguuacagaaucaaagaauucauauuuucaaauacaccugaggucauuuaaaaaaaaauugaacccuuggccagcaguggaggcgcaggucuuuaaucccagcaccugggagauaaaggcagaaggauuucugugaguuagaggccagccuggucuacagagggaguuccagccagggcuacacagagaaaccuuaucucgaaaaauaaacaaguaaauaaauagaauaaaaaaaauaaaaaauggggcuggugagauggcucaguggguaagagcacccgacugcucuucugaagguccugaguucaagucccagcaaccacaugguggcucacaaccauccuuaaggagaucugacuggugugucugaagacagcugcaguguacuuacauauaauaaauaaauaaauauuuaaaaaaaauaaaaaauaaaauaaaauaaaaaauguugaacccuauacaauccguaguacagaagagccauagaccaucugcgaccuucagaaauuacaggcauaauucugucuggauguacucugagucuccuuccacagcuuucagauaugagggcuguggugcuuagaaagguuagcacgcacuacauuacuccucucccacaccaucccagaaagacuugguaaugcagcccuggcacaaaaaccucacucuccaucucauuuuaaaugcagagaacuaaccaaaguaaaaaguggaaguugcucgagaaagagaggagaaugaugaagcgugugaacaaccaaucaucugcaggaggaagagaguggaugagaaagcagacucaaucgaucuggccaccccaagaaagcgaaagagggagccgaggaagcccggaguacccgcaauucagacccccggaggacgcgcaggaucaucccacuucccaccgaggugcgcccaaggaccccgggacucugcauacagcagcgccggccuccuccgccuggggcacaguggcgccgggcucacccgcgcgggacucacccaccaggcgcucccccaccccggggccgcagaggacucgcggccgggccgaucggccguaccuggcuuggcgcgcgucgaacucgcccuggagccccgagguccggcucagcaccagccgcugcagcgagagcugcacgagcgcccgcagcgcgagcagguagagugcgagcgccagcgccgugcgcgccucggacagcgcggucuucgcaacccggcucccgccgccguucuccgucuucccccacauccucccgacgcccuucgcauccuccugcgcugaggccucucucugccggugcgacgcggccgccucucccucccgacgcuccgcggugccgcggugccgccgcacagccgcugacuccgagcuccacuccauggcggcaacugccaccaccaaccgccccagccugcgacaguccgggccaccgcggccuccgcagcg

SEQ ID NO: 9236 - RNA, 40209 nt, Mus musculus
cgcugcggaggccgcgguggcccggacugucgcaggcuggggcgguuggugguggcaguugccgccauggaguggagcucggagucagcggcugugcggcggcaccgcggcaccgcggagcgucgggagggagaggcggccgcgucgcaccggcagagagaggccucagcgcaggaggaugcgaagggcgucgggaggaugugggggaagacggagaacggcggcgggagccggguugcgaagaccgcgcuguccgaggcgcgcacggcgcuggcgcucgcacucuaccugcucgcgcugcgggcgcucgugcagcucucgcugcagcggcuggugcugagccggaccucggggcuccagggcgaguucgacgcgcgccaagccagguacggccgaucggcccggccgcgaguccucugcggccccggggugggggagcgccuggugggugagucccgcgcgggugagcccggcgccacugugccccaggcggaggaggccggcgcugcuguaugcagagucccgggguccuugggcgcaccucggugggaagugggaugauccugcgcguccuccgggggucugaauugcggguacuccgggcuuccucggcucccucuuucgcuuucuugggguggccagaucgauugagucugcuuucucauccacucucuuccuccugcagaugauugguuguucacacgcuucaucauucuccucucuuucucgagcaacuuccacuuuuuacuuugguuaguucucugcauuuaaaaugagauggagagugagguuuuugugccagggcugcauuaccaagucuuucugggauggugugggagaggaguaauguagugcgugcuaaccuuucuaagcaccacagcccucauaucugaaagcuguggaaggagacucagaguacauccagacagaauuaugccuguaauuucugaaggucgcagauggucuauggcucuucuguacuacggauuguauaggguucaacauuuuuuauuuuauuuuauuuuuuauuuuuuuuaaauauuuauuuauuuauuauauguaaguacacugcagcugucuucagacacaccagucagaucuccuuaaggaugguugugagccaccaugugguugcugggacuugaacucaggaccuucagaagagcagucgggugcucuuacccacugagccaucucaccagccccauuuuuuauuuuuuuuauucuauuuauuuacuuguuuauuuuucgagauaagguuucucuguguagcccuggcuggaacucccucuguagaccaggcuggccucuaacucacagaaauccuucugccuuuaucucccaggugcugggauuaaagaccugcgccuccacugcuggccaaggguucaauuuuuuuuuaaaugaccucagguguauuugaaaauaugaauucuuugauucuguaacuugcaucuuaaaucagaugaguccuuaagcuaguagaaaguuuucaacuacuauuguguuuuaaaaguugcuucuuuagaugaguuuucuuaagagcuuuuuggaaggcacccccagucucuccuccggucccacccaucccucauuggaguaggguuaauuuugaccugaacugaaguuauuagguuugguguguacagcaagaggcuuguguuuauuguuuauucuuuucagaaguuaaucaugccuacuugauggcauugcauggcuauacagauggcuucagccccuuagacccaguaagggacaauccauaacuaucggcuggagucaggccagugaagcuguguuguccugccuucagcacucguacauacugaauaagcccuagucuuggugcugauuugguaugggucaauggagaaaagugugaaagcauuaguuccuggaacgcaguauaaaaugaugaagcuuccagaucauuuucuugagaugucucucucucucucuuuuuaaagcaccuucaguuccagaucucaagaguuagagguggaagagaggcacagugauuuucuuuuucuuucugagaagucagaagaucugaacuuucugcgguuggagggagggaagcacaguggggaguuguuccaagcugaguuaggcuugugcguguaugccaucaccauccuucugauugucuccagggauuaucuggaacacauaacggccauuggccccaggacuacaggaagcacagaaaaugaaauucugacgguacaguaccuuuuggagcagaucaagcugauagaagcacaaagcaacagccuucacagcaucuccguagauauacagcggcccaccgguuccuuuagcauugacuucuuggggggcuucacgagcuacuaugacaacauuacuaaugucgugguaaagcuggagccccgggauggagccgagucugcuauccuggcuaacugucacuuugacucaguggcaaauucaccagguagguacuuguauuuagucauuuaaagucacaaagauagaacccagaaaguuuauuaacuuagccccauauaaggaccauuuuucuuugaccagcauuuucucauuguguuagaaguuaagcuaauuaauauguuuagagucuagcaauguaauauuccuuuaaguucauuauuaucaguguuauuguaauuauuaaauaguggcacacaaaccccauggcaauacaugagauguuuugguacacugaaguuuauccucaguuuaccaacgugucuguccacuuguaagugcuuacauacuuacaggguggcaguaggcuuuggggguacuggguaaagaucccuguauuuaaaggauacguggauuagaggacauuaguucuaguaguuucuguuaaaauuaugguccacugaagguagaauacuuacuauuguguucugaauagacacuggcaagauagaaaacuugauguucaagacaaugucugacacaauacauaucugucaaaucgaagugaauccccuacauugaaguuuuaaaaacaagauuuuucagaaacaugauuuguagacucuggaucucguuguccuugcagugacacaaaaaagugcaagcugcauugucaagggcagugguuagcaaagcaccugaaacuuugugcaguuguuugauaggguauugguugaagugcacauagcccaaacuuaagccaaaagaagcaguaagcgcccauguaagucugagaagcaucacaaucaacaguggccacuuggagguagagagacucagucagcccgaaggcuggagauuggguucucccaggauauagagguagagaccgauguaguuaugcaccacaaggauucuuucuugcuuuaaaaaaaauguauuuauuaaacauuuuauuuguguggguguggaugugggugugcuugcccgcguucaaguguguguuuguaugccauguguauguguaugugugugagcacugggagaccagaagagggcgccagauuccucggagcugcuuuaguuaccugugaacaguugugguugcuguggguucuggcauccgaacucugguccuucaggagggagcagcccacagucuuaacugcugagucaucucuccaaauuauuuuuuauuuugaguuggugauguuuuuguaaagaauuauagaguaaaacaaaaaucacuauugaaauaauaugugaauccugcucauuguauuaaauucugaaaucuugauaaauuuccaugacucauaauuuuuuuuauaagcuagacaggaguccaucuaaacuacugacguccauugucucuaaaauuucuucucuauaugcucacauaaauauucacaaguaaaauaugaacaaaaaaacccagcuaauacaggcaguuaagaauagaaagugacagccagacaguaguggcacacucugguaaucccagcacuuggaaggcagaggcagguggauuucugaguucgaggccagccugguuuacagagugaguuccaggauagccagggcuacacagagaaacucugucucaaaaaaaaaaaaaaagaaggugacauuuuacaauggcauccugggauuauacacucaagaagacuccucuaauagacaccaagccgaggugggugcugggcguccugaccaggaggagagcaucugaguacugggccaucuuuuggcauauugcuuaaccuaaucuaucuuuaauuucuuaauuguaaauggaaaacugauagcuaauuuccuaacaauguugcucacaaauuaaguauaaggaaaccuuuaggauagcaucuuucagaggaagucuuccucugguggugguacuguugguaacaauacuucuagauugcuugaauguauagcaggccuaauauaacacauaagauauagacuagccuugacuugaugaaaugauauugugauaagacauuucuuuauauuuagaauguauuuugcuuauucagacaucaguauccacacauucauuuaaaacaaggcagaugugcccuaacuaugucagggacacuagacagagucaccuuuugcucaccuuucagacgauuaaauucuggaaagggucauauaauaaugcugugauuguuacagagcauuauaguagaaagacuggauauguacguaucaaucaaauguagagucccuugccuuucauaauucuuaugugggaauaagauaagauuguaagagaagauaguaaagagaaaaaaagacagacaggucauugccaugugugcacaugugucuguuugauaacauggggaacacaaaucauuucaaagaggcgagucaguucucugccuugaauauugucuucaucaaagaacaauacuuuuuuuuugaaaagugaugagacaaaaggagagaaccaggugggguguagcucagugguagagcgauugcuuagcaugugucagcaccaggucugucuuuagugcugcagaacugcacaacaaaugaaccaacccggagggaaucccgaaccaaagcaaaaaagcccacaaaacaaaaaaaagggagaaaggaccuagagccuguguggcagcgaaugugggaaaccgugugaauggcaagcccaguggggaaagcuuugggucuguagccucuccagggccuaugguugucuuuguagauuaaccuucauccuuccaggcagacagggaggcggaaccccugcauagauuuacgguccguuuuuaggcaaauguggggagagcagagagcuuuuuuugugucuucagauuucuuuuuaacaccaaagagccuuguguuacaguaacauguuuugaguggcauuuucugcugcuguuaacauagagccaggcccuuagauuauaugugaaguccacuaaugaaaaagaguuuagagaaccauuagaauuuuuuuuuuuuuuuugguuuuucgagacagggcuucucuguguagcucuggcuguccuggaacucacucuguagaucagacuggccucgaacuuagaaauccgccugccucugccucccaagugcugggauuaaaggcgugcgccaccaccgcccagcccauuagaauuuuuuaagcccccccccccccgccccuuuuuuagagaaaggaucuccuggagcccaagcuagccuugaacuagucucauauugcuguauagcugaggcugaccuugagccuucugaucugagcgugucaccaugcaugguuuaaaugacuaaaaagacuuuuguuuuucucagauugucccuauggcuuccugcaugcuuacucccaaaugcucuauuucuaguuuagaaauaauucuuaccuaaaauuguauaauacuccuacugauaguaugaaggaaguaucuaucaauaauaagcuaagagaagcuuaagugaaaacucaugcaagugaaaauaguugucaccugaauccugucuguggaugaacucaccgaggccugaguguucuuuugugcaugccagucaugguggggguggaacccgacaccuguacaugcucugcccccaagcugucuccagccucaggaguguuauugcggcauccugagcugugcagucucggcuggccugaggcuuagcagcggcucugccuuagugaccccagggcuggaucacaggccugccuggcugugcuuguuuuccugugugugcuauucuaaaguucucagccgcauagcuggacccaggaauugauagcaagaaguaauguuaccuacagaagggccucauuuaucuucucaggucugcugugccgugccaggucuuuggugaacaucugaguuauuuugggguggcuucacuuucagggugauucuaaauggaaagagaugucaguuugucacuuagccuucuuacugucuuuggauugucacauucucaaagguguugugacccucuucuguucucuccuaagacacugguacccuuagaguagggagaugagugggaaguuuaacguguuaaucagcuauauauaaaguuaaguguuguuaauuucacuucacugaauaaagagaaguguuacugcuugcuuuucauuuuaaaauaacagucucaaauggaaagaaagcguuuauuucauguucugagaagugacgcacgcugcuuacaucagccuauaccccugcccuaacagggauuauacccccugccccagcagggaucagccuguacccccugccccagcagggaucagccuauacccccugccccagcagggaucagccugugcccccugccccagcagggaucagguaacgguuacuuuguuucacuuucauuaaugacuaaaguaccguccaacaaucaccagggcuagugucacuaauauuguuucuuuuugagcagaaguggggcauagaauucagcagagcccuaaagcaaguguuuacuuucccugguuacagagccuccccuaaguuuucagagagaaggaagaaagcuaacagaggauguuucucaggugccaaacaauggguguuuucuuguaaaaucugugcaaaaggccugugggguugaaucaucagucugcuuucuagaccucggaagagugagcggagugagggagauaaaacuugcccuccauccuuccugcuccugaguccucacugaacuugggagcacccugacucaccgcugugacucaucgcacuccccccccacccccucccggaagugcugcugccugaguuaugggguuuccuuucucuaacugcgcugucugcuuccuauuaugaaaagaaucagaucagcagaaagcagaguuguuuccugaccuccagggugccucccacugcggaucugucuaggugcacuuuuccaccucagcccuccuccuugguucucuccgcggcugcacugcuuccucuagguucagucugcacuggugaggcgugagggccccccaacaugcuaacaauuuuaugagauaccucacuuagaaauuuagcaauaaucuucuagcgucaucaaauagccagccagucccuuuaacuaccucucauggugcuuuuaaaaucagcacuuggggcccagcaaaucgguccagugcuuaaggguaccugccaccaaggcugccggcuugcuugaguuuggacccacaugacagaaggcgagaaugaaguccugcacauugucaucugacuuccauaugugcucuguggcaagugugcccccccucccccaauaaacacauaaaaauguuacagcaacagauuuaauuaaaaacaaucagaguacuaggguucuuuucauaaucuuuagauuuucugauguagaggcuggaguaucuuacugccauccuucucucucucucucucucucucucucucucucuuucuuucuuucuuucucucuuucucucucucucucuuucucucucucucucucucucucucuuucucuuucuuucucucucuuucucucuuccuccuuuucuuucuuucuuucuuucuuucuuucuuucuuucuuuuuuuuggugccguccuuuucagugcugggaccaggcacaguucacucuucugugccuuaccauucaggugccucuguacuuugccauuacuugaucccuuuggaaagacuacuuaaagcauccaguguuacucccucuguaaauguaggugcuguaguguuuaugauuuugaaagaaugugguagggaggaggaagccgugagcaccagaaguacccagaggaugggggaggaggauccaguccaguuggccuuaggauccaucuggcugauugaugccccagcuauugagucugaacugaacgaaugcuuccacuggucacaucauugaggaggccaggcaagggucuuccagggccuguuuuuguugagcauaguugucacccugugaugacagaguucugcuuccagucaugcagcuauggugaugccacuuugaggggaaacucugagaagugccucuguuuuucugacuucaaggugccagugacgaugcaguuagcugugcagugaugcucgaaguucuccgggucaugucagcgucuccagagcccaugcagcacgcugugguguuccucuuuaauggcgcagaggaaaaugucuugcaaguaagauuuauuguuuuaagcauuuggguugaaaaauuuugagaggaauaaugacugguaacguuuuauuaguaauaugaauaguaucauaaaaauaauaugcaaaauaaacacuauguacuggcuaguuuugugucaacuugacacagcuggaguuaucacagagaaaggaguuucaguugaggaaaugacuccaugagauccaacuguaaggcauuuucucaauuagugaucaagggggaaaggccccuugugggugggaccaucucugggcugguagucuuggguucuauaagagagcaggcugagcaagccagaggaagcaagccaccaaguaauaucccuccauggccucuguaucagcuccugcuugaguuccaguccugacuuccguggugaugaacagcagcauggaaguguaagcugaauaaacccuuuccuccccaacuugcuucuuggucaugauguuugugcaggaauagaaauccugacuaagacaaauugguaccagcauagugggguauuccugugacaaccugaccauguuuuggggaggacugugacuuuggaacuuugagcuagaagagccauucgguguuaagagcucugucagauguuguauagaaguuuugaagauaauguugagaacaguguagaagaugaaggucuggcuugugaaauuucagaggaaaaauuaaagacucuuuucagggccauugcuauuuuggauugugaagauucugugguucugguuagcuggagcugaagaaucagcugugauuaacaagauaccagaacuacuaaagcaaaaccuuugcauuacugggacuauugaugcuggcuagcuggagcuaagaaauuaacggugauuaagaagagaccagcaucauugaggugacaacuucuaugaaguguuuucugaaagcacaaagaggcuguguuccagagauagccaagguuguacuccugcugcagugggacuugguaauauguaagggucacccaggugguacuaguuuugaaggcaugaaggggucacgcagaacagcugaggcucggcacugugagaggccauggaagaccauuggugaaggugcagccucaguugcaauugauagcccaggacugacggggucaugcaguguuuuggagaugccaguaccaugagaugaccaccaagagcagcagcagcaguggaguacaggcaucuggagccuagaggaugaugcgugugcuacaaaggacauggcuggagaaaugacccaagcccuuggaggagcccagaagaucgugaguuggaucccagacauuggacaguuggagaacgacuuaugcuuuugauugugacugugcccugauauuuucccucuugaaggaagaaacuauuuuaguggagcccacaguuaagagacuuuuaauuguaaaaagacuuuggauuuuaaaagagauggauauuuuaaagagauugaaaauuuaaaaauaaguaaagacugugggauguuuaaaguuacuuagaccuuggggaugaauaagaauguaaggguugaggcuuacuagugauguguuugugugucaaguugacaaggggucaauuguacuggcuaguuuugugucaacuugacacagcuggaguuaucacagagaaaggagcuucaguugaggaaaugacuccaugagauccaacucuaaggcauuuucucaacuagugaucaagggggaaaggccccuugugggugggaccaucucugggcugguagucuuggguucuauaagagagcaggcugagcaagccaggggaagcaagccaguaaagaacaucccuccauggccucugcaucagcuccugcuuccugaccugcuugaguuccaguccugacuuccuuggugaugaacaguaguauggaaguguaagccgaauaaacccuuuccuccccaacuugcuucuuggucaugauguuugugcaggaauagaaacucugacuaagacacuguaucuggcagugguuuaaaaaccccccaugcauguaguauguacaguaugcuagaaacucagcugagaacugcccauccccccaggacucuuucguuguuuucacucuggucuuugaggcagggccuugcugugucucuuaggcuggccuggcacuugagauccucccaacccagcuuucugagugucgcuguaacgagaaaagugugucaagggcuucucaauggcaucccucuccugaccuuuuaaagccccgacaucagagagaugaggaagguacacagcacuaaugcuuaaccauauggauucucucgccuguccuuucuucuuaacuucugcauauccauuuucacagugacauuuacuuggcaaacugaacccaccguuuuguauaggaagauagccauucugugugcaaauaagcaaaauaaaaacauaguuuaaccuacauuuuuuuuuuccucauuaaggcaagccaugguuuuauuacucaacaucccugggccaguuugauucgagcauuuauuaaccuggaggcugcuggugucggagggaaagaacuuguguuccaaacagguaugugaggcugugcacugagcaggucagugcgacaguggaaaguuucucaggguacaaaaccuuuuuaaugagcaaucucuugaaugagguugcauuuuaaggcaugaauguguuugguaauauguacgaugguaugugugcacauguaugugcaugugcauguaucugcgccggguccuugugugcuugcuuaugguagccagagguguuaauaucaggugucuuccucauuugcauucgaccuuuuugagacagagccucuugcuggaucuggaacuuauccauucagcuagucuggcuggcuguugaguuccaggggccuucuugacgcucuuuauuaauuuuaaaaagcaaaauaaugugagcagcaugugcuccuguauaguacuuauuauauguaaauguuacacgaaguuauuuaguucucaaagugugaugaacaccugcugcugggcuuccgcucuguggaugaggaaccgaggugagaguuuuucuuguaagguuuuauacuugguaugugacaguggauuugaaggcucagagucgguucacagugaguaacuguauuguaauaugugcugguugguugguuuauuuauuguuuugacaacauaacucaaacuagaguuaucugagaagggagaagcucgguugaggaguugccuccaucagacuggcaugugggcaugucugugggcaucuucucuguggauuagugauagauacggaagggcccagcccacuguagauguaccacuucccgcagggaauccugaguuuuauaagaaggcugagcaaaccauggagaagagccguccccuauagccugugcuuuacaguuagccuccggacuccugacuggagucccuauccuagcgucuguugugauggacuccagaaccuguaagccaaaugagcccaugucucuucaaguuccuuuuggcuaguagagaagcaaauaaggacauaguacaaugugaauauuauuaauuauagaugauuaggauguaaggguuuuaaaaugauaguaagaauuaaaaugagaaaauuuacucccaguuuaaggaauuuaauuucaucagugaguaauuugaaugucaaaaaacaaaagaaacaaaaacccaaaaaacaaaaaaacaaaaccucccccaaaaacccauuaaguguaacaggcagagagaguuguaauuuuaggauuaugauuccugaagaugacaggguauaaccguugaacaucauguucuugccauuuuagcaaagucgagagugcacagacuugcucagcagggccugcuaagaccugacuuuggaagacccaccuccucuccugcccccgccacacacaaagcuuuggccaaagcugccucuguugugugagucuagaccaucucauuucacaucccugccgcccuugaauccgaucccucugccucuaccuuucgagugcugggguuagaggcauguacccugccugacuugccaggagucuuaauagugaguaguguuuugggugagagggguuagaggacgugaguaauggauagaaacuuacucucuagcauuuuuaaaagauguuguauuauuuaaguuuugaauguacaguaagcacuaaguguuuuuauaaccuagacaguaucauauuucaguacucucucaaacuuacuuuaaacuuuuaaaaagauccuguauuuuauuuuaguuaacaccuuuaagaaauucaggguugccaguuugguggcuuaggcuuuuaaucccagcauguggcagagacaggcagaucucugaauucuaagucagcuaaggcuacauagggacaccuuggccacacaaacacacacacacacagagucagaauuaaaaugcucauuuguuuccagauaugugaucauuuugaaaguccauguugcuggagauuuuuuuuuuuuaaaucuaaagccacauacauuuaguuaaggaguaagaacuugggucuaaucagagccagaaaaagugaauacucgguagaugcuaacagagagcugccugagccgagacuuuauuuuaggaaaguguguguaugugagagagacagacagacagacacacacauacugauacacacacacacacacacacacauacacacacacacacaauucaaggucacaagcacaaggugagaaacaacaagacuuuucagcucucaaauuuuucuccuuucucuugaaucagugagaagcagcugaacucuaauaucuuuaggaauagguagcugcuaucugcucuggccccacuuucuugaugcaggaggaacaccuucaacaccuaccaaaucagaaaggggcagcagagagcgcuaagcaaggacauugagucucacuggcugugaaagccaggcuccauagagcaacagcuguccuggguguccugucagaaguguacugugaacuuaagugccuucaucuccaugccuuuaaguuaugcagcagcugcucuaucuucuggugccccgauaucauccagucucaugguuuaguccaaaugacuccugauguuuuuuucugcauauauuaguacagucuacauagauaguuggaagagaugagagcucacuuuccuaaaaugaagucucuguuagcuucuaucgaguguuccauuuugcuggcucugauuaggcccacguccuuacuccucaacuaaauguaugugacuuuaaauaaaaaaaucuccagcaacauggaauuucaaaaugaucacauaucuggaaacaaacgaacaaaguuagcaccaguuacagguagaaggugguguuugcuggugggaccaggacaggguggcuguggcaguggucgggggaggagcaugaagagccagugagcuuuccgcugcauagugaagcuaggugcacagcagaucccugccugccugaucugcaguucucugugcuguuaaguaguucccguguauuuguuacuuugauaauaagaccccaguaccuccucaguauaugugcaaauuaaacauuuuacucauucuaaaaccugaauauuuuaagacuuacuccccuggaaggaacccauaacaaucgugcugagaacauccuucuuagcugaauuuuacaccauucuuugcuucuaguguugagcuuaucuuaacgguugaagugugugccugagagcuuuuggagguauuuucugaugcuccaguguguuucucaggauacgucucucacaucugaggacacugccuaaagaagacuagcuuucuuggggcucugccuucuagaaaguuccuaguguugauuucauuuuugacuaagagaacaaguacucuagucuggccgacuuagacuugugucugagaccauguguccgauggcccugcccucagcuugcuuucuguguggugagaaaucuuaucuucuccugacuuuccaguuaaaaaaguuuguacucuccagagcuccauggucacuggagagggaaaugcucauuugggaugccugauggcaucauuuuugaagauguuaauaaaauauaacuuuauaacauuuaaacagaguaaaccauuaacauaugccccauuuugaaaaauccaaacucuacugaguacgagaauucugguaaggcauaugcucauggcuuuuccaccacucugagcaaaccagugcuaauuugcucuauaacuuuuugagauuuuuaagguauuuuuucuuauuuaaguuuuuuaaaauuuauuuaccuguauuuuuuuaagauuuauauauuuauuauauguaaguacacuguaguugucuuuagauacuuuuucuucucucucuggucccucucguuccagccccacucacucugcccaaagauuuauuuauuauguguaaguacacuguagcugucuucagacacuccagaagagggcaucagaucucauggaugguugugagccaccaugugguugcuggguuugaacucaggacuuuuggaagagaagucagugcuccuaaccacugagccauuucuccagcgcccauuuaccuguauuuuaugugcauugguguuuugugugcauguguaucuuggaguuauagauaguugugaacugcuaugugggugcugggauuugaacccugauccucuggaagaacagucagugcccuuaaccacugagccaucuuuccagcccugggauuuuuaaaaaaaauguguauuuaugugcaugaacacauagucauauuauuuccuuaaaaauggaauaauauuuagcaacuguugccauccuuagaauauauauaaaauccauggcuuuauuaagguauaauuuaaguguccuguaauuuauccacuugugguaagauuguguuuuagguuuuuccacauaguuguguaccauuaucauaauucuagagcauuuuaagaaaagauuuguuuaugcuuguaugcucauguguaugugaauaugggcgcaugugugugcagcugccgaaaaagguaugaagaagucaucggaucccuuagaguuagaguuagaguuagaguuagaggugucugugagcccccugacaugggugcuaggagcugagcccugcuccugacaacugagcagcaaagcucuaaccacugagcaacucugcaucuccuagaacauuauuccuaaggagucccuguacucaccagucagcucucgcucacauuuccucagugcagccagccacauguggucuguugaacagagcuauccgauuaauccuguauuguguugucuuguuucauuucaggcccugaaaauccuugguugguccaggcuuacguuucggcagcuaaacacccuuuugccucugugguggcucaggagguuuuccagagugggaucauucccucugacaccgacuucagaaucuacagggauuuugggaacauuccagguacuuuguucguggucacaggcuguugaaucaaaaacaaacuuuauuucuugaaaguuguaauagcuucugagaggacauuauaugugagauauuuaucuucugacucacuguuuuaauuaagguuuuaccgcugugaacagacaccaugaccaacucuuauaagggcaacauuuaauugggccugaauuauagguucagagguucaguccauuaucauuaaggugggagcauggcagcauccaggcaggcauggugcggacagaacugagaguucuacaucuucaucugaaggcugcuagcagaagacuggcuucagcuaggaugagggucuuaaagcccacacccacagugacacaccuauuccaacaaggccauacuugcugauagugucacucucugggccaagcguauucaaucuaccacacucaccaaagcagcguucuugaugcugucuuuucaaagucccauagugauuuaaaugccugccuccucuguggugucaccaugcgccagugugggagauggagagaugccagcgagccucaggguuuugacuccugugcugcugucuugcuuuuccaacuccuuugaugauuuuuacaguuggagauuuaaauuugguucguaacugcccaaauuccauccucaaaacuuucucccccuaaugugugacuuaaugcuuccuuaauguuuuaaauuauugaccuugguuauagauuuuuaaaauuuaauuuauuuauucacuuuauaucccaauauuagccccugccccccaccguccccugguucuagauuuuguaagaaaaagauuuauguuauucaugaguaugacagauaucaguuaaccucuuguuuugacauuucgucuuuuagaauuuaauaugucaaacaaacaggccuaacacaagucugaucuuuaaaguaagaugacuuuuuccauugucuaucuuaggaauagacuuagcuuuuauugaaaauggauacaucuaucacaccaaguaugacacagcggacaggauucucauagauuccauucagagagcagguugguauuuaccaguuuggcuuuugauauacaaugaugaucuauuaggaguguucuauagucugugugggagagagacaguauguggccaaaugcguuacagacuugcaguggaaagaugagggcuuaaaaguuuagucuuugaugucugacuuagcaauuaaaaacuuagaaauagucacugugaauacuuacaaaggaguggccccaggcugcaggagggcuguugaacaguaaagaccacagacaagugaaugcuaugaaccguaguagcaucaggaccuggguuuguacaccagaugcaagcagagaaugguacauggaucccuuguuaggguggcgaggacagaugaggcacuuacguagacagagcauuacagugcuucccggaggucuagaagcauuagcggaggcccaccugaggcuuaggaagguggcagggauuugggcuucggagagacgauaacguuuuuaaguaaaagcauagcauagagcaggagggaccugggaggaggggacggaaggugugcugugcugucaggcuggaacggaagcagugcuuucagaaauagaaggggacgagguugaaauagaugggguaaggcugcuagauggcuucaaaaguuaucagggauuugaagguagagagcuugccugauguguacgagauccuggaguuuaucccuagcauugaaauaugguugaguagauggcucagcaggcaaaggcucuugcugccaaaccuagcauccugaguuugaucccugggacccacauggcggaaggagcgaaccaacugcagaaaguuguccucugauccccgcaugugugcuguggugagcagcaccccaggaaauaagaaugugauauacaauguguaaacucaaaaagaaccuaaaggaauaaggaauccuugaaggucucauuaaggugaccucauuaaugaacucauuaaggugguguuaaguguuauguucuggccauguagugcggaguagagagugagcagugaguuucugacaguuguuuauacggaugaagacaagcccugacuggcgcuaacaaaggugcugggaauuagguacauuuugaauauuuggagugucucucaucuuguguguguagguguguguguguguaacuuuccucucuucacggacaugguauaucaaaaaucuggacaguuucuuacuuuagugagguccuacccauucuuacucccugcguaggguagugaccaggcuacacguuccuacccauucuuacucacugcauagggcaaugaccaggcuacacguuccuacccauucuuucuuacugcguaggguagugaccaggcuacaaguacucacuacuugucagcucccugcuucuacuucaagaugcugggguuacaguccuacacccccacuccuggcucacuucaaaaacauuuuuuuccugauguaggauuucacucuguagcccaggcuagccuugacguugcagccuuucugcuuccuuccuaacugggccuuucauuguuauuuguucugguuuguuauccugauggacuggggaucaaacccaggccuugugcaugcauugcaggacagcauuguaucaugguuccagagccaacucuccaguuaguuuuagggaaaauuguuuuuguuuucuuuuuaagacaaggucuuguuguagagcucaggccagcugugaacuugcuguguaacauagguuggccuugaauucaugauccuucugccuuugcuucuccuucauaauauuuuuuuuuaaagauuuauuuauuuuuguguguauugauguuuugccugugugcauguuugugagugccagauccuuugcagcuggacuuacagacaguugugagcugccaugaggaugcuuggaauugaacccaaguccucuaguacagcagucagugcucuuaaccacugagucaucucucuaacccccuaauaauucuuaacaugcuuuaacaacuucacgagaggcguuuuuuuuucguuuucccacugccuuuguggucuuagugucucaugguuauaauguauccacugccuuuguggucuuagugucucaugguuauaauguauccacugacuuuguggucuuagugucucaugguuauaauguauccacugccuuuguggucuuagugucucaugguuauaauggauccacugacuuuguggucuuagugucucaugguuauaguguauccaugggcaggcuugagguggagcucuggggcugugcauuuggauuagggaagagcaguaugagagggccacggcugagcuucuaaguggggaggaaggagagcaggagcagggaccucaucugggagaucuggaagaaagggcaaagcgguggaggguggggugggaagaggugucugcucguguacuucccggguccguuguuuucagauaacgccugauucacuucugcuucaugcgucuguauguggaagucacaauggaguagcuuacuagaccauguuauuuuucuuaauaaaaggugacaacauuuuagcaguucuuaaacaccuggcuacgucugacacccuggcuucuucgucugaguaccggcaugggagcaugguguucuucgaugugcucggccugcuggucauugcguacccuucucgugucggcuccauaaucaacuacaugguggucauggccgugguucuguaccuggggaagaaacuucugcggcccaagcacaggagugagucguucccuuuaccgugcgcuucugggaugggggugggacuugcuggggagaguuuagccguugucuuuguuucuuuaaguaucuuaggagguugcuugcuuuacauuuuuagaaauuccuagguaaguaugaaguugguaugcuccuuaccuuugaggguuggugaagaugaccauucucacgcacucacccugaaacgggcaaagucagcuggauuggcugccugagcccaacugauggaaggcagggcaguguaagaaggcagggcuguguaaagcuaagcccugcuaugcaguggaugcccugugcccugcaggccucggcaggaggcugcccaagcacccuuucagcagcuguguucauccagucucucguuaaggugugaaaucacuaacaaugcugaaauggaacuucagugcuagaagguguuugcuuuucuaaaaaaaaaaaaagaguugcuagaauuguuucucuacuuauuaauaacaaauaauuucuuaaaauucaguaauauuuuauacuaugaccaagucuauaaccaguguuaaaacuaaaguuuacacaaccaaaaagaaaaaaagguuuguagagguugacuuuaaaaaaaaaaaaaaaauauauauauauauuaacuuauuuguugugugugggcacauguguaagucuggaagucagagggcagcugugggaauuggcucccuucuuccaccacguggguccuggggauccacuaagcucaucaacuuggcccgcugagcucuccugccgggccuguagguugacuguuagugaaacgucucaggaggucugcugugcuacaggccagcagcacaaaaaugggugcaauugcaaucuuucugcuccccuucugccugaaucauuucugcuugaaauguugcaggguugaaauugucauguuaucaugauauaaguacuuagcaucaauugaaauuauucuuuaucaccaguuaucuucccugccauuauuucccaucuuuaaaaacauuuuccauuuauuuauuuaccuacuuacuugugugugugugugcuugugugaagucaguagacagcuguggcuuaguuugcuggggucuggggauugaacucacgcugccaggcuugguuggccaagugcuuaccugcuggaccaucuugccagcccuaugcuacugucuuuuagcaagaguuuauauggaacugcguccuuuaaaauucuugcuaauaguuugauaaaugaagcguucuacaaguagugauuacuaccucuuuccuucguaaggagggugucugaauuccugugagauaucgcuuaauuguuaguauccugggcucucaauguguuccuugaacaucuuuauucuuaccccauucuugugucuuacuguucucuuaacuacgacauuuaauauuuucaauuaugcaguagaguuuucauuuuaauauuugccccuuuagcugguuuuugucuacugguuuuguaauugguuugaugaagauggugacguuaacuuuuuguuuucucuuucuuagaugcuaauuacaugagagacuucuuguguggacucgggaucacauucauuagcugguucacuagccuuguuaccguccucauuauagcaguguucaucucucucauuggacagucucucucaugguauaacuacuuuuauauugccguuugccuguauggaacugcaacagucgccaaaaucauauucauucauacucuugcaaaaagauuuuauuauaugguaaguugcugauguguuuauuguuuucuuuuugcugcuuucacaaacugaggacaaacaagugaaauuauuguguauggucuuucagagcuauuagacauuguucagcuggcuauagacagugcugccacaauuguguuaauuuccuggacuuuuuuuauucucagaaguggggugcagaauucaagugauguugcaaagcuguguucucagcaguguuuagaguggugguggcaguaaggcuugcuugguggcucucugcgucuucuguugcucuauaaguguuuccaugcaccaaucgcacuggcucacuuagucacagugugcauaucacugcucuccucugcacugcauggcuggugagggggagcugcugacuucuccgaggcaucccguguuaggcaguguucuccgaggcaucccguguuaggcaguguucuccgaggcaucccauguuaggcaguguucaacgaggcaucaguguucuccgaggcaucaguguucuccgaggcaucccguguuaggcaguguucuccgaggcaucccguguuaggcagugcucuccgaggcauccccguguuaggcagugcucuccgaggcaucccguguuaggcaguguucuccgaggcaucccguguuaggcaguguucuccgaggcaucccguguuaggcaguguucuccgaggcauccccguguuaggcaguguucucugaggcaucccuguguuaggcuaugucugacguaacccgacaucauaaaugccucuuuccuaaaagaauagugcaugugagaucucuucauuguuuuuuccuucacuuuucuuuucuuuuugauauuauaucauuucccccuuuccuuucuaccuucuaaucccuccuauagaccucuccuugcucucuuucaaauccauagccucuguugucaccguuguuaaauagauguauguauauauguucauaaguauaaccuuuaggcuaauaacauuauucaugugucugcauuagagcugaccaucugguguuagguagccaauugugcucuuucuggggaaagacuauuucccaucucucagcauuucuuauuugccuguaguucuuuguguaggguugaggccuuguggucuuucccuuaccuacuuuaccaugucuauuguuguuguccuugugcaguuaauauuaaugcagugaugguggugggucuauauggauguagcuuugacauuauuaggagacauagugucauagcaaacuccuuuaucuuccagcucuuuauguccccuuuugaaauguucucugggcuuuagguucuagcguuguuuguaguuguguucauuggcauugggaucuacaaguuucuauuuugauugguugugguuuucuauaauggucuccaucuguugcaaaguuuccuugauauaggguaaggacuacaguucuaugugggcauaaggaaaaauauuuaguauguaguuagggguuauucugguuugguaaaguggugguuguagguucuccaggauccaugauguaacacgcccuggguagcuggcuagguuuccugucccaggcauuauuucucucuuguugaguaggucuuacauccaguuagagagcuugguuaccaccgagaugugggagccacuacugcacccuucggguucucuugccaugcugguccuugugguucauaggcaucauagcuggguaggaaggacuacugguugcuucccuccuuuggaagcuguguaugcugcagccuaguaccuaccauaagagcuaguccucagaaggaagcguuuggcccccgugucugugcauggugucuucaacaauaaggacuuacuuucuaccgugagggguaaccaguuaacaauagccuuuaagguuuugggagucccuugggcaaccgugaccuuguauuaucuggugugguuuuguacauuuugucuagcuuucuccaaacuucuaucuuugguuucuugccuucccaugaugcccaaggugaagggcaucagugaccauuuguuuccucugcagcagaugcuuagccaugaacuuccuuguguagguuguuccuuagucauucuugauggcugcaggcuuagaauagucaaggaggaagagagccccuugggucucucacaggcugcagcuugcuuauuagagcuacguugguaagaauuuuguaccguagccuggcuucaaacuucagguugucucaccucagccucuggagugcugggauuacaaaaaugcacugccuuaucaaaccuucagauugaguuccgagaauuauuuucuuuuuuaagaccaugccucuaaugcuggguugaacauguaaauauuuaaccagucaaaccuguuugccagugaacuuuaaaguggggucucuaaagacagagaucucugaggaaguagagauaagaaugagagaaaagaagcuuaaaggcagccacucccucuuugguggguaugcacugaaguuaugacuucgaggcaugcacaugguaaaauguuuaaaguuccuuggacagcuuucuucugaaauaggauaaguugcccuugggcuucacgucuuuaaaaggaaccuuaaauuuuguaaggaagugucaagaauagagaaaggugggacagcaucagaggugaugaaguggcaggaggaaagauagggaaaucaagccacaugucccccauggucauugcugcgauggugugguuugauaugugcucugugacgcugcagcagcugguaauguccuucacagaccacugcucuucacuguuucaacuguguuuggaagcugcagcagcagcagagcaugggauggguguuuuuagggauccuaugacaggagcaggauugcuucugcucccuuaucauaaugaguugccccauccugugcagcaguuggacuucaucaguuugcagggcugacccugcugacaauaagaugcauuugaccuugagauggaaauugcaacaagaucuuuacgaaugacugugaaugagacuguauucucuuucuuucagaaugccagcgaccuguaucugggagaacuguucuucgacaccucccuguucgugcacugugcuuuucuuguugcuuuaacuuaucaaggguuuugcucugcauucaugagugccgucuggguaguuuuuccauugcucacaaagcuuuguguguacaaggacuucaagaagcacgguagggaauuuuuuuuuguuuguuuuuuuguuuuuuuauaaaaauggggaauauguuaaaaaugcaaagcucccagauauuauuugaccaaauuaucuuuccaaaauauuuguuuuaauuuuuuaugccaugcaaguaucuuauacuguauaccccaucccauucucacauuucugaacauaugcuaguauauugccuuaauacuguuugucuuuuaucuucccuggugacauugacugagugcacuaggucacauguaccaagggacuagagucccaccugacccaguuucugucaagugccagggcagguaaacccugaagaugagcccugcaucgugcccuagaauuccauaggcuuguucucuuucuuuucccccaggugcccaaggaagauuuguugcucuguaccuuuuggggauguuuaucccauaucuuuacgggcucuaccucaucugggcuguguuugagauguucacuccuauccugggaagaagcgggucggagaucccccccgacguugugcuggccuccauccuggcugucugugugaugauccucucuuccuauuuuguaaggaaaagcguccuguuuuacugucuauacacgugaugccugagaugcacuggauucugugaaauuaugucgcucauaccuuguuaagagaauuuaaacuagagggguggggucaguguuugugcacugucagguuaaugugccaagaaaauguaggaugauaugguggcccacacucaggagguagagacaagaggaucucugugagucccagaccagcuagggcuacauggugagaccguguuuuguuguuacuguuuuaauguuaaaacacacacacacacacacacacacacacacacacacacacacacacacacacacacacacagccuuccgagcuauccagauuccccucucuuccuccaaaccuggagacaggcucucacucuggcuuagaacuauggguuaccaggauggccuugacuugugguacuccuccugccccaaccucccaagugcugggagacaucacaccucgugucuaaauccucccuucaaguagccuuccauuguagcagauaggaaugugugggacaggugauguguggauugagauguucuguucugaacguaaagaauaaucccuaugagcauguuuugaaguuaguaagaggccaaaucgcaguaguuuagguuguguguguguauucgaagugauuucaguaucauuuacuucuucauugcugucaaaucaacauucaugaauuugccccuuggggugauaaccaaacaugcuuuuguuucucggucucuugaguauacugcguagguauggagucucaccuuuguuugucugugugcuucuuuccccaugggacaccuuaaaggaaaggaaagaugguuggucgggaugggccaggccccucaggaaaguuccugugguaugaugucugaggcugauggcgagccucucuagagaaagcaucucugcuccagcuccuaaggaguauuuacgcagugcuauaggaagugcuugugaucugaggcuagcgauccaaguagaggcagggauuggaguucuuuacagcuuagguuuucaugcacaggauagugagcuuuuucagaucacuguaguaaggggcauuccuuguggaaaugagguucugaggacccagggagcuaaaguuaccacagccguagucuguguuguccaucaggaaagcccugcauacguggcuuugcacauguagccauguaaagucauucuuaugcacaugcuugcuguuggcuaacuagcauuaaaaggaaccuacauccuaacuggcaacccgagugcaggcuggggcuguagcucacugaagagagugcucccucccaucaaggggucccuaggcuagguuccccaacacugaaagaacacuccaaagaacacucccccuccagcccucccucccucccccucccccccccccccccccccccgggccaaacaacaaaaccugcaaaggcauucuucacucuuaguguuguuuacagagguggauggaauucuaauguuuguugcuuacuucuuuuaguuuuauuauuaaaccuucaacccuguauuucuguauuuguuaaguguaguagcuuuuccuuucacugugacaaaauacuugauaaaaauaggaaaggaaaaauuuauuuugggucauggcuccugaggguacugcucaucauggugggaaaggcaugguggugcuuuugguggcaggaaucucuggcagguccgagugggaccacgacaagaaucaagggcuaacagacccgaggccuugccaccagagaucuacuuucuucacuuagacccugccuccuuaaucuccauagucgucucaaauagcacuuaucagcuaaagguuuaaacacaaaaacuugaagagaauauuucccauuuaaaccaugguagguaaguuuguuguugaggaugaagggagaaaggccugggcacagugacaccuaacuaaucucagcacuugggaggcuggggcaggcagaucaggacuuugaagccaaccuugauuacauauugugaugcugucccaaaagcaaauaauacagccacggagagcagccuucuguccucuguagaugggagucuagucugaagguauuuauauuaugaauuagcuuuucauuauucucuuagaguagugguccucaaccuuccuaaugcugugacccuuuaauacaguuccucacguggugacugcauccauaaauauuguugcuauuucacaacuauaauuuugcuaguuacgaaucguaacguaaauaccugauaugugacccuguaaaagaaucuucccgucuucaaaggggucaagaacccauaguuugagaaccgcuguacaagugauugacauuuuugguaccuacaaaggcgauucagaaguaggauauuugaauuccuuuccacugaucauguggaagggaaaauaaugaagcugugaaacuggagaucaggaacgccccaaggcauggcugugcuugaauccauaacaagaucaaagugcacuaucacagguaaaucuuacccggaaggcuuugggaaggcacaccucuuggaauauuaauuacaacugaguaugaugguaguauguaccugugaagacagcacuucugagcccuagggcaggcugguguagacagagagcuguagguuauguugagacaagguaauauagcgagaacaaugcuaacccucuaaaacuacaaaccguauuuccuuuugucacuaugugaagugggacugugacucugagcuguuguuaguacuguucucuugguuuacuuauucacauguuacagguuaaagacagcugccucuugaugcaaugaguugcuccaugguaacagaacacugaacuauaaucuuuaucucagaacacgucuuguagucauugaggcuuuauuaaauauguuuuagaaaacaguuagcauucuuguuaagugagaagcuaucacccuuuuuggaguuauucuuuguuggguaucaugguuauacugccaggcugagagccaaaauaggccugauaauaggcaugggauccggagacuuagcaagaaacagcuaggugcauguacacucugagggcgcaggauggcgucagguaccuuccuuaccaugcccucaccuauuuccuugagagagcaccucucaccgaaccuuucagcuacgcuggcaaaccugagagccugucuccaccccagugcugggggcuuggcuuuuacauggcugggaauuuaaacugaaguccucacgugugcacaggaagugcucguaccuauggagccaacuucccgguuccauuccucauuagguuuacugauuugagacaaggucucacauggccuaggcuagccuuaaacauuuggaagaugacucugaacuccugaucuucuggccucuacuuaucaagugcuggaauuacaggauugugcuaccaugcuuagcuucuucauuugaucuguacucacucaagaucuuaagagugauauaagauacauuuaaggcagaguacaccuguaaacgugccuaacuauagaaucaagcacacugucacuuuacaucuacucccucaucuucauucugugaguccauuuauaacuuggagaagagggaacuucaauaggaaaugguaguuuaaaguuggauuuuuuuuuuuuuuuuuuuuuuuuuuuuugguuuuuuugagacagggguucucuuuauagcucuggcuguccuggagcucacuuuguagaccaggcuggccugccucccgagcgcugggauuaaaggcgugcgccaccaugcccggcuaaaguuggauuuuaggacaguuuuggcaguaguuagcuugggugugucagaacuacaguauuauagcaaagauuuauuuauuuucaaauuauauacuuauaauuuaauauauauugcuaaaauauauuaauuuucagcuauuuccuuuccuugaacucuauauagcugcccuguguccaaauuuaccagcaugucuuaggugacccucacuacuuggugggagaguugaaacauuuugagcauuaugaccauuugguagaagaacaaauaggguuacaaguuguuuugcugucucaccaccuuaaauccugggguguuuauuuucuaacaagauaaggucuuucauccaagaauaguaccguuugguugaaauuucucaggaaaggauauaggaacauuauauaagaggagacaacuuugcauaaacuuugauauuuugcuuuuuaaaaacaaauuccucucauugagaauaucuucacauuggugcacuucaugagcuuaggguaggcaggaagaugaagagacaaagguaggagcuacuuucagguaguuucucaaaacugagugggcugcgaaugcgcuugguguguacaaacuuucaguuugcugauuuaguuacaauaaaaaaagcugauucuggaugcaaaccuugcaacugagccguucguguuugcugcucuaagcucagauuguuuaguguucacagugauuaaccuaaaaggacaguacuguuucauggugcaguuuuuccucaaaugcgacuucuacaggguccaucuaaaaacuagccuauaugccuccagccccuacuagcauguuauaaaacacuaguggaaucugaauuucaucgaaacacaugcuuaggcauaaaaccuuaccuuugagaguuuggcagcuuuacugucauugguuggauucaguucugugguguuugcugagcagggcuggccacugcuggccacuguggcacauagggcagugucuuggcugugaauagguucugguccuucuuccguggacaccugaacacagggucacugugcuuuguuuccagucucccuuugcuuucugccccacugucaggaagugcuguccuggccugcugaagccgucugucacuuuccaggcucucacuuaggagggacacaccugaggaauugcugcuuuaucuccuggggucacugcacaucacacaggccacuagcuuuucuuuauuguguucuagacaauaccuacuaaaaaauaucaugggaaacaccucucuaccaauguuaugaauucguaauuugugucugugcuuguguuuagauuaccuucaucuaccuugugaacagcacaaagaaaaccauucugacucuaauacuggugugcgcggucaccuuccuccuugucugcaguggagccuuuuucccauauaguucuaaucccgagaguccaaagccaaagagaguguuucuucagguaagggaggcucuucagaagcagugagauucaggagaugagaagcgccuuguggguuuugagcuucaccagugaacaggaaaacucgacuuuucugcuguugacauaauuuacuugguuuagauuuguguauaaaguagcaagggacacugaccaucagugggcauucuuaucucuuagacacacuuuccaucauauauguauguauacaaaauaugcauguguauaaucuagaagccaugaccauuuaaaauuacaaauagcauaaauaucuguaggcugauuaaaaguaggcaucaguucccuggagcuggaguuauaggcuguuaggagccgccuggugugggugcugggagcuucuggaagagcagcagggcauguucguaaccacuggaagaucgcucuagcuccugguuuggcuuugagaccuucucuuacaguauugucuagacuugccuaacucugugcucaaaugccucgccacuucagccuuguaaguaauugagacuacaagcacaaacacugucccugaucaagucuuauauauauauuuuaaguauuccuucaacucuaguugugaauuacaauaaaaggcacuugcaugucugccaucuauuuuaaaaggaaaaaacccacuaacaguaacuuaguaauuauuaagucuccuuuuuauuucccuguuucuaaucaauuuuuaaauuuuuuuuacuauuuauuuauuugaguacacuguagcuguacagaugguugugagccuucaugugguugcugggaauugaauuuuuuuaggaccccugcuuggucagugccugcuugcuccagcccaaagacuuauuuauuauuauacguaaguguacuguagcuggcuuuagaugcaccagaagaggacaugagaucuccuaaugggugguugugagccaaccauguggcugcugggauuugaacucaggaccuucagaagaacagucucuuaccugcuaagccaucucaccagcccucuaaucaauucuuggaauggucuuuuuaucuuuauuaaauugggguaggagugugggugagcuagcugaacaguuuucucauuagucuuguucuuuucagcacgugaguagaacuuuucauaacuuagaaggaagcguaguaaaaagagacucuggaauauggaucaauggguuugauuauacuggaaugucucacguaacaccucacauuccugagaucaacgacacaauccgagcucacugugaggaggaugccccacucuguggcuucccuugguaucuuccagugcacuuccugaucagguugguucauacuuuuucuuaaguugggguuuaguucccaaauucuaucacugucaggauucagugaaauuuaaccuuaacucagucaagcgcuguuuguaauguuucuauauuaccagaaaauuuccauuucuuuagucagauaaugaacucaggagcaugguuugcuauuuuaaacguaagaaagucucucuucaagaaacuugaguaguaguuagaaagggcuaugcuccugaccaguauaauacaacaguuacggcuuccucccagcuugcgauacucagacagauggcauuucaguauucaucagaggaaugggauaggcagcagaaaugccugggcaauuccugucuuuaaaaggauuuaucauuuaugugcacagugugucugcccugugccuguggaggccagaagagagugcgcaaucucuggcucuggagucacagguggcugugagccggcacauggaugcuuggaacugaauccggguccucuggaaggagggcuuguaaacuguugagagggauuuguuagcaaucuggccagcagaggagcuagccucauuuauugcaucaggcacuucucagaccccuuuggguguucugaaccauucugugaguuaggaauuugcugucagcugcuaaagcauccugaauagucacccugucuuuccaauaggaaaaacugguaucuuccagcucccgaggucucuccaagaaacccugcucauuucagacuuguguccaaagagaaaaugccaugggauucgauaaaguugaccuuugaagcaacaggugagccaguuuccuucucaugucgcaucucacgcuuucaguuggcugccauggcuucccgcgagacauaucagagaaacacugacugacugacugacugaccgauucgggugucucaccgagagccaggcuggccugugaucauggucuuccugccuuagccugccugcugagugcuggagccaugcacugucacuccuuguacauuacaguuuuguuuuuuuuuuguuuuuuuuugauaaaaaccauacaacuuuuuauugucaagucaaagagguaucaaaauuaaagcaaaacuuacagggugagacuuaacgaaaguacuacagagcaucaaaggaaguggaacuguaacuaggcgcagggcaaucaugaagaaaugaacacaggaaggguaaggcgggacaacagugagaaccugcaaaagaccccaggggagaugaccugguguuacuuucaucucucacaagcgccuagguaaaugacuaaugggauaagauuucuaagcuccacuaugugcuuaagaguccuccuccccauuggcgcugucucugucaucuucuccuuccucaggcucuuuuucuuacaguauuuuuaauagcggcugaaaguuacuuaggaaaaucuccuauguuuuauugcuuagaacaguuucagaucacaaacauauugagcagaaaguacagguuaaagcuugucaagucuggucauugcucccuaacacccagcuucuguucacccugaguuccagucuagauuguaccuuuuccuacuguuucucuuccuuucugugucuacugaaguggaagcguaaauuaucccacuuagcucucuuacucucuuauuccugcuucucucuugcccucuugcucccccucucuccccacucccuuccucccccccucucuccacauggucauggcuggccucuauuucucuauucuccucuucucucugccucuacuacccucuuaacuccccucccauguccugaauaaauucuauucuaugcuaaaaaaaaaauuaccccacuuagguuguuauuccuaauauaugcauucggugcuauaaauuuccuuuugaauacugcuuaggcaguauucaauuuuuacacuuguaauuuuuacaccugagaaauuuauauuuggcuccgaggcuauaaaauagguguucaaaucaaacacuuacugauaagucagagaaacuuacuuggaaacaguucuuuguuguacauaggauuuugcugguuaugaaagacacaaggcuguucacaugcuguuuuacaugaggaaugacaccugaguacacccuaucauagggguuagggugccuucuguauuuucaaaagcuaaucaauucuucgacuuuauaaucaucggugcugagaguuccacucugaauaaauuuguagcauaucugaguaaauauguaguucaaaauggcagaaguaucuuuagagucauuuaagaaacugcaaaauuuguccuagccccaagacaagauucauguaacaacuauaaaugaaauuugucaggaacucagacagcaagucugaaaauuaaagucuaacacacuccaguccacagauacugagaucugguauuuacauguugaugaaugaagguuaaaaaaacauuuacaguguaugacuguuauguuucuguaagaggauaaacuuuuccauggacaguauaaauacuaauucauaguccaauuacuagugaauuugagccaguguguuucaggcagcauuugguggcauugcuauuaagaucaccugcugcugugucaccuggcaguccuggaacuuguucuguagaucacacuggccuggaggucagagauagaucggccucugccuccccagugcagggacuaaaggcaugugccgcuauugcccggcccaguuaugacuuuuaagaaaccuuacuggaagucuuaguguuaguuuguuaucaaacagaucugcacuguuccaaacauuuucuuuucuugcuacauucuguucaccuuuccacguuaaaaacuaguagcucuugcagaucccaaccagugacgucccuguaagucuuguccuaggcuuucccccacacuacugccugcggauuuacuacauuugauuguuacuuuccaccuuaagaaaacacagugcuugcagaaugucuagacuacuucuacuauugcuucuuuaaaguuuuauuuauuuacucuauguacacgaguauguuauagcugucuucagacacaccagaagagggccucagauccuaccacagaugauugugauccaccacgugguagcugggaccccuggaagagcagucaauucucuuaacugcugagccaucucuccagccuagugacucgaugucuuagcagagcauucugggucauuuguauaaagcuaauagguaauguggaaaugugauggcuaacuuuguauauuuggcuagacuguaguaccuugacauuuucugauaacauguaaauaguggauuugagucuggcugaugaguuucccuccuccaaacacugagagucuuaaggaccucaccacaggcagauuaccuuugcacucugccugcaacuuguuggggaggggggcagggcuggagauagguaaauuauaucagcaguuaccaaguuaccuuucucauuuccguucucuccuuacuuaaccuuguccaaacugcuaaccuccuugagcuuuguaaagagcccgucuaaagucaucacagaugaaccuaacaguauugucacugcacauugacuucaauguuccucuugcaggaccaagccauaugucuuucuauguucgaacccacaaaggaucaacacuuucccaguggucucuuggcaacggcaucccagucacaagcagaggaggagacuacuuuguguuuuauucccauggacuccaggcuucugcauggcgguucuggauagaagugcaggugggauuucccaggcuucuagacaguacguaacaaccuuggaggccaguguuguggcuucagagaacuaacugcuuuuuccccagcaggucucagaagaacaggcagaaggaauggugacuguggccauugcugcccacuaucuaucaggggagaacaaaagauccucucagcuggaugcucugaagaagaaguucccagacugguccuuuccuucggcguggguuuccaccuacagucucuuuguguuuuaaucucgcggauggacuuugaguacauguccccugaacauugcaugggauaguuucucucccaugauacaaggauguuuguaauacaagucaaugaacucuacugagcauauguucaaagagcuuuugggauaacacucuucagggcuaaguacuguauggguuaaacuuggggacagugauaccuggccaugccgguugaaacuuccuguuuucugacaacuaagcacauguggauauugccaaucaugucacucaugacuaaggacucagcagcaugccucuugagcagcuuuccugugaggaucaagaaagauguaggcucuuagaccacugcuaaugaaauaggcaaguccacuugccaguggagguggguaagaugccucucugugcgcuacaacuguaguacugggaaguaaaugccacaaagguggaagccgcugcagcaccuuagauguucgagcgcuguuucuucaggcagccguucagauuuuuuuugucuguuuggaagccuaagcccugaugcagaggccugacuccugaguagcauucagugucugcuuuucccucaaacacauuccugucauuuaccuggggaagagaacauuuuuuucagcuacauuuucuucuuacauuucauggguugcuuuauuugugcaagcacagaacuuaaaacuucuuccccagagcacugaauugccagcauagcugcugagguggaagaggaggagggcugggaggacuggggauuuuauaauauuuauucuguuauauauaagauuaauccuuuagcacaaguucuuuauugcugcauuggguuuucuguuuucuagcaggugacuaaguuguuguaacuugccgucagugagaaccggcuguccugauguugagguuguagcuuacacaggagacaacuauaccuguauuuguuaauuuuuagaucccgcauaagggcagcagucagacuuaauggugcuuuucauuuugaagacagggauguagcuugugagguaugucacggcaguggcucuuguggcgucucuagguuccaucagugacagaggaugagaugaacaguaaauuauucuaauuuuacaguaguaaauauacaaagacaaaauuugaguuagcuaacaagcaugacacaaaauguaguugaaagaaaagccauaguaaggcaaaaccaaaccaaaccaaaccaaacaauauccuugucaggugagaacaggaaggcgccucucagaguggcccucagaacugucugaaugucaacaagagcacuguuacgugugcaccgcagaagaggagccucuggaaauugcucgugugguacgugucaguuucuuaaucguguuccuuguauugccugccuaaucuauaacgccuuaaaaacgcugcggcuggagcugauaguaacaugcugacugucacaaguggugacacuuaaaguggagucaguguuuugcuggacucacagaaaucuuaucucacuagugcuucaagugucuggcuccugcuguguguguauucucugucaggucguacuuaaaggguugaggguuuaugucuagcuuguagagaaccacagcugaguaacaguacugauagcucaaugaauuucaaaauacgggcuuauguucugugcccggguuaaucugaaacugauuacuagaaauuaugggggaggagagcaacaugucaugcugaggaaguucacuaggacaaggaugcucucugacuuccuucccuuuggcaggcaccuuuucaguguaaucaaucaugguuuucuuucugucuuuggguuguuucucuaugcaaacgauuuucauuuucucuaacacuauuaugcaaccacuaacaagauguucaguuucaggcaugcuuaacggccagaaauggucaggcaauuacaugcaguauucauggcuuuuaaaaagcacacucuguaguuaucacuagccuccuaccuuuaaagguuaucugaucacuuguguaauucacuucucaaaagauaguuucaaggucuaaguaaugcaucccccagaagaguauaaacagaagcagcacacuagggacaaguaugaagaacugaaagauuguucuacacagcguuuccagcuuagcagcuauaacuaaaugucugagauuucccccaacccugauuuugcugugaaagagauuagaccacaagccagccuaggugacucaggaagcuguuggaagaacaugucuguccaucucauuuucacuuauuugcugacuuguugaggguuaaucguugccuuacaauguuacugaaauaaacuuuuuaacacacugguuggaaaaaauggaucuuuuacaacugcuuuuuauucuaucuccauauuuuaaggcuauuuuuuaucccuagugucugucugucuccgucucucucucucucucucucucucucucucucucucucucucucucguguguguguguguguguguacuaucuuuaaaaugcucuauauagcuugagaauuacugcuauuuuaauaagugguauaagcaaagaacucgauagaaauggucacuucaucuggaaucuuuuuucccuggaaugaaacugugcaucugaauuucagagaaauaaaaagaaccuguuuagcaaaugggaagauccggaguauauuuagguuuaaaucuucuccacugagagaggaagucacaacaggaagcuuuuuuaaaacuguggcuagguauaagagcaggcagagaagcuacacugcagacauacagggacuucucgccacccacaggaaggcugaccccugacaaagcccguagcauuuucccuggugucuuaguuaggguuuuacugcugugaacagacaccaugaccaaggcaagucuuauaaaaacaacauuuaauuggggcuaguuuacagguucagagguucaguccauuaucaucaaugugggagcauggcaacauccaggcugucauggcgcaggcagagcugagaguucuaccucuucauccaaaggcugcuaguggaagacugacuuccaggcaacuggagggagagucuaagcccacacccacagugacacaccuacuccaaccaggucacaccuauuccaacaaggccacacuuccaaauggugccacucccugguccaagaauauacaaaccaucacaccuggcuuuuuuuguuuucugaggagauucugucauagcaguucaagguguuuuuucauuuuuguucucauuuuagggccaauaaagucauaaugcacauaugccucaguaaauugaacuuaaaaaaaaaaaccauuugauugcaaaauuuaaugagaauuucuguaauccaauauccugaccaagugggaucaguagguccuaccaaaacaucauuuggauaucagaaagaaauuuaacuauauuaacuuucaaguaguuaugcugaaccaaauggagcaaaacaaaacuuuuaaaaaaguauacaacaaccaaagaauaauuuucauaaugccagauuucuugccuugguguuuccuaguucuguuaguacacauuauauauuuuauccgucaaacgcagcccagauucuaucugguaaaggucuucagugagaacccagagcaucauacuucaugauaaaagacuuaagacagggagaagacaaugucaauugccucuccuauugaccaucauucugguggcuccaggcaggacaaccuggcaagaaaggacaaaacauccagaucugaagugcagagcuaaaaugauaucugguugcaaaugacaugaucauuuacauagaaaaucaaaaaaaugcaaagaugaaauuaagcauuccauuuauaagaauaccaagaagaaugaaacagaauaaaggcaaaagaguacaaaauguugcugaaaggaaucaaagggcuaaaaugaaugagacauucauggccugggaagcaggauacuaaaaaggacugaauucuucaaacagguuugcuuacauaugcagaccaucucuacagagccacugaaaaguucauccgaaauucagacggcaccacaggaguccuacaacagccggagcagccuugagauaaauauagacaguacuugaaccuccacagcuuccuaugaagcaagaaucacccagaaggaagacugcacauuuauaguguguccauaaaaaacccgcauuauaguguuuuugacaguucaguugggaaaaaaaaaucuuuucauaaauuguacucaaaacauugaauauccauccauauguaaaagaguaagagagucucucaaauauacaaaaauuaacucaaaau

SEQ ID NO: 9237 - RNA, 3426 nt, Mus musculus
ccguuccacucuugguaaaaguuauuaagugugcaaauuccaaaaccaaaaagaaugugauugcuacagagaacuguaucucagcaaucggaaagauucugaaguuuaagcccaacuguguaaauguggaugaaguucucccacacugguuaucguggcuuccgcugcaugaagauaaagaagaagcuauucagacuuugaauuuucucugugaccuaauugaaagcaaccacccaguugugauugguccaaauaauuccaaucuucccaaaaucaucaguauaaucgcagaaggaaaaauuaaugaaacuauuagccaugaagaccccugugccaaacgccuagcuaauguuguccgucagauacagacuucugaagaauugugguuggaaugcacaucucaacucgaugaugagcagcaggaagcuuuacaugaguuacucaguuuugcuugaagcaguuuaauaccaucuaucauaaaaguagcuacaacgugucgugaguggauucauuacaaaugagagauauaccauuucucucugcuaagcaguucauacuucuauguuucuccaggauuaguguuaaggucuccuguuuacuuugcacgugucacuucuuaaacugugguuguaaccugugcuuccaguuguccuagaguuauuugucaccuucccccuauuuagugugaaauguauaaauuguuauuugucugaccuauugaugcugggcagacgguauauuuugugccaagaugucugugacugucacaagaugcaaaaaagcucacaaagaaagggagacuuccagguuaaacauuucuggaauugagggugaagaauacaguggcagacuuguucuuccuugguaauacuguguuuguuacagugagggacggaugcuagaacugagugugucaagguauggcagugguuguaggaguuguuuucuacaauauaagugaaccuuuucauaugguacuccugaaaagugguuauagcaugucuaaaaacaguuccuaaaguauccagcugagaguuaugagaacuuuuaaaucuccuuaaccaaacugguuuaaaagaauuuaucuagaacugaaacauucauggguguggaggagguacugaggagacauuuaacacugaaagaaucugacagacuagaacaguguaauaaauacuaaauagucaguguuugugggagucagguauuguuacauguuuuggccaaguauuauuuuguguuuguaugucauauccccguaacucccauuucaaacauaaagggaaaccuuuauucagaauggggguuaaauagaguucuauuuugacagauucuacagaaacagugaaacaaaauguuauccuuaaacauuaaaaagaaaagagcuuuaagacuagucacauaucaguguauguguauuacaaaacagcuaucaauuuaugguuaauuacauuaaauggaaugucuuuaguguugaagguuuuuuuuuguuuguuuguuuguuuuguuuuuuuuggguuuuuuugguaggauaggaaaagacuucuacuuaauggaacuucauucaaaacuuacaaacaagaaugucuguugugacuuccugagccuguugugaguacuguguauguaacagaccaaauauguccgaaccaguaagugcucaauaaauugucaguguuacuacuguugauuguccuucuacuguguucuuuuuuauacuuuaaaauuuuuuuacauggaauuucccuccccuacuaggucuaucuaggacuacugcagacagggauauaaagucaggauuauagauagcucagaauuugauauauacuaugcuuauaauuguauuuaaaauaaauagaaaaauagcuaccuugaaguuuauguuuucucuggguggugggacuaagugccaguucuucucuuaucuauaauuaaccuaugaacaauauguuucuuauuaauaaaaguuuuuuuaaguccaaggacuugauuuuuuucuuucauaauaacuaggaucaguucaugaauagaguuaaggcuccuucuaauuaucuguagcucuuucuaugucuuaagaaaucuuucaccaagauucuuuuuucauuuucuguagucuuguagaaaucugacaaaugauuuguaauugggcaauuggaguuuugaaguaagaguucuuaaauuuaaauuuugucaaacuuuuccuguuaguuuccccaucuguaagauagccuaauggguagcuuaugugguuguuguuagagucaaagaagauaaugacuaccaagugcuuaguagcacaagguucagaaaguggaagcuauuguguaaaguuuugaaaugggucugguggcuaaaagaggacauuuucuugaguuugguuggcuuuagauuugugggcuuugucagaggaaaugaaggaaaggcuagccauacaguugucaguugcugaaguauaacugccccaccuuuucaucaugaaccgugguaugucugagagaaaacuauaaauuccagauaaauacaugcauguguauaagucuguguauaugugaaguacuuuaauaacuuguauuccuguugcacuauuuuacuuacaacugguauuuaacuuacugaguccccacaagaaaguuuuacacuauuaaauguuaucaguccuuuaguaguuaaagucuuuguuuauagucgcaaaccauuuugaaggugagauaaucucaaccauuuaguuaugaauaucauguuuaagaugcauuucuauaguuuugguuuuauguuucauuccaaguuucaagcaaguuuaagucugaauauuaugugcauuagaaagcugugacaucuauuugggguucauuaauuuccccgucauuuuaagcaacaaguaaacuaauguagugaguccauauuuuagucauuuaaaaauauguagcgagauuuuaaagccacaccagugacaagcuguacagcuuagaauagacauauggagacuuuuuagugagauugcauucucuuaaauucuuagccgaacuuaagaucucguguguuuuucgguuuuuaaaagucaauagaaaacaggacucgcuuucgagaacuagaguucuacaggccaccacucuucuuuugaggagcucuuaauuuuucuuucuaaacuuuucuaaacgcugggguuuuuuuuguuuuuuuuguaaaaaacaaaacccagucacaaggaaggagagguacaaagaauauuuuacaacggagaggauugaaucuuguucacucucguuauucacuuguguuaacaaagguuaucuaguaacugccuugagaaaacuaacaguaaaauuuuuagaacuaguaagggucucaccaaaaggaaacuuucagucuaugguucaccuuccagacugcgccagcgcaggcgcucuguuucucccuccaccccac

SEQ ID NO: 9238 - RNA, 5137 nt, Mus musculus
uagcuuugacaggacgcgauggcggcggccgggucugcaggguugccggcgaccgugucggaaaagcaggaguuuuaccagcuucugaagaaccugaucaauccaagcugcauggugcggaggcaagccgaggaggucuaugagaauaucccaggucuguguaagacuacauuucucuuagacgccguccgaaauagaagagcagguuaugaggugagacaaauggcugccgcacugcuacgacggcuuuuguccucaggguuugaggaggucuauccaaaucuaccuccugaagugcagagggaugucaagauugaacugauacuggccguuaaguuagaaacacaugcuagcaugaggaaaaagcuuugugauauuuuugcggugcuggccaggaauuugauagaugagaguggcacuaaccauuggccagaaggucugaaauuccucauugauucgauucacucuaaaaaugugguucugugggaaguugcacuucacguuuucuggcacuuuccugggauuuuugggaaccaggaucgucacgauuuggauaucaucaagagguuguuggaccaguguauucaagaucaggagcauccagcaaucaggacauuaucugcuagagcugcagcuacguucguccuugcuaaugaaaacaauauugcucuuuucaaagacuuugcggauuugcuuccugggaucuuacaggcugugaaugauuccugcuaccaggaugaugauucugugcuagaaucccuuguugagauugcagauacuguaccuaaguacuugggucccuaucuagaagauacucugcaguugagccugaaguuguguggagacucuaggcuuaguaaccugcaacgccagcuggcucuggaaguaauagucaccuuaucugaaacugcaacuccaauguugaaaaagcauacgaauauuauugcacaggcugugccucauauauuagcaaugaugguugaucuucaagaugaugaugacuggguaaaugcugaugaaauggaagaagaugacuuugacagcaaugcgguugcugcugagagugcccuagacagacuggcuuguggacuuggugggaaaguuguuuugccaaugaccaaggagcauaucaugcagaugcuucagagcccugacuggaaaugucgacacgccggauuaauggccuuaucagccauuggagaagguugccaucagcaaauggaaccaauucuagaugaaacaguuaacucgguuuuacuuuuucuucaggauccucauccaaggguaagggcugcugccuguacuacacuuggacagauggcuacagauuuugcaccuaguuuccaaaagaaauuccaugagauagugauuacagcuuuguugcgaaccauggaaaaccaagguaaucaacgugugcaaucucacgcagcuucugcucuuguuauuuuuauugaagacugccccaagucauugcuaauucuauauuuggaaaauaugguaaaaagucuccauuccaucuugguaauuaaacuucaagagcugauucggaauggaacuaaguuggccuuagaacaacuugugacaaccauugcuuccguugcagaugcaauagaagaaagcuuuauuccauauuaugauauauuuaugcccucacucaaacacguuguugagcucgcuguucaaaaggaacucaagcuucuucgaggaaaaacuauugaaugcauuagccauguuggacuugccguugggaaggaaaaauuuaugcaagaugcaucaaaugugaugcaguuacuguugaaaacacaaucagacuuaaauaacauggaagaugaugacccucagacuucuuacaugguuucagccugggcuagaauguguaaaauccuuggcaaagacuuugagcaauaucucccacugguuauugagccacuuaucaagacugcuucagcuaagccugaugucgcucucuuagacacacaggauguggagaacaugagugacgacgauggcuggcaguuuguaaaccucggagaccagcaaagcuuuggcaucaaaacuucaggacuugaagcaaaagcaacugcuugccagauguugguuuacuaugcgaaggaguuaagagaaggauuuguggaauacacggaacaaguugugaagaugaugguuccucugcugaaauuuuauuuucaugacaauguucgaguggcagcugcggaagccaugcccuuucucuuggaaugugcaagaauucguggcucagaguaucuuucacagauguggcaguuuauaugugaucccuuaaucaaggcaauuggaacugaaccugauacagauguacucucagaaauaaugaauucuuuugccaaguccauugaggucaugggagaugguugccucaacgaugaacacuuggaagaacugggaggaauuuugaaggcaaaacuugaagggcacuuuaaaaaccaagaguuacggcaaguaaaaaggcaagaagaaaauuaugaccaacagguugaaaugucucuucaagaugaggaugaaugugauguuuauauucugaccaaaguaucagauauuuugcacucauuauuuaguacuuacaaggaaaaaauuuugccaugguuugagcagcuacucccacuaauuguaaaucuaauuuguucaaguaggccauggccagacagacaauggggacuaugcauauuugaugacaucauagagcauugcaguccaaccucauucaaguauguugaguauuuccgguggccgaugcuucucaauaugcgagacaacaacccugaagucagacaagcugcugcuuauggacugggagucauggcacaguuugguggagaugacuaccguuccuuguguucagaagccguuccacucuugguaaaaguuauuaagugugcaaauuccaaaaccaaaaagaaugugauugcuacagagaacuguaucucagcaaucggaaagauucugaaguuuaagcccaacuguguaaauguggaugaaguucucccacacugguuaucguggcuuccgcugcaugaagauaaagaagaagcuauucagacuuugaauuuucucugugaccuaauugaaagcaaccacccaguugugauugguccaaauaauuccaaucuucccaaaaucaucaguauaaucgcagaaggaaaaauuaaugaaacuauuagccaugaagaccccugugccaaacgccuagcuaauguuguccgucagauacagacuucugaagaauugugguuggaaugcacaucucaacucgaugaugagcagcaggaagcuuuacaugaguuacucaguuuugcuugaagcaguuuaauaccaucuaucauaaaaguagcuacaacgugucgugaguggauucauuacaaaugagagauauaccauuucucucugcuaagcaguucauacuucuauguuucuccaggauuaguguuaaggucuccuguuuacuuugcacgugucacuucuuaaacugugguuguaaccugugcuuccaguuguccuagaguuauuugucaccuucccccuauuuagugugaaauguauaaauuguuauuugucugaccuauugaugcugggcagacgguauauuuugugccaagaugucugugacugucacaagaugcaaaaaagcucacaaagaaagggagacuuccagguuaaacauuucuggaauugagggugaagaauacaguggcagacuuguucuuccuugguaauacuguguuuguuacagugagggacggaugcuagaacugagugugucaagguauggcagugguuguaggaguuguuuucuacaauauaagugaaccuuuucauaugguacuccugaaaagugguuauagcaugucuaaaaacaguuccuaaaguauccagcugagaguuaugagaacuuuuaaaucuccuuaaccaaacugguuuaaaagaauuuaucuagaacugaaacauucauggguguggaggagguacugaggagacauuuaacacugaaagaaucugacagacuagaacaguguaauaaauacuaaauagucaguguuugugggagucagguauuguuacauguuuuggccaaguauuauuuuguguuuguaugucauauccccguaacucccauuucaaacauaaagggaaaccuuuauucagaauggggguuaaauagaguucuauuuugacagauucuacagaaacagugaaacaaaauguuauccuuaaacauuaaaaagaaaagagcuuuaagacuagucacauaucaguguauguguauuacaaaacagcuaucaauuuaugguuaauuacauuaaauggaaugucuuuaguguugaagguuuuuuuuuguuuguuuguuuguuuuguuuuuuuuggguuuuuuugguaggauaggaaaagacuucuacuuaauggaacuucauucaaaacuuacaaacaagaaugucuguugugacuuccugagccuguugugaguacuguguauguaacagaccaaauauguccgaaccaguaagugcucaauaaauugucaguguuacuacuguugauuguccuucuacuguguucuuuuuuauacuuuaaaauuuuuuuacauggaauuucccuccccuacuaggucuaucuaggacuacugcagacagggauauaaagucaggauuauagauagcucagaauuugauauauacuaugcuuauaauuguauuuaaaauaaauagaaaaauagcuaccuugaaguuuauguuuucucuggguggugggacuaagugccaguucuucucuuaucuauaauuaaccuaugaacaauauguuucuuauuaauaaaaguuuuuuuaaguccaaggacuugauuuuuuucuuucauaauaacuaggaucaguucaugaauagaguuaaggcuccuucuaauuaucuguagcucuuucuaugucuuaagaaaucuuucaccaagauucuuuuuucauuuucuguagucuuguagaaaucugacaaaugauuuguaauugggcaauuggaguuuugaaguaagaguucuuaaauuuaaauuuugucaaacuuuuccuguuaguuuccccaucuguaagauagccuaauggguagcuuaugugguuguugu

SEQ ID NO: 9239 - RNA, 2738 nt, Mus musculus
uaaaauacucaucagccugaggccuuaauuacaaugagcagugucgcacuacugaaccauagugaccaugugacaugcuuuugaaauaaaucucauacuaagccugagauauguggggauuagauauuauaguucauuauuccaacauaacauaaccuauuuaagaaccuguguaaauuaauugagagccaagagggugauguggcaaaggcaucuggucugaguuggcuuuuuguuuguucaguuugguuuuuguuguuguuguuguuguugaugaugaugaugauggugauggugauggugaugauggugaugauguuucuggaauccaggacuuuucagugugaggaguuaugauguaauggagcaaugguccacaacgauccggugcagaauaaaggauggagcugccugucaaaugcaaagcaacucuuuggauaagcagggaaagguuccagaucagcuuuggugaugguguguugggggugggguguuagagucagacaccaacauacaaggguaggcacacccuaaguuuauuuggaugaguuucuuugguuuuguuuuaagauaaguucucacuaagcaacucuggcugaccuggaacuugcuguauagaccagucuggccuuaaacucacugagauucccuccucuaucugucucucaaauacuaggauuaaaggcaugaagcucuacacucagccccacaauuuuuuuaaccuuauauuuuagacaugaguacauauguauauguaugugacuguuuauguguauuaguguauuauuagaagaaaucucguucuccuaaauaugcuuauagccgggcgugguggugcacuccuuuaaucccagcauuugggaggcagaggcagguggauuucugaguucgaggccagccuggucuacagagugaguuccaggacagccagggcuacacagaaaaauccuaucucgaaaaaaaaaaagugcuuauauugaacauugcauugcuauuguaaaaauaaacuguagaccacaaaggcuauaucagaaagauuacauucacauuuaaccaaauuaagcuaauuuuucuccaaaaaaguauuacuuguuaaaaccagaaugaaaauaaaaauguaaagcucucugagccuccuauuccuuagccaucauuaagccuggcuuccuguaccaaacaccugagcccuuacuucauuuccucuaagccuuggcuaugacuccagccauggcuauggauaucaaaggucccuuugagguuccacugccugugcccugauaguagcucaccucaggcuuaugucuauaauuccagacaccucugguucgacuacguuuguuguguuguuuuguuuuguauuaaagucucaucccaugggacuuaucaagaaaaaaaaaguaagcagagaacucccucugggcuuuggucacaggagccaccccugacacccucauuacucaaacucaagugacaucuuggaaguuggaagcugucauaccaccuuguugugcacaugcugggauuuuccagggcuaggagcuaugcaauuagcaagcagccucaccuuuagaccacgaacaugagaggauccaguuccuucaucuccacaaaccugauagaaauaucugcucucucuaucuuaauucuuucccugaaaggcuacccaacauccucccuguuccuucuuccccacccaccucaacacaaucuccuugaugaacugaagcuucuauagcgcagagagaacucccgucagccaacugcuccuuuccuuacaaauagaccccaaggggaaaaaugcacaaaugaccuugggaauggagaauagaaaaaguggaggaaacagucccacauuaauuaauguuguacgauuuuucuauauucauauuuguuguagaugggccuggugcuguucuugugaaccaaucuucuaaugaauaaaggagccaaucacugggcaaguaggugggacuuccagauuggacagaggaagagaggaagcaggaaagaguuaggucucuuuuggacggggauagcaugaggacaagauguaauuacuagugucuccugguuucaacaguggaucaaucaggauucaccacgggggaauucagauuuaauaaggcuuacaagauuaggauuuuaguuguugcacccagagauuuagcuaucauuguuucugaacuaaguuuguguagcauuuuccuucacacagcaguucaacuggguucaagugcgaaagacguaggucuuugguuggugagucagacucugagagcccuaagaguccagguuaguugacucuguugguuccuguggagguccuauucccuuugaggcccacaguccuuccuccuauucuuucauaaaauuccccaagccccauccacuguuuggcugugggugucaauguccaucugucugagucagcugcuggguggagccucucacgcagauggccaugcagagcuuucaauggcuccgaaacuccaaguuuuccuagacagguucuggauguucccuauuuagcaacgaggacucagacagugucuuuuguuuauuuguuuguuuauuuguuuuuguuuuucgagacaggguuucucuguauagcucuggcuguccuggaacucacucuguagaucaggcuggccucgaacucagaaaucuaccugccucugccucccaagugcugggauuaaaggcgugcaccaccacgccuggccccgacagugucuaua

SEQ ID NO: 9240 - RNA, 77238 nt, Mus musculus
agcaggugccugcugaggcggaggaacuuugcaagaguuagugcaguucgcuguacccauucauugcccgcaguggucgggaaggggauccagggacugcggcggccacucccggggcauuggggccagaggagggccggaaagcgcugcugacccucgugggcuggggaggugacggcguccaugcagcugugugccagggcaugggggcugcgccugggccgcggagccgggggcggccaccgccuggcucggggcaccggcuugaguugggcgcagcgaagccgggacagcagcggcggcgguggcgguggcgguggcggggaccgcggcgcggcuggggccucgcgccuucuggagcgccuccugcccagacacgaugacuucucccggagacacaucggccccggagacaaagaccggagggagaugcugcaggcgcuggggcuggcgguaaggcccuccacccuccacccugccggagcucugcccgcugggccucccggcucccaccuugccuuccuccuccgucccgggccccagcuugaaagcgagcucgcucuuaaucguggugccuucuccucucuuaacuuuuacucuguucucgcucuucuaaagugcauuuaaaaaauauccccaacuccagacgaacccuaacuuugcaggaaaagaagacucccuacuuagaguacauuaauccggucagcuccaguugcagcucccgaacccggaguagcggauuuaccauccggcuccaucauuuuuuuuuuuuuuccuccaaaagauuucugcuuccugauguuucacuuuaaaaagaacucuuaauuagacgauuuaaaugaaguuccuaccagccuuugaagauaaacugaaguggcucucuuaacucaggcucuuugcucugacuguccuguucaccagcuugcguuuuuaaauuuuagagcauugaugagcucaucgagaagacgguccccgccagcauccgcuugaagagacccuugaaaauggaagacccuauuuguaaguggccgggaggacucucagggguuccgcugcucugccuucuauaaucucuguccggcuuugggguuggauugcucaguacuugacaggcccuaaaccgcugggauuuuucuucccugaggaaaaccuauguaagccccuuucauggucuuuaucccugaguugcuggcgaggcaccuacaagcuuucccaaagaaggcuuugcaaaagacacguguuggauuagaagucuccaccucaugcacgcccaccggaagggcuuuuuguuccuuugagcugagaagguaguuaucucaguagaucaggugagacuuccgaaaggacaaaggaaaucaccugagguccugcagcuagagaagagacuuauuuggaaggggacuuagacuucucaaagucacgagaauuucaaauuguucugucucacaucgguuuccccucucacccucacccaucuaaaggcagcagugcuuugcaagccugaauaugugggguuuuuguuuguuuguuuguuuguuuuguuuuuucugaaaagcacacaaacucgauuugugcuugguuaagaaaucucaggcuaguuauaggcuucccuuuuuaaugauuauuuuguuuuuaaaagauuuucuugcauuuauauuugugcaccacgcgggcuguugggucaucuagaacuggaguuccccacaguuagggaacuccaaaccuggguccucugcaagagcaacacgugcucuuagcuauugagccaucucuucagccccucuugguaaaagugguuuuaaugguccuaaugcugucuuugggugguuuuuuuguuuguuuguuguuguuuuuuuauguggcauugacuucuaggagucagggaagaaucuagauguuaagggauggucagagcugaagaacucuuagaaaauuaaaaaaaauaccaagcucccucaucugauaaccccagaucauagagauauuucucuagggcaauuguuucguuugcuugcuugcuugcuguugcuugucugguuugguuucugugagaagaaauucuacaugcaaagcugguuuuguuuuaaaagacauccugagccuauuccggcugcagcuggggaugcuguaccucagguucuaugagggcugcugcccuccuugcugucagaugcugauggccaggggcuugcucacaaagcaaaccaccugagacuuggaaagauggccauaaggaauaccuaucucaauuucaggacaccaacauucugagccaucaaaugugagaaaaacagaaguuggcuuacuuguuuuuugaaauaaggacuuucaugcagcuuaggcaagccucaaacuugugauucucuggcccuuauucauugaguaaaguuauauuauguguacaucacaauguggaaaaacuguacuuauuuuugagaacaguuuuuuuuccugugugugauccuuccuuccuuccuuccuuccuuccuuccuuccuuccuuccuuccucuccuuauuuuuaagaucgggucucaaagccaggcgugguggcgcacgccuuuaauccuagcacuugggaggcagaggcaggcggauuucugaguucgaggccagccuggucuacaaaaugaguuccaggacagccaaggcuacacacagaaacccugucucaaaaaaaaaaaaaaaaaaaaggauagggucucacuauguggcccuggcuggccugucuuugaagaccagcugggauuaaaggagugcacaucugguccuaguuguguauuugucaaggaagccauuggcaaguauuugugccaauaauugccuuccugagacuuuuaagagcagaaugucuagauuagcuccuuguauaacaugcucuaaguaagauguucuuuuaggaguauuaaggccuggugaacugaucaguguucauccucucugucucuuucugucucugucucucucugucucugucucucucucucucucccucccucucucuuaaugggaucuucuugucccuguaacuggcauggaaccacguagaccaggcuucccccaaaagcagagauccaccugccucugucucccuccgaaguguugggauuaaaaugacuugucuuguuguuguucaguucagauuuuucuaguaagagauuuauuagccugugucucuuggaacagguccccuagaguuugaauucccuuagagaaaauauucuacagucaaaauucucccuaccccaccccuuccugaaaagcucgcucacugggcuaaggagcaagggagaagagagaguuagggaugcugcauuuacaagacguggauguuuuacacugcugcgucauggcggaugaauggucucugugagggaagcaggcugguuccuuguuuccuccagcaggagcguuuagcaguggaguagccugacucacacuuaccuuccuguggguaccaacccucuucuauagcggagaugcauuugcuguaguggcuguaagaaccgggcuguugucuuuaccacccucauuguaagcaaugaguagauacuuggcuuagcacuuaugcuaacuagauaauguuaaacauuuguggagcgccuccugugggcacuuuugaaaagugcuuuuuguguauuauuuauuuaguccucauuacagucugugaacggagucccucucucuccccccucugccguuuguuuuagagauaagggucucaauuguguugcccaggcuggucauguucauggacuccaaugcuucucuaaucuucccuucccagauaccugggacucuaggcccacaugaccauugcacagcuauuaaccccuuuaaaagaaagaaaccgugguauacagaggcucuuuaacuugccagggucuuagcccgugaccuuuggaugggagcagaaugcaaacucaggccaucugacuccauugccaacccccacuccccaccccccaaugaugacauugcuguuuucauggugucccaggcaaagcagagaacuccuguccuggcucuucuaaggugcacaagccagucauccuuuugucuugugcaaacugccccuuugggaaugagacaccacagugaggcuaaguguggaguucucaggcccaccaccagguugaaggaaguuguuauggaggcccagugcuugcuugggugagaaacaaccccuuccugacaaaccuggaggaugcugaugcaggcagggaccagcaaguaaaggacggagccuaaggguuccaucagucuggaaagagucuuccucuccaacccuucagaaagugaaaaauaauauuauuuauuuauuuauuuauuuauucacauuccuaaugcugccccccccccaucgccccagaaaaauacuuuuaucggucucucaguaaguuauuacucaagagaaacaagcaauaccucucagcucaaaaucccuucagcuuaauuccacucagaugaauuuuucucuucagccacaaccuugcaccaaaauaauaaauuccgauuuauuauuaauauagauaauaaaucagguaagaacuguauuuuagugggaucauugguuucucugaaugcuccaugcugucucaauuauuuucuuucuucuauuaauguuguaguuaauuuaaaaguacuucagaaaccaaacugguguguuuuuaguugugcugcucuuuuuuuuuugcuguauaaagucaucucagaggagccagauuaaacuagcccaaacuagccaaccaaaugccacagagauuaaaguuuacacaaacccacacacugcuuuuccugggcuuugggagacagaggagagccaaccccccaaagcucaaacuauucaacuggaguugaggcgcugagcugucagaaucgguuccgaugaggcucgugggaacugaauguucuaaggugugucaucagaaugcauuuuuaaauaaauguuuaauagagggcagcgaucaaggggaggggcauugugcaaugcagaugccagugauaacuuuaucacccagagggggauguagucucuagcugaucggugcacucagaaugaggcugcuauccuucaccaagucaguacugccuagagggcccucagccccaaggcucucaggcauugcuggcuuguccuaauccuuccuaacugagauaaaucugccucauuuauaacuaagauuguggacuagauaaagacgaaccaaaucgagauuauguauccugagcuugugguagcaagacuuagacuugaguuuuggaaaauaaaaaagucuuuagaguguguguguguguggaaguguugagggggcuuuagguguggucucaacaaggggcuauuggcuuccggaacaguacagaagggcuaaugagagaggugcucacccacgugccgcuucagauguggugaggugaguguguauauauauggcucccucugauuguuccugagcuagaggaaguauugaaaugcuagcacuugaacccacagccuuagaacugcuaggacacccauaaaucccagucuuuauaaaauuuauuuuuaacauuaaaauauuuuaagguuuccuggguuuugacauaucaaaccauacugaccacucuguugacagaaauaucaaaauauauuuuuuuuucuuguuaacuaauuacacaugaguaguggaggcaggaguguauuugagugcaggcacccuuggaguauaaagaggggcguuggauucccuggaacuagagauagugguugugagcugcgugaccugggugcugggagugucucagccaucucucccagcuccgucacuuucuuaaaggaucagggaauccaucuagcaucaauaaagauagaucuaaaacaaauguuuuguuuuguuuuuuuaaguucuauuggcuggugagauggcugaggguaguugcaaccaagucugaucacuucccagagccuagaagauggaaggagaaaaugaauucuacagguuguuuugugacaugcgugagcauacgcacuaagcacacuaaacacaccuucaaucccagcacuugggagucagaggcaggcagaucuuaguucaaggccagccuggucuacagagagcuaguuccaggucagucaaggcuacacagacaaaaugucucaaaaauaaaauaaaauaaaauaaaaauaaagaaagauuauauuuugcauaaguaaaauuccuuaauuuuguuuguuugaagugggcuaucuuggaaaaacuauagaucauccauugcuaguuaggaauuuuugccaaauucaaugguuucucuaaaacaauaaugagcuacaauccccgaaagcuaccacgagguucaauugggucugccugucuuaagcuuucguuuuuucuuagugauuacuugccaagaagagugugaagagacgaguggauaaggacacgugcuuguuuuggagagaaauggagucugguucucagcacauuguaagcgacuuaaaacccccugucacuccaguucccagggucuaucugauauggccugguccuuggcuaguaggcuugcaugugguacacagacauaugcaggcaaaaauacuaauacacaugcauuuuuuaaaaaaaaaaggauuuuaaagaucuuuguagaucuagcuuuugauagagguuucagcguagucuacacacauuuccuagaucccugacuucaccuccuaccagacuggucgguguguuacauuuaaugaaucacuuuuuccuuucuuccuccccuccaucuuacacaucccacaacggccucauccuugugguugucucgcuucagcuucuugcauacuagacuugaagugcaucaucaugucuacccgauggaucaauaccacuucaugcuuacucaugguucauagcuaacucaggaaauagcaucauuucuuaugcaggaguggguaaugauguuguacauucuaagaguuuggaaauguagagugaccuguauugaucacuguauuagaauaguucacugccuuaaaaaaaaaacugcugcaucucccccaauuguacauauucucugcauaauauuaacuuauggugaacuuuaaauaucaucaaaaguauucaaugcuaucaaaaucacuuccgcagcauuguagauacagugucacacuuggagaucacggagaugggaaggcccuuugucccuacaugaaauucccugaacuaguuagcuuuucagguuuugaguugguguuuccuguggccuuuguuagcagucguuguuugaguuuguaguuuccagaucugcucccuuaguuuccucugucagcuuuccauccucguuuacugagaggcuuguuaaacuuucuuggacuuugguauacaaaaccacgcugaccacacuguugacagaaaugccaaaauauaauuuuuuucuuuuuaaauaaucccaugugaguguagcaggggcaggaguguauuugagugcaggugccuguggaguguaaagagggguguuggaagguggaaggugccacacgggcacuguauacauuagagucaaaugguaauaacagcaagauaaauauggacuauucugcaaauaggauggaaacauauuauggcguuggcagaggugaaagugucaaaacacauggcucuuugaggacugauggaugaacuguaaacggacaauuucguuguugaggaguaaggaaaauccugaggauucagagcccaaaaguuugcauggcauaauuuaaaugugagagaguucaguucugacuggaggcaggcgccgaguccauguaaaugcacaagauagaagcaggggaugacaggcgcccucagaccgcugcaguucucauccugguagaauggaacggaguuaggaagacugaacacagagacagugagauggcagugcaaauccgggaaagguaagagucgaaaagcguagagugcgccagagcugcgcagugacuucgugggaacgagggacuucccugguggacugaggaggugugggaaagaugaccacguggaggggaauagucggguagagucacgagggucaggaagacaauuuuccucaagcucuguggucccuguguugaauuuuggaccucucuuggguccaagaaggaaaacuguccgcagaaucaagagcgcccccuagagugguaggaguuugggcgcugcuugcccgguauucaugguaagcaggaagagugagacuaaauuaggcauaagcgaaguucgaaaggagucagcgugucuaccuaggugguaaaaauggaggucaccccucagagccugcugagguugaauggcauugguucugucaggcaucauuuaugaucuaggagcaagaacgagaaaugaggucgcuaaguucugcuacggcuaaggauuggaacuaucaagugccaacgacuucaaggucugccggucagcucaggucacuggguuuggaaagagauggaaagguucauccaccuugcaccuagagguucaacgaccaacuucauggaacagggagcaaggacaggggcagugcacagauucugaaggcagaggcucuggggcaaguaagaucacaagaucauacacuguucuccgugucuucugacuucugcaugucuuugcuaaacugccugcccaggagcugugugccuuguuguauaguggauaaaaacuuagaucucuuuguaagauuuauuuauaaguuaugaccagacaugauggcucaugccuucgaucccaguacuugggaggcagaggcagguagagcauacauaguaaggugaggcuagauuggucuuccaggaguugcauagugagauccugccucaaagccgaaacuaaaaccaaaaaaaaauuuauuguuaauuuaguuuauguguauguguacuugugggugcccccuuggaggccagaagauuucccggaacuugaguguggcuaacaggaauugaacacugguccuuugcaagaguagcaggugcuucuaaccacugaaccauccuucucaccccguaaaucucauuuucucugcucaggccuguuuugcuuauuagucccaggauauuuuuuuauaauauaaacagagagcuuaaguauagauucucaaugcugauuaccaaauucuaaaaagaugaaaucucugaaucuaaaauuacuguaggcacugauagaacuuuuccaauagucucaaguuuccacuuauaaauguuuucucaaaacuuucgccuauaggaauauaguugaaccacuuaggaaaacaaauuuuguaguaaucuacuauggacucugugauggguuaucagucauucggaacuaccuguaugugagaccucaggugaucuucauuguaacacaacucuucuuaauccaccauaguccugucugcaaaaagauuacaguucauuacuuggugagauuauaaauuauaaaaccacagaucucuccauagaccguuccuuugaucuaugaaaaguugucaucugccuuucccuuaggcagggcuggcuguuugaguuaaggucuuggaacauacaauucccuuguccccuugcucugcagggcauagcagcaugcccugagcagaaaaaagggaaaauaaacuccgcagacguucguuucagccuaaccaucuggccugaguagaaauacauaggucaucugguguccuagauaaauauugugaguugcgguguuucucuauguugguuuucuaaagaguaaaauggagaggccaugaugaggccuccccaagaaaggagagaucuggguuugaggaacaaaauaacugacauuccucaagcuucucucuaccacuguggcugcuguucuauugaucuugaagcugugcgucuuuccguugagcaggguccacugcagaggacucugcccugugaaggaaggagccaucaggacacagaggagacaugucucaacuccuuuagguggugauggugauuugaggaguuaugguggcuugcuaauuggaaucuggucugaccagaucaggaggagggaaggaaguugggaauaggguagagggaagucagaccuauguguuguucccauugccuuggucauagaguaacugugaauuuuauuuuaauugucaacuugacucugucuagaaucacccgggaaagaacugucuaaggggaagggauaggaugucucagggcagagaucaucuugaugacguuaacuguauguaaguugaaaggucaaccaaugauuggcaccugggcauugauuaaguccugaaccauugaagacuggagugcuggcaugccgcagucauugaauugcucucuguucuugacuguugaugauguaaggagauugacugcuccaagucccugcuuccuugacuucccugcccugacuggggcuggaauugugggccagauuuacucccuuaaagcucccuaaagcugcauuuacaauucaggguauuuuuuuuucuuaccgguguagcaagaaaugggacuuagacagugaugcauugccaguagcuaagggccucccaucaguuuccacuccacaguggacagaggagucugguuugguuugguuuccuuuaaugaaaauaaaccuaugauugaacagaaguugaucacaaaaucccccacuauccagggaggaaauuugacagcaucagguaccugggcuagugaauggauaccaggagguuauggguaagauuaaaaaaaaaaaagaaagaagguauuguaaaugacuaggugauaugaaaaaauggcuaaguuuugaaacagaauuugaaucuucauucuggcuuuuacucagaaagucauaacauaaacuaucucucauaaaacaccaaucaugguugacaccugccauccccacccccacccccagcucuggagccagggauaugcaugcuggcaagaagaaucugccaagacaauuuccacccuugcaaucuguccccagcuuuucccuuuagccucuggcaaagaaagaccuuucuccaacuggugacuggcugggcaaacucaaauaugagcguguugguuuucaguccuggugacuugcuuggagacuuucuuagugccuugccaagaguaggagggugacaauucgggggaaggcugugacacugcuuacugucugcucugugcagauccugcuggugucauucagagaguaccaugcccaucuaccucccaacugcauccugggaaagguguugucauuuaauuguuauccuaaguaauauaagugcauuguccaaaacucagaugcacaagauuuucaagagaaagcuagacucagcucuucuccuaaccucagcuuucugugaaucaucucagagauguucuaugugcaagcaagugcauguuuaguuuucauugguauuacauuuaucuauuuauuuuguguauauaugagaaugaacauggaggcuaguggguuuuuuccuuccaugggggucucagggauugaacucaagcaggcuuggcagcaagcaccuuugcggacucagccauuuuaccaguccaguuuuguuuccuugagacucuggcuaguucagguuggccuugaaaacagggcagggcaaucuuccugucucagcuuaagugcuaggauuauauauaggcagguacuaccacguccaucuuguauuuguccuuuaaaaauacagacgaaacauuuaggguguagcuuggggguagaaugcuugcuuagcauauccaaggacauuguuuaacuccucauaucaaagaaagaaagaaaagagaaagagggagaaagagaggguggauggaaggaaggauggauuaggggguuacagugaaucacgaaugcauauuccuauauaauuaaagaccaaaucaaagggguuugucauggguuacagauggagagaauguuuucaaguaggcaugugcuuuggugcaauguacaucuuacuuaacucagguaaccugucuccauuucuggggauuucuuauacagauucauucaucugagaaaucuuaauagccacagcaaugugccagguguuuaagaacuacacuguguuauaaaacauuuguuugaacuagguguguuggcauaucuuuaaucccagcacccgaaggugcugaauuugaggcuagccuggacuauacagcaggaguuccaggucaacuagagcuccauagugagacccugucucagugaaaagauuuauuuggcgcaggguucuggguauuucaggcacacguggaaaggaagcuguucuuagaaagucuuuguccugugaaguuacauaaggaggaaggaggugugcucaaugaauucuaagaagaugagacacauuucccuccccaccuggugacucagaagaagcagagcccagagggcacugaacucuguucucuguccuuuaggaccaggccauuauauaaugcucugaggcaagggaauaaacaggucagaagcagguguuugucccacaaggaaagaacucgcugcucagaugugagcaagauugccuaagcugcugcacgguuggaaguacacagcuggccaugcgguguccagcggcccugcagggcugaaggcaucuaauaaaaacacaacagcuugucuccaacugguccuuucugguuuugugagaacagaaucucaccguguagcucaagcuggccucugacucaacuauguaucccaaauuauccucgcacucaugguaauccuucugucucagucucccaaguguuagcaguagggcgugaagcacugugccuggccuccucacgguuuugaauugaugucucuccucccuggucuuccuuucuuuccccguuauuuaauuauacuuuccaaggcagaugggaggugacacauggacaugucaagauggcggcuaacccugggauucuaaguacccuggguuaccccuucugcaccgaagcgacuuuuuucugaauggauaugagacauaacaucgagaagacaccugaaacuacacacaccaaacucuguguuuggagaacagcuuuucuugugugugagugaggaagccugaggucuuagauuuuuaucguagcaguguccaagcuucuaguuagggaguucaggcaugaugugcagcggcugagagagugggaacggccccucacagcauucacacuuuaggaagcgugaccaagaacuugcugucuuaguuuuguuuccagaugcugugauaaauaacucugacaaaaugacuugaagggagagggcuuugcccaggucuuugcugaauguguccaaaccuaacucaccagggggacaccaggcagaaucacuuggccagcgucuugugugugagugcaggugcaugcaugcccuggcacgugugugccggucaaggacaccuuucacaaaucaguucccuccuuccaccauggguucuggggaucaaacucaggucuucaggcuugugugagaagcauguuugcuugcuugucagccugauccugguuacuucuaaccuagccaauuaacauuauauuauuuacggaaccaauuaggauugaauugguuaucucgguucagccauuuguggaacaugaguucaagaaucuccugccuccccagcauuggacugggaggaugaaugggcagugccuuucuucuucuugcuuauuugucuugacauagaucuucuauguaggcuugguuauccuggaacuuacuccauagaccaggcuggccuccuggcucugccugccugccuccagggugcuggaauuaaaguuauaaccccuuaugcuagagacaggacagacuuugggcugaauaacuaacuguggcauuuguccaagucaccuugaggugguguggcagagcaucuuaccucugcauugauuggauuuuucuugguuuugguuuucuuugcuuuugauacagagucucacugugcagacuagguuagcuucagacucggauaugcuucgccuuagccuccccagaugugugcuacuaugucuggcuuuuguuuguuuguuuuucagaaacauaguagcaacuauagauagugucaguagaugaaccccucccuuuaaaccaucugggcugcuuucuuccgguagucucucuagaaagugucugagcagaugccugcauuggucagcuaagguugcugaaaugugcuaccgcaaucaagacggcucagacaaaaggcauuuuuccuccucagcugaguucaaacucaaaggugcugacagguggguuccaucuuggagcucugaggaagaaucgcuuccaucccucucugcuggcaucccgugccuuguaggcacaucacaauggucuacacauguauuacaugguguucucauugagugaaggucaaaugugcccaaauucccauguucagguaaaaccacgcuauuagaugaaaaugauugaguaugaccuugguuuuuuuggcaguucugcaacuuuauuugacaugaucagguuaguucucauccacauugacugucuguagauuuuugaaugugguaacaggcgcguaaguuaccagcguguagagcuugucuggggaauccucauccucauugcguuuucuggacaagcguacucggcugcgauauggaacguuccuuauucccuuggcccagacagcuuuauugagccuggugucaaugugcacaucugguguccccauuuccuucauggcaaacuuccgaauuucuuugagugcccgaggagcacgcuucuggaagcccacuccauggaugcgcuugugaauguugaugguguauucuugggucaccaccucguugauggcagaacugcccuucuucuucuccccacccuucuuggugggagccauucugcugggugccaugacuuuguuuuaauuugaguauuuauaucuaucugugaagucucacuauccaagcaaagucacaugcaaagauaccaaggauucugauugcaaauguauuguuuuaggagacacaauucacuugacaguacuccuuuuaaccaugucccuccuggacucugguguuaacuggugaccacaaucuccucucuguugacucuccauuccuuauauagcacaaucucuccauaauucagagucauauucucccacuagaaaauauagcauccaagaaguaagcucuuaauuggaccagcaaauccugucagacuguucucauuugagagcuggaccuuuguccagauggcgcaauguggagcagggaccuguccaucuugcacaggaucuuaauugaagcuuggcuggccugccaggcacugcuaauuaaucuccccuccuacugggcuuuugaauggcucuguuccugagauuauuuuggaggugauuggauuuccugcauucaagaauuuucuaauuccuuacuaacgaggucucuuuaugggaacacuaguugagaguucaugugagucuuuuuaucaggauuguuacuugauguuguuggauacuagggcuuuuuguuuuguuuuguuuuuuuuaauagcucuucagaugacaaggaaaauaaccaguucaguagaaaaauuacaaacaaaauuuaagcuauguauuauauaaggcuuuaccugucugucucuagagauugaaaagacaacugaaagaaggaacaagagaagugacccaguacuuaggagcacuuaccaccauuuauuuauuuauuuauuuauuuauuuaauuuauuuaguguaugugaguacacugucuucagacacaccagaacaaggcauggggucccauuucagaugguugugagccaccaugugguugcugggaauugaacuuaggaccucuggaagagcagucagugcucuuaaccacugagccaucucuccagccccacuuacugcucuugcagaggaccuaaaguuucuuuccuagcacccacaacagggcagcucacaacugccugcagcuccagugucaaagagcuacuucuggcuuuuguguauaaagcauaccuuuacacacacacacacacacacacacacacacaaauuuauaaaagaccaucauacuacugugagaaaauacuuuauuuagagaaaauaaaacauaaauuuaaaggauacagaaaaaacauagaauuaggugagugcuaaagaguugauugaacaaagaggcugagugugauggugcagaccuuuaaucccagcacuagggagguagguggauggucuauauacugaguuccaagccaguggaggcuacagagugaguugucgucucagagagucagagaacugaauggaggagggaguaaggggggaaagggaagaaagagagaaugaagaagaguccugagcaucugggaauggguccgcguguaaaguauuuguaacagaagcaugaggaccuguguuugauccccuagcacccacauaaaagcuaagcaugaccgagcgugcuccagaggcugagacacguagaucccuggggcuuucugcccaggaagccuagcugaaucaaugagcucuggguucaguaagagaccccuuucucaaaaggaagcuggagagugaucagagaaaguaucagucgauggcuucugugcgccuccauucguaugugugcacauaauugugcacacacuauccagaugggaacgaugagggacuaauacugaggaaucugcggccccuucugccaaguuuccauaugcaguauuauuuagugaugguuggauggaugaugguauuuuuccauauaucuguucggauacaaacacucuuagacuguaagcggggcuuccugcuggggcauuuucucugguaaccuguuuccuuuccccccacaaucaggugagaaugaaauccucgagacucugcaugccauugcaagcaagaaccagaucuggaggucguauauuggcaugggcuauuacaacugcucggugccccagaccauuuugcggaacuuacuggagaauucuggaugguaaugugucuaucuccuugcuagagaacagggauacuagaucuguggucucuguaucccauggcucacacacugacaccugcccccugcugcccucgaaacuucaguucaggaauccauccaucuggcuucugauugggaaauuucuuccaggguguugaaauagauuuuuuuccccuuccauuugcauaaaguccagaucuggucaucucuuccugaaucaaccugaaucucuaugcuguuuuuggacaaggcuucacuccucuuuggugagacccuggggcauuuuaggcugaacuuagucgauauugcaucucagacuuuauucuguugccaggguuuuacaagugucaguauucaugucucacuuagccccacauuucuugguccaaagcugauggaagugaagucauggugucagaagagugacgacuguaacaucagcuuuauugcugccauuuuaccgagaaugggaacauguguguuguggacaggccugugcuuugcauggccagcuucuuguucccaucaccccuuguuagucagacaauucuuuccugcuccuggaggcgggggcaggggcgggguuaauauguguuagaggacaacuuucaggagucagcucucuucugccauggggucuggggaauucagguugucagguugucuugaaagccauuuucccccugcaggaucauccugcuggucuugacaggagccagaucuguggacacauccaugucugcucucuacccguguggagauucucacagcucuauacuuuagcuccuuuuuaauaagagaacaggaaagcaggcccaucaaaaacggagaguguuucaguucuucaguggaugaaugugcucgccaauguguuugauuaguugagggcuuguuuucuuuccacuguggcucugguaaaaguuugcaugguaaacucuugguugauuucgaaagcaaauagccuuucucccuacaccaccuuuuuuuuuuuuuuuaaagagccuguuuggccaugaaugggcuacagcuuucucugccugggcucuggccucuggccuuugcucuuagugaccauacaggaugucugccauauuucucucuggcugugagcgaguaugcuaauuaauuugggggcagccaguguuuugagagggagacaauacucuuguuuuucagccucgggcuuugggugcauuuuaaauuuuguugcuuugcguuauuauccagaagcugaagucugaugccgcacccagcucaugcugauagggagggcugugaacacgugggugguacacuccacauuauacuucugaaugguuuccauagcgauggagccaacaaauuccggugacgugaggugaaaauaaaugggucacauagacucgaaagaauacaaacauuugggcuucuaaaagaaacugcacuggaucaagaacuugucucaugggguccacugucccaaaacauccauugcugagaacgucaguagcuaaugucaacacuggcauuugccuuguggcuuccugguguuuguaaucuuggcaguaagauuaaaaugagcuuuuuauaaguuuuaugaucccuucugaaagcccccuacuuuuucucugauucuaaaacaaaaucauaacucaaauaauagagaaaacuaguuauuuaagaauaaacgccaaugucguguugaauauauuuccaaguaaccuacuucagaacuauaagccuuuuuagauauguagauacuuuuaaaauacacguuacaguauaucuagaaaaagaaugcauuugaauuaaugucaauuaagacacacccauggaucacaccucuuucccucuuuuuauuccucuugguaccugauauugagcucauguguucacaccacugaggaacaucugcagugucuuggacaaaugguuuuaaacacuuuuccucccugacugaggcaaacuucuguauguaugacagcagcccuuucauggcaacuuugaaaaccuuuuaaaaaauaguuuuuaaaaaaaauguuuuaauuguauguguaugggucuuuugccugcccguauguaccucucugcuccacauacaugucuggugcccagagaagccagaaaaggacuuaaagucucccuggaacuggaguuacagaugguugugaccaccagauggaugugggaaauugaaaccugguccucuggaaaagcagcagugcucucaacugcugaacagccucuccagccacucuuugauagcuuuuuuuuuccuuacucuucuuuggagauaggcuuucacuauaauuucccuggcuguccuggaauugcuuuguagaccaagcuggcuuggaccucucagagauccaucuaccccugucucccgaguguugggauuauaugaacgccaccaugccugacaugguagcaguuuuuaaccaugaaauaggguuguucuuuacuuccuuucacaggccauugcuaagaagggcauuugggcauguuauauuucuccaguguuuaaaagaaaaaaaauuuaaaaaccuguaacuauuuuaaaaacuugaaauaaaagaaguuacuuucaaagcaguggugguuacauuaacucaaccuuggauuauaaagggggcuaacgacaggaagacuggucauguaaaagacagaauaaguagaccccacuggcugaggucacagggucaccgcaacucagacugagcagcuguggucaggaaauuuaauguuuuuuucucauagguaguaggaagccgcagugaucuugaaguuuuguucguuguauuccuuguguauacacaugcuuauggguaugagugugcuguggugcaugggcggagcucagaggacacccguguaaauucuggggaucgaacuuaggucuuugggcuugauggcaaccgccucuacccaguuagcucucuugccauccuuaucagagauauuugaaugggagucaaaaaaugcacauuugcaccucaaauauuuugcaauuucuuuuucuuuuucuuuucuuucuuuuuuuuuuuuuuuuuuuuugguuuuuucgagacaggguuucucuguauagcccuggcuauccuggaacucacuuuguagaccaggcugaccucgaacucagaaaucugccugccucugccucccaaguguugggauuaaaggcgugcgccaccacgcccggcucuuggcaauuucaucguuuaagaauugucagauuagaaaggcaacagagaaaggcugggcagguacaggugccauuggaagauugaugguccuuauuuggauuuaacuugccugauuucacuuuagacuuuugugaaacaguauugagugguccaggguaaccucaaauguagcagaggugacuuugaacuuuuucuccaaagcugggauuaaauacauacgccccacccuacuuggucuuucccccuccuuauucuuuguaaauuaaugugaaauuuuaggcucuaauguuuucagguguauguauguguuaauaguguaugccuguguaccgcacagagaccaaagggcauuagguccucuggaauggcaaugacagguggcugugagcugcuugauacccaugcugggaaccagaagcggaaccucuacuagaacaacaacacuucagcaucccugccucugccccaagauauaaaagcaagauuauauuuauaauuaugucucuauagggaguauauuauguagccaugcggaagagcccagcgaguuggaguuugugagcaucccuagagauugagugugagcaccauguccugcuaccuuuagauuuuaagucccaaacucccacucacacacacccucccucccuucuuuucucuuucccuccuucccucauuuuugagacuggauucuugcugucuaguccaggcagccuccgacuuuuaauccuucugccucggacucccaagugcugugauuacagccugggccaccguaucuaucuuuuacagcaucucauuauuuagccccagcuggccuggaauuugcuauggaaauagcaacuauugcucacuguuguucaagaacaacaacugguuagguagggcugcccauacuuuugaaugaaaaugaacuuugguggcuguuuuuuuaaauugcuacacuuuguguaggccuccugugaccugcugcuaaucuugaaaaaauguauccucacccccuccuuacaucugcuccagauaacaacuaucucuccuggguguagcugggugugauggggaacaccuuuaaucucugggaauuuauuuaaucucugcauuugaagaccugcugguccacaauagauagauaguuccaggccagccaggacuauagugagacccuuucugaaaacaagaaccaaacagaaagaaaagaaauugugucugucuccuggccuaaaucccaaaugaugucccugaacauagugcaaguguccuguugugcaguccgucugagcauauggcagggacagugucacacuugucuuccuaacagcaggcugugugugaugcucuugucugacuggaguucaccacugcccauugucugugguucccuaggaucucauuucucucacguucccauucacuugccugcacuguguauuguauugcaugcguccuuccuuccacuucaccagucccuuagaauuuguucuuuacaguucauaaucuaggcuaugcagggaauuaacugcaggaacaauguguucugcuguacacaauaaucacacagucacacuaguagaaaaauaaauaauugagaaaaauauuucaaugugcugacguaguacugagugcugagauggucuuuaaagauuuuaaacaaagcuuuuaacauagcagugcuuucaaagucugcaugugauugagagagagagagagagagagagaggaaaagaguauaaaaaucaaagccauaaauacaucauucuuuuggcuuggugucuuaguuaauuuuuuuauugcugugauaagacaccaagagaaggcagcuuacagaagacuuaauuuggauggaggcuuacaguuucagaaggugagucugugacccucauaucagggagcauggcagcaggcagguaggcauggauuuuaagaacuagcuuauaauagaacacgugcagaugcccuagggaauuagcucugucaagugugugcugaggaccugaguucagaucccuagcauccaugcaagagcuacagccauggcacucaucugcaguccucaugcugaggaaggggagacagguggauugcuggagcucacggauccuaguggacuugguuuuagugagaguuccugucucaaaagauaagcuggagugggcugcagagauggcucagaagagcacuggcugcucuuacagaggacucagguucaauucccagcacccacauggcagucuguaacaucagucccaggaaauuccauaccgucacacugcauacauguaggcaauacaucaauaccuaugagaaacaaaauuaauuuuuuuuuuuuguuuuuuguuuuuuuuuuuuuuuguuuuucgagacaggguuucucuguguagcccuggcuguccuggcacucacuuuguagaccaggcuggccucgaacucagaaauccgccugccucugccucccgagugcugggauuaaaggcgugugccaccacgcccggcuucaaaauuaauuuuuuaaaaagguaagcuggagaacaauuaagauuccagcaucaaccucugccuuccacacacacaugcacauacgaugcucauacauguguacaauaagacaauuaaaauaguaauugacaaaaaauauagagguugagagacagccaguucaaggccagccugauuuauugagugaauggcagguagcccgagcuacauacuaagauuaauaauaauaaauaauaauaauaauaaaaugucagagggcucaguaguuaggagcacuuguucgugcagaggagcuggauuugguuacuagcaucuacaaggugguucacaaugcucuguaacuucaguuucaugagaucugauuuccucuucugaccuccaugggcacuagauacauagauaacgcacauguacacaagcaggcaaaacauucauugauguaaaaugcaauaaguaaaucuacgaaagaaaugaagagaggaaaaaagaauaaguucuggcugugcccaaagaauaauaaucuuuuucugugacaauucuguucuuccccauaaaaacacaagcaaaugauuuauuaacuggcuuuuuauuccugugaccaaauacucagcuuaaguaaguaccuaagggguaaaagauuuauuuuggcuaagguuguuuguauguauguauguauguaugcauguguguauguaugcauguguguauguaugcauguguguaugcauguauguauguauuggggugcuucccaggaccuccacagcgugcacauagagagaggucagaggacaaccuccuuaggcaguucuugccuaccacuugggucucagggguuggacucaguuugcuaggcuaaguggcaaaccccuucaccugccgagcuaucaccugcccaggucaccccccaugucaaugucauugggagggaaggugagggaacacaggaguucauauccuggcaaccaggaacucgccuucuuuuucaauccaguucaaucucuaaacugcugcauggugcuguccuccucggggugagucucuguccacauuccgacugggucuucagaaauguaugucaucaaucgccuaagcagguuuaaguccagucaaguuggucaucucagagucuuuccaguguguuauauaauucucaagagcuuuggguauugaauuugaaaacaaagggauuucaggagcuuuucuggucaggagcggcgagguuuauggucuucuguuucccucucagggucacccaguacacuccguaucagccagaggugucccaggggaggcuggagaguuuacucaacuaccagaccauggugucugacaucacaggcuuggacauggccaacgcuucccugcuggaugaggcaaccgcggcugcagaggcgaugcaacugugccacaggugagaggcuaugugggagagccugccccuccggaagacaggcauccccugagaacuguggguggaaaccccgugcgggguuuuagagcugcauguagaguuugccaaaagaaaauuggcaucaguaaagaugauuuucugaauguguagcaaccaaaaguuaauuaauagaacacuaaugaaucgcagguguuuuuggcagaccuuguaagaucugacugcauuauacagcuuuggucuuaucacacacaugccacuuuguaucucaugugccuucuucauguuacacacaccaacaaaugcugccugaaacaguucauguucaaaauuaucgcacgcuaugaauuacagggcuggguuuugguuuugguuuguuuuggucaguucucaugcuccagaggcuggcuauauaguugagggugaccuugaacuccugaucccuccaccucuaccuuccaagucccaaguguuaggauuaugggcaugagccaccgugucgaauuaaacugcaguuuacuauacauagagucuuucugccauauugcacuauauuauauauuauauauuauauuuauauuuuaguauugacaaucacaaaaaucaaaguggccaucaauuugagaaaucugaagaugcuguauaucuuccccaaucaaacauucagccaagauuuaauucuuuaaguaaaaauaaaaccuaucucauacauaugcaaauuuuccucaucagaugggccaggcauuccaaucaaucaaucaguaaauuugcuuuuguucaaaggguuguuucaaaauaaaugucuuuaugcucuauccucagcaaauguuugauuuggaugugauauacaacuuuugucuuaguuaggguuucuacugaugcuacagaacaccaugaccaaaaaccaaguuguagagaagaggguuuauuuggcuuauaguuccauauuucuauucaucauugaaggaagucaggacaggaauucaaacagggcaggaagcaggagcugauacagaagcuauggaggggugcugugcuguugacuggcuugcuaaccauggcuugcucagccugcuuucuuauagaacccaggaccaucagcccuaggauggcaccaugcacaaugggcuggaccgucccaaaucaaucauuaauuuaaauaaugcccuacaggcuuaccuccagccagaucucaguugaguucccuccuuucagcuagcccuccuuggugugccaaggucaugggaagaguuaucugacaaaaaugagucaugaguuggaaaacuacaaaaccauacaacacuuuccuguuguacacauggguaagcuuacugauucucucucccucccucucucucuaucucucucucucucucucucucacacacacacacacacacacacacacacacacacacacacacaauguaugugcaugggcucauauauauguuacaaucauuuucaagcuucuaauugcguaaguccacaguugacuuauuggacagcccugaggugcuaucaaggacaggggucccuuucuuucugccaccuuuauaggguuauauuauauuauauccucaugccagaagaugacuguuaggcuucuagccuggacaucugcacucaggaaaaagugaagggcagagacccaggggugcuucuagacaauuaaaggccucacgaagauuucacuccacagcuuuuauguacaucucacugaacgccuuccuucacguggccugaccugagaaaugagcuccauaugggcauagccuugcccugguaccuggaguauaggaguggaguauaggaggaguggagcgugggaggaacugacauuguaauggacaccaucagccugacuccuuaggaagaauuuucuauguuuagaguuugccuuguuuucauugcuuucccccacccccuacuccccccaacucccaacuucuugugcagcacauaaucccagggcugugagugcccucugacccuuaguuguuuucucaggccuugccuuuuaugagaucucgaggacuuccucagcucuuccugucccuaccuauuagugcuggccuuucacacacacaccucuccgccugcuuuuccuuccuauuucacaguauauuuugaacaccucauucuuacuuggcuuucuagaauaggguuuuuuggguuguuguuguuuuguuuuaugcguguguguguguguguguguguguguguguguguguguugugcacaggugccuaaggaagucagaaagugucagguccccuuggagccacccaacauagcuuugaguacuaaacuugguuccucuggaagaacagcaagugcucuucaucacugagccaucucuccagccccuagacgagaacuuuucuugugucuguggcauggaagggcugugguuauuuaaccucacaucugccuagacacauuuaguuuauaugcacuaucuucuguuaguagaaauuacuuugcaugucccuaagauaaucuuccucaggaauucuaauuauuuccugauaauccauuuccauaaguuaccgggucacaggguacaguuaccaaucacucuacagucccccuuccuccacccugugcuuuggaagaauauuagaacauaucuucauggaagaauucauauuuagguugggaaauaugcccauauuugugauguuuccuaagaacuggagccucuguccugagugcgcagaugaguuuaauucuuggcuuccacagauaauggugcuguaggguccaggcagguacaggcucccucuagguaugaauguucuggugguggagcccacccggggcccuucugauuccuuaacagcacugaggguaaguucagguucuucauggaagauggcacacaggauggcaaucuauguauguucucugucacuauucucagcuuuuuauugauuuuuuuuuuuuuuuguaaauuuuguucccuacuucuaauuuuaaaauuucuuuuuaucauuuuaggcaggcugucacaauccaggauggccuggauucaauguauagcugaggauuacccugaccuucagauauucuuuauauauauuauauacuuuauuuuauauauacauauauauauauacacacacacacacacacacacacauauauauauauauauauauauauauauauauauuccagguguugagguugcagacuuaucgugcugagauucaaaugcaggcucuguuacaugcuaggcaagcacucucucagcuaagacacagcccuggccccuguguagcuuucaccucacacucacagaaguggagguguuuuuucuuugcuuauuugauuguuugggccaaggguuuccuaccugcucugcaggguuggccuugggcugccuuguggugaugagcugcucucccucaggaaaagcuuccuuccuccuuucuccuuaugucuccauguaaauuagaguucaagcgugugugugugugugugugugugugugugugugugugugugugugguguauggguggugugggugugugugugaugugugugaugugugugagguguguaugugugugugaugugugugauguguguaugcguguguguacgcacacauguaugccauaauauccauguagaggcuggaaggucuggggggagucauucuccaacuucguugaggcagggucugucuuguuucugcccaccugagacucuaagcuaaaauaccucugacaacaagauauauuacuuuacgagacguuuuuugaagugguuucaauuucccuuuauaccuaauaucuguccuuuucuuuuuaucauaguguagauguccuaaaacugaauugguuuuuguuacauuguguuuguuggaacaggcuugaauuucccuggauugcugucaggaacugagucaccaaucgcucauuucucuuuagaguaugcuuagaguuucccucacugcuuuugguauuggagaaguggcucaguugguagagaacuugaccagguugaacaccaucacuagcuacacuagccauaaaggcuugcacucugcacuguggaggcggaggcaggaggaucagaaguucaauagaguuggaggccaaaccagaauaccagagaaggggaaaaaaaaucuucaaguuuaaaugugcuuuuucuuuucaacagacacaacaagaggaagaaauuuuucguugauccucguugucacccacagacgauagcuguuguccagacucgagccaaguaauugauuuaaauuguguuuugagccacggguaauaucauaucaucucuaccuugucucucuuucccacuuccagucugauuggaagugagcuggcuuuagacuggauuuggugaguuugcuuuccccagcuaacuuucucccauggaugcucugccaagucccucgucaguacugaggggcaaacacaugcugaguucauuugccuuugugauuucguaaguccccaugcuguucugucaucucgugauaaaauuuaaaauacuaaaaucagcuugaggcaggaggauuucaagucuguggccagaugagccacauggucccaaaguagagauuagggcuauggcucagcaguaggacacuagcuagccucggcugaggcccugguuucaaucccuaguaccgagaaaaaaaauggaaaagggucagagggccaacaaaagaugaaauaaaguaacugcagcaauguuuuggaaaguugggaaagcagagcucacucaaacaugccugccauggccaugguuuccggugugcuucaugcagaugcaguugcuaaggaaaccacaccacaacuaaggaccacuuugauuaguccuaugugccuuugcaucguuuaguccuguaagcaacugaaacauccccggcccagccauuacugcauccucuuucugcuuuggcaacacagggcguuuuucugcuccacacuguccuucggaagggguuggaguuguaguuagaggguuuuaagaaucuaaggaaguccuuguugccauuuggacagguuucauuuaccuuaagcugagccggggugucccggagaugccucugugguaagggcuggaucuuuagcucuagggggugaugcuccugccaggaguagguucucacagagaguuagggagaggggagugggaaggacagaagaaagagacugaagagugaagcaugcaugugaguuggccuggagcccuguuaaacuuugaugagccagguaugaggugaggugugacugggagugaggccagaagcacaccuagggaaagaacagaaaaugaauacagucucccuggggacaagcugcugcugauugcauuuuuuugggccaggcaugauggcuuaagagaugggucagcagccugacaacaugaguuuuaucaucacaagccaugaugaaaagagagaccucacuuaucuucuaaccccuacacacguaccuuggcacaugaguaucugcgcuaaugaacaugucacacgugcgcacgcacacacacacacacacacacacacacacacacacacacacacacacacacacacacacacagagacacacacagacacacgggcaugcaugcacucacacaccauaauaaaaaggaccaauuuucccuuguacuuucagauauaggggggugcuugucgagcugaaguuaccccacgaaauggauuucaguggcaaagacgucuguggggugcuguuccaguacccagacacugaggggaagguggaggacuucacagaacuuguagacagagcccaucagacugggguagguaagcccccugcugagguucaggacgcugugucccaguucccauaucugucugucuuuuaucacauggaauggugacaucuucuuccccuacuccuuccucuuuguuacugucacucacugaucccugguaaauauucuuccauaugaaugcauaaucaaauggaguucccagcaaugccccucccagccagccuguuuguaguggagacaacuccugcacagucaggauaaggugauaaccuugaccucuucuccauuuccuccccagagccugaccugcugugcuacugaccuuuuagcucuguguauuuugaggccaccuggagaguuuggaguggacauugcccugggcaacucccagagauuuggagugccacugggcuaugggggaccgcaugcggccuucuuugcugucaaagaaaaccuggugaggaugaugccuggaaggauggugggggugacaagguaaagcuucacgcccccuuacugucaucacgaccuucccuguuccuuuucucuccuucauuuuguguaugugcguguguguacaccauaugugccuagaaacccaaggaaaccagaacagggcauuggauuccccaaagcuggagcuccaggcaguuccgagcugcccagcgugggugcuagggaaugaauucagguccucuaggggagcaacaagugcucagcugagccccuccccuccccuguucauguucucugaucucucucuaaauuuaauugguccacgucaaguagacggaaaaacaaguuaagaagagggaaucuaucuggguuauguacuguacgccauuauucagacaacaugaaaagguguguguauccuuuggaagguauuaguggagucguguacaggcaauagcuugauagaugucuggagagaccggccuauuuuaagugcauugugccuacccagcuucuuuuuaaaauaucacaucguggaaggaagaacucacuuuuguguuaaaagcaaagguuuaguguggcccaguaggguucuggagguuccgaggguuucucuguguagcccuggcuggcuguccugucuacucacucuguagaccaggcuggccucaaacucagagauccgccugccucugccucucaaaagcugggauuaaaagcaugagucaccacugcccaggugacuggugcuucuuaaguaaagaauuuagaggaauuccagguuauauauauauauguauauauauauauauauauacacacacacacacacacacacacaaacguauaugcuguauauauauauuauagccuguauauaucuauauaauuuguauaucaauauguuuacauauguauauauaguuuuggggucuaugauaaauauauacacauaguuuauguagauauauauacagauuaugauaaauauauguauacauguguauauguguauauauauguauguguguguguguaaacacacacaguuuauacaucuauauauguauccauguauacauuagagagggaaaguuuuuucaggguaaguagugagacuuguuagcauuccuucaguuucuacccagucucuucaaaccuccaguggcgaaacacuauuuccucaggucaucagccauggagugacauagaauccuugauccccaucauccugugaggaagagugauuccugggaaaucuccuuucacuaguccaggcuuuauuguauaugucucagugccucaaaguccaaauuacaaaccuacugugcuaauagaagagggucacuuggaaguugguuuuuauaagcauuucccacacaauucuacugcauucaccuccgcugggaaagcaagcccaucuacagcagcgguucuucaccuuccuaacacuucugaggacccuuuaauacaguuucucaugcuguggucaccgucccccaaccauaaaauuauuuuuguugcuacuucacaacuguaauuuugcuaccguuuugagucauaauauaaaauaaacauguaggauaucugauagucaacccucaugaaagggucauuuaccucaaagggguugugacucacaguccaagaacugguugagaaguucuguucuacggcaauccuggugcuuugaucacccgggcugacuagauguguugucuugauccagggaugccacagggaaggaaguguaucgccucgcucuccagaccagagaacaacacauccggagagacaaagccaccagcaacaucugcacggcucagguaaguaucccauccaaccgccugcugacugauguaaggugcucacuccuucucucacuugcucauucagucgccaccuacugacgagcauguacacuagagauggaaggaucuuacugacagaagccugggguugguugguugguugguugguugguuuguuuguuuguguuccagggcauuccuaugucacaugguuuugcaucucacuguguuucuaugucacauggucuugccucucacuguuuauaugucacguggucuuguaucgccuugcagugacauagaaaucuaugucacuguugccuaggcauucauuuuggcauuaguaauaaaacaauaagaaguacaacacuggguccagagggauagcucaauaguuaagagugcuugcugcuucuccagagaauccaagucgauuucccagaacccaaguugggaggcucacagcugcuguagcugcaguggauccaaagcccucuucugguccugaguauacccaaacacaugucgcguguauucacauagaauguggcauauauuuacacagacacacacacauauaccaacacaccuacacauaaguaaaaguagaucggcaugaguagugcacucgaaaacaacccaucaaaaguaggcaaaaccagccgugguggugcacaccucugaucccagcacucaggaggcaggggcaaggggggcucugagucucuggaagaguagccagugcucuugaccccugagccaucucucuagcaccuauucuguuuguuuuuuaauauagguauguauaugagcauaugugugcgaagguaggcucaugugugucaugacacacguguggaggucagaggacagacagcuugcgugaaucaguucuuuccuuccacugaggaaucuagagauaaaacucaggucaucaggccaguggugagcugccuugcugguccuguugcuucaguguuggaaaaucauuuuccaagugcaccuggucugugugcagugaccaguuauguggcugcuucuucuucauuuacuccagcuuauguauggcucauuucauaguuuuucugcauauuuuacagaaguuaugaaagugguguuuauagaaaaaccugaaggaaaaucauguuugcccuggggggugcuggcacucugucuucccuggauuuuauuuaaucuuuucuuuuuguagauugucuaguucuuuauucguuuuucuuaaguguucuguaagcagucaguggcccauauaguccuccaaugccuuugucuuggcaaagcacgcaguugcccuucugcccagauguggcugacuuuuccugggcucugucuucugugcugucuuuggauaucaucugcugcugcuucugccagcuauuguuguucuuggguuuuuuuuuuugguccuucgugugguccaccauuaacuucuuagauuuucuuagauuugcaucauugauggaacauggcuauuucuuucuuguaauuucugaaauucuguuaauggauuauauuuuauuuuauuuuuuuaaaagauuuauuuauuauuauauguaaguacacuguagcugucuucagacacaccagaagagggagucagaucuuguuacggaugguugugagccacuaugugguugcugggauuugaacucuggaccuucggaagagcagucgggugcucuuacccacugagccaucucaccagcccggauuauauuuuaaaaucuuucuauggaauaguggccuaacugauaucaaaauuaucaccauguuuugugccccccucuucuauuugaaacagggccucauuguaucccaggggucccucaaagccacuauaugauuagggauguucuuaaauuuuucauccuuccagccucuagcacuugggagguagacaggaggaucaugauuucaaagccacccugggcagcaccauaaggccaauuccuccaaagaaaaauaauaaaguuuuauuuucacuauauaagaugauacaagugcuauagaagauguagaagacugggccagugguucucagccuucccaaaacugugacccuuuaauacaguuccucaugugguggccacccccaaccauaaaguuauucucauugcuacuucauaacugcaauuuugcuacuguuaugaauugucauguaaguauuuguguuuucugauagucuuaucgaucccuguaaaaagaaucauuuauccucccaaagguaucugcugauguaggcaaagaauagacaaagucagagaccagaggguuggcucuagagcaaugaguauucggucugaucagaguguguguguauacucaaagcuuuuaaaaaaggaaauggaaaagaauuguuuaaaaaucucccugaaagccagguguggagguacacgccugaaaucucugcacuagggagacugaggcaggaggauuugaauucaaggucagcccgaggcaaacagcuugacccuguuaacaaugauaaaaaguagcacaaacgagaugguucaguggguagaggucucugcaacuggcucccaagaguugucauccuacuucugugcgcucucucucucucucucucucucucucucuccccccuccccucucucucuccuuuuugcacaugcaaauaaauaaauaugaauauauguagaccaauacacauacacacauguauauauauguaaauauauuuaguuguuaaaaaucgcagagucugccaggugugguggcauaugccuucaauuccagcacucaggaggccgagguuggcagaucucugacuucgagggcagcuuggucugcacagaaauuuccugucucaaacaaaacaagggucugggaagaugacucuguguuaagaucucuucuugaucuugcagaggaccuggguucaguucuuagcaucuaugugauggcucacggcuucuacaauuucagauguaagggaucugauuccuuuuccgaccuccaugggugcuugcaccuauguggugcacauacacacacacacacacacacacacacacacacacacacacacacucuggcacacacauagguagaauuaagugacugaauacuugaauauuacauuuauuuauuuauuuauuuauuuauuuauuuauuuauuuagugaacuggaucuuaaccugugggucaugacccuuuggggguuacaucagauaucuuacauaucagauauuuauaucacaguucacacuaguagcaaaauuacagauaugaaguuaccaagaagauaauuuuauggcuaaggucaccacauguggagcuguauuaaagggucgcagugcuagguugagaagcacugaugaaguguaucugucugaguaugggcacacaaaugucauggugcuuguguggaggucagggcacaaccccaggugucagauguugcauuuccguuucuggcuuucuguggguuccaggagaccugaacacaggugaguaguacuuuacccacugagccaucucuccaggccucacugaucugucggugaagucugaaguuugguuucuugugcuuuagccucagaagaaucgugucucuggguuugugaguguuugaacauggcuugcuguuuugauucuggaagaaauguuuaauuguguaaaaaauucucagaucucguuuuuccccauugaggucuuuauugcucuacugucuuccaacaguagguauugcuugcuggugcugacagaagccugcuuucccucacgaaugacacgaucccauuguaccagugcgacccuuuuauaaggguugguagagagacuuaagcguuguucucccucaggcuauauaagugguuguuccagagaaugcaggaaauuaaaucauuuuggcccauuuuucuuuagcuugggcauucuaaguccguagucccuuccucccaccaccugucuuccaacgcauggcugauucuguaaauguucugucuuguuucaggcccuuuuagccaacauggcugccauguucgccauuuaccauggaucccaggggcugaagcacauugcuaaaaggguucauaaugcuacuuugauuuugucugaaggugaguggguuauguucccagcauaacaagauggauacaugugucuaaggacaugaagucuuggaacuaauggucaaguaagagggcaguauuuucaguaucgaugacagugugacaggcagacuacuagauuuuucuuuuccuuucccuuucuuucuuucuuucuuucuuucuuucuuucuuucuuucuuucuuucuuucuuucuuucuuucuuucuuucuuucuuccuaaagacagggucucacuaugcagcucuggcuggccugcaacucaccauguaaaacaaacaggcuuugaacucaccagagauacuccugaguacugggacuaaggucaugugucaccccacucagugaguguugguauuugugguaaaugaaguucuuaaucuuucucaccccaaauccaaauggaggaugaacauuuuuauaagaaaaugauugaaagucauucuacaauuuagaaauaaauaagcguacaaacaaaugacuaguggacccauacaaucucacccucauuauuaauucagaaacuauucgaauuguuuuguuguguacuagacaaagguagccucaaacuuuuguguggcuuaagauaacuguaaacuccugauccccugcccuugcuugccaauugcugagauuauacucaugugccaacacacacacucuuuuauuauuaauuuuuaauuuuugugugguuuuggcacugaagcccagagcccucugcguaucuaccgcugaguuaggcucucggcccuuggccuuccucuuugguaaggauuaagaaauggcaauauccuaucaugguagcuuuuuauagaugacaguuagauauuguaucaaaauuuuuaaauugauucgaagaaaaugaccucacaaacacgagcuuugaauuuauaucuucagaccccacuuacggaacugugcguggcucagauuucaguacacagcuggaaauccagggguggggagguagugacuaacagucccagguguuacuauccggcuagucuagcugaguuggugugcuccagauuuggucugacccugugucaauaaacaaauaaauaugaaagggauugaagaagauacucuggguugaugucugaccuccacaugcauauacaucauacauacggagaagggcaguugacuaacaacuuuuaccugcuacaacaacaaaaaccaacuuaauugugccuauaauuuaucuagcuccacuacuguuaggcauauaucuaaaggaaguaaccugauaaaugugaaaggguuugcccauugaagccuccuuuacaauugauaguccagccuuggacuauuauuggaagcagauuaaauauucaacaacacauaauuguauuauaucaagaacacauaauuacauuauguuguaucuauucagcuauugaaaauaauuaugugggaauugauuuauugcaagcaaagaugagaccuuguauauuggcucaucucuguagucauaguuaagauaaguugaggccguaaguuaaggccagccuggucuacaucgugaggauaaccaaggcuacauagaaagaguuagauuuuuuuaaaagguguuuuugaugaauuccagaccuaugugaaauuugguauaauucuucugucucauucuccuaauuuauagggcucuaggcauaauguucuuuuuaaaaaaguguaaccauacagacacacacacacaugcauacacaaagagacacacacacagagauagacacacagauacagacacacagagacucaggcacacaugcacauacauacacauacaaugagauugcacccauuucuaauauguacaucaaaacacagguaguauugauuucugguuagucuucuggugauuuuuuuccucccuuguuugguauguauuucaugaucuuucuauagcaugauauucauuguuggcuaguagacaacaugcaauggucaauggucaccucuugcugucuaugaugcuaguggcuauugugcagagcgcugucugagaugauuauguucccggucuuguguagggcucaagcgagcaggacaccaacuccagcaugaccuguucuuugacacuuugaagguucaguguggcugcucagugaaggaggugcugggcagagcagcucagaggcaaaucaacuuucgacucuucgaugacggcacagugagucagacaguauuaaaccaguucuuugugucucucaugaaaagucuuccauuuuguuuaacaaacauuggugauuaagagucuauuguuuguaaacauugaaugucuagcuuguucuauugugaucuuuucaaagaagcagauuguccucagcucuugagagauuguuuuuguaugugggacugucuaagggucuaucuaagucagauaacaaagagaguuuggggaugaagaagcuaaccacguuuauuuauagacugugggagcagccugaagucacuggaauguugucuacaguugucuuuccaaauucaaagcuugucaagucugaggcugguccaguuccuuucccuugaagaucaacuuggcccuggaggguucccuggugcucuagaguggcugaggaguuugaucagaaccuucucuaguuugguaucuuggacaguuuuucucuguggucuggaguuuggagcugaugacuuccauuugguuuuuguuucuguagcuuggcauuucuuuggaugaaacagucacugagaaagaucuggaugauuuacuguggaucuucggcugugagucaucugcaguaaguaaugacauguuguugucuucauggugauuauuagcugugguguugagaauggcucugcucucaaguggggcaauggccauccugcugcucaaauuaugucacugacugucugucccuuaucccugugacugcugauaacuaaaagucaauguuaacagacccuacccaggccagaacauccaggcuaaggggauauuaguggagcugcacccugacuuuaauacaaagauuugugacauugcaucucgguuucugucaauucugggaaagcuaugacacucauucauuuaaugaguaauuaaauaauaauaauaauaauuaaguaauucucaaugauguaguaugugucagauauggcgugcccugccguuaggguggcaaauugggcaugaguccugccucuacuaagugaggagccagacaauaaugaggaaucugugagcagaauggcucagcuucuuaccagggcuugggucaguucuaggauggugugagacaggagaaggccagggagagagagagagagagagacugaggaauucuguguaacugaguggcuuccauaacagcacaggguuaccaucccauaauaggauggaagugaaagagaugucaguggcucccuagauccaugcaggguccaaacagagcacucugcacugcuuggugcauagacauuacuucauugaauauuuguucauugaaagucagugaaagaagcuuuuacuggggcuggcaagauggcucagccgguaagaacacugaccgcuuuacaggagguccugaguucagauuugacacccucuucuggugugucugaagucagcuacaccgugcuuauguauaauaauaaaucuuuaggccagagugcaggaguugaccagagcaagcagagguccuaaaaauucaauucucaacaaccacggggcucacaaccgucugugaguguacuacaucuacaguguacucacauauauaaaauaaauaaauaaauauuaaaaaaagggaaagaaauaaagaaagcuuuuacuguagaaguugaaauaccuuccagaguacugagugaugaucuucgguuguccagacuuauuaagagcauuauucagcuccaaagacuaguuauaaacuaccaagaagcaucacaguggucucccauuguggaccacguaaacuccuuuccuguagaacaguuuccucaagauuauuggucuguaugaauuugagggauguuucuggagucguggauaugacuugagauagcuguccuuccauuuguuuucugcugcuuugauaaaacacuauguccaugggggcaacacagggguaggaaagucauaguaccuccuugagggaaggcugggcaggugcucagguguugaccaaggacagacacugcuuaucaucuugcuuucucacauagcccaggcccacuugcccaggguggcagcaacacaccccauccuccuccaucaauccucaaccaagaaagugccccacagacuuguccacagaccaguccaauggagcaaguucuuaaguugagauucccucuucccaguuuacuuuaguuugggucacguucacaaagcaaaccagcacaccaugcuauuaacauagggagggaugagaaacaggcuauguauuauuaaauuagauguucuagauauaaaauccguauuugcagacauuuuucccauuauuggagcauuuucuuggcucucuugauaauaucacagaugaacagauguuuuuauuuuuguuuauuuuguugugcuagugauugaacaacacacacacacacaccacacacacacacacacacacauauacacacacacacacacacacacacacacacacacacacacacacacacacacagguaaagacuugacuagugagcuauacccuguaguuuacagcucuuaguuguuuguuuguugcugucuuuuugguggugugugcuagguuugaauucaggccuuuuuuuugugccaggcaacugaucuggcucugucucagauaauaacaaagaacaaaaaaugugcuaacuaauagguucuaaguauccgucccuauauguuuucacuggaguguucaauaacuuuggccuuuacaugaauguccauuguguuagaugugcaauguagccuggaagcuuccagccuuaucccuguccuucagccucaauguucuuucucuuucuacaggaauuaguugcugaaggcaugggagaggagcggagaggucuucuagggucuucauucaagagaaccagcccguuccucacucaucagguguucaacagguuuguguggcuucagcaaauccugcauuuuguguucuggugguggaucagggagcccuggggaggaugcaguuucugaugcugaccacgcuaggaccuggguuauugccacucaggcgagcucacugauagucaugccagcaagaccccaucccugaugggagccaagcauacuuugucuccugggagcucugcugugcuggggagaauuuacagaugaaguucaucucaggaaccccguguccucuucucaguggccccuuguugcuaggggugcucugagauccauuagagucucuccccuccauauccaugagugaaugggucuuuggagucaggacuccuuauuuuguaugaggaccggccugacucuaauuuaauggcuccacccuugugucuuauguucacagcuaucacucagaaacuaaucuuguccgguauaugaagaaacuggagaacaaagacaucucccucguucacagcaugaucccacugguagcuguuuguggccuuucuccuuacuucuagcccuauccggauucccccugugggucauauccgauacacugcaagaggggagcaacagggccucgaggggggugggaagguucauagauggggcauagccaagcacuaauggauguuccuuauauaugugcuucuucaagggauccugcaccaugaagcucaauagcuccuccgaacuugcaguaaguuggucacgucuauauuauuaaggggguauuuaugggccaguuuuccaguugguacagaagcaaaugacaaaaaccuaccuagacugugacuccgugccuuaaugauccuuuacuuugucauucuccaaucguggcagagacccugauauuucucacaacuugaucaguuaaauuuauggauaaagcugaguguagcuguguucaugcucuuucucauacacgcaaauauauauacacauauauaauuacagacccugccagguaugguggcauaugccauuaaucucagcacagucuggacgcaggggcaggcagaucucuaaguuuagggcuaacuuggucuaaaaagugaauucaggacagccaaggcuauacagacaaacucugccucaaaaaccaaagcaaaacagcaaaauguauagacauuuuaauauucuuauugacaaaguuuuaucucacgauauuuuuaaagccauuaauacaagcuaucuuccuggcucagcauccuaaguagcugggucuauaagcuugcccaccaugagcagcuauguaaagugguuauuauuacuacuaucuuuaccauucuguuuaguaugugauguguguaugugugugugugugugugugugugugugugugugugugugugugcauacacuugcacaguacagugguucucaccuauguauggaucccaggggucaaagcgaggccacaaggcucugcgacaaucaacuucaucacugagccaucuuaccaacucuucaaauuuguuuuuuuuaauuaaaauaauuaggugacuaguuuuuuuuaaaucuggacuuuaaaaaacucuuacuuuuuauuaguuuguagugagccucaaagguagauguaagaagauuaagcacgugcgguaggcugccucggugguaaaggacuugccuggcacucaagggcucugauuuccuucauaguuacaacaacaaagacaaauugacaggcgugugccugugaucccagcagggccuugaguucacauuucaaaaaccaaacagacaaacaaacauaucccuccuucuagaaauccauucacaaugucagagggugaaauggaaggcuuaaguuuguucucugugucaacagaaauuugauugacaugguguugcgauagaucuguauaagaucuagaucauuccaacagaguuaauucauucccauuauuucuugggauucucccgauguugcaagccaucucgggcaaaggaacugacuuuggacuggguuaggaagggucucuccuguuuauauuucuguccuuggcuugcucugcucagugaaaaaguaauauguuugcauauguacacauguaagucaugcccaaacucacugcuucauggauggccgucuacuuugggaccuuuuugcuccuggauagguagaauaguguuucuguggcaguuuucuucguggcuuuugugucccgcuuguacaguguaaaccauaauaguucuuauauccuuggguugugcagagaaaccgaguguguauucugaaugccuugagagccccuggcuccuuggaaccauucuuggugaugguauauugucauccccagcaucagaauccuuguuccccuuacaccacacgcaugcuuauuuuccucuuccugcucuucagcccaucaccuggagagaauuugccaacauccaccccuuugugccgcuggaccaagcccagggauaccaacagcuuuuccaagggcuggagaaggaucugugugagaucacaggcuacgaccgagucucauuccagccaaacagguaagagacugcguugcguucccucugguuggcagcucuacaauacccacacccaagggcaaaauauucuuuuaguguagccuauuuuuaaaaaauaaaaugauuuaauuuuauuuuauauguuuuggugugaggguaucagaucccugggaacuggaguugugagcugccaugugggugcugggaauugaaucccgauccucuuauccacuaagccaucucuccugucccaucgguguagucauuuauuaccauuuaucauucucaguugacuggccauuuagauucugcuggagggguaugaccagacuuccaaaguggccucauuugcauagauauaaauuuggugaucauuuguggguugggagagaaauuaggaauguugaauagggcuuggguuucccaccguaugagccuccccgugcuuuuccuugggccuccuuagagauagcaugguaccuggauucaaagggaaauguuccaaaccaugcaaaauuacaaauguuucaaguccagcuucccauguuauaccggaaucucugaaaguaaaccguggugcuucaauuaagaugaauuauuuacagaagugagcauaauaacuauaaauuuugacauguaaaccuuccuuaauauuaagaaacucaucacugguuucucuguuucccugggauauuuagaucuuaaauacaaaacaucaaauaguuuaucccugcugggcauggugacauacaucuauaaucauaguauuuagcaggcagacguagauggaucucugugaauuugaugccagcauggccuuacaugguuaauuccaggcccgacaagacuauguagugggguuuuucccauuuuuguuuguuuguuuaauuuuuguuuuuuccacuuauuugcauaaaucaucaaccccaaagacauugauagucuggccaagaaaagagccuaauauuuaauugcccuugccuuucccauuaagcucaguguggcuugcuucaauuuguuuccaaaauucucucugcaguucuuaaacucacuccauagcacacaccaaauacaaucuagaagcuuuugguucagaauuaugauacaauguuuaaggcagccagaaacaagaaguguaucuuccaggaacacauaaaguaaaagacaaggugaaauuacugucaccguuuggcuucuaaaguugaggaaauugcugggcuggcuaguuuuaugucaacuugacucaggcacagacaucaacagaagaaaggccuccaggagauugggcugaaggcaagaauagggcauuuucuuaauuagugauuugauggggguuaggguagugaagucagacuugaguuaguaucaccucuggugguccuggguucuauacgaaaguaggcugagcaagccaugggugagagagcccguaagcagcagccccccauggucucccgauuccugccuuuuuugaggucuuauccugaauuaacagugauguagaauuguaaacccaacaaacucucuucuccccaguuuguuuucagucauguuuucaucacagucauaguaacccuaaccaagacaguugcuuuugacaaaugagaguucaagugggcaggggagauggcucagugagugauagugccuguugagcaggcuuugaggaagugguagcaaccugggcucuggagcaagaugggaggugagaccgaguccuuacaaucugcugcuguuucuuugucuuuguuuuuaaaucaagacaagaucuuacucuguagcuuaugcuggccucaaauucauagcaauucucccaacucaaucucccuggugcugagauuauaaggccugagccaccaaacuaccuucagcuguuuaguuguuagaguccauaauaugaucuuuccuuuagggacuauuuuuaacucucugauugguuaauuaauuaauaauuaauuaauugagacaauuagucacuauguaguacuggcuggccuagagacucaauauguagaccagguuggccucaaucucacaaagauuuauguaccucugccuuccaaguucugggguuaaagcugugggguaccgugccugccuuauugucauuuugggguuugacugagggucucaaguauucuaagugugcaguuuaccacagcaguuaccccucaacccuuuuguacaaagacaaaauccaaaguuggccaugguguugcacucccaggaucccagcaccgggagacagagguagggagaucaggaguuuagaaccagucucagucugggcaauauguccucagggggagagagagcuggggacagcugaaacuccugaugacagcuccacuccugacuucuguguugcuuugugugugugugcgugugcgcgugcgugcacgcacaugugcaaaauauguggaaauauuucucauaagaaauaauuggcuacagugaaaccuaucuccaaauauuccucauuuaccacacuucucuggugucugugaaauuagacauuauguucuucuuuaggcacaagggaagauuaaauacacaaaccuagauaaaacuaagccuaauuugaggcaggcacuuguuuuguuuugguuuuucgagacaggguuucucuguauagcccuggcuguccuggaacucacuuuguagaccaggcuggccucgaacucagaaaucugccugccucugccucccaagugcugggauuacaggcgugcgccaccacgcccagcugaggcaggcacuucuaaauucagucuuuucaccuaugauuccuggaaggaggguucccauaaacaaacaaacaaacagacacacacacauugagcuuugcccauaaauguuugcucuacaaaggaaacuuuggcuguuuaucuccccaucucggugugcaauguuguuuuuuauuuaguuuuuuuuuuuuuuucucaauucauauugucuagcuuugcuugugcacccagauggggaggcuggaguuggccauagaaaacuggggucacuucaacuacagccucuugccaacuuuuugguucuugaccaguuauucugguuccaucugauagcacugaauuucuuggggauucuuugaagaauaaguacuaguuuuagaugaaaucauccaguaguuuccccauauucugaggugaacagugaaaugcacagccaagcgcuccuuccucugagugauggugaggcaguucacuccacugcucacccagugggucugcggcccacugucccucggcaucuccuugcaggccaccaugcagcccugcacauguccccuccacagcaauacuuuucugccgguccccagcugguuuauacagauaagcauuuuuuucauaauccuuuuccaccaacagguggcaccaauaaccuuauuuaaugaucucuccaaaguaagcuuuacagggcauccaaacauuuuuaguguuuagaaaaagaacaguugauauuaagagaucuaaggcagaaacuaggcagcauuucccaccuuuccuguacuggucuccuguuggauugcuggcgcuucuguccaaaaagcaccuucuuaaacacacacacacacacacacacacacacacacacaaaacgacaacagcaacaacaauaaaaaccaauuuauuuguucauuugugugugagagaguguauguguguggauacaugugccaugugauuugugugagacaagucaugggagucacucuuuccuuccuucaugugagccccagggaucaaacucaagucgucaugauuggcagcaagcccugcuuuaaccccuggccccucccaccauucccagugucuuucaauguccauccauaccugccauaaggcaaggugaguggcugguaugagaacaaguuaggggcaaauauaaaauaucuacaccaucuucccaccuuaccucccuccaacuccuuucacacccucuugcucucucuuccaauucauggccuguuuuuucuuucauuguuacacacacacacacacacacacacacacacacacacacacgauccgaugaguccauugguguuacuugaguaagacuuuaaggcugccacuuuguuggauaacuaacaaggggguucaucccuagcgaaggcuacuuacccguucuuugccaagggguggagccucaugaaauuccccucuacccuguuagcauggcuauuggugucgcccuuguucaucucauguuuagauagccauaugguugaagugucacggauguggcuuccccguuauuuuucggagacacggucucacaggaguuuuguuucugccuaugucuucuucauuguucccaaauguuagguuaggaauuguauuguagaugucuucacuagggccaggcaccccgagaucauuuauucucugcauuuugacaaguuaugguugucuucaauggccuccaucugcacaaagaggaguuucuuuguuaagagaugaaggcuacgcguaucuggguuguaagaaugcaguuaggaauuuugcuuggguuuugguaacgugauuuauaauggguucuccaagauccuugaucuuacuauucgugugugguuggcuagguuuccaguaucuggcuugauuugcuucuguugggcaggcugaaguccaauuagacagcuguugauuauuguggugguuugaauaugcuuggcccagggaguggcacuauuaggaaguguggccuguuggaagaagucuaucacugggggcaggcuuugagacccuccuccuagcugcuugggagauagucauuuccugguuaccuuuagaucaagauguagaacucuuagcuccucgcagcacaucugccugcaugcugccaugcuuuuugccaugaugauaaugggcucaaccucuaaaccuguaagccaucccaaauuaaauguuguccuuuauaaaaguugccuggcucauggcgucucuucacagcaguggaaacccuaacuaagacaguuaucuucaggaauaggagugucacuacacauuuuuuaaagucccuuacuacaagggggaagaaaggcuugugugugaauugucaggggugaaggauagaauucaauucccagcaaaucuccuaagcauuucuuucccagccacuucauaaagcuacaguuccuuaggucccugguggggaaugcacagaaccccgagucuagcuuguugagauaaggcaggcacauagcaugaacauugcaguaacuuuuaauguacaguagaugcacgggcugaucuuggaucacaugaacacguaagguaaaauacaauaagguucuuaaaauugguguguguguguguguguguguguguguguguguguguguccguccgugugcgcgcccacccaaggaagucagaagaaggcaucagguucucaugacugguguuucaggcaguucugagaugcucagcacggguucugggaucuuaaccauccucugaaaagagcugaaaugcccuugacggcugaacucuucuagcaccugcaauaagaguuuugcuggaggaaggucacucauucaccagucaguguuuauuauauccucuuuuuuuuuuuuuuuuuuuuuaaauuuguggacaagaaccuugcuuuugggaauagccagccucuuuggggccuacuuagugaaaacaagucagucacauuaggagcugaagguacuagcucagcacaaggaccuguguggaaaacuccgggaugagaauuggcuugauaugguucagggauggccuggacagcuggagggugguagaugacagccauaggacggagcuagggucaccugacuaagucggcuuugggagggcucauagaguuggccuuguugguugggaugauucagucuugguguggauuuccucaccauucagaacaucugcaugguuuuuaauucccccauuuaauagaugacagagcagcaggggaccacguaaugagaggugauagugauuuucaacguacggcguucauuuccuuguucuugaaauaaauaaaaggcguuaagugugcuggcacuuuuggcuucagcuguaaaaugagagauaaaaaugagugaguguagcguggagaacaaggcucugugaaggaggcagagaggcagagagcccugauaccucucacuuccccuucccugcuucauggagaacaagaacucugacccauuugcaguugucucagcuuugcucacaggagcauuagucauuaagcacgcucucaaaguggugccugcaagauaauggcaggcuucuagcagccacacauucaaagggcaggaacaaugugugauaggaauggaaaguuuccauggcgauaguguggccuuugcaugacucaauauuugaugguaucggaaaaagcuuauuuuucuaggcgugaucauuaggcugcagucacauuuuuaagauuucuuuccucugaaaaagacucguugguuugagcugauaaaacaugagccuggugaugguuucacaauugcuuaguucagcauagagggguuuguugagugcuggguguguuuaggaaugagacuugccacaaacugauccuaauaucuucuuauaauuucuaauuucccccuuguaaaaacccagacaauggguuccuuauuauucccacaauuuuuuuuaaagccagucaaauucccccuaguaagaccagguugauucuaagguccugagcugauaagcauggcucaccuuuaguuggugccaaccuguuaaucuucuuucuauaaagaugccauaugauaggaaccuggaccauggcugccuaauguguaaucagugucugcuaaauccuaaaugaacacggggaaagcuuggagcccacaagccugacucuucucuucuugucuuugcagcggagcgcagggggaguacgccggacuggccaccaucagagcguacuuagaccagaaaggagagagacacagaacagugagugagcaugggcagguggugcucgaucccugggggagguugaaggcucggaucucggagucccuucuguucugugggaccuaccuuuccagccuugguggaaguagacagggagacauauaaucaagaaacccuuuucugccacgugaucaucaaagacaucccacguaaucacggugacagaaaacguucagaaauaaaaggcuuuugugcaaacccagcauauggaguagucagugggccaugaaagugcucucuagggagaaggaggcaggaaccuuauugcugccauugccacccuccucauuagcuccgcccuagcccugggccuaagauuaagcaauuuugagccuaagcauagucuaggccauauguaagauaccacugaauaacuacguucccccuaacacuaagcagauuguuccuagcacuaagcagccaugagguuggggagcagauguauuucugcugcaugcucugcuuugggcaugagagucggguuugcaaaaaagugacuccuggggaccacugggguccuuaucuacguagcuggugcuacugggcaccaccacugucccagaaagacguguugugaucuaugcaaagccucuccuuaaggccaaaggaggccucuguuccuggccccuucauuuuggaggccagcuccgugcuagguuuucugcugagcuguggagcuggaauucuuaggguagguaucaggagcaggacaaacaggcccugacuguuccaggagagcucuagaagguucuuaccuaagcgggucacgucagugcauggcagcccaagcucauguccuuucugagcuuauugaagcugauuuuuucccccuucugguuagucugaauuuuacaaugaagaauuuuaaaacuuucacaucuuccuuuaaaaguacaugagcaaggcauguccucucccucuguagccuauccaucugauuuuaaaagugugucuucccacugggaauagaauaauaauuccuccuccuccuucucacccuccuccucuuccuccucacccuccuccucuuccucuuccucuuccuccucugugguguuggagauggaacccaggccuuucccauacuuaugcaauacuguagaccugagcuacaccaucagguuuuguuuguuuaccauuuuacugcuauuauuacagacauguaguccaagcuggccucacacucucuguucagcuaggaacgccuugaacuccuuacccaacccccugccuccaccuccccagaugccgagauugucuuucugugcacacgcuccacuuguuuugauguucggauauguuuguacguuaguugagauagggucucaguacauaguucaggcuggacuugaacagugcaauuguuuugucucaauacccuaagugcugaguucacaaauguauucuaccauagcuaucauuugaacugacuuuuaaaaaaauauuuauuuauuuuauguaugugaguacacuguagcugcuuucagauacaccagaagagggcaucagaccccauuacagaugguugugagccaccauaugguugcugggaauugaacucaggaccuuugcaagagcagucagugcucuuuuuuuuucuuguuuuuuuuuuugggggggggggugcgagaggguuucucuguguagcccuggcuguccuggaacucacuuuguagaccaggcuggccucgaacucagaaauccgccugucucugccucccaagugcugggauuaaaggcgugcgccaucacuggugcagucagugcucuuaacugcugagccaucuccgcagcccugaauugauuuuuaaccauuuuugaaauaugcuauuuguaaaaucagaaauuacugagcccugggcaugcauagggagaguguagcagccagagagaccugaugauacaguagacagacaugccaauguggauuuauucacuugguuucuuguaaccuucaucucuuagcuuuaugaggaaaggcuaguuuagaucuaugcauguccuuagauucauagaaucagaaagggaacuauggagcuaagaugugcagaggggggacaccacauggcccacuccuuguuccuucauagguuuuaaauaccuguaagccuugaaguuccuuguccucgccuccccacgguugcucaguuaagaaccugaacaaggggcaggucuugcugugagaccauucacacugcacagccauugauggccagagaagccaucaaaccaguggaucucaaacccuccuaaagcugugaccccguaacacagcuccucauguuguggugaccccaaccauaaacucauuuaugguacuacuucauaacugaaauuuugcuacuguuauaaaucuuaauguaaauauugguggacauagaggguugcuaaagggcucacaauacacagguuaugaaccacggcacccaaaccucauuagucuguggcaggcccaggacucagcaaugauaaugagccagccagaacuuagguuuuuuccacucucugguccuuccuaauccucaguauuuaccuaucuccucauucugacaccagaaaauaguugcuuugauacagaaguuggggaccaagccagauacuccagaugagagaucuucugaauuaggugauuggcuauugggggcucuugcucccucucugaacauccuaguccucccacucuuccuccuccuccacuccccauccccggguaugaugucuucgcuggcaccacugugcacacugcuagcacauuggggugagaggccauuccauauggaagugcagaauucugcacuucuagacaguagaacaagaaggcagggaagcccuccuagcugcugagcucagaaacauggacagaauccggcagucuggaaacacugacugccuucuagacaaacagcuuuaauuuuagcccauuuuuagagaagagaaugacuuauucaaauaaccagggaagauuuccacauuagugaugucagcugcucccacaccauaggcucugauggagcucagucaaacacacccuucucauuuaaaaacgagucggagaaguuacagaaccgcccaggucccucaugguucucugccuuccagcagguuuuggauaugacuccacagucgcuuugggucagcuucagaggcuccugaaguagaaggcccaaguguaugauucaucaguuuaauuugaaaauaaaauugaauuauuuaacaaacauuuagcaauuaccauguuccaggcauaaagcacucuauaauuccguuuuuucacuuugcuggucaaaucucaacucgaauguucugacgagaggcugaguuuccuauggaaggacagaacacugggcucucacaucaacacaucuaugccuuuaaaaaaaaauuaaauuuugagaaccauuucucuuccugaaugucugaggcagucauagcuuuugcuggguuuuaaucucuggaaaauacguacguuuuaaucugugauaccaucaguaauucuuugaggaugaagucugugcuucuacacaggcuuccuggaagugaggauagagcaucccccuaaaggauauauaaaccauguaccaugguuggauucaccugagagaauccaguacaucaauucuggguccugauacuucuguguccagcagaacacugaugaaauugggugagaggaaauuaacuuuagggugaaagcagcuuaaaguuguccaaucuccccagacucuagagugucuacagcgcccgucucuacuguuccagggugcgauugauuucccauggcugcuuuaacaaauggcuguaaacucagugucuugugacagcacucagggacugucuuaaagcugaagggcagaaucagaaacugucuuccuggugcuggcagaugccuuucuuucucuguggagcuagggaggaccuguugccucuccucuucuccgaaggccaccuuccuccugggugccggucuucuuuguuuuuuguuuguuuuguuuuguuuuguuuuucgagauaggguuucucuguauagcccuggcuguccuggaauucacucuguagaccaggcuggccuugaacucagaaauccaccuaccucagccucccaagugcugggauuaaaggccugcgccaccacgcccggcuuaacaucccgaaaaauuuuugcucccucuguagcuagaggauggcaugguguuuauguguccaugugcaagugcaggugcccacagaguagacaggaagggaauaaacucaagcagucuuugagaguauaccuacucuuaacugccgaaccauccggccuuacccuccauucugugugaguguauucauguguguauguuugaguauaucuguguguguguguguguguaugugggcuuguguguguuugcauacacgugguuuuuuuuccucacuaauuuauucacuuuacaucccagucacacaccuucccccaucccccacuguuccuccucuccucccagucucacucuuauaaaucccuucccccauuacccacuccccuauucuucagagaaggggaagccccccuuggguaucacugugcccuggcacaucagguuacagcaggacuaagagcauccucucccagcaaggcccgaccaggcagccugucuaggggaagggaauccaaugacaggcagcagagucagagacagucccugcuccaauuguuaaggcacccaccugaagaucaggcugcacacagacuacaaauguguagggggccuaggucagccccucaggcccccauggaaauggguuaguugacucuguggugucucagacccccucuggcuugauuaauccugucccucuacacauccacgcuacuccuccaguucugccugauguuuggcugugggucucugcaucuguuuccaucugauacugaagccucucgggagacagucacgcuuuucuucagucauccucuguuuuggaggaaucaucuaaaagcugcauuuuuccucuggaagcccauuuguauaaccccuccccagaggagaugccauacugguucugugauuuuuuuuuuuuuuuuuucaggguaggagauuauuugaguucuaccaggaaacuucuguccuguccucucuugugcuguuucucucugagauccaaacugcaaguuuccuguagucacgauuccugaugugggggaaccagugggaacuugggcaaaauccuuuuggggggcugccgcucaagggugggcguuggccuuccuggccugcaugaggaccugugugccaugcuuuguaccuuuccccgcuccccgaccccauuggggaugcggcucaguggaagaggagucgccagacgugaccaaggaccuggcuucauucaucccagcacucaagucccaauccaaauccaacggucuuuugguuacaaugucgucuguggucuugagacacggucccuugauuuuuuucccagugaagccgugucccauuuugucagucaccuacugcacuguggauccugggcacaggguccacugaucacucucuuugcagaguguuugguccucacacuaaucauuuacagcugaguaaggacucagucaguguugacacaguuguguuggccuagggaggcccugggcgugucugucauugccaucgguccugguucagccaacagcagcccugaaguugugggguuggaguccuagagaucaacuugcaaccuuuuguuguuaagaaggugcuuuccauaugcuauguguaagaugagguuagaaagggcacggaccuggcuuucaugcgaaggcauucugaugucuuuggggauucaaacggaaauuccccuucaggacaugguuuuugcaguaaccacacuaaugaccacagaguucaaggcacugguuuuggugaaaacacguggcaccuaacgugugucauagacagucaugcuaggaggcuuugcucuaauuugaaauauccuggugauuauuuuuuucuuuuucuuucuccuuuucugccuccuucccuugugcaugcaaggucugucucauuccuaagucagcacauggaacgaauccagcaagcgcucacauggcgggcaugaagauccagccuguggagguggacagauacgggaacaucgauguggcucaccucaaggccaugguacucacccuccccaucagagauuggagcacucugggcugggaggggacagaugauggugaugucaugguuaggaaagggccuggggaggucugagguggggauggaggggugugaaaucggacagugucaacuuugucuacucuuguguguaaugaaagacauugaucccuucucuaaaugggucuguagggaaagaauacaaagcuaaaaaccuaaccaucauuaagggaaagagaaaaauaaaaagcaaucguauuuuugguccccaauuaaaaccccguggaggaugucucccaccccccucccugccucacagagugaagggucuuuucacggacccccucagcccugauucuuccacuuggaauauaacgaaugaaauauuuauugugauaccgugguaugaaggcagggccugcuucccugucagcccucagauuucuccauucacguucagacagucacaguugcacugggaauuaaagcacacaugcggauuuuguaagccucccaacagggcugcacuggauuccaggcaacuguuccuguuccuuccaacaccaacccccacucccaaucucucaaccuccaggaagagguugcuuagcaaccauaucuguuuuccaccaguggacuggaggcugcaucuuaaguagaagggaaauuggugaaauaguggugugauucugucaggguuauuaggcauggguaccgagaaccuacgcaaaagcccccgaaaggaugcugaaaacgcacagccccguucaucuuuuccacccuccacuuccucuccauugccuuuuuccccccuggaaauauucugggucccuuguaguuaucaaacuuguccaauauagaauauauggaauaugaguugauuuuccucccuuauuaccgcugcucucauuuacuugccaagaaaaaccaaguagaauuacccuacuauguacaguugcuuucuuggggguggggggguggggagugaaguaggcacagugacacacacuuguaacaccagcaauucaaaggagaggcaggaguucaaagccauacuuggcuacaaagcuaggagucagucugaguacagccuggugguggugguggugcacgccuguaauucccagcacuugcgaggcagaggcagauggagcucugauuuccaggaucgucuggucuacagaaugaguuccaggacagccagagcuacccaaugaaucgcugucucaaggaaccaagaaaaaaaaaaaaucccaaaccaaacuaaccagccaaacaaacaaaacaaaccuguuuccaaaacaacggaagugggggagauuuuuaugaaaaccacaacacuuaccacgcuucugugggaaggaagguaggacuguguacagcaaaacaaacaaacaaacaaacaaacaaacagaaaugagcagaaaggcuagcuagaagauuagucaugaacagagagacaccuccccaccaccauccaaacagccugagaucauuuuuugaggugguuugaaccaaagcagaaccauuuuacagaacuggacucaagcuauucaaaagucuucugagcagccucuugguucuggcuuaauuuguugagaugcagucucauguaaccagugguuacaguguacccaggauagcucuguuuacucagugcuucguuauuggcgcuuacugcucuuaauuggcacagggagcaagccuggggcucucucugugcaugcuaggcaaagcccucugucaccugagccauauccaaagucugaugucuuuauccuaaaagggcuuugcugcugcuuuggggugauuuaugaaggaccauuugguugugcagcaaccacaguuguagacugagauauugucaagaauucaaacaucaagauuuuaccuucccucauccuauaaaauaaaaagcgaaaauaaaaagagaagucuuggcugagaaaggaucagauagaucacuuccucuccccauuucccgcucuccacagguggaccaacacaaggagaaccuggccgccaucaugaucacguauccaucuaccaaugguguauuugaagagaauaucggcgaugugugcgcccugauucaccaacacggaggacaggucuaccucgacggggcgaacaugaaugcccaggugcagauacuuagugcccguuggaaaaggaauauagaguuuucuuuuuaauuuuuuaaagguuaauuuuauugugaaaccaagcagcuuauauugucaggagugccauuccuccggggacaugaccuggcaaguucucaguucccuagaugauggaguuuuagaaccaaguucugggcagccauugguagaugcucaguucccauggcccacuuuaccugggguuuuuaacaucaucaggaccuccagggauucaguccugccuuccucgguugcaggagugacugccagugaacaacugccuccuuaacuuuuuccuuccuucguuugaaucguuugauuccguucauaagugcaguccaggggucgugcucugcuucagcagcaaacgugucuuuccaccuucaucggcggcuggauucccaguugaauagcgcagcuagguaucuguauugucucaggaaaauuggcagccucacucccuccuccucagcccagcauccucuaggacccagagucuaggugcacauaauaaauacccagccuugaacuggccagggaagguggugcugauccuguaaaagcugccuguuccauagagugaacacauugcagcucaggguuaguagugcugccucuccuuucuccuaagguagauauuuaguuaaggacugccccagcgcguguuuuuaaaucugaauagggcuaaagguucaguuuccauuuccaaagaaaccacagucacuuugacuguggaaugccagguugucuacagaaucuuuuaggaacaccuuuuacgguaaauauuuaaguuugugugugugugugugugugugugugugugugugugugugugugugugcauguggaggucaaaggagaacuugcuggagugggucuucgggaucaaacucagguaguaaaacuuagugucaaacgccuuuacucacugaaccagcucaccggccccuaggaagcuuuucugugggcuuuauggguguggcucugcugcuccuuuccuggggagacaaacagcccagaacagcauguccuuccugcgugcuaggaaguugacuuucgcucuuucccuuuggauaggugggaaucugccgcccuggggacuuugggucagacgucucucaccuaaaucuucacaagaccuucugcauuccccacggagggggcgguccuggcauggggcccaucggagugugaguuguggggugcuggcuucgggauuguuuagaaagcagcaugcauggcccaaaacuucuuauucuuccuauccgagucuucaaguccgaggaauuaaccuucaugucuagugcacuuccagcagcuggaugcacagcuggaguguuuuagauuagguccaaagaaaaaacgguauucacuuaguaaccaugguauccacucagccucucugggcuccgagagcaugcuuguuaaacaaugagcaggaagccguucuaaaguauaaggggucagagcuagaauguuaguaccugugucauggauuugaccgcacauuuccaagaguuauuuauuuauuuauuuauuuauuuauuacacuuuuccuuaaaaaaaaaauagcuuauaauugcugggugugguggcacuugccuuuauuccccgcagucgggaggcagcggcaggcagaucguugugauuucaagagcagccuauucuacagaucaaguccaggacagccagagcuguuacacggagaaacucugucaacacaacaaaaccaaaaaaaaaaaaaaaaaaaaaaagcuuaugacaauauugagagugauuuaguuggaaggcagacagcgaacuccauuuagguuuaauuuucaucaugucuuugaugaauaagguggaaacaaauuuuauuaccagagguaacugguugacgucaacauggaugacggaauauauuuuagcuguugaucguuuccucgcuauaguaacagcauuauccagagcuccuggaguuuucaaaaugugugguggugaucggggcagggauguguuuagcguugcugggagcccggcugucuuuuccuuuugaucuauauuacguauagcuaaugagugucccgggugguucagagggugcauaguagggcaguguucguggguuaggcuccaaguggagggcaggggcaucagaucagcagccugccguagccaacagauagcuugaaggaugcagguugcuaugaggaggcuguguggggcugccgcugccaaguuguccaccacaguccuuggaagcuacuagaggggagggaggagagggaggaagggagggagagagggagggagggagggagagagggagggagggagagagggagggagggagggagggagggagagagaaaugaauugagagaauccaccugaguugcuuucugguaauuuguccccuacaagugucaugucccuaccaccaugaguguucagagcuccuagagacgguggccacuugguucaguugcgucuuuuccgcaucauuucaaugugcgcuuuaaaccaacacaggaagaagcaccucagccccuuucugcccagccaccccgucauuuccauaaagccaacugaaggcaccuggcccgugggcacugucagugcagccccgugggguuccagcuccauccugcccauuucaugggcuuacauuaaggugagcuuaagaacacgcgugacuguggggcggugggacucacuuucucagaggggccaaaaaugaaaucugugaccugagaagggacccaggggacagugcugaugacugggguagagggaaaccuucuagaaagagccacccagaacuguuucaucuguuucuuugggcucucaugauggcuuuacauuuuuuccagacaugauuaaguuccaugagucaugcggcuguucuggcugcgucauuugguuuccuguuggguacacacagcuccaugcaagugaaaagcacugugcguggucaucgugacgcuuugcugcgauccugggguacaggauagugugcauuucuuggcagcacggaggaugagauaugauguaucgagaauuugggggugguucuagaacccugagcagucucaggacuuggggaacugugauuuuagggguaauugagcuugaccgagagagucggcuuaccccccuuguccuucuccacggaaauauucaagccggaauugauuuuaugcaguucuuguucagacuggccugcccacguccuaggguccaaucugugaauaggcacucuugcuagguuguuaauuagagcagccuuuucauaccaguggcucuuguuaaagaaaggguagccucgagugagacaaaaucgcaaacucaacuauacaaauugugcuggguaauuguggggcuugcucuguuugaaugcgaugacauuuaugacucuucuuuagaagauuguuauuuucuauuuugagacccagucuccuuauauaguccagucuggauacaagccuaugauucucuuguaucagcccccuaagugugggacugacuauaggcauggauggucaugagacugcccgguauuuaugacuucuuuuuacguaauaguuugagacuuuguuuauuguauguuuauggauguuuuguccguuuauaugucuguguacugugucuauacagugccuuuuggguauauuagauugccugggauuggaauggcacauuuagguauuagccacuguauggguccugaaaacaggaagagcagccaguuuuuuuaagcacuaagucauuucuccagucccuauaauucuuacuuuauuuuuguuccccccccuuuuugguuuauuuuuguuuuuguuuuuguuuuugagacaggcgucuuugcgcuccuaacccagcugcgucugucucccgaguccuggccuucccagcaugcaucucauucaagcaugcccagcuucauuuaugauuuuuaaugaaaaguuuauuggaagcaaaggcaacaguucugugcccuggagccuugaagcugccuuugaaauguugugcaagucguuugcaaauuagaggaacacgcccgaagagaaugaaaauugucuucuuugcaaacaaccaaacccccaguucccuuugauccauggauccuguaaaauugggcuauuuguacgaacaaauuuggucuggagaugguuucuuacauauagaaaguaaagucccuaaggcuguuuuggucauaagcccagaauaccaaaccgagcaugaguguuaaagcuaaguaaguaguguuuguuugagccuuaucuuauuucaggcuauuacuucucccauagacacacuggguggagcuucuucauuauccucugcacccauuguggauacucucuccccgaugccccugaaccccuccugauguccuucuacugucacugccuggucucaccagcaugcgcuuuggccccaucccacugagaauaaaacccaacugauguguccuugugcuuggagccaccaucauguaggaagggaagugggaaguuggcugggccauguccaugucaaagcaaagacuuaggacuugagauccuaauccacgcugcugcggugacucccagaugacagucaugugccuuucccacuguaagcuguugucaguccucucacucggcacuccccaacacccuauucccagacccaaccuccccucauuugcuuguuuucaagguucugguagaguuuaccauucacuuucagauggcucacuagggucacauugcucucucuucacuuugaacuuugaaccgcuguuuuguucaguugugugcuuggaugugaggucccucagucaugaacacugguguaaucuugauuuuuaaacccuuugcccuucauguccuucacccuguaugauggcaaggacucaccaccaaaauaagaaaagauugaggcuggcaguugcuauacacaaacaugaacaacauuuacauuccucauugugggcaauggaaaggcuaaccacacaaaauugaucugguggacuuuggccaagaucucaucagauuccucaaaauucucauuacaucuuaaauucacauaaaugaaaaauacacauuacaacauuucuaagaacaguucuuuuuuucuucucuuugaagagcaguagcaggcagucagcugugcccuacuuucaggcuuuguugcuaugaccccgcccccaaaaagaaaaauaaguaaaauuagcauugaaagaaaaaaaaauuuucagccgggcgugguggcgcacggcuuuaaucccagcauucaagaggcagcggcaggcggauuucugaguuugaggccagccuggucuacagagugaguuccaggacagcaagggcuagacagagaaacccugucucaaaaaaaccaaccaaccaaccaaacaaacaaaagcaaaaaacaaaaaaagaaaaaaaauucaaguguggaggagacuaacagauuuccuuucuggaauuuuccauucguuuuuaaucugcagccaugcugaaauggugagcucaccauugaacaaacugaucugggggaucuguuagugucuugacuuuuaccucauccacucaauggcugcuggcuccuuuucucuuugcugcagaugauggguggaaagggccucaaagaagccacagaaaucgccauucuaaaugccaacuacauggccaaacgacuagagaaacacuacagaguccucuuuagaggugcaagaggcaaguaucucucucucucucucucucucucucucucucgugugugugugugugugugugguuccuauguaacuaugcuagauauagaugugauuuugaaaggugagagggaugcuuuaauuucuuagaauauacaaaaguguagaauuuuugaaaauacagccaacuuacucacuacuauguacaaaacuauccuccccuagucuacacagccuaguucagcaaggggccuacaccacccagagagauguucacauaaacaucaugagccaaucaugcacagggugucguagagaugccugaaaccguggagccacuuagagcaggcagagucaggguggaguaguuugacaaaggaggcaguuaugacgaugcaaguaucaugcaguuauaugagcgaacauacacgggagccagccagguaaggaggaguuacccgaagggggugcuugaggugggguaggaagagagagggccagagagagagguuaaaaagacagcuugguaccuggaaggucuuggaagaaucuagacuuaacuccugagccaguuauagccauuaaagguuuccuagcuugaggaaugacaugaucagauucauuaaaaggccgugagauggacagguucuuggaaguauaauuagcuggacauaguugcuccuuagugcagugcuagguaaacauuuagucuuacauuggaggugcuaaaggguaggagaaaaaaguaaacccagaagugauaggaugugaugagaguaagaaagagggaggggcuagaaagauggcuuagcaguuaguuauuguuguuacagaggaccugagccagguucccagcacccauuaggcagcuuccaggugagccaauguccuccucuucuguccucugagggcaccugcauauagaggugggagcaugcgcgcacgcgcgcgcgcgcacacacacacacacacacacacacacacacacacacacacacacacagaggaacuagguagauaccuggugcuccagucacggaaggagaaacaaggccuagaacauugaggagugagagcgaagccccucagcagauaauggcacuaagaaggguggccagcggcuccugcucuugguuccuccgcccaggcaggccccgcgucuacauuacuuaucgucucuaacuuaaaggcugcucugaucuuauaaaaagggguacagaggaauacuuugugaguuuguaaauaaaaggaaguaaauaaccaggagcccugggaggguggucuccagagagcagagaagguucugagggaaacgucuccaagcaacaagcagcgcagcagagugcuucugcaguugcuaaugaguucagacagcgcucccgugcugugaaauccagccugguguguauuugcuuuaaggaggggauugaauauuuaugcugucugguuauauaaaugaugcauauuguucaauucagaagucuggaggaaaaaaaaaaaagccaugagagggaaaaucuaagugauacuugcaucgucagccagauaaagcuaacacugaauguuucacuguauucccgcucuuauuucucuuggacaauaagcuaacaucacagaugcaguuuggaggauuuauuuauuuauuuaucuauuuauuuuugcaucugugugggagaguaugcucauccuucuuagugcauguggaagccagagguugacauagaaacaccuucuuuaauagcucuuuaaugguucuuucauuauuuuuuuaagacaaggucucucaaggaaccugaagcucaccauuucagcuaugagcuaggcuggcugaccagcaagccucuguccuccuacuuacacaugcaguguaccagagcacagcacagcacagcacagcacagcacagcccaaugucuuuuuaugugguugcuucauugcucucucuuucucaaucucucucucuauuuucuuucuauuuuucucucucucucucucucacacacacagacacacacacacacacacacaaacccaccacuacuaccaccaccaaugucuuuaugugguugcucagucucugucccugccucucccccgacucucucuuucucacacacacaugugcugucaucuuuuaugucuuauguggcugugcaguauuacauuuuccccacagcuccacaaugccuaccuauccuauuuccgugaguuuuucccuaugugacugaauaguguggaugcccugugagucuauaguuaaauuuucagcuauuugcauuguauuguugcuaauaagaacaaccccuccaauaguguguuucuguuuuuguuuuuugagaaaaacuauuucuuuagauaacuuauaaaaagggauauggaggcuuugagcuuuuuauacauguuucuuuaauuuucucaagacaccgugucaguuauuuuaugcuacuaguauugagagugcccaucacaccaagaguauagugagaagaauagacgaaaaaaaaaacaacaaagguuuaaaaaaaauuaucaauuucaugacuggaagagacuuuguuuuaauuucuaauacuuaagguuuucuuucauuucuuuaguuaauuauugguggcaguacuuguuuuugaaccuagggcuucacuccugcuaggcauauauccuaaggaugagcugucccagcccuaaaugucuuacauuacguuuuauuuuaggcagcauugcuaagauggaauuagcauaccuccucauauaauuugcucguuuaagcugcacaauucagcaauuuuuaauguguucacugauugcaaaguuuagguuuugaaagcaggaauuaaugugacuuaaauugaauggggcugguuggcacccacgagagaaggucagaugucaccacgcacuuagcauuuauguaguggcuuggggcagggagcccuacuccaucccuugggacuucagaguacagaaagauggauggaauuuccauuuguuuuugacauuuuacccccaaauuaaauugcaaguagcaguucucaucccgaacugaaauggauugcugcuugcagacuugauuacucaauccucaagucagucaaaccaaacauugacucauguuggucugcuaaacacauauguugcacaauuucagaucuccuauucuggggcccggaaccccagcacuguugugcuuuggggacucaaacuaggaauguuuucaauaaucacggugaauccuaacguguccuauggcacuauuagaagaccagugcucgucuuaaucauauuuaccagcaguaaaucagauguuggaauuguagaugccugugaggcaaucguuuuaaugagcuccaggcuugccagcgugagcugagaucugaauauuaacuaaacuguccaggcuggugggcuuuuaaagcaaacaaggguaaaagagauagguggagaagccggagaaauauuuuauucugcuacaaugaagagaaaaggaauuacuuuacguaaaacgacuguuuuguuggugguauuggucagucagucucuuuuguuagaugcuuucgugggauuuuguuuuuguuuugcuuuguuuuguuuugcuuuguuuuguuuuguuuuguuuugcuuugcuuuguuuuaugauagagcaucucacuguguagcucaagcagacuggaauuugugauugaccugucuuaacauugcacagugcugggauuacagacauggccucuugccacacccagaaaagaugguagauuuguaagagaagggauuuuuuuuuuaaccuuucagggcccuuaucuuuuggguuagguucaccacgugcuccaaagggcuuuccuguguuuggucuuuggcagcauaauuugacuaauguuucuaucugccucucaucuuggacaagcccaauguugcauuggauuccagucccugaagaacuuuucagguggcucuuccuuugacagugggcaguggccgcacagucuggcuggcacgugcugugccaggaaaaugcugggagugaccacacaaccagaagaccuuuugauugcccgcccaggcuuaauucacacgagcugcuuaccucuaaccuucugaggcagucacugugagaauguugcagcaguggcuccaaucuguguucuccgggggaggcguagagaauccuagcuucuauaccacaaccccaugaccccaggcaucucuuaauaaggaaagcauugaauuggagcuugcuuacaguuuuggagguuuaguccauuauugucauggugggaaauauagcagugugcaggcagacauagugcuggagaaggagcugagcguucuacauccuaaucugcaggcaccaggaagagagagacauugggccuggcuugaacaauugaaaccucaaagcccacccccagugacacacuuccuccaacaagaccacaccaacuccaucaaggauacaaguccuaauaaugccacucccuaagagccuagugggaccauuuccuuucaaaugaagacaaucacacaugggccaggccacuucacuuuguaauucuauugcuccaccuccucaccuuuuuaauauaauauuuuuguuaacucuuaagaauuucagucaugcaaauacaauguguuuggaucuuauucacucccaacuuuucuccucccacaaaucuacccugaucuucuuaccuccucccaacuuuggggccuuuuuuauccuaccccucuuuacuggaugaguccaguuuauccagguuuuugauacagugccauaggacguuauguggucccccaccagggccacguccuuagaacggacucucucuccccagaagcuguggacugucaauagccaggaguguugggucccuuugaccuucuuucugcaggucugugcaggcauccauagcugcugggagcucauuguggcacuguuguguuuagaagacacuguugguccacaguccuccaaugcacacacucauccaaagagcacccccuccuguucuuuccgacuccucugacuuggugguguucacacucuuagcugcagucuuggguagggcuagaggaaacagcugcuguuuuagauugccccaaucuuaucauauacgcagcagguuuauacaucucucuccuaaaagcuguaaagagagaaaaacaucuugggcccuggccucuccuagacaccaaauuuaaauauuaucccuuagagagagggguacucuuuggaugagcgugugcauuugaaaauaacaucugaaccucauuuuuuuuuuuuuuuggaauggaccucuucccaaaccacucaucugugguggugccuaugcaauggaaucuuggguuuagcaguugguucaguugccacuaaaccccugcuugcaagacucuccucuaggccugccaacaaaugacuucucuccuggugacguacauuuccggccucaggcuagccagaugcccugcaggacaguaaauaucacuagccaucuuccugcugggguuguagugcccaggguagcuggaaacucagaggaggaagggcagaggcugacgauagacucuaagaauccuaaaaguagaaguugauaaggucucaaggauuuuugugauuuuuuuuuuccuccucuaaccuuauaaugguuauuccauuggacacauguuuuucugagaucacucaccuagacauagaccuuucuagagucucauuuguaaccaguuucucucucaucauuguuagagagcauaugcuaaaacuaggcaguguuaacguauuuagucucgcacucucaugcgugcuuucagacuaaaggaccauuaaagguuuauucauuauaaaauuacuuucuucagguuuagcagaguggcucaggcugccuucaggggcuguuagggacugcgguuaguuuugaaggcuagagguuugucaguggauucaccguuggcugagaguugguaaaacggguuauuugguuuggugugcaugcuucugugcugcauauguguucugugugcaugugaguguguggguaggcaugugcaugugaguguguggguaggcaugugcaugugaguguguggguaggcaugugcaugugaguguguggguaggcaugcacacacacagagaguccagagcaggugcucgguccuuccuuuguugcucucugcauuauugccuugagacaguguuuuucauugccagaaaaacuuacuguuugagcuaggcuggcugaccugugagugcuugagugcuacauauaccauccucuucacacacacacacacacacacacacacacacucucugcuggagaauacaggcacacauugcugugcccagauuucacaugggcgcuggggauuugaacccagaucuucauaaaauaaauauucuuaccuacuuacuggcccauuuuccuagguugguaaaaccaacuaaggaaauauauuaaaauauaucaacaggugggcagagaauuugggaaguucccaggaauauugauugcuuauuaaagcugacuugcuuucacugguuuaaagauuuuauuuauauuauuuucaauuaugaauauaugugcauguccgggcaugggguuugcacgugaaugugucacccucgaagguaagaggagggugacagauccucuggagcuggaguuacaggugacugugagaugccgggcauucgugcugcgcaccaagugcgcaggaccucuggaagaacaggaguuaacugcuuagccaccucuccaucccaccaccagcuuauucuugauggcuggguguuuagcagcuccugauggaccuaggaaggcggucuguugaugaacuagaucgccgugaacugacccccauacauuccagccucacugauucuaaggcuaucugacacugcucccucuuucuuuucuuccuuucuauucuuucuuuuguggauuuuguuuugagacagagucuugaucuacagccucaagugugugauucuccugccucugccuaauucuaggaucauaagaggacaccacuucaucuggcgggcagcgcuuauuacuaauccuccgucugcagccugacauuaaaagcccuugccauccuuugaagcaucacauuaaacuccccaugugaauauauauuuguugacauguacuuacaucuugauugcccaagaugagguuguuuaaccuugaaagugaaagugcugagcucaccaaccagcgaauguuuagcucuagaaauaauuuacauauauauauauauauauauauauauauauauauauauauauauauauauauauauauauauaucaggauuguauuucacuguuucuaguugauuuuuggucuucagaauagaaauuucagagaucuccugauuguucuaguaacaccauccccuccucacaccccucccuucauccacugccaggcuguaagaugcacagguguaggaugagauggugugugauggagugaaugaagucuuuauugccaacucuaacuguaucaaguucgcuucgcccccuugguccccacggaccuauguaaagagccggauuguuuagcuguucaccagagggaaacaagacaauccucaucuucaccugacacuguccuugaacaggguauguggcucaugaguuuaucuuggacacccgacccuucaaaaagucugccaauguugaggcuguggauguugccaagaggcuccaggauuaugguaagucgcguuugacagucacacaguuguuccuguaagcuauggaccauuuccuagaaccgcaugcaguucuggacaauauauccaagaacugcauguccuggucccaaguggccauuacucagccccaggccaggacgugagccagaagggaaggagggauguugcugucagcucacaggggcgccaagaagaugcagugaggaacugguuguuaguucacugauaaccaguuuuccuggcauucuccaucuauugccaauaggucauccauucauggggagucauaugcgggccuccuauucagaugugucaguaagacuguuuacaaaugucuaauguacauuucuucuuaaaguaagucauuaaggagccgaggagguggcucagugagagcacucucugcccuuggguuccauucccagcauguggcacccagguuacaaccaaccacaucugggugccccccuuccugacuuaggaucaagauccaggaaucuguuucuagaacaguacacggaugguuccagguguggauggucccagaugugggggccacuagagcagacugaauagaauuggcucacacaaggcuucgaggacaaacuuuaauggguaaucagaucagugugugcuuuaaagaccaaaacaacuccuugcuggcugggcgacacagaugcaggcauuuaucaaagccuauuaaaugcuuuagccaaaaucuguguauuucacucuaagguuuaugacaaaauacaagacuauugaauucuuauugcuugauggacauucuaaacuacuuacaaaauaaaaguguucugauaguuacagcaggucagugguggcgcacaccuuuaaucuaagcacucgggaggcagaggcaggcggauaucugaguuccaggccaaccuggucuacaaagugaguuccagaauaaucagggcuauacagagaaacccugucucgaaaaaccaaaaaaaaaaaaaaaaguugagacuggcaauauugcucaaugguaagugcagccaagcuuggcggcuggaguucuagcuguaggacccacaugguggaaugagagcaaaccccccaaaggcucccaguauacaaacacccacacauacacauaugcuaaacacacgaaaacaaauuaaaaaauaacaugaauggcgccauugaaaaaucuauaggggauauguggguaucuugcuauagugauuucugauuggccauggacuugaaaauuucuauuaauuucuauuaauguuggcaaacuaguccguuaaggcauggagguggggcagcaacagggaaugaugaaguuuuccagaccuugggaaccgcuggucuccgcagcaacguuagccggaagggucgugagucugcgagacugagcuuagucuuaaaauggucucagagauggaauggccagcguccaguggaaaucuacaggagcaugaauaagggucugggugaaccucuaggacuacaccccaaaaauggcucccaaaguugucugagaaaugaggggaagugguguuugccuuugucuagaacaaucccuuuccgucauguuuuuguuucuuaauucaucuuacaaacaaaagcuuacucuaggcguguuuauacugcguucaggaaagugcaaagguuucagcacccagaccuaggucccucacacggcaaacgaggacagugagauuugcuuguuuucucuuugacuucugauuggccguuucucgccguuacagcauaccaucauaaacagucugguuugucuuuucauuuuugguggugguuggcgucauuguuuuugguugucauugcuuucuuuugaggcaccguggcucgacucuaaggccucggggauacuaagcaugcggucugaagcuaagugucaacuucagucuagaaagauucuaaaauucaacgugaaauggaaaugccacucucauuuuuguccugcuacuacauagacguaccuuagaaugcuuguaaaagccaugcuacauaaaguauaaauuuguguacuuagaacuuacacacauuccucuggucucccucuguaggauuucacgccccuaccauguccuggccuguggcagggacucucaugauugagcccaccgagucagaagacaaggcagagcucgacagauucugugaugcuaugaucagcaucaggcaagaaaucgcugacauagaggagggccgcaucgacccgagggucaacccccugaagguacacagcaucccgcacugguaucuggcgagugugcugacccuccccgaguucucuguggugauuagauucuugccuagaaugagccaauuauaagaaacacagagguuucaaucucgaauggcuguggugauuacuugggggaaccuugguuguaggagcuguagacgccaccuguacccaacugauugugaaggagggaguggcgggagguggcucccuaauuggagaguucuuaucauuccguuugcgucauagcauuugugugcuucgcucaugagcuuucucuauaaccccaguucuuguguuggccuagcaaccugagaccaacuuaauugguacgugauucagccuggaaguuuagaccgcuaagcuuaugucccguguggggaaaaauucaacaugucuccaaucuuccaaaaacacauuacuuuuagaaucucacuuuucugguucaguguagacauuaaccaggagauggcuugagaagaaugcucuguggacagcagucgcaucuccauggcuauaagccagagaaugagauguuguaguagcagcagguucagaacugccugccuggaggggcauuguggagaugcuaaaaggcuagggccuugcuuggaauacuguagcaaagggagacucuuccucaugguaugagcuauguugucaggugugacaacuucuguuccgugucacugugugcauaauguaaacacaggggagaugguagucaccagauucaggguuaaaugcuggggugaggugugggagaaagcagcacacugcuuugaccggacccucugccaccauuucucuguccagaugucuccacacuccuugaccugugucacauccuccugcugggaucggccguauucuagagagguagcagcauuuccacuggugaguucucugaaugaacuuugccaaccuuggugucauuauaagcuguccuaccccacacccuuccuguugccccugagguuccccauccacagucucauuauauaaaguguaucuaggauagcccgugaaguguagaugaugaugagagggaccaaggagucagacagcccucaagggucaucugagcucauucagagcauccgauagacccaggccuaggaacgcagaggaucagggauuaacacugcacagcaguucuggucagauggcucaauguguuuccaccaucgggagguggauugaaugugaucugacuuuucuuuuaaagauuuauuuauucaugugugggaggcuaaguguguaugacuuuauaugaaccccggaugcagaagcaagccccuggcagugaguguaucagcuucauuggcacuuuaauuucgggugguuugugagcugcugugugggcgccgugaacugaaccuagggccucugcaagaguaguaugugcucuaaccacugagccaucucucuagccuuuagcauuuccuucugaucccaaaggcauaaagucaagacuccaaaguugaaauugugaaaaaugguggguuuuggcauguguugggccaccggugccuugggcugugggaacauccaaaacccacugucucgauuuacccccaaaggacucggaacauccccaaauguccuccuuuucccuuucagcccuuugugaaaccagagaacaaauucuggccaaccauugcccggaucgaugacaucuacggagaucagcacuuggucugcaccugcccgcccauggaggucuaugagucuccauuuucugaacagaagagggcuucuucuuaguccucccuccuacguucaaagggcugacccgaugucucuugcuggagcauuugacaagcaaggauauuucuucuccuuuacguggcucacacaugaguuuuauacgcuguauauuuuuauaaucuuucaagguaauguaagcacaauuagcauggugaguggcggccaccugcuguacggcaaggcaguggcuguucguguugccuugauugggagccauuuaguuugccggauagaaaauguggggugcgcuagcaauuuuaacauuuuaauucaagaaguuugcagcagucagagccuaugcugggaauucaauagacauucuuuuuguuccaaauaaguccucguggacugugcccucugugggaaaccccagggcaaauguuuacauuuuauacacugaagaauucuccucacuaaugugccugaucugucacagcauaaguguccuccuuucacugugcggacuuuuuuuuuuaucugcuuuuauuaguguccuaauaaaacugaguuugaguaaugcgaauuucccauuugauuuuacacccaugauacacacucaggacgcugaaggguagcgggaucucucggcccaacagccacguuuucacggacagucacccuugcuuuugacuggcuaaggacaaucuguacagccuacuuauuagagaaggccacucuggcgcuuuuuaucuugggccauagguaacuuaaccucaacuuacggaagauuaaguagcaguuucuuugaagcccagaga

SEQ ID NO: 9241 - RNA, 3792 nt, Mus musculus
auuuuuuuuuuuaauaaagccauucucauuccaaucaauggaguacaggugaagcaaaaaaugaaauaauuucuuggcaagagaaguguuacauucuagaauuuaugauuguuuaguaauuauuuuuuaaaucaaagugauugaaacaauucuucagcaugucagaggaucuaaaauauucagaauuaauuauuuggcuuaaguuggcaggcuuccuucugcauaaucucuucugaauucugcccaucaucuggaaucacuugcuugggcauucccucccuuccaauaacuguuggucacuuaggugaauauuaauugguuguuaacuacuuuugguugauguuuuuuuugaaacugaacauuguucuauagaaagaguuggccagaauggaccugaguucaugggcaucccucugccucagccuccaaaauccugggauuauaggcaaaagcaccaaccacacuuguuagaaguuuugaagguaguuauaccaaauucaagcccauauuaccaaagccauuugaguuuuaucaauguagauacauucucuuuaaacuaacucacacacagacaauauaucuuaucauuuuaacccccccucucucucacacacacacagagccccaaauguaucuauacuucuaacuuaaugauuauuaaauguuaaauuuuauuucaaggacuaccagcugagagagacagaacuagagaggagagaugugugugugugugugugugugugugugugugugugugagagagagagagagagagagagagagagagagggagagagagagagagagaaucuaagcagagagcacaucucaggaaauaaacugauacuuucauguuaaauuuuagaugccuaucaccgacuauuccauuucuccuuacauucgacccccuagacauugaagcagaaaggguuacacauuuaagaacuguaaaccaaaauuacuucaauauagaauauuuaugagucaagacaaucaaccguguacaaaaaaaauuuacaugcaagagaaacaaggcaauguagcacaccucuagaaaaauaauuaaaaguuuugcugcauuuacagguaagugccacacugaggauuuacaacacaguaauuuacugcaaucacaggggaguuccaucaagaaacaaaguccuuacacuccagagcuuuuggaagguauugucggaaugcuuaauuacacacugaagauuccuacauccuugggauugagcugacaaaucauaaaggauuuucguagcauauauuagauaaaaagaguccaucauauuuagacugucgguuuagugucucuggcagguguggagccuagaagaauugcuggcuugauggugaucuuucuguauccugcaagccaggccuuccccgcaguaacagcgcuggaauaucuccagcccgugggagccuuuccguuugugcuuggugcacaccugaccuucuuuaaggacagguuuacagaucuuggaccagaagugucuugcacaacacagcccugcggcacagucugaugaucggaggcagacggagccuucuuguccugugaaggagacagaaggaaaauuacaguuacugcgaggccuguaccaucccacugagacaauucuaaaugcacuucugauauauuaaaugggaaaggcugagccugaaagccccuuuacuaccuuuggugugauauauuuuugaagucagugugguucuucugggauauccaucccccgcggcggcguuguggucauuaccaagguuuucaaugaugcuuuccucaauuuccccucgaggaaaauggcuguggucagagggcaugcauauuccuaagaaaaccagaaauagugauuaauccucaggcuguaguuuguugcugcuaauagccaagacaggagcaguggguuauacagacaccacugugaguuaccucacugcuguugcugccuuucuauuuaccaaaacuccccagagaaagcaguaucaaugaguguacugucgaaucguauggaacgccucagguauagccauuuuaaaugcuuuccuacuaauuguaguggaggcaguagagacuuuucugucuauuuuaauauuacccuuugggcuaggaaaaagaaauccagucacuuaaaagaaauuaaucuuaaaaaauaacuucucugcucugggugcuagcugcgcaaugcaguuccggcugccuggaagacugcgaucucacccgcuaguuacuuuacuguauaauuuugauauuacggagauuuuagugaguugacucuggaaugcugcuguaaccuaggaaguuagccaccccucaaguuuauuucuggagacuucuuugagacauuaacauuuuguggaucugugguugugugugugugugugugggggcaguacuucuuugaagguaguugaggguggagggaaaggggagaagggauggagagcuagggguguaagcgguacagagaucucuuuuaaaagcuggccagcagagauuaaucauucuagcuccccguugacaacaguuguaauagccuuagaggaaagagagacuggcaaagccacgcagaguccaccuuaagaaaaaaacgucuggcuccccuuucagaacgaccucucccccuuucucaagugccccaaggcucccugaagauaauuguuugauggaaggguccacuuucaggucuuguuguuagaucacagagggaggcaaggaaagauaaacuuucaagugcucaaacacaagccagugacgaugugucaggagaacccuugcaugagcacgcguuugcagguggcgccaccuuagcuuugacagaaccagagcauuucauuugauuccuggguccucaaaggcaaggugguucuaauuuaaaaaggaguccaagacucaccauuuuugcaguaguucccggggcagcacauagcgugccucaugcagcgcuuccugcgcuuucggcaagccagacagaucuguacaccuccgacgccggcugccccgcggcuggggcuggagcaguacucgucagagccgcacuccucaucuucagcgcaaggguagggcugugggaagggagcggacuggugagcaacucaagcauccugguacccacaccuucaagguccccaucugccucuucaaaagccccuuaagcgcgcugcucuuaaugcagugauuccaaacacaccccaaaucucacacaccuagaucuuucugagacccccgucgggaucacagcaccccucuuaccugguaguugucaagagucugguacuuguucccgcccucauagagaacucccggcgccacacugacagcagagcccggcugccccccagcaccacccagcggugggggcagguucuugaucgcguuggaauugaugagaacugaguucaagguggcacuggcuccuagcagagggaggcugcagagagccaucauuguaaacacggccaagaaccggacagcugccgcugcacacacaaccaucaucuccgaaggacgcaaacaggcaaaggucaggaaaagagaggucacuuugcacggcggcuggcugcagagucuggacugcggaaccucaacuucgggaccuccgcugguggagucucuggcugccaggcgcacagcucugcaccgccaccgccaccucuggcugccuuuauacucaggcucccagcccucccagcuccucagggaagacaacaaagccgggaugggauuucaaagcuuugggaggagcugggagggggaguguuugugugucggaagcagggaggacu

SEQ ID NO: 9242 - RNA, 885 nt, Mus musculus
cuuacuucauaauuuaugaucuucagaaaacacacacuguguauauaacauacuuucuugaaguugaguauacauuuuuaaaaccccaaacacuuccauccuucauauaaaaaagauugauaacuccaucucagcaguuuaaugacacaacaauaaacagccacacuggcuuccuuauugucaucuuccgcacagucugacgcugacauuuagauugaaaucuguaucuacuuucucaucuggcgggauaauuggagaacuucuucucccuggccuccagguguuugccaacucccaccagguucuaggaaacaaagggagagccugcagggaaaccaggaagugcaaacgaccuauuccuccugggcucugucuuuuguuaagccugaaaauggaacccugugugucagcccaaagcccgaaggaguccacagaagagaaguuggugccuggagggaggauaaaaacagaacugcaaaaucuucucugccuauuuaguggcuugcaaucugcugccaaggucccaggacgggggguaauuguugcagccauucuuugucaccagggagacuuccagagaaaggccagguuccaaggaauccuccagagagcaggugucugcagaugggguggcgaaggcgggcggggacagaaaaagcuugccuccccccuccccaucccuaggaaaaccgauuugaagcuuuuccgugagagccagagaaaacuuuagaacacuacagcucuucagcacuucugacuacucacugugcugugcgcugugcggaagggagucacuggacggcuucuaauaugggagcuucagugugagccgaaauguggcguucaccagaagcauccgucugauuuucucucgaauuuucaugg

SEQ ID NO: 9243 - RNA, 745 nt, Mus musculus
uacacauuuuuacuaacauuucuuuuuuuuuuuuuuuuuuuucaauauauaagucuuuuauucucccaaaagagcccaaauuguucauguggucaggaucucguuucuggggccaggaacugaggccuccucacucgucagccugcugcacaguucccuucucagacacauagaugccguccaaaaacuuccugauauccuuguuuuuaacuguuguggcuugcugaaucagggcagcugaauuugaaacaaguucaaugucauuuccuucaaggauuaacucauccuucugggcuugagagacagaacaagccacaccuguccucauccgaacccugcggauguauuuuucacccaagaaauuucggauuucaaccaaagagccauucuccuggaugacgacguugauggggaagugagcguacacagaccgcaucuuguauuggaagcccagcgugacacccuugaucauguucugaacaugacugcagaugguccugacgguggccaguuccuuucuguuaccccaccauuugucaacccggagccuuuucuucuucuucccaagaagacucagcuccacguugaugugauugaagucccuccgcagagucccccuggggcccuucacaaugacugugcgccccuucagagugauuucgacauucucuggaauguccacagucugauugcugagaauggucuucauccucgcaguagauggggcaaagagccuaacauuucu

SEQ ID NO: 9244 - RNA, 29606 nt, Mus musculus
cacaccgaagcuccgagacgaucggccacacucgcucggugacagcaccggagaccacgcuugccuucugagguucccgggccggaagugcgcucugcucccgcccccgccggcggauccggaagugggggucggcaagcggcgcgccgcccuccgcggggcccccgggcacgaugcuucgcggcgcgcgcagccaccucccggccucgguagcgcccgccgcgguccuggcugcggcgcugcucucgucguucgcgcgcugcucucucccggggcgcggcgacccgguggcuucggugcucagccccuacuucggcacgaagacacgcuacgaagaugccaaccccuggcugcuggucgauccgguggcgccgcggcgggacccggagcugcuggcggggaccugcaccccggugcagcuggucgcccucauccgucacggcacccgcuacccuacgaccaagcagauccgcaagcugaagcagcugcaggggcugcugcagacccgcgagucccgggauggcgggagccaaguggccgccgcgcuggccgaguggccgcugugguacggugacuggauggacgggcagcugguggagaaggggcggcaggacaugcgacagcuggcccugcgucuggcugcccucuucccagaccucuucagccgggagaacuacgaccgccugcggcugaucaccagcuccaagcaccgcuguguggacagcagcgccgccuuccuccagggguuguggcagcauuaccacccaggacugccaccucccgacgucucaggugacagcgcgcuccgccuucccuagacugcggacucccucauccagccuccccucgugucccuuuuugucaccucccuuucccgcuugcguucucgggacccaggauguggacuugguugucucuguuguuuuaguaauacgcuuguccauucacucaucaggugugaauuccuagcauuuucugcgcaagagugcaguaggggacgcuggagacccagcuagaaggaggggaaagaaaguaucgcuucucguuuuacauuccacauucccaaaucgcguuauccccccgagugccaaccuagcuucuuuucccuuccuggcaaguaguuuaacaccugggcgcacuuaauaauauagaacuuucuuccucccaaacugcuugugagaauugggaguuuuguuguuuuguuuuuuugacacaggguuucucagcccugguuguccuggacucgcuuuguaggcuaugcuggcuucacagagauccaccugccucugccuccugagggcugggaucacaggacuuuuggcuuuuuuguuguuguuguuguuaacaacaucuuuuccuguguuucgacauuuacaaggauuuuuuaggaagcugcuccucaaagccucuuuaagccuuacuuaggguuaggguacccuguuucguucuuguguuugcuguaguuucccuuguuguagcugugguccguagucacauguauauuaccucaccuacuuauuccauuauuauacggcuucgggauuucggggcacaaguaguggaauccucauuucacaggugaagaagccaagaguguguccccuucaucacccuuauauaguggugaacuagucaggcccaguauccagauuuguggcuuuucuagaguggugaguuuuccuucggaaaauguuuuagcuguugcggcaaacgguaacgcuuucugugugccgagcauccuguacacugggcacuuaacacugcuuuaugaaguugcuaaguguguccccugccaaucucacgcacaagaaaugaagcaaaagguaccaaauaauuugcagauuuucauacaguuagacaaggaccuagggaaucuuauauagagcuugcucucaacgcuaugcauacggcuucccuguaagauaacuugaagaaaauagcguggggguuaggaguggauaaguguuagcaacugcuuaucaguuugagccucagagaacugaagcaaggacauuagccgacaaagacucaaacaacagaaaaauucaguuucccauuucuccccuaauacuuaaaaaccucuuagagauuuccacaugguuguguguuguguuacuaauuugaauaacucaacuggcugauguauguauguauguaugcuuauuuguugaguaugcuuuuuaauuauggcuacuuuuuuuuucucauuagauugagugaacaucuuccuaaauccauucaaaugaacuugagugucaaaacuagaacauuuaaaguagcacaacagggcugcugagauggcucagcagguucaggggcuugcagccacgccugacgcccugugucgggucccugggugcauguugugaaagggagaacugagucaugcuaguugcacacuaaaugaacaccaauaaaucucuuuuuuuccaauuuuuuauuagauauuuucuucauuuacauuucauauacuauccggaaagucccuuauacccuccccccgcccugcuccccuacccacucacucccucuucuuuguccugguguuccccuguacuggggcauauaaaguuugcaagaccaaugggccucucuucccaaugauggccaacuaggccauccucugcuacauaugcagcuagagacaugaacucuggggguacugguuaguucauauuguuguuccaccuauaggguugcagaccccuucagcuccuuggguacuuucucgagcugcuccaucgggggcccuguguuccauccaauaggugacugugagcauccacuucuguguuugccagacacuaaaagcacaauguacacuguguaaaaauauauuggaccucguaggcuaaaugaauuucugucucagauuguauugccagagaucagaacagcucaggguaaagcugucccucauuguuucagucacagaguaacucucuugucaucugagauggguggcuugccuauuguguacaugggcuuuugagaaaggccauagaaucagauuuuagguuuuuguagaaaugaacaaugauuugauaaugguagguuuuuuggggaccauauaagaagaugauagaauucucuuauuuaggauguuuauauaagaacuauaaauacaacugucaauuagaguagacagaauuaccauuugggggaauauauuuacauauauauuuguauuuuugcacauauauccaacauaacauggucuagcuugguuuuccauguucagacacagaaacaauaguguucuuuuccuccuggaagaaugacaauggcaacauuuggaguauacuuuggaaaaggccccaacaguugaagcaugguaaugaaagcuuuuccaauuaguauuuguugccaacuugugaaaauaguguaacuuaguaaaugcuaaccaggaaacuggcugagagcuucaggcaggugagccuaccagaggcaagccucuggcuucugaaaugaaacagcagacccaaaauauuaauguugcuuugcuggguuuuguaguuuaugucaaaacagaauauuucguaaaguaaggcaguuuggaaaaguuagcugagaaaaggaaaugcucuucuuggaguuuugcucagcgaaaucuggaaaguaaggaaauacucuucuuuuuuuuuuuuuuuuuuuuuuuuuuuuuugcuuuuuuuugguuguuuguuuuguuuguuuuucgagacaggguuucgcuauguagcccaggcuguccuggaagucacucuguagaccaagcuggccuugaacucagaaaucugucugccucugccucccaagugcuggcacuaaaggcgugcgucaagacgcccagccaaggaaacacucuucuuggaguuuugcucagcgaaaucuggaaagugcugguuuuaguuugcuuccuuagccagugcuggaaggaaacaguacuuaguaaugcaagaccccccccccccaugcugggccuccacucaagucccgggaugagcuggccaacaucccugaugcaaacuagcugaggccgaaccccuugcagggcaggggaguucgacccugagcggugacaguaaggggcuuuuuuuuuuuuuuuuuuuuuuuuuuaugaauuuuucuuucuuuuuuuuuuuuuuuuucccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccaucaguaaggggcuuuuaacagcuagcugaggaauugggaggaguugggaggagaguugggaggaguugggaagagaguucuucucuuucagguguccuuggugaaauuuacaaggcaggaguggggagugagcucuuucugaauuuuuaucucccauguccucagcacaggaaggcaggcaucucugguuguaaaguauagaaacaaaaaggcuuuugcuggcuauagagaacaaagagcuuccuucuagcuguauuuuuagagaucagggaaaacaagcuuggggaacguccaggggcuuuaccuuccagggagaaacgcucuaaguccgggucucacaguaacagguuugcauuuucaugcuuuccuguuacucuuguugcaagaaaauauuuauuuuauguaaauuauuuccuuguauagcauugcuuuaagucauuuucagucuacuuuuuaaaagucuuuucuagcauauccgcugguacauuauaauuguuauaaaugaagaagcugggcuagggauguaguggguagagaguuggccuagcauacaaaggcccugaguuugagccccaauccccccccccccaaaaaaaugcauggagcaaaacaugauucucuuuggggcugaggagaugacugugggguuaagagagauuauugcucuuacagaggacgaaaguucgagucccaguaccccugucaggcagcucacauccaccuaacuccagcuccccagaaucugacuuccucuccuggcuccacuggccacuguaccaugcucuugaucaaugcuuguuucaguuuugguuucuuuccucccagacacagcuuaaucauuuguuaaauguuuccuuuuuacccuuuacauuuucagugacuggaaauuguaacuuaugccugugacuuacauaugugugcucuuuucacuucagauauggaguguggcccuccaagaauuaaugauaaacuaaugagguucuucgaucauugugagaaguucuuaacugauguggaaagaaacgagacggcucuuuaucauguggaagcuuucaaaacuggaccagaaaugcagaaggucuuaaagaaaguugcagcuacucugcaagugccaaugaacaguuuaaaugcagguaauauucaugcuguguuucccuuacauucuguuuuaaguaguuuggagguguuaaauguaaaacaagccaaaaaaaaaaaagucacucuucuuaagguccauaguuaaaucuauguuaacuaaauaguaugucuugggucaggaaaaugauauaccgggcacuuauuuuuauuuucaucuucuuuaaaucuuuuauaaauuauuaugcaagguccuuaaauguagguuuuuuuuuuuuuaugagagccucauuucuaaguauuacuuauaguguaaaaguugccuuuucugaauuaucucuuaguaaaauaauacaaguaaaaaaaaucauauacauccuuuaauuuugggaaacuuuaggacugcauguuaaugugggagaaugguagguuuuaguaagugaaaagucaagugggguuuguagcuuugucuguagagauucugagggcaugagguucucucuugaacugcuguaguggagugcuugccuggagcuugccaucuguaggggacgcuuuggagaguggaagcagauggccguaagaggaaacauggucaccuagcaauggaaaauuaagaaaaugaaguguuuucuuauuuucuagaacuuuacaacuuauuggauauugguaaauacuaguagguagagaagagauauugugucuccuacuguggauuaguuucuaagauauuagaagaacgcauuggagggagggaaagguugaaaucucccgggccuggcuuggugaugugucuucuguuuguuuugucauucguuucuggauauagauacaccacuuccuagucugagagcuaagacugagacucuaaaugagccaugucauggcaucagacaugcgcaguaucaacaugccacacugacuuauuacguguugggaaacauuuccaauagcuuuuaugucuauuccuagagaaauacauuuuuauguaugugaguacacuguagcugucuucagacacaccagaagagggcaucagaccccauuacagaugguugugagccaccaugugguuguuguggauugagcucaggacaucuggaaaagcacucagugcucuuaacaacuaagccaucucuccagcucccuuuuaaaagauuuuuauguguguuugagugugcgugugucuguuuugugugugugcaugcacauauauaacuacauguguugccuggugccuauggaggccagaggaggaggucagauccucuggaacugguuacagagcauugugagcugcugugugggugcugggaguagaacuuggaucuucuguaagagcagccaggguuuuuaauugcugauccaucuuucuaaccccaaaguguauuuguuguuguuguuaaauauuuaccucagacauucuuuaaacugaacugauauggaaugcauauaguaucaauuaauuaauguuggucccauuuccuuugggaaagaaaaaacaaacaguaaaaugaacuggaguaaugcuagcaccccugcaguuugcaccucaucucuucucuccaucauuaaguguuacccacuuguuuaccagagaacacagugcuuggcugguguugaccaaggccuccuuuagaagcccaaguacucaaugaccuaucccuucuuuuaguacccauuugugccuaaguaaagcaguuagcaguguaaaaaccccugguuccuuuuucugaaaccugcugugauuucuugggcagcuaaguuugaaaagcgaccauucguucccuccuugcuguuugagguuguccuuuccuguguucugcuuggagucagcgucuuucucccgccccuucacucucuucuuccgucucaaucuuccauggugucucugguuauguaccuaauaguuauaaugugaacuauuguguaguuuuaaaaacugauaauaaauauacuuuaucguuauuaauguucaaguugggaacuaaacaagaccuuggcucuccuuuucucccucugaaguuaucaauaucaaguucuauuuaauaagccguugggcuaacccucuguuggguuuccuaggcagccugcacuuagcaaccaacuaguucuaaaaacuaaaacaguuuccauuuccagagggcugcguagucucauuggauugaagugucucccacacgguccccucuaguggugcagcuggcuguuggcaucaugcaggccaggcuuugauccuccgucgucucuucuccagaaacuccguuuuuucagcugugcguuuaacuaugcacguaaccuuuuaugggucuguagccuuuaaagaaccaaagaaacuaguaacucacacauuuuaccuguucucuuccccagacuuaauucagguagcuuuuuucaccuguucauuugaccuggcaauuaaagguguccauucucccuggugugauguguuugacguagaugaugcaaggguaaguauuuuguuuauauuuuuuccucaugguuuuuggucauuauuugaauuuuuucuuauuauuacuuagagcagcuuuucagaaaaucgguaggauucggguauacaaacugcccgggacuaacucccgauauuccuaaguaaggagaauaaaugcuuaaguggguaaauaauuggguucauggaacucagaaaaaugguaauuugauuucuaaguggugccccucgucccaauuaaaaaccgacugcuuggacagguggcaggcuaauauaaagcugagugggcugcagagagaaccauuuuccacagaccugauucacccuaaguaguuuuccugagaagccaguuccgauguuugacugagaugcugccugguugcaccugcugguggccaugguucacuucaguuuucauuuccuuuguuuucaccugauuauggacuuuuaaggacuauaggaagaccuccgaucuuaagggacuaaauucugugugauucgugagugcuggguguagaaagggagggugggacaguguucuggauuguccgggauuauagaccucugggccuuaguuaccuuuacgcauauguaaaugccaguguuucauaugggaaccaaaaauugcuuccacauucuaaagaaauauacuccuugccaaauagagcacgauuugaagcccaugagcugcuuuguuuuguuucauagcggcucggaugagcaguaacaugucaaaggucacgccgccacgguucuuguaccaguguaggaggggcucacgggagagcugaggggagugaagcaucucaguggaugaccgcucuagggugcugagugccgggguacacgggugucacgugugucguuucuuccccucugugcugagucagugcugggugauuacuccccagcccgcagugaccucuuguacugggcucaggacucauuacuuagaaacuucccagcuuuccugccuuuaaugugcccuguuuuggaugaacauaggauuugucuuuggaaccuuguauuucaucugcaggaguguuuuuguggagauagaacccagggccgugauuuccaggugcccuccccucauuccaaguaaaaaccugcuucugggaggaaggauuguugaggccaguguaaagccgaguuaccucaggacgguuucccacagaccugagucuauggguugggcugugacaucuccguagaagucacuaaccuugcuccccgcuuccuucugcccucuucuguuccuccucccguccgcuuuccgcccaccccagccagguuucuguucuguaucugagcgacagcacgaggugccugucuucuuuucccuguuucucacuuucauuucuggaccugugcucccuuuagacgucuuucuucucccucauuccaccuuuggcuggacacuuuuaaaaugaaaagaacaccauuaauaauguuaccaguguaaguacaaagaaaucucuggucaccguucccaugucagaacaucuccucuccucccuccuccuccugcacggguccagggggugaucaggugaucaggagaucacuuucaagauuauagaaaugauaauuucugaaaaaggagaaaugucauuuaacuuguuugccaagguugccauaguuguggaaauguuugggaugugauucaguuggcugccugcuuccuuccuguucugaguggcucugcccauguguggccccuaguaaugaccgaccacaccuacuuccagaacacacaccacuuuccuugagguggucaucaccugccucugcugacccugccugugugcaucccucgaccacccuuauuaacuuccuugucuuucagacauuuuauucuugcuuucuguacauuguuuccuuccagcaggugauuucaugcauggcaaaaccugacgccacaucugucaaacaccucagggugccccuggaacuuuugauguuaaagacaucucuuuucagaauuauguauuucuuuauuccuaugaguccucccucuuauuuguuccaaaaugauagggugagcacuugugcauccaaacaagaccauucucuuccaugccauggauagaugaccauucauaucauguuuucaggcaucacaguauauaucguaaucacaccauagaacggacaucccaacacacaauuuuuuacaggcaucuuaauaaagcccucuauaguugcuguucuuaaauucagagucucuucaaggaugucugauccauuugguggugugucgagacuccuuccaucuggaaaaaggacucuagauuucuuucauuugcugugcacuggcaucccauaggaaucuaggcuuuuuuuuuuuuuuuuccugcagaauauauuggguauaccuaaauacauaaguucagauuaaacauuuuugacaagaauucuacuugaaauccuucuaaauguuucccaucauaaagaaugaugucaguuugucacauccuugauauguuugaucacuugaugagaauguugccugccagguuucuguguuguggguuaucccuuuugcuuugugugaucaaagaacuuauguaagcaaccaugaguuaacaauuugaaauacauguucaaauaaauuaagaguuuccuuuuauccguaaaaggcaguuaguuaaauaugucuuguggcuacaugacuggcccagugguuaagagcacuuacagugcuuacagaggacucagauucgcccacacuguggcucgcagccuucuuuaaccgugggagaucuaaugcuuccuccggucuccagaggcaccauucacgaacacacacaugcacauaacuuuucguaauuaaaaaaaaaauuauauaacucugucuuuuaaaguucuuuuuucagugauuugauuaaaaauaacuuuaucuguuagcccuuggaacucacacagugaggcaggucacacggugaagcacucacggaugaaucagauuguaccagggauuuaccugaggcuaauucacugcuaacucgggcauaguugaaacaugauugacuaagcgauucuuguugaaguuggaugguggguccacaugagauuguuauauauuacuguagcauauuuuuguguuugagauguuugaaaguuaaagaugauggcuuggugagauggcucagcugguaaaggugcuugaugcccaaccugacagccugagcugaaguuguccucugcccucugcccucugcccucugcccucugcccuugacaugcaccagcccauacaaagaugugcuucugugugugugcaaacacacacacacacauacacacuaaauguacagugcauuuuaaaugaagagacaauuacacaguucucagcaccauggagauuuuugguuaucuggggccuuguggauagauggacccuuucugcuguuauuuagccaacaguuguuauaguggguguuuuauguccgguguuugcuuacaacugaagauucugacgucagauaagcacauggaauaaaagaugcuaacaauaugcuugccuguggugaugggacaguuaagacagaagucuuguuggcagucaggcaggucuuuauagagauugcagaaccagccacucccugucacauugccuguuuuuacagcucugcaccaucgucuguuguaaauguucccagaguaccguacucuguggccaacuuuuguguuuaagauguucacauaaaagucauucgccuuauccagaucugccaucugguaaaccuguccccagccuuuucaacagcaacuucucuuuagaucuuugacucuaguuauuugcuuccucagauuuucuuaagucaguuacguaacuuauaccuggcuguaagccuguugaaucugcaucuucaagccuaguucaugacauacgugugcauaggggauuuguaauggucacuugucacuguuuucauuccuaaugcuauuguguuaucuccgaguagauuaacauacuuuuaccuaguugccuuuauuuugaaaucugugcguuguaucuuccuuccccuuugcugacuuugagguguuuguuugggauccagcacacuggucuaacucuguccuaaacuuugacuagcaccaagauucucuaggagcucuugucuuaauauucucacaaaucugcauugacuauaagucagaaggcgugggacagagcccauggcccucauuucccauuagcccuggugcaaaguuuuggugccacagguguuggugggugcuggaccguggaggccucagaugcccggggcggcaguuguaggccgugagugcuaagcucugcugccugcucucuaauggaauuagugcaacuucucugagaauuauuaacaggacuuuguuacauuucuggaacuguauuagaauuacuucugaaauguuucucuuuagguucuggaauacuuaaacgaccugaaacaguacuggaaacgaagcuauggcuacaccauuaacagccgguccagcugcaaccuauuucaggacauuuuucuacaccuggacaaagcaguggagcagaagcaaagguaaaagcgucuuuaaaaacguggaguacaagccgggcgugguggcgcacgccuucagucccagcacucgggaggcagaggcaggcggauuucugaguucgagggggccagccuggucuacagagugaguuccaggacagccagggcuacacagagaaacccugucucgaaaaaacaaaaacaaacaaacaaaaaaaccccguggaguacaucuggaacuuacuauuuguaagcuucuggaaaauaccauacaaugcauaauuuuuuuuaaacuauauuuuuauaaaaccuugauaugguaauugauauuaaccaaucaauauauuaguuuuguugcagucacacuugguauugucuccugaugaugguguuuucucucacauucccuuuguaacaaucacugcggcugcgugugcacuguagugugggggcccuugccuuacgugugcacuggccuuuauccgcuuccugccgcaguggcacauggcuucuuucuaguuucuguuguaaaauggcuucugcuaugaauaugcaaaagacuuuuauuuuaaaagggaaucuguccuuugagaagaaucuucugcuagcauuccuacuuuugaacucacuuuuacaguauggcgggaggguacagucacugguagagugcgugccaggugugaggucuccagcaccaaaagcaaacagaaguuaaagcuucggcuagaaauguguggugggaccucaacccuguuucauuugacagacguugaccaaaacggggcaacaaaagcuggggauggucuguuucagugugguuuguacugaguuuuguucauacagcacuaauuuguaaaauguucuuggguuuaacagggguuagaggaggaaaaaaaaaaccuaauaaaacaaaauccccaauuagauuaauuugguuucugcuaccagaaacaguuuuuaacuuauauauguuuauuuauuuauuguguggacgccaagggacagcuugcaggacuugauuuuucucuucuaccauauggguuccagcuaugaaacuuggggcuuagcagccaguucuguuaucagcuaagccggucuccugguccagccagaagcuucugggggguggagauuucaaauaaagauaauacuuaggauaggaguuaacuuuuuccuguuugauuuucugagugacuuccagcucuuacacuuuaugagauaacagaccuuucccauuugaucauuguucauuugcucagugcugagucuaagggaugauacauuuauaauugugucaggaggcucuuaaacaacuuuaucaguaauguuuuaaaauaaaugagaauuucuguauacugaaaaaucaggauaguaugaggaaauuccaaauaaccccagccccagaauugaaagaccuagcuauugguugaauagaaagaccuagcuauugguugaauagaauuccccccccccccgccccccuuuuuuucuuucuuuuuuauuauguagcucuggcuauacuggaacuacguagagcaggcuggccuugaauucacaguuccugccucccaaguggcugggguuaaaggcauacaccgucacacuuggcuauggaugaguggaaaucuuaucaaaucucacaaguuuucuuguaggaauugagaaguuaguucuaaacuuacacagaaauauaaagaaucuauagaaaugaaaauaauuuugaaaaagaacagaaaauccagauuugucauacuucugugagaacuuacaggaagccuugugugauggugugcaccaggaauccuagcacuuuggaggcuaggacagaauuaugaguuugagggacacccugccucaaaaacaagcagauagccguagacauaauagaguccuagucagauagauagagggcuacaguaacauugugaaauaaacccauauauaguaggcccccauauccauggguuucccucuuugguauuuauuuaacuacaaaucuaaauucacauggguccugaauauauagagucuuuuacuugucaauauucucugaauaaugcggaaccuuucuaucgcuauuagaaauaaucugggaucaugggaaaugcauggcaguauaaauguaaguccucuguaaggacaacaucauuuuauaugugaguuuccacaggcagucgcagaaccaauuccccaggaauacugaagaacaacuauguauguuaaauugguuuucaacaaaagaugccaaggcaauauggugaagaggaugccguugguaacagaugaugcugggacacuuggguauccaugcuaaaaacaagauacuuagaccucucauacuacuaauaagaaggaaguacagaucuuacuguaagagaaaagaauagaaauagccuaauuauaagagauuaaacucagucauaaccuuggauuaagugaggcuuucuuaaauguaaugcccaaaacaugauccguuaauaaaaauucauuaaauagauuuuuuuaauuuuaaacuauuuuucucaaaggguacuauuugggaaauagaaaauauuugcaaaacuuauauacauauaguaauuugaauccagaauguacagagaauuacaucuuacuuaguaagaaaaugcgcacacacacacacacacacacacacacaccccuugaagguauaaaagagggcuuacagguauagugguagaauaugcacuuuaaaaguauauaaguccacucauugguugaauagguguucaaugucuccuuccucucccuccccccaaaaaguacaaaagauuugcauagauaucauuaaagaagauacauggauggcauaugagaaaacguucaccauaaucuucuaucaucugucaccguggcuaucagugucucagugaaaugccacuuagcacccuuaagcuggggaaaaugaaaggaucacccucacucauggcugacuggaauguaaaauuggagacccuccuuggaggacaauggccguuccuaacauuaaacaucugccugacgaagcagauccauccaguguggccacucggcagugauggagaucuucagauggauucuuaugccuuggguaguucagauuuuguaaugguuuuuagguuguguaauucuuccuuuuaacauuagauggcaguauugaaaccauugugccaugaugcccuuguacaggggugcaauaaauguguacugcuuugucaauucgcacauuaaagcagggcaacuuggucucuuaaaguucugaggaauuuacucagauuuuagguuguuuuuuaaagucggggcuguggggcguaacucaggggcugugaucuuuuuagugcugaguauuuaaggaugauagacuaaaucaugggagaguuuauauaaacaaguuggcuguucccuaaguucagauucaugugucuaccugcuuuuuggauggacaaguuuucauuuuauccuguguggguuuaugacauuuucaauauacugcucugucuugaguaacuaacgcagugcuuuguauauagucggugcuauacguguguaugacgaguaugugguauagaccuggguaaugacgaguaugugguauagaccuggguaaugauggagugugugguauagaccuggguaaugacgaguaugugguauagaccuggguaaugauggagugugugguauagaccuggguaaugauggaguaugugguauagaccuggguaaugacgaguaugugguauagaccuggguaaugacgaguauguaguauagaccuggguaaugacgaguauguaguauagaccuggguaaugauggaguaugugguauagaccuggguaaugacgaguaugugguauagaccuggguaaugacgaguauguaguauagaccuggguaaugacggaguaugugguauagaccuggguaaugacggaguaugugguauagaccuggguaaugauggaguaugugguauagaccuggguaaugauggaguaugugguauagaccuggguaaugauggaguaugugguauagaccuggguaaugauggaguaugugguauagaccuggguaaugauggagugugugguauagaccuggguaaugauggagugugugguauagaccuggguaaugacggaguaugugguauagaccuggguaaugauggaguaugugguauagaccuggguaaugauggaguaugugguauagaccuggguaaugauggaguaugugguauagaccuggguaaugacggaguaugugguauagaccuggguaaugacggaguaugugguauagaccuggguaaugauggagugugugguauagaccuggguaaugauggaguaugugguauagaccuggguaaugauggaguaugugguauagaccuggguaaugacgaguaugugguauagaccuggguaaugauggaguaugugguauagaccuggguaauaacgaguaugugguauagaccuggguaaugauggagugugugguauagaccuggguuaucuccagcgcugcugcuucuccuguacuguuuaccuucgugccucccacacagcucagugcagggccacuggcauucugaacuccguccuccucacuuucuguaucuagucauugccuuguggguucuguguguguguguguggugugugugguguguguguacaugcaugugucucacagcaugugugcagaauucagaggauagcuugagggagucaguucucuccuacuauggagaaucaaggggucaaacuuagguugugagacucagaggcauuugaaccaucucuucaguuauauuaaauuuccaguuuacauuuucuuuauccuuauugcuaccaucucaauuuaggguaauaccuauuuucuaaaaaauuuaauuaguuugcauguauauguguguaauagcuauaugaguguguguguguguguguguguccaugcucagauguaugcaugugugucugugugugugcaggucagacaccaguguugacccucuuccucugcuauucuccauccugcuuucugagacaggauuugucuguaacuaggucacagguugaauuacauggguuggccagugagcuccagggacccucuuuuaucccugacccaacucuggaguuacagacaccugccaccaugcacagcuucuuaugugggugcuggugaucuaagcacacccacugacugaugcgucuccucagcucccaccuaggucuuagaaacugccugccuucaaggcuuccccugaguuuggucuuauuaacgccacaucaguauggucgucuuccgaagggacaguucugaucaugugacuggauugcugguguuugcuuagucuccuuacuguauuaaucauuucuuaauuuuauuauauuugcauaauaauuuccuuguuggcacguguuuuuaaacuaacuuugugcauguuaauaauuccaaugacaucauagugacccuugauguacuuuacuuacuuugcucugguucuguaguuguuauuuuagaaguuccauaacugugggggggcuggagagauggcucagcgguuaagagcauugacugcuccuccagagguccugaguucaaaucccagcaaccacaugguggcucacaaccaucuguaaugggaucugaugggauucaaugcucucuucuggugugucugaagucagccacaguauauuacucauauaaauaaaauaaaauaaaauaaauaaacaaggaaggcaggcaggcauaaccuuuaaaugccuugcucaauagaauuggcuggcuuauuaagaagcauauucucugucauauaaugauucuagcaaaaucugaauaaaugucugagaaccucuaggaaugcugcuaccaguuaaggcaguacucucacccuuccuaacgcugugacccuuuauuuuuuuuauaguguaucaaagauuuuuuuauuguuucauuuauuuacaugccaaauguugucccccuucucaguccccaccuuuaagaguucuucaccucaucgcuuucucacccuugccucugaggggggaccccaccccccuagccaccccccucaugcacccacccacugaacccuuuaauacuguuccccguguuguggugacucccaacccuaaaauuauuuucuugauccuuuauagcuguaauuuugcuacugcuguaaauuguagugugaauaucugcguuuucugauguucuuagguggccccugugaaaggcucgcuggccccucggguugggaaccacugagucacuggacucagcucauuucagcucagcaaguccuuguggcacggcagugaccugggcauagugggagauguuggcaaugcugucaaaagugaccaagaagaaaguucugaucguucacacccuaguaaagauaauacuuacagugauugagaccaaagucuacggaugauuagaauccugugauuaauuagacaagugaauaauucaaggucaggguaacuagaaaaggcuaacuggccuucggugaagugaguaguaugguagaucucucuugauuuuagaaccauauucaguguuucucaacaaacuuaaaacauagggggagguugaguaccaaaggcauugugugcagauauaccugaguuuguacacacuugccucuuaccagugucucacaacaagugcauacccagucagugacuccuugguuugaugguuugacuuggauaauauaguggaauaaaucgugggcaccuuuccuagaccagagaaaaacaagcgcacguaauguguguucuagauguuaauuuaaaaugcucccuuuuuuuuuuuuuuaaauuuguguugcuguaagguucagguaccccucuucucagaacacuggcaagugaagcguacccacagaaccacaggucucaugaguacagagcaguccucaugcuauuuuugagcacuaaggguguucguuugcgugcaauagagauuaugcaaagaugcauaccuucaaauugucugcaagaacccagguuccagaugggagggcacuccaguaagagcaucuguauguaaaacccaaaauacucagggggugaguuggaaugaugaggucacaugcaagucuuuacgggaagagaugucuuuguggguaaucaaagaccaaagaggugcucuuaccaagcuucaauguguccacuccucguguugugcuuacagcugcauugaacuacaguuaacauaaagucaucuaucucagcauagaaguaguacagcuggcucgaucucaccugugugccuaagucauuagcucuccgucucuuuuuaagguuuauuuuauuuuuacguguguguguguguguguguguguguguguguguguguuccugcacauggcagaagagggugucagaucccuugaagcuggaguuauaugcauuugugagcuauucagcauggaucuagggaacagaacccagauccccugcaagagcaaggagcugaacucugugccgucucccggcccucuucuuugucuuuugcugaucugucugaccaggaguccucucuuccccgugcaucugagcguucaccaguuuggcuuguuagccuuggaaguguauuuugccgaugccuuccuccuggguucccaugugugagucuauguguaacauaauggcugacguugagagcggccccucuggacuccagagcucccugucccgaaguauaucuguuccaugaguuccugccaguguucccucccuggaccucacucaccucagggcugccauggccucugcccuccacccuccacccuccaccacagccugcagacgcuaaacagucagccuggacagcugcuggguucaacccguuugccuucucucuuacucuguugucugacugaaaacuacuguuucauauaauucuagcuuccuaaugcuaguagggaggacaauagagcuuuaucccuguucuucuaucuugugagcuuaauuucuacauauuuuuacauaaaaaggacauuugugucauuuucauuccaggcuuacauugccaaauguguacuucuccagagaucuacugcagucaaauauugaagacuuguaaacaaaauuuacuuuuuguaauuuucuucucaaagcgucucauugcucuggcaguuccaaccauuuguaugugcucuuacguaagugugcacauugugaaauuuguccgaagugccaucugauaguccuagaucauguuugaaagcauaguuuguguaacgccaguugcgugugaaacauaaauuaagagcuuagaaagauguagcuguguaugcuuaagggaaaacaugcaauuauugggucuucuuacugagcauuuugaauugcuuaaggcauuuaccuacuuugaacauuuacauaguuucauuucuugguguaauuuuagucuucagauuaaauuugguuugaauugaagacaauaaaaucuucucguuuauuuauauaauaaaggaugcaauuuacaaagccaccuucuuccuggguaacguuagguaauucauuugauacacuggacuuauucucucucaggucugauuuaggaacuaaggagguggcucagugcguaaaguguucacugugugagccaugaagaucugaauuugaauccccagcacccaugcaaaaccaggaugugacagcacacuucuguaagcccuacaccgggacucagagaaaggcagaaagagagcccuagggcucacuggccagcugcauagcccagcugcucagcugcugauucaggagagaucccaagucagacauaagguagagcaugagacuccacugcagcugaggggcuguagucagcuagugcgugcuggggcgaggaagggguggggucauucuucagugguguggccauuggaugcugccugugccuaugcucacacaggcaagcuuaguacauuucacacaugcgcaugaucucgcuucagcauaauuaucuaucacccuuucugguucuguccccuucccacugaaccccccuucuuucuaacaagcccuucugauguuauuuguguggaugugugugagaggguguggugggggcggggagaaggagggagaggggagggagagauugaggacacaggcacacugauucccaguugcaucacuucauucgcacuucauccuaacuuggcucuggagugcugacucagcaaagguugaccgugaccuccaggcgcacucucugcgccuugggauacaguccaggcagaagcugggcagguggcgcuuucgugaggugcuugguugggccugcaugaacgugaaccaggaguuggcuuacaacuugauggaccuauucaguuuuagugcuuggagcaguggcagcguguuccugaaaaugaacucugauugcuuccuuauaggaguuaacugauuucucuuuucucucucuuccugaugggccgugaagugaacagcucuacccagccagguuccuccugcuacacagugcucuguccauuuaccuugucaggagggugaaugugacuaagcccucugaacaugagccagaauaaauaucccccuucaaaaagucagagccuuuaucaaaacugugagcauacuuuuaaugacugcugauaaagauucgaucauauacucuuguauauuugguuugaaguauuuggaauggugauuauaauauaagcugaucaaaaaaauucaaaauaguaaaacucagagggucacaaaaaacaaugcaaacaaaaagaugaaagcaagaagagaaauuguugggaagaagaaagguuuagagggagugagagaagacuagggggugauaauggccagcacacaguguauacacgagaaaccccacaacucacggaacaacugcccauaauugaagauccuuaccccaucccccaacacacacucacacacacuuuuguuguuccaguguaauuuagaagagaaagugauauuuuuuaaaaugcccccaaacagaaauuugaguaagucucaugaaagggcaggcaaauguaaaugugaacagauguuuaaggacuauauuaacccuucgaaggggauguuccccuuuugacauacauguuuccauagaugucguugaacaaagguauaucugauaguuuaccaauagauuugaacaacgaaguagaaaucaguuccauacugcugcugugucuuguuuauaagugaagaagagcguucuggcauucuuaguuauaaguggacccuugacuuugaacuuacugauuuuaaaauaauuuuuaauuauugucuaaggugauuugagucauaucucagaaccaauucagaugcuuuucuuacacucagagccucuggaauaaagcuguucuugcugggcagugguggcgcacgccuuuaaccccaauacuugggaggcagaggcaggcggauuucagaguucaaggccagccuggucuacagagugaguucuaggacagccagagcgagagagaaagcuguucuuuaggaaagccuugacgaguugagguugcuuugucaucugguuauuucucuaauuaaacuuuaaguaaaacuuaaaugcccagugauaacuaaguugaauucaggcuaugggaaacaacauaaugaagaaaagcauauguuugagacuuaagcaguuaaugcucugagcuguuacuaauggaaggaccauguaacacagucugucauggucucagacuuagcccaaguacccaagcagcuaacuuggaaggaguuagagccaaccagacugcauagagaacucucccugaccuuaauuuaauguucuucccguugcuuaauugaaaguaggcucaguuugccuucuuacccuuacaaccucaacauaguuaucuauugaacucuuucuguguuguauuugaaaugaaaaaaaaucaagaaugaaguuagugugugcgugcgcgcguguguguuguguguguguguuauggguguauguauguuuuggauauacaaggcacucccugccugcauucccagaagcagggaaguggaagcagaagcaucaaauauuagacagcagccuggguaaauggugaaucccaggagaaaucggcucuguggugagacccaaucucuaaagucaaagcaaggacagaucuggaaguguagggauuggcaggaugcuugccccauguauacaaagcccuggguuuaaccacgaacacaggagaaacaagaaauuuuaacaguuuuuuuuuuucuuacuguauaccacuucugacuaaaaaucuuagguagaugguccucgccuuuaauaauccuuggaugaauuuaugccaaguaagaacuuacacccugugauuugauauggacaugccuuuaaaguuggugaauccagauuccuagacuagaagccuugugacguagcacugacacaccgcgcagucuugcagaacucccagguggaauacuguucuguucccagaaagcuggcuugagauuauuuuaaaucagcagugguuuggaaguaaaugagugucuguuaucuuaaauggcuuguccuacucuauacaagaauuucuuacacacggggauguuucgguuuuucccagaucacuuauuuuagaugguccuuuguuuuggcucugauuguaucuauuaaacuuagccacaggcuaccuggacuuuuuauuuauguuuggugcuuugggauaucuggugauuucuaaaauaugcugcucagucaagugacuguacuacuugcugugguguuugucuucagugugguauuuacacuuauauuuuagaacgagaaccaaccugaauggccucuuggacucuaaacccuuacaccacuaaugaguaugaccucugaccccugcugcuggagcuaccccagcucuuauggucugugacuauucgcucucacacauugauuugcugcucugugccucaugcuaauguauugcuaugggucaguccagcaacugcagaggaaguggcuuaucuuccuuuggcauaacuugcugaguguguucuugugcccucagaguucagcugugggggacccaccuuccacuguccucacuucagcagaugcucacguuuaugagggcuuugacccaaaugagcuugcauccagagucagaauagcaagccacacauuuauuuugaauaauuuucagguguagucuaccugaaggaaacuaaucuaaaacauuugacuuuauggccugugugguaguccaugccuuucuuuaauccuagcacuuggaagucaggaguucggggguaggcagaugaguuugaggcuggacucgucuacauagugaauuucaggccagccagagcuacacagugagacccugucucaaaaaaaggaaaaaaagaacuaaauaagacuugggguaauaguuuucuagagguaggcuauuuuccuugaacuccccuuguaaguuuagugcaugguauuuuuagugagguuagcuggcugugcugaccaagguggccguguccucuucaucuuuacacaugggcuccugcacucacagugcgagccugcugcugcacuuggcugagcuaucaggggcagggagcagugugugcacggacucuccagacacugccucuuagcaagucccuccugagaugagaggcuuucucaacagucauaugcugcuaucuguacaagccagaauuacauuuccuuguuguuaucuuaccugcuuuucucuacgccccaccccacaugagaagagaaaugaacaugguaccgagcccuugacaaggaguaauacuuaugccacgccuagcagaucagucaauggagcuuugaaaaggcuguuccuuauugcuucuugcagauuuuaauauggccauuuuuuaaguaucuuuuauuuuaauaugagcagcaccaccauguucucuugcucuuaguuauaagaacaucugcuuccagcuggaugcuuugagcugcaguaagagcagaacacacauacaugcaugcacacacacaaaaucaugcucauucuucccucuuugacauuauuucauaaacuuaaaacaucuuuacaagccgggcagugguggcgcacgccuuuaaucccagcauugggaggcagaggcaggcggauuucugaguucgaggccagccuggucuacagagugaguuccaggacagccagggcuacacagagaaacccugucucaggaaaaaaaaaaaaaaaaaaaaccaacaacaacaaaaaaacaaaacaaaaccaucuuuacuauagucuauauaaacuaugaaauaguuauuacuuccuacaggcaccuuuaauuagcaaugucauguucuaacugcuauugaggauucucauuuagucuuuacuuuuagcuauaaucauaguuuuuccuuuuuuuuuuccuguauauuauggacuuugacaguggaaguuguucuauacuagagggugauaugguggcauuuauaaaaacuauacuuuuucuuucuguuguaaacggucucaaauuuaaauuuuuucauguguagguuuugcuuucaugugugcagugcccauugaguccagaagagggcgcuagggucacuggaauuguaguuacagaugauuaugaaccaucauggggugcugggaacagaacccagauacucuggaagagcagccagugcucuaaacaacugauccaucucucuagccaccaacugucuaggauacuuuagagauaaucucuuauguacugugugaaagcaucaacugucaauaaaaccugaugaccaauaagcugaggcaagauuagaagguuggacaucuggcagaaagaagggggaacucugggaaagucaagacucuaaggaagagguaaccagcauguggcaggcauagaauaguauaaacagguuaauauaaguuacaagguaguuggagaacagaccuagcuaauggccuaggccuuuauccauaaauaaacagcuuucgaguuacuugggaacugggguguggguaaaagcccacaguuacaaauaaguaauuuuaaaauauaaguuauuuuaaugaaucuaacauauaaacauuuugauuguucauaaaauuccaaauaaacuuuuuuaaaacuuaugaucuuuuuuuaaaaauugcuuuucauuucuauauauguguaggcaugcacaccugcauggaguauacacagaggccagaagagggcgcugaagcccuggcacuggaguugcaggcuguugugagcugccugguguggaugcugagaagcaaacaugagcugugcaagaauagcaugugucuucuacugagccauuucucuagccccaccauauacacuuuaaagcacugugcuccuucugaaaaaaaucugacuuuauaauauuauuggcagcaagggagacaaaagaaaaaaaugauaacugcccuuuuuuuuuuuuaauuuaaguuuaaagaaucuucagauuuauaguuugggucggggccgggguuguagcaagcagaguguuagagcacauguguucuuaaguucaaacucuaauucaaaugggccacauccgagauugacugucuucugugguuggauguguuuagcaggacuuugaacuccuuguuuguacucuccucccaacaugcaugugcaugugugcuuuuuguaucaauccuuacaaaugccuguuacuucagcccugugggagcagggacagcauuacuggagcauacaggguucuggccccacccaaaaaauggcagccuuugguuuggggagaguccuccagucucaaaggaaaauguagagacgaacacucagcaccauauucuggccucugugcaugugcagagguguacacacacacacacacacacacgaaaaaguaaauacugggaaaaugaaaacuugaaaagauaaaagacgacacuuaaagcgcacucucuccuucaggagcauuucguggaucggucuucauaggggcagcuuguccagcccucacaguaagugcuacugugagcucguaagugcuguuugucaacagaauggucaacuauuuacuauuugggguagauuugcagcacccuggauauccuaauuccuagacauuaauacucagugugaagauaguucaucucccccacagaaucucagccauaugcuugcauuacauauagaaagaacucuuaaaguaggagccguccccauggcucagaggggagaggugccugccgggcacugcuacuggaacacacacgugcugaaaggagaggugacaccugacauuagccucugaccuccacgccagagcugccgugcuagugagccuccccuaacuuacacacuggauguaauaguuuuaaauaaauaaagaugagauuacauuuuaaaaugagagaaucaguuacuguuaaguauaguagguauuauauuuuauggcacagaucucuaaauuuccccuccaauuucuuguugaaggucucagccagucuccucuccagucauccuccaguuuggacacgcggagacgcuccugccgcuccucucccucaugggcuacuucaaggacaaggagccucugaccgcuuacaauuucgaggagcaaguuaaucgcaaguuccgaaguggucacaucguaccuuaugccucaaaccuaaucuucgugcuuuaccacugugacaacgcgcagagccccgaagaacaauuccagauacagcugcugcugaaugagaaggugcugccccuggcucacucgcagagacccgucggguuguaugaggagcucaagacccacuaccgggacauucuucagagcugccaaaccaguaaggagugcagcccgcccaaagcgaacaucacguccgaugagcucugaggaccuucggcugugccauacugaggggugguuguguuugcaggagguagccacucuagaggccgcggcagaaggagcucugugaguccaaggccagccuguucuacauagugaguuccaggccagccaagacuacauagagcaauaaagccuggucuuucugucuuuucacagaaaauaauaguuccuuuuaggaucuagacauacggguaagacaugacucucccuggagcagcucucugcagaacaaaaacuaauucaaugaagcagcugucccucccaguguuugcagagcugagauuuuccuaaugaccuaagaagauacugacguagaacgguauuagaaaaugacacuucaaaaauguuggauaccaaagcacgguagcugccgggugagcggcagugauuggcagagauggggacuugagugaccauguuggguucccuucuucuccuucuugcaggacacaaaugauaucgcuuagucauaagugugguagacuggauccugaccagaaggaggucugauauaauauccauccagacaagaaaucaacaugcuaucaagaaccagguugaagcaaaacugaaagugugugauauuuuuguugacguuauuuauaaaaauauuucaacgcugucaauaauugucuuuaaccuccaaguaggucuugcagaaucgucuucauuucaucagaccuauugggggugaacaguaauuaauaggaggcccagccuggcagacgcuugcugacgcuccuuggcucuugccugcuugucuuuuucauuccaucauggcuucccuuuucauagcuggaucuuccgugaaguguuccuuuuggugguuuggauuuuuuuuuuuuuuaaauaaagaccuuaucugccgaauuuaauuguagagauuugaacccgaucaaagaaauuuugaguucucucaaauaccauaaaaguguuugcuacaauaaauaaaauucuugugacuuuacuaccaagucaucucugca

SEQ ID NO: 9245 - RNA, 1391 nt, Mus musculus
aaugcuuguuuaguucauguucuuuuuauuuuuaaaauacaaauaaaacuuuuuucaauauaaauauaucauuucauucaaaaguagaaaaaauauacuauaaccuuggucacugcccagcaggaacaaauuugauuauuuaaagagucagaaaucaggucuucucucaacaugugagguuagagcccaguuccagugcgauuucauacauaggaaagucuugguucuagaaacaaaucauuucagagaucauaaugauucaaauacaccacgcugaaugucuaccuuguguccuggagucaaugacacugggauaaguugaaauuuaacaccaagaccacaauuaaauucacauagaaacauuauauaaauuacuuugucaggcugcagaaacaacauuagauuuuauagcagugugcaucacuuuaaaaguuacaaacuucuaauaaaguaacucaagucuguuucuucuucuggaucaaguguacagcgcaucgcucucuggaguucacgcagcgcucaccgcaggcgcaaaggcucucuggcaggggcgcggaccgcagagugcccagcauuuugucccagugugugaaguaaggagcaaaauugcaguuaaacugagagugaugcaugucguggugagccacgcccccguaccagccaaagggcacaagucugugaguggaccacgggaagucauagcccgagugguccuccaccgacagccagauguuaaucacgugaaagguaaagauggugagugggugacaccgaagcaccgcgacguucagcacgucgaagaaggucagcgaaagcagcucccagaagcucauguauugggucgccagcgcgaaggaggacgaguucuggugaugcaccuuguggaaggugcgguacagccagggcaccuuauggugcagcaggugccacgcgaagaucucggugucgaagagcagcaggcagaucaggacgugacuuaggagcuggacgagcucaggggccuccugggggaggagcgccgggcugcgcacccagugcagcagcgucaccgggaacacgaacaccaggugcugguagagugucagccccaggcaaggcagaagcugcuuuacggaaggcgagaaguccggguggaucuuguagcgucgcaggauggggacccagggauacaggacguccagcaccacgaacgguaggcagaagcccacguaagugaugauagaaaaggugacugggaagaugggugagcgcgugaacgccucccuuguccuuauggugucccagaggggcugcaggagcagcuggcuggaacagcccaggucuuggagcuccgaaccguuguagcagcccaugcugagacuaugucccacaauuguggucuccccagcccc

SEQ ID NO: 9246 - RNA, 35164 nt, Mus musculus
cagggugacggcuccgcccucccaccaaguagguguaggcaccagguuggccaagcucgccugcuuguagugggcacugcuucuggaggcugagguuggaggaccacucccggugagugacugcuuuggggcuggcuucgugcagcgggcucgggagcugguguccuguggaucgccagggcugggagaggaggccccaccagggucucuggccuccaauugcucugcucccggggcacgcucugugucggguaccugaaggugguuuggggggcggcgauuauguggguaucaacaagaaguggacuguccuucccugggcgcccucccgcuuccugggcaggcgcgaucgacgauuaggaacccugcccagauuucuuggacugcuggacaggcagaaugccugauucucaguccucuucauccuuucuucccguuagcucucccacgaccuuacucuuagcucuuacacgacugcauggccagcagcaaccuugggaguggguccugguuaaaaaccccggcgauacugcugaauaaucagcuaguccuuugcuuccaguauuugacuggcguguuuacauuaucuuggaaaaugagcuuaguuaguacuguugaguugguagagaagcgucagacuguaggaggcacugcaacaucugggcauugccaauagcuuaggaauuauugaaaaacuaccccggaccuuuauuuucgucugucucugaacugcggagcuguuccugcccauuuuuuaaaagcaacauuuguacuauuuaugcaggacuugucagagucuugaagguucaaaguuaaaucagacuucagcucugcccacccccacuuccguucuccaguugaaaggaaggcagacaaauaaugaauuggauuguugcaaagccauaaguacugugguaaagauguucuaaacaccuagacuagcgcacuaaacccagcucagagccuuaucagacaaccccuucugugagaauuauuugucaaguucguugaguaacggugcuguguuggaaggaagucuaaugggugacuuuccaugugaguagcuuccccaaucaccucacggugugaaugcccuucccagacuguaucagguucuguaaaaacggcuuccaccaaaaagaaaagugcuuauuuuaaguugccuugggaaccuuuauuuaucgaucuaccgcccccacccccccuugcuuuucagacugcuuuuauguucucuaguauugaaggaccucugggacagugaccugaaguuagaaagguagccuuagacugugcuacauaagacuaugcuggcaauuaaaagcauguguggccaggacaaacuccagagauuauucucuucugucuggaaugcuggaaaaaauaacuucaggagaaacugcaauuuucugagagccaauuuccuaugaaauguggaaugcuugguuuaagagagucuuuauuuauuuauuuauuuauuuauuauuuucaaacaacaguauugagaaaucaacacugaccagcaggacacauuguaggaauuucuaaauuuugacauguacaaauaccagggaauuaaucuauucagaagucggagcaaacauaccacccugaagaguccuuugcaugcuccuugggagauuuccccucuugcccuucuucuccccagacgucaaucuguuuucucccuguauaaacuagguuacauuuucuccaaguuuuauauacauuggaacaauuccuuccuucuccucucuuuauucccaucccugacuuuuuugauguacagaauuauucugagauuuguccauauugggugguucaauggugaaguaugcauacauacaauuugucuaauuagucacuuauuugguuggcuuuuccccuagcuuuugaucguuauauucaaagcugcuauaauuuaaguacaagucuuuagcaauaugugcaccugucuuuuaaagugagcacauccauuuuuuaaaggcuuggauuacagccccaacauucauucugaccuuagucugagugcuguuagagacuuguaccaccucacucuuagcagccaaguauuuuugccacacuguaguuuccagccaucaaggggggggggugaucuuugaugauaguuggagaguuucucuuuucuuucccuuuauuuucauuaacuugagugacaguuuugaaugcugacauauaauuuuggguaagaacaaauuuuggaucuaguggcagguaagagcuaacguaggcugaauuuaaaaauauaucuaaaucugaugcagagcggaaaaggugggagaaugcuagggcucuucucuuuucuucuaaguuccuccacaugcugcuuguguagggacaguuuguuucucuuugugaggaggugguaccugaguguacagggccuaguguguuagcugggggaggggggaugucuggaggccucuuaaugaaaacagauugauguccccgcccccacuccccugccagagaccgcuggagucguuugguucauaucugucuccacucuggcacuuuauuuauccuaaacuugguucaagacuuuuaaagaaggcucuggucugucaagacauguuugugugauaaaauucaguugguuacuuuaaacggcaggaagaugcaacuccagggccugguguucguuuucaccauugggauccugcuuucucgggugcccacgggaacuguaucagcuguggauccugaagucaacaugaauguggugaguuucuaaaggucacaugcuuuugaaaugccgugaugacaagugucuuuucuuaaacagaguuaugacgucacaacccuaagcucuuuaccgcuuguuaugauuuucacuuuuuugugaauggcagaugccaagcuacaguuuccccacuagauacugcuuacauaaccggauuuaucaggcugcugaacaagacacacagccuacgcuaaguaauguuuucuuuuuaguaauuuuauuuuuuaaaucauuuaaagcacacuuuaaaacuggucaaacuguguaaaccguuuaugagaaugccuuugugagugcugaaccugagauguuauuaagaauguccauggaacacaacucaguacaguugugaaaauauuagaaggaaccguuagaaaaaaaauccaagcaaaaaacaaaccaauucaaccaaccgaccaaccaaccaaccaaccaaccaaccaaacaaacaaaaucccacuaaaauuaauuaaagcauuucaaacuuaugaaucuuaaguaaacagugaaaucuagauaaaaccagguggaagaauaugauagaaaauauagauuauuaaagacacaguagcuuuaagacagaagauggauugaccagcuaaagaaacaggagacugcagagagugacaaauuccuagauaggacaggauggacugacacaggccauggcauccuucuaagggaaugauggaauucaagucuuucagguauuuauggcagagaggauaacgaacacuuugaucuuccauguaauugguggaugccuucccaccugccacucaugacucuuucccuguggggagguaaaauuaauggcaguuucucauuuuucggcuuuucuucuauuaguuucaugccuuucaaaugacauuuuguuuagccuuauugccuaggucaggaacuuuggaacaugaaaaauguuagcugacauauuuagaaaagaagucuuuauuugugccuggucggcaggaaagaaaacgacaagaggccaaauuugauacacucagugcagagcuggcggaaugaugagaugccugcgaguauaacugacugggucuugagauggaaucuugguuacuagauggagcagaauaaagcuuuguuuucugccugcuauuuuuggagauggaagacucagaguccaccauagaauacccauuguucuuuuucuccccagaccgagauaaucaugcgcuggggauauccuggugaggaacacucgguccugacaggagauggcuauauucugaguauucaccgaaucccucgugggcggaagaaccauuuuggcaaagguauggauguuuucuggggcuaggcguaacaacuuuuggaagucacugcgucaucugaguuggugacugaauucacuggacagaguuaccacaagacggcuggaggccaauguaccagcuaaggaaggcuggcuugauuaauuuaaucauuucuacuggguucuaaggucacauuccauuuacaguuuaaaaaugcccccuuacuuuguuuauuaacgaaacauuuuauguaauggacuguugugaacauuaaacaguuggcuuuugcaauuuaaaaacuagccucccccugccaaaaaaaagaccagaaagauaacaguaaauacuucuuuuucugucuuacuuuccaguuuuuaacauguguucuugcuguauaauaccuucauuuaacaucuuuguaucuuccacaugcucauuagaaacaaauauggauuauuuuuuguuuccaccuuuuaaauucaaaaggugccauaaaggacauaguauuuuauucucugaauuauuugcuaucagcaagcucacaaaaaguguguuuauuuccuaucacagagaucuucccaauaauucuuagaacacuuaucugaagaugcauaguauuccauugcauauuuaugucaugguuuguuuaaaaaguaucuauuaaugaacuuuugugcucauuugaauuuucagcuaacaaacauugcugcucaaacaaaucaacaacagcaaaaaaauaccuauauauugugcaaguuaauaaauaguauauagaaauacuuauauuguuaugucaugugagaugcuuguuucuucugucuccaucacaagacacuaaguauauuauaaugcuuagguggcuaugccaguuuuccuuuuccaaauccauuugagauuuuguuuuaguguuuauagcgcuauacuaucaucuccccuugugaaucuuuuacaaaacgauugaaugaugacuggcauugaucacuuuuuuucugcuuucaaacacauaaaguauauaucucauguaagaacgagccuaugaucuuacuuuacuuccccuuuuuuucaaaaaccaaaaccaaagccaaaaaacaaaacaaccaggaaaacaacaucagcuuuuagauucuauccaaagaaaaaugaguguagauauuauuuccuauaauguucguaguuaaguaguaauuacuacuaccagccauuuuuucuaagguucccaguuaaaucucugcugggagaauguacuacagucaccccuccccugcaggcuucugccuccacacugcaguuaagcaagcauacagggcuccuugucuugugcacacacauugcauugugacuggugaagguguuucuugugaagggaggcaaagaugcccccucaaagagauagcaaugcuuguggacagaaggugguccccuugcaggcuggggagguggaugcucuugucuugccugagagugcugagucagaucuguauucagcuuuagauccuagucuuccuucaccaauucugaggagaccccacccucccuugcggaaguccgugaucuguguguuuacaaggcagccucaggggggucuuuacaaggaauuuugugacucaguuaccuaaaggaguugugauuucuccaagaccugugcagaugcuuuccuuaugguucgcucuccauggcccacgccuagguccuggccagaaucucuuugucuauucaggagcacuguggucaaugcuguuaaucugccuugcugaaagccaaaaaaaaaaaaaaaaaaaaaguacccaaaauggcaccaaucuugugaaugccacuucccuuuuggcugccuauuaauagcacaucacccuuucagugaccuagacuagaaauugcuaagucauuuuccuuuuguuuggcagugauggggauugaacccauguccuuagugcaugcuuaggcaagcacuacugccaagccacauccacagcccuugcagaaacguucuugauuuccucccagucucuaggccacccacaaaccaucacucauuaauacgguucucccugcucugaccaccacacuucuccccauuacaaucuugauggcauucauuuaggcaccggagacaggagacagcgcagaagcugagggaaccuugagugaaucacuuugggugggggggagacucccccuauaccagagaaaacaaaucucaaagcaggucuauggaaauguaauauuguuuugugaaaugaaugcuuuuaacauauagaaaguaauguccuguagccuuauucuuuauaagaaacuauaagauacauuaaaaugucauuuauuuauuggggugacauucuugguggggggcaauggguuacacauaaauggugagggggcucuucagacagcaugacuagcuucacaugggugucaaaaggaacacagaguggagccaggugucugcucugcccguguacuccuguaaguucugcugccugcagccuccuguuccaaccucucugucucguuugcagagaaagucuaaaucucagcuaugacgugauuuugugcagcaacaaucuuuauggaucuaauggauguagauacauacaucccuuaauagucuguccuggcuguguguguauguuucaccccauccagaggagcagacgucuguacuuguggcuggcuaguggagacuaaacuugcaauuucccauuuaagauacaguguguguguguguguguguuagaugcucuucucugucauucuccauccuauuccuuugaaacagggucucucacugaguuuggaaccugucugguagccagcaagucccaggcaucccacugucuccaucucauaccauguuagauuucuuuuuaggguuuuuguuuguuuguuuuuaaaugugggugguggggcauuugaacucaaauccuuagacuuucacagaaauuacucuuuucccacugagccaucuucccacuuuuaagcaaucacucucaucacaugcugaacuaccacaguauucacuaagugcuuaagggaaaugaaacgcagaaauuaaucauuuauagagaagugguuuuauuuuuaucugcucagccuuaaggaugaguguuaauauuacaaggcucucacucccugcuuggaccaagaauuugaaaagcuugcaccuuuagaacauauuucuuugagaucaauucagucauuuccugcuggagacggccaaggcaaagggcagcuacuugggcguuuuaacugcagagguaguauuccuugaauuuagaacguguccuuauauaaguacugagcaagcugauccuauuauaaccauaauauagacuuuauuuagcuaaaacaaggaaauacuacuugugccagcauuaaaaggaaaacacaaggccaauugacuuacuaauuguuuaauugggaaaucaaccgauuacugucaccuaacuggggaaucagauaucucauuuguaccugaacaauucugcaucugcuuaccuggggggugagauugaauucugggcugugaagacuagaaacaacuacaugcaacaugaggaagcagacuucucaggcguggccuaggcacagacucuccaaggguugccaacugagccauuugagucauaggugaaaguucucaucgugacuugugaguugucuugcaaagaaagggcuccaggccauuguuuugauuucauugggucuuucuguagagaaaccuuccuuuugaaagaaaccacuugugaguuucuagcuuuauuuauucauuuaauaaaugcagcuuuaguaaggguacauaaucuggcccauaauucccugcacugagcacauguagacaggguguagugcauacccaggcuucuaggcuucugaugguacauuggauaggggaucuguuucagucuuuuaaacucaacaacauaagucaagccagcuguacagucucuuuguccaacuuugguugagguuggagcaaaggagaaguguaacaucguagcauacacugcucugccugccucuucccuuucuccacaccccuuccuucuuggcuagcugcugcuaagugucuugugucugggagaauaucuaaugucucccuugacaugcacaaggauguguacacacacacacacacacacacacacacacacacaauguauuuuaaacggaaaauugcaagcagagucuccaauaggcacaaguacaaaugucugcagcucuggauuggguugaaaagugcagccaggacagaauauuaaggaaugugugcaucuccauccauuagauccauaaagacuguugcacccagaaccaggcaccuacgggcauaucuucugaacucucuguguguuugguucacagugguuaagucaacaguaacucagauggcugauaacaaguguaauuaauuacugccuuccccacagggccaaguggagcuggagcccuguggaggccgacguccuucuggcuucauuugcuuuaauguugguuaugcugcugauuaauuugcuuugaaaaugcugcaccccaaggacuuggccuguccccaaguccuucauagcccucuuaggagcaaagcauugagauuccaaaauauucuuuguucuguucuaagucacauuugggguaaaggcuucccuaucuuccaggaucagagacagccagggacaaaaucuguagccuuacuaguguuacuguacuaaaagcgcuagccucaggcucgagugugauggucucgguuuccucaucuuuuaugugagaagaaugguaucuaccccauuccugcuguaaggcccuugaggcaucuuucccuaugugcaccccugccaaauucaacuugcagugaaugaggugggccauguuguugccuucgcauggcuuaaccgauccuagugacggucaccaggguuguggagagcagcacuaugcuagcgaugggauguggggccaugcaugugcucgcuccugcagugcaggucacucccuuuccuacagguagacuuugaaguggaaaugucauggccuggacucugauaaaggccacaugacuuucuaauugcuuucugcggacaagccaaguguccccccaagcgugaaucaucagaugaaucauuuggacucuggucagccuguuggccagaugaggauaacaagguucuggcgguuaaguaguuuucccaugauaaacggcugaaguggcauaaagauuccuauaccucguguuuaaguuuccauccauccagcccuuuauguuagccacuggguuugcaguguugucccugauaaagucagaaagcuaucugguaacuuacauauuagauucguuguuuagucuccugggaucuauacuuuggaccuaagccccuucaccuuguuucuuccuccagauaggccgcaccucauguccuccuuuggcaugugccuuuuuacccuucuaccuacugacaugugauaauaaagauagcuaguucucaagggauccaggcucccuagccucggacuucugaaccaugacuugggaaguuuuaaaucucuguuuuguucuuauuauuuuuuuaaauuaauuaggcauuuuuaguuauucugucaauacaacagagaggcacuaaaaucaauaguauuugaaaucaauaguauuugaacugauuuuuaaggccaagucuucaaaacuagaauuagacuauaaaaauucacucaggagccaucauuuuggauaacugaaacccaauggcagacuuugcuaccaacuccaauucacucuuacuaauucuugaggagacccuuagggucccccuugaaugcuuguugggagaauaugucuguuuuguggcuucuuccggggcauuagucagcucauucucuccucacccagcuugcaggcaauagcuggcuguaacuucucuuaaguagguuugaauauaccucugaugggcugauuuggaauagccaagggagcuucaaaaacaagaccuuccaggccaggcucuguguacggaguucuucauucuccgggucaaggucagaggcaguaacaugucuguuucacaaucacucuguguuauuucaguacuuagcuaguuuggacugcuaaguacugcuaaguacugcuugacuguuuggauggcuaaguacugcuuggcugcuuggcuugcugggagcuggcuggaaacagacauaauauuugugugcaugccucuuaucgacuuuagccuuuaauaauugcuuuuuuuuuuuuuuuaagaucacuggcuaagaccaagaccuuugaaaugaaauagaccugggucucaguguuagcacacggcuggcugaagggucuauggccaguugcuuucucuacauguaggucacuauuaggucucaaacccaggacaaaugccugaggugcauauuuaacauacuaaaguggaccuggcugccagguucucccugcaucuucaguuccuaccuauaauagggucuggcugcauacccuucacccuccccuaaacuucuccagcccagggggggggcugggcugucuuucucuagcugcccuuuccucuauaauucagccauuuugauuaccaaaucccuuuuugguuuacccuuuaccuucuuggcuucuucaucugggucucccauuucccauccugccucuccucaccuggucacguccacucuggacucucccagaugucccugccucuggccaugcucucccuuuuaucuacaguaaccuuucuccuccaccauacugggaccagucaugcccuuuucuuucuuuucuuaguucuuaguuuuauucaauuaccucauuuuuaacauggauaugaaaguuuaagccauacgugacuugaagccuaggacauaacugguagcugguuugaacaguauuaggaauagugccaagcuaugcagacucuagaagcuggcuuggguuauuaugugguuagaggucauucaggaagcacuuaagccaaagccuaaucaggcuuucucgauacaggaaugauuauaccaagccuuggacauuggguuuguccagagcagggggguaggggggggcccacuuugcugguugaugaguuccugugaacuugguuaugugggccauucauggagauguaagcugagggcagcucuagcuuuguacuauccaguauggaaccauaggaauggauagauacuacauacaagggcccucuuaccauuugguuuagaaucugcuauugcaggauacaaguucuuuugugggaaaugcagucucuucccaaacuagcaaggagcuuaggaugucagguugaggaggaccuuagaacuccugggucaggcaaagaagccugccauuucaagcuaauuccugaaguggcuccauugugguagugucuuagacuuccccaggaacugcaaggccccugguagucuaagaucacuggcccugggccaccaauuaugaaguugaaucaaauccuuugagacuuuaugacuggugaaaaccugaguucugugucaugcugacaacguucaacuuuggccuccuuccuccuugccccuugguuugaugacuucccuagaccucagcugguuccccaugacuuuuuggagggaaguagcagcucaugcagccucgugucucgggagguaggaggaaguccccacacaccaaguugucuuccucuuaagaaaggcagucauugucaggccuaccuucagcugagauucaccucacuggcaggcagcauuacaguggacagccaggaggcugcugcuuagcugaccagggugaagucauuuuaccugucauuaucuagaaaaacaaaacaaaacaaaaaugucaguuuuggcauuuuuuguuguuguuguuuguuucuguugucgucccugauggcaguuuugcauuggcuccuagaggcaggaauuuuaguaauuauuguagugaguuuguaauuccaaacuuuuagugauuauuuuuuuuuccuauuucucacgaugaaguaaaaucuugaaugaaggcagagaugguauaucuggcacagugcacugaagguagaacuuucgaggaguuuagucuugcugguguagccguaaaaugccauuagaaagcaaagcagcacauacaguggacccgcacugacccacuuucuuucccauuucucuccaaggugguaucccuuuugcuuuuguuccuugcucuaucuccaguacugagaaggaccugucacagucgaugcugaacgagggauugcuugacaauggcugcauggucaccaccuuguaggccucuggaggauaggauguuuuuucuugggggugggguggauuguacauccaagucuuuguggaguuuuuguuuuuguuuuuguuuuuucaguuuaacugucucaggaagaggugaucagaagauaaauucauauauaccuuuagaauuugguguguuuucuacuuaacaauuuuuaaaauaguuuuugaggauuuaauacaugagcacaauauauguuuaucauaccuacccuucccccgccccacaguucccuuucagauuuccaucucaaguccaugucuucuucaguaagacuauucuaugacuauuaauuuuuauaauguuauauacuuuacaucccaaaccuagccuccccucccuccucucuucucaguccuucccccucccuccccuccccuucuccucagaggaacagaggcuucccauggcuaucaaccagccuuggcauagcaaguaagacuagguggaucuucuucuaucgagauucgacaaggcagcccaguuaggggaaagggauccgaaggcaggcagucuauucagagacagcccccgcucccacuuucggaguccugcacgaagacccagcugcacaucugucacguaugugcagagagccuaggucaguccuaugcgugcucucugguuggcaauucagcggcugugagcccccagguuaguugauucuguagguucgcuuguguccuugaucccucuggcuccuucaauccucccuccacuucuuccacaggauucccccaagcucugcuuaauguuuggcuauggaucccuguaucuuuaauagugucuggggugggauaccucucauggcauugaucucaagcugggccagucuuuuguuggcccuuccuucaaauucugcuccauuuuuuuuuuuuaccccugcauaucuuguagauaggaaaaauugugugucuaagguuuugugacucggucaguaucccaauccccccauugaauucuugccugguuauaggauguggccguuucaggcuucauuuccuccauuucugggagucuuagcuagggucauccucaucgauuccuggggguuuccauuguccuagguuucuagcucaucccagagauaccccugccacaaucaaguugucucucccaguacucccccuccauccuuccccaccaccuuuucccuucuguugcucucccuacuccucccccccuccagucaccucccucccuccauuccuaauggaugccuaaucuauucccccuucucaguaagauucaaguguccccuuuuggacccuucuugcuacuuagcuucuuuggauuugugauuuguagcaugguuauccuguacuuuaugacaauuauucccuuauaaaugaauacaugccauguuugucuuucugagucugggcuaccucccucagaauuaucuuuucuaauuucauccacuugccugcagaauuucaugaugucauuauuuuaauggcuuaguaauaguccauuguguaaauguacacauuuucuuuauccuuuuuuuuaaguugagggacaucuagguuuuuuccaguuuuuagcuauuauaaaugaagcugcuaugaacauaguugaacaagucuuucuggguguauacccaagaguggugcugcuggguuuugagguagaucuauuuccaguuuucugagaaacugccaaauauauuuccaaaguguguguacaacuuugcacccccaccagccaugggggaguguuccccuugcuccauauccuugucagcaugagcuguuguuugaguuuuuacuuuuagccacucuggguauaagaugagucucagaguuguuuugauuuguauuuuccugaugacuaagaauguugaaugacuuuaaguacaucuuggccauuagagauuccuuuguugagaaaucuguuuagcuauguacacuauuuuuuaauuggguuauuugguuuguagaugucuuguuucuugugcucuuuauauauuuugaauaucagcccucugucugauguggaguugguaaagaucuuuucccauucuuugugcugcuguuuugcccucuuuaugguauccuuugucuuucagaagcuuuucaguuucaagaggccccauucauuauuguugaucuuaguaucugaacuauugguguucuguucagaaagaugucacuuaugccaguguguucaaggcuauuucgcacuuucucuucuguuagauuuaguguaucuggguuuuuguuuguuugauugguuuuuuuguuguugucuuggacuugaguuuuguguaggaugaucaauaugggucuauuugcauucuucuuuaugcagacauccaguuagaccagcaucaguuuuugaagauauuuucuuuucucuauuguauaguauuggcuucuuugucaaaaaucaaguguucauugguauguggguguacuucugggucuuugauuugauuccauugaucagccugucuguuuuaugccaguacuaugugguaucuauuauuauuucucuguaguguagcuugagaucauggaugaugaccccuccagaaguucuuuuauuguacagaauuguuuuagguauccuguauuuuucauuuuuccauaugaaguugaguauugaucuuucaaggucuguaaagaauuguccuggaauguugaugggaauuguguugaaucuguugauugcuuuugguaggauggccauucuuacuaugcuaacccuaccaauccaugagcauaggagaucuuucuaucuucugagaucuucuacaguuuuuucuccagagauuugaaguucuugccauacaggccuuucacuugcuugguuagaauucuaaggaauucuauauuguuuguggcuauugugaaagguguuguuucccuaauuugcuuuuuauaacagauuuagggucauaccaaaaucgagcagaugcaggguuaaauaaccaagauuuccaaauuuuugcaguaugaauaaauccacuauacacaucaacauuucuguuccuguacaugcuuagccuuauauuuuauaaauacccucaguuguacacauuuauaagucacuguuguccagugucuauacuuaguucugcucauauguuacaaaugacgagcaaagcugugcuaagcauguguguguguguguguguguguguguguguguguguguguguguaagacucuggggagccuuaacuuaccgagccccccugagugaacaacuuggagucagggaucgaugcaaaccaagaggaauuugauuguuccaguauguugcccugcacugaaaggagagagaacgacccugaccccaacccugagcggcauguuugagcuuuuauacaguuuucagagcugcagccaguaggcacaaugcgacugguagaacagugugacuuuuaaacuggucgaucuuuagggaaugagguggcaaggacuucgcuugucuguagguggacaaaggucagucugugaaugugucuacaugcucuaggccucccccacccgcaaagugaccaauggugauggucgagggucgauccccccucucugugguuuguggaauguaauuagccccucccuuccagaggggaggggugccuauaugcucuauggccuuucucuuccaggaggggaggggucugguggaauuuuccaaaguuccugagcugaccuccucuugugcuuuugccaucaguggaggugaagucccacugcccugcauuguggccagcacuugaugcuaucucuguuuaggguucggccaugguuauaaguguacagagccaucucaugguuguguguuccuuucaguuuaucucguuugaaauaaucgcgaugaaauuauagaaauacuuuuaaaguuccuccaaaucuauuucccuuuuuuugaugcucaagucaauguuuuguuacuagguaugcaaaacagaagaaagaaaaagugaaguuuugcugcuuucuuguuaacacuguuuaaggaaaacacagcccucagguuuuacaggcaugcauugugggcuccauauguuaauuaacuucugcugcucuaauggcuuugguccuccuaacaguuggcuguuuagcaaagcaucauguuugcugagaagguuggagcuaacagcuucuaaauaucaauguuuuucaggucccagaccaguuguguaucuucagcacggcuugcuggcagauucuaguaacugggucacaaacauugacaacagcagcuugggcuuccuccuggcggaugcuggcuuugauguguggaugggaaacagcagaggaaacaccuggucucugaagcacaagacucuuucaguuucucaggaugaguucugggccuucagguauaucacaguugauuaugacuugcgucugucuguaucguucgcaucuugaaggcagacaggugaaguuaaagaguacccugaaguugucuaaaaagggagcugauaucuugaaaaguuguaaagcuugucagggauuuaaaaccagucaugaagguaaauuuaaacaagugauugcauaagugauuagauucaguuaggaauucuuaaggcauucuuaccauuccuggccuugugggcugcuagguuaacucucaggcaaucuccccaucucucuaguaacacucacauguuacauguuuauucauucuauuauccucugucucucuccuucuuacuucuggcuccaccaaugaauuguugugugauacuugacacaggguauaaacugugucuguuuccucaucuauaaauuggggauaauaaaguccuagcuuauaaaguuacggaggccugaaggaaaagauucaaggaagaaucccuccacagagucugggguguucuaaguguuuccucacacugggauugucccuucucuccucgcucucucuuacacacacacacacacacacacacacacacacacacacucauccauacacauauacucgcagacacauauauauacagacucacacucauauccacacauacacauacauucacacacacacauauacacauacucacauacacacauagagucucacacacauguucacgcagauauacauacauacacuguuguguuuuauaaaaaaggucaggauauauuugaagagugcaguauggugaagugggagggguacaugaagaaaguacagguauagugcagaauagaguuuauuuagggcaugggaaggggaguugagaagggaguagagacagaaggacagagagagagagagaaagagaaauagaagagaggccggccagaaacacauggagagagagguggggggguggagagagggagaaaggggucaagcagagaagaaagucagagagaaagggcagagaaagggaagaggggccaaacagccccuuuuauaggaaaccaggccuaccuggcuguuggcagguaacuguugggcagagccuagaaggaaugcuaacacacacacacacacacacacacacacacacacaaacacaccccuaucugguuaaaagaguacauccuagugugccagguaucauagaagguuggcguuguagaugguuaaagguuugcuuuccuuugauaaaacuagagucauccuggucuugaaucacaggagugagagcuuuuaccaaaaagcaguuauuagaauauguucauuguaacaccguuuauaauaaugaauacucaaaugcauacccacagcaaauucaguuaaucaaguguggcauauuaacauaauaagaugagaauaaacaucuauacucccauaccaacauggaggaagccaggaauaaaagaagacaugugucuucuucccgacugugugcagugaaucaagcuauuguaaugucaaaccuucaagguguuaccuuuaggguguacaauucggcaggaaugcuggggacuucuuugguccuugguucguguucugaacucauguaagauugauuauucagccauguucacugugugcugacaccacuucaugauaagugucugcaugcuauucuauauuugugugcuauuucaauuaaagaguucuuuguuuuuuggauuauaguuuugaugagauggcaaaauaugaccuaccugcuucaauuaacuacauuuugaauaaaacuggccaagaacaaaucuauuaugugggucauucucaaggcugcaccauagguauguauccaauaaagaggucaaaggcaaugugucuuagaagugaaauacacaaaaugacauuacuucaaguagaguuuuuuaaaauaacaggcagaaaucaugaauagggcaagggauuuucaguaauaaucuauagaaauucagaauuuaauauagauuaucaaguuucuuaaaauugaaagaauggauguaggcuauauguuauguguuucccaguuuuaaggaacauaagacugugagaggguagaaaaaugggaaguuuucuaguguuagaaaccuuacagagucaauaagaaaauauacuuaaaucuuaacugccccaggcgggguucaucucggagguugccuagcauguuugaaucccagggucuaaccuguagcuucacccaaaauagauaccuuaguaaucaaagaaauuaaguuaagucaagcauaacuaaccacagagauggcagcucauacuuuauagcuuugggaagcuauuugcauguuuuguucauguauuauaaaacuaacauguuuucaaguguguguguuuguguauguguggccaauguguuguacaggccuggucuuagcugucucccucaagcauugucugucuuguucuuuugagauaaagucuagacacuaaauaggcuagauugucuggccagccagccucaaaaaagauuuaccuauuccugccaucccagugcugaaacucaaagugcagcccaccacacguggcuuugugacaugggcuuuggggauuaaacucaaguucuguuuguauggcaagcacuuuauggaguaagcuguuuucucaguucaauauguuuauuauuauuauuauuauuauuauuauuauuauuaaauacaaguacaaaauuuuacaaaguuuaaaaacugcaaaucaacacuaaauuuuuacaagcauggaaacauauuccaucauuucuuagauaaugacauuagguguucacuagcacugucuuauucgagacacauggaauacauucugcauggagacucacaaaggaaaaagcuugaguguuaacauguuauuagauugcccugccuuccaggaaauagagcuggacggucguaauuaauaauacuucuuucgugucuguuaaaaauccaugguguguccuagggacggguagcagcgggugaucuaagagguguguaaaagauacuuuccagcaacgggaguccaaaugugguuuuugagacacugguguucugcuuggauggucugcaaauuaggaauggaaagcaggggagaaguagaccugugggguggagcuguagagguucauguugccaugggaacagggaagacuuuuugcugcuucuuucuucuucuucuucuucuucuucuucuucuucuucuucuucuucuucuucuucuucuucuucuucuucuucuucuucuucuucuucuucuucuucuucuucuagauuuauuuauuuauuauauguaaguacacuguagcugucuucagacacuccagaagagggcgccggaucucguuacagaugguugugagccaccaugugguugcugggaauugaacucaggaccuuuggaagagcagcagugcucuuaaccgccaagccaucucuccagcuccauucucuuaucuuuuuucugugcauauuguagacuuaaaucuagaaccaaauucaguguuucugagccagagcguuuuaggaacucuguucaaguguacaagggaagcgucacuugcauaguuacugggcuuccucuguagguuacaauggcugaccauucacauguucuuuugugaggaauuccuugaagaucuagcuaauucuuucuuuugcucugcagguuucauagcuuuuucacagaugccugaguuggcaaagaagauuaaaauguuuuuagucuuggcucccguguugucucucaauuuugcuucaggcccgcuacuucaauugggacgcuugccagacccucuucucaagguacuugggccccaccaguuucgcuucuccucagauacucucuucugagcugagaaauuggucauuagaggagaaauggcaguguccucuguaccugcucuuacgagaucagugggugugcuugccuucaccuaccccaccccccaccccgcuccaccacagaggcagcuaggggucugucccguuaacucaacacucaguggcauguuuucuuagugaacauguucguccaguucccuacccacuguacaaggaggguacaaggaagucuuuggaaagguaccuuaaguguucuaagugcuuuucauccauagggcaugagggugugcaggaguggacaggagguaggugacaggauaugugccauuccuaugugccugucccuagccaugcagaauacaaucuaggacauuaucuuaauagagcauauuuuagaauaugacccguaagcauauuagugcuuagccccaaagcuaugcaacucuaagcuguauucagagggggaaacagcacucaggagaaggaguaugaguucuuuaagacugauuaguccauuauuccucucuuauguauuauauauagacacaaaugcaugugaaauccuauacagcauuaucaacagucauaugcuguguacguggguuuauuuucauguuuugguugugagccuaaccuuuaguggcugagucauaccuccagcccuguaauggguuuuuuacaaugagaaaccgugcauuggauugugguccuaacagauuacagugaagcugaaaacuaccuauccacuaaugacaucauagccuaacauacaauucacaauuuguggugaugcuaguauacaauaauuuauggugacaagaguuaucugaaagugucagccauauaguuuugcacguuauuuaugucauaguuggcuguaagugccaacuagacaccgccuaggaucauuuaagaagaguccuaauugaggaauuaucuaaaucacauugacuuguggcgugucuguaggggauugucuugacaaauaauugauacaggaggucccaggccacugggggcagugucaucugggggcagaugguccuggguuguauaagaaagcugcccaagcauuagccugugugugugaaucggugagaagcucagugauucucagcuuaacuccuucucugacuuugucaaugauggaaugugagcuggauguguaagaugaacuacggccuuuucucucccaguuugcucuugguuaguguuucacaacagcaacuaaaagcaagccagaauaaugucauacuugauaauaccgacuacugauuuauucauccccuuuccuuuuaaucauuaucguagcauguacucuuuggucuugcaaaaaugcuuauugcaaaggcacguagcacgaugugacagcaguggacuugugagucucacauucaccacgucuuuugauuguaccaagaggcugugucaaguaaccuguaccaccuaggauuguguaaggauauuacugugagagaguugcacaaugaucacauugcuugagaacuugguucuuagaacgucuccgugauauuaagugacucauuacuucaagguacgcguaacaaagcuccccaccccucucaggccguuuugaaagucucucacaggaaggauguacuuuccucugaucucaaaaccugacagcuacugagguggaagaaucacugucuuaugcuucguugucguuuuaacugcuacuugguagguuuuggguuauaaagagcuacaguaauuuagucagacuguugugguaggaagucauugcaccagcaaacaugcugauaaaacuuuguuuugacagucuuuguuaauagugcugauuugcauuacaaacacuuuagaaauuacacguacuuccugacuacuaggccaccuccauaaguccuuucuuuaggauuacucgguuuagaggucuuugccuacagacgccacauaugaauguaugcacauagagaugcaccaagagagauguaucguuuuguuucaauguggaugguauccaauucuauagauuguucugcauguugcuuaucucccagggacagcuugccugggauuugauuuucuuauuaaguguuccauagacagcuuuugauuauaaagaccugcuauuaauuagcuggacugcuguggacauucaggcugguggggggcaucucuagaguagagacaggggaaugugguugcugcuguaggaaugaauguucuaagucuagcuuguucccuagaguuuaugaguuagcuuugucaauguagaaaugucacaccuccucccaguccacuuugauacuacauuuuguaaauucuggaguggggaucauggaucugcguuuuuuguuuguuuguuuguuuguuuguuuguuuugguuuuucgagacaggguuucucuguguagcccuggcuguccuggaacucacucuguagaccaggcuggccucgaacucagaaaucugccugccuuugccucccgagugcugggauuaagugcgccaccacugccgggcagggaucuguguuuuuaaaacauucucugugauucugaugaagacggugggccuggcauuugggaaccaugauuucagacuagagugguuuauggcacacacugggaaaguuuaaacaaaaacucacaaaacaaaacaaaacaaggaaaacaaaaaacagacaaacaaaaaagugagccauauuuacaacauauuugaauuagcuucucuaaaaaaaauacauguugcuuuugcggcagcaaaguguuccccucuaauccuuugaagaaaaauacgaguauaaaacuuacuaacccaucaaaugaccacuuuguagacacuaagccgggaguugugaacgggcuaacucuccaugucacaugcccuugucuccagguuacuuccugguccuuuuuagccaacucuuucuuauauugcguuucugaaagagaucauucagaccuaauugaugucuauuuguagguauugauacaugauccaacagaagauugauuuaacagugugcuggcaauauuuauguccacuugacauaggcuaccaucauuuggcaauagaaauccucuaacugagaaaauuccccaucucaauugucauguaggcaagccuuugugggcauuuucuuaaugagugauugauucaagagagaguagccuauuccuaauggugcuaccccugggcaggugauccugguugcuuugagaaagcaggcugagcaagccaugagggagcaagccagggagcaggacucuguaucugcuucuaccuccaggucccuguucagugucaguuccugccuugacuuccuuaaauaacauacugugauguggaacuauaagcuggauuaaaugccuucucccccaacagaaaaaaaaguauuuuaucacaaguaauagaaaucuuaacggacaaagaucacagacucucuguggaucacaggcugucuguggauggguaaauuuucuggaagaaacuagaauagaguauuauacauuuaaaguagugugauauuuacacugcagaucggauaacugacuuuuuccuuacgggaggaaaaaggaagcucucugcuuugccauccuguggauuagugauaagcccaaacaauagaaagaguagugguuacaguuguaguacugagcucagcaggggcauucaguuuccucaaaguuguuuguugcuauucaccgaucgaucauccacucagaggcagagaagcagacugcaugcacagcugcauucauuugaguuugcagcuucugcauacuauucgcuagcaucuacaggcaaauauguugcacgucuuuggccuuuuucgcuuguagaagcaucauccuaguaucugcauucaccaucagucacuguuuucucuguguacauguccaucuuuguggccagauuucucuucuuuaaaaggauacuugaagguccagccucugucugaaaagacccaaucuccaaauaccaacauucucaaauacagacaguuaagacuuaaaugucagccuuuuaaggggucauagcacaacccacauuuccuuuguagaauuugaguuuucuauucuugcuuguccuggaguuggugugugugagcaagacgacaaagggacagacaucugaauuccauauaaggaagaccuguccccucucccacgguacaugaagaucugccuugagaaugcaguggcagucccgguuguaacgugugcacagguucaguugacuguugguuagggacaauguacacugagaauuggaaaacaacucuuccaaagagccagagagccagugaauuuggccuugcgggccaagugguuucuauaguugacuguuccuaucugcaaaaguuaagagauaauucacaaacugguacuguggguauauucuagaagaacuuaacagaagcacauguggugcuggaggcagggcaggugaggaguaaugaacugucuaaugggcaccgaggcaaggauuccgagggaggaucauagagacaauagcauaagcgugaaugugcuugucacucaacugaacaauuaagcaaugauucagaugauacaucuucuguguucuaccaucaugaaauagcucauaauaaauuagcaauaaucaugcauggcagcucacagcuacaguaucagccucugggagacugaggcagcaggauuucuaugaguuuaggggcagccugggcuauauaacuaugaagccagccagagcaauagagcaggacccuguuuugaaacaaacaaacaagcaaacaaacaaacaguaaccuaccuuuaggggguggauuaggcccauaugggaggagaaggaaacacacuuaguuggagccucuggaucuucucagaaguccuguuagggacugucaacaaauggucauggucagcucccuuuauaauggucuacuauaaacuuacuuagcuuucugucucugccuuuuuuuuuuuuuuuuuuuuuugguuuuucaagacaggguuucccuguguagccuuggcuguccuggaacucacucuguagaccaggcuggccucgaacucagaaauccaccugccucugccucccgagugcuaggauuaaaggcaugagccaccacugcccagcuccucugucuuuucauugugagggggcuucuugucgugugugucucuaagcacaucugguuuaguauaucuuaucacuuuccuguuuugaauguugguguuccggaguccccugcggagaugcuuguaugccuguacuucugaaggcaugugaagcuggaacaccagguugaaaugcugacccauucuuggguuucuuuguauuuccaggacauguuuggacagaagcaauuucucccucagagugcgaugcugaaguggcugagcauucacguuugcacccacgucaucaugaaggagcuuugcgcaaacgucuucuuccugcuauguggcuucaaugagaagaauuuaaauaugguacguaguuaugaucuauggaugugcuuauuugugugagagaugcagaccuggaccuaucagacauuagcguuucauuugagaaacacauguaucagcuuuagcaaaugguccugucugcugcugccuuuggguucacucuucucagcuuccgacacagaaccuauauagaaacagucagcgagucauaauauuuauggagcauugauccuaguaguguguuucuuuuguugaaaauauuuaaucccaaucuggaguuucuacccugccuuugaccauuuaguucccagauaaaagacacacacaaccuuuuauauuuauuacaagcaucaucccucacaaaucuggacagauauauauccucuaugcuauuaugucuauuucccagccaauaauuccauuauauauuuugccauguuucaccugggcugcuguuaacuccaaucagccaacccauaugacucaccuaacccauggcagcuuucuccucucuucaccucuucaucucccccuugugguuguccucugccaagcccgggaaucuuaaagcccgccuauguaucuucugcccugcuauuggcugucagcaucuuuauucaccaaucagaaguaacuuacaggcaaauucacauagcuucacuugggucaauguauaaaguggacucucuagucucuggggcaaccaggucuuggggaccugccaagagacugaaccucgacaugucucuuuuaaaaacguguguuuaaaucuagaauggcuauacauauguauguaugucuguuaugaaguguaaaucucuggcuuguguuucuaaauguaucugugucuuaaaauguugaauuuugaaaacagguuuuaaaauucuggaauaaagccaggcauaguggugcauuucuguuaaguccagcacuuggggagcugagucagaaggaccuugaguucaaguccuuucccccacaaaacaaucugcagugaaggggguagagacuuuuaaaaaguaauacuuuuuuccccuuaauauuaaaggaagacaugguacaugaaaguuuggcaauuuagggaagcaugaagagauaagaaaugacaaguggcugcauccuguucuccauugcacuugcgccguuguugccuuuccuccauagguccucugcagacgcagacauuuuuguuggauauauucauagucagauaggcucugaucucugagagaguaacagucugaaaaaaaaacuguuuagauuuguauuguuuuauccugugaagagauaaacguacuuaugaguaucgccuuaacacuauuuucauucucuaauucaucauauucaucuuucagucuagaguggauguguauacaacacacugcccugcgggaacuucugugcaaaacauguuacacuggggucagguaagcaaaccaaggguuccauugaacucgugugacauuaguauuugguaacguuuagaauggacaagccaagaauccucagagcaucacucugcacacuuuucccuuucuuccuacaguuaugggugcuugucacuggcuuggugccacuuuugguaucucccauaauauacucugaguuaggcauggguucaucggacaguuaucggggucgaauuguuucuuucuucucucccugacuuucuuccccuuuauuucugccucagauuuacauaucccuuuccucugcucccuuccuuuuucuucccuguuuuuauuuuuaaauuguagacuagauuuauuuuauuuaauguuugaugaaauaugguucucuagggauaggcaaucauguaugauaaugagggucacuaaguuuaaaauagaauuuuggucauuuuaucccauaagcaauguaugucaguuccagaguucuuggaguucacauacagauagaaagguaaguaucuucaagugggaauaaaauuauucuaacaaucccauauagaaaguaagggcacauuugaaguaggaaaugucucuacauuugggacaggaaaucucucugaguuugcucggugccucuuguuaaaucauuuuaaaaagaagcagcuauagaauauagcagguagaauaugugauguugaacaggauuauuuuuuuccugcuauggcuuuacagugugcuuuccucuucccacuugacagucauggaggacauauuuuuccaccuuaggacauaucuuugagaauggucuuucccaacuaacuuuaucccaaacauggaauacuuugcugcuuaagcuucaaaccaagauguucuaauggugucguagaaaaguuucugaguaaugggcagaugccacuugcaucagaacuacuguguuccuucuaggauuucaccuuuuacuaaagcauucguuuaaauaaaauuaagacaugggauugcaaaacugacuauaaacacugauuuuuaauaaugaagacuauggaguuaggaguuggcucaguggauaaaggcacuugcugccaagccugauaacccgaguuuguuccuagaaccaagaagguccaaggucagaauguacuccacguuauccgcugaccucuauauacacacacagacacacagacacacacacacagacacacacacagagagagacacagacagauacacagagacacacacacacucuacaaaaauaaacugacauagguaacauacuuaaaaacauaaauuagugcuggagagauggaucucuggucaagagcacugacugcucuuccagaggcccugaguucaauucccagcaaccacaugguggcucauacaaccaucuguaaugggauccaaugccuucuucugguaugucugaagacagauacaguguacucauauacauaaauuaaauaaacaauccuuuuuaaauagauggauggguggauagauaaauacuuagauacuuacauagauacauagauauauagguacauagauauauagauacauagguagauagauacauaguuauauagauacauauauauauauauacauacauagauacauagguagauagauacauagguagauagguagauagauagauagauagauagauagauagauagauagaugauagauagauagauacacagauagauacauacauacauagauauauagauacauagguagagauauagauaauacauacauacauagauauauagauaaauacauagauacauagauauauacauagauaaauagauacauagauagauacauagauacauagauagauauauacauagauagauauauagauacauuuauagauagauacauagauagaacauagauacauagauagauacauagauagaugcauagauagauacauacauacauagauagauacauacauacauagauacauagauaaauagauacauagauagauacauagauagauagauagauagauagauagauagauagauagaugcauagauagauacauagauagauacauacauacauacauacauagauacauagauaaauagauacauagauagauacauagauagauacauagauagauacauagauagauagauagauacauagauagauacauagauagauacauagauagauagauagauagauagauagauagauacauacauacauacauacauacauacauacauacauacauacauagauacaucgauacauagguaaaacaaaccugugcucugcagauggcucagcagcuaaagggcuggcucugcaagccaggcaacuuguaaucaacccucagaacucacagaaaguucucugaccuucacaagugcauacacucucucaacuuguacacacaauaauaaaaaauuaaauaaaaaugaaagcagacuccucgguccccugagauucuuacucacuuggacuggagcacuuuggguguuuauuuuugcauuuuuauugcaaugcaaguuauauaacuugcuacuuuuuuuugcauaaucuauaaugccauugucucaaguaugauaggaaucacuugccaguuccaaaagucccuguguguuccugccuaaugccuucugugacaacaacugaccugcuuucugucacuguucuuugccuugucuuuuccagaguuugugugaggagagacauauauuauaaugcauuuguuugcuguuugucuggcugcuuuucucaacauaauugcuuuugagacgauccauguccuauuuaucaguaguucaguccuuuucauucacagggaucuguauuuuuagaaacucugccaucggccucuuccacuagccaggugugcaggucucugagggggguuggagccuugucugcagaaguguggugugagcugcccucucgaaagcuucucuuaaggagcuaccucuuagcuuauuauugugucaggaaagcuaagugucaggugacagagcuugcuguggcuuggagcaggggccccagaaugcacgccgucugugccaugguuucagcucacauucaccacuuagaagaugccuuaaacccuggaaggcaaugagauucaccauguccuucuucucuacucuauuucuuuuaugaucacguguuuucuucacaaguccucauccuaaaauucccccaacaugugugaauauuuuaccucgcuauuuggacaugucuucaaaagggccccauucucaaagaugucccagccuggccuuucagaggcccuugaccauguugagauuguggcugcccugaggccaugcuaugucauugucacagaagggucuuauuucauucucagugucccugggccccccaggagcacugaguuuggaugagagcagcugaacuggcuguaguccaacugucugcucugguucuggccccuguaaucagcugaucuuggucaaagucugcaggcugagggccaauagcaucgaucucuagccagugugauuucagcauuuccaaauccacagcucaguggagacagcccuuugccuuuugcccuucugcucacugugaugucccucuguccacacagggguuacucugcacagcuauuuccuaguguuuucuuguuacugcccuccugcugggcucucccacugagccuugauuccaggagucagauggccccaggaaaugaggcaggugcucagcucauguuccaagguuguuuauguuuuuguuuuuuaaaauuuaguccaggacccuaguccaugggaugccacacaugaccaugaaggcuagaucuuccguccuccucagauauaucugccugggaacacccucauagacacagccaugccuagagaugucucuuaauugauuccaaauuuagucaaauuggcaaucguagcauccuccaaucugaaucugacuaucuuauccucuuguuccccagccaaaccuauucuugccucuccacacccccaaucuccaguccugcccagagccuggguccuuguuucucuuggaagaguccuauccucaucuggcuuuaccaugcuggccacugccacugaggacacagauagaaauagaguccugagccuaucccacaucuauccaggaucugaauucuggaggccuguuccuaggaucuacauauuauucugaccucauaucauucugaugccauccacuguagugcugcuagcugagcacgugagcucaggcuaaguuccaagcuagaccccuagugcuuuauccgagugcgugaugugugagagugguaaacugaaugcugcacacaugucacugauuucauuguugugagaacaucagaggacaugcugaaugcaaaccaugauaauuauagagucacuuggcgauacaacuuuacuugcucccaguuaaccguuaguguacauggccaucuccaaauaaaaucacuaacucuuugcaaaaaaagcccaagaagcaaauguuagcggaaaaccuccacacagauaaaguccaucucauaggggcaauccuucuggucauagcuacuuuucuagccauucagucagaaauucagucaugugguaaaggaagccauaguacaguuuuaaauguaccuuaaauaauuauucggaaaugauaaauagaccuggauuagggaguaacuugauuucugagcauauaauuaaccuaguaaccucuuuuuuuuguuuuguuuuugguuuuuugagacaggguuucucuguguagcccuggcuguccuagaacucacucuguggaccaggcuggccucgaacccagaaauccgccugccucugccucccaagugcuaggauuaaaggugugcgccaccaccgcccggcccuaguaaccucuuauauuauuuuauaaauuucaucucugcuaaguuuuuuuuuuccuccaaauuuuauuuuuuagguuuuuaaauaccguaagcuucaagcuuuugacuggggaagcagugaaaagaauuauuuucauuacaaccagguaagaauuuucaaauaugcuuccaucaccgaagccagccuaggcuuccagaacucaggugagcccagcugcugggggaauauucucggcagaauugccugguuaugaaguuuucucucaguccacucagaucuucccagaucugucaguggugguauggcccaggccuccugucuccauccuuuaggcuguccauaaggggucguugugauucaguaggaucauaaacacacuccuuagaaccaaagagccuucaggcagcugccagcuugcuagaugugagaccucaggcauauuacauggccuuaaagccuuuuccauuaaguaacauuuccauuuuugaucacugcguuuccuaaagcgugagaaccuuucucucugcuuuuccuaauucuugaacuagcccuugcaugugugugugugugugggggggggggggcugaaagaucaggaaauggaggcauggaggaguugugugguuucucuugcauucagagggcaugaagagaugagcccacagugccucccuguucaguuggcucuacugccuugacuccacaucugggggaaaccgugaugcucacuggggauuaaguggucccuauagugcagcaaagaggaaaaaaccgcacaguucuacuccuuguaacgacuaccugaaaaacauaauggaagcaauucuuaaaacauguuuguuuguuuuuuaaauuaaauuuuuacuuucaaaucaaacuuacuagacauuuguuuuuccauggagauuucauuuauuaaaauaaaaaaaaauuuaacaggaauaauugcaaagcuuucuaugacucuuuuuuuuuuuuuuuccucuuguagaguuuuccucccucguacaacauaaaaaacaugcgucuacccacugcuuuguggagcgggggccgggacuggcuggcagacaucaaugacaucacuaucuuacugacucaaauccccaaguugguguaucacaagaacauuccugagugggaccaucuggauuuuaucugggguuuggaugcccccuggaaacuguaugaugaaauaaucagucuaaugaagaaauaccagugaaugcuggacuugaauacuuccccuucaauagaggggggaaaaaaaaaaacagguguuugcuuaauuucuguaaaauccuuguguuuuccuugccuaggucauuuguauuuuuuaugugcaagaaaaugaugacgucgaagguguacauugcucucugguuaauaagaagcacgcuagcugucuuaugcuucauugugacugacuagcaagcguccacaaccagugaugccuuuuaagugucucugugauccuuuuguuuaccuuuuacaguuguuuucggugcauaugugcugugcauauaugugccuaagugugugugggcuguguucuggcccuuguguggagguaauggcucacaucaaggugucuuccucaguuacuucccaucuuacuuuuugaaacagggucucuugcugaacagggagccugcuauuucaguuacacugguuggcccaugagccuccaggaucugccugucucuaccuucccccucaccaaugcgguggaauggggugucugucccagccggcauuuuuacccugauucuagggacaggaacucagguucucaugcuuguguagcaagcccuucacucaccgaaucauugccucaaaccuucugcaguagaccaagcuacucaguugcuuuuauauuccugcccaacacaagugagcacacacaggacauuucaagcuguuguuugcuagcaaaaauaagucugccagugaccugaacacacgaugaaaagcuccuugcucugagcuucauguggcagugcaaaccuacaauccuaguucuccagagguugagacaggaaggcugcuguaggacuuaggguucaucuagaaagcgagacuuugucucuagaaaaccaaagacaaaggaggaaaaaaaaaacccaaaguacucaguucucaucccuuugccuuagaggacugucuagcccagaguuccuguguuuaccuauccaaacaacauuuucauguuuuaaugcauuagcuuccuagugaaauccaguguaaucccagcuucuccaggaauaaauauccucucuucaguuucaucagaccucaauaacaaaauuuuucaggccaagccccccccccccccccaaauaagcguagacucuugaaaagcaguuugcacugauuaaaaaaauuaaaaaaaaaaaacuugaagauuaauacaaugagcucuguugguuccgaauguguagucuggucacuuuucuguggagaaacauucuguggagggacaaaccacugauuugccagaagcgaauauggcugccgugacggugccugcaugaagcuaaagcugguugugguggcaagugguccgauucccuuucacacaaaugauguuuucagacagagcucggcucaggaauuucgcuuugagaaucaguguuguaugcacaauguuuuacugagccugcuuugcuccugcguacaggaagcccacaucuguucacuuggcuugcuggcgauggcugucaccacuagacaguugauaaguuuucugauauucugauauuagguaccacggaugcaggaauauuacuugauauuggcucauacagacaggcagaaugauacaacuuuguaacaauuuaaagguuuguauuuaaacuuuucaauaaaucucagccucauaggccugaaca

SEQ ID NO: 9247 - RNA, 5510 nt, Mus musculus
aguggacugagauuucugaacugcucagcccacacccagcuuuucccagcagcacagaaacagaucaccaucaugaggucagugcaaucucugcuucuccaauuaaaugauaaacugagcugaucacugcacagcagagucuuaaguugucugcuugcuuguagauugaaaucacuugcaugagcauggcuuuuuuuuauuggaccuuuuucauuauuucucuguguaaaugugcaagacacugcaguuucuaaaacugcucacuggaugccccuggagaauauugauagacacggguagguccacugaagcacaaaguuugacucaaagcuagcacuagaggagucacucuuucugggauuuuuugguguuuuauuaaaagugaucaagacaauagaaaguugugugugugugugugugugugugugugugugugugugugugugugugucuaucugucugucugucugucugucuguguuuccaugugugugaguuuguuguguuuuucuguaugugugucuguaugugugucuguaugugugugucucauuguuuauguguaucuguguguguguuugcauguguguugcuauguguuuguaugcgauguauguaugugucucuauguuugugugucugugugugugcuuuuucaaaggaaccaauccuucgccagcagcuaguguaagaguuggaaacaguacugcaagcucaguucauguuugugaaaacuaugaccacuucaugauugagguuuuaagaaauaguucucacagaugagcagggguuuuauuuaaauuggguuuuuuuuuuuaauuucucauaugccacaaaaucucaaagguuaaaguuuuuuuucuaguaucuaaggcugcaggacaagcaaaaacacauuuccccuuaaauucaaacucuguuuaauuuguagcuaugaaagcagaacaaugguuaccuagagaugguaaggguagaauaugaagauacacacaggaaucucagggaugucauacauaaccuauaaggagugugggugggcacaugggcauaaacaauugcugagacccaguguacacaaaucauuaaaauaagugcauuguauuguaaguaaagaguaaucauaguauuucugauguuuuuaaagagauuuauuuauuuuguauauaugcauacacuuugggugucugcagacaaaccagaagagagcaucagaucccauuacagaugguugugagccaccaugugguugcugggaauugaacucaggaccucuggaagagcaacaagugcucuuaacuguugagccauaucuccagacagugaauuuuuuguuaacugaaacaauaccugccauuagaggagacucagagagaacuaagaggaagggcuaauguuucugacaaauauuuaucauggaaggauacaagccuuguuggcugagggaaggcugauguuauuagcuacuguggaagcuaagaaaaaagacagucuucccuacccucaacuccacggguaacaaggguuagcaagguucagguuggaaucacaggggaugacaaucaugcaccuccaacuacaucagcuugcuccuucccauagaaugggccucugagaagaucaguauuaguucugagugugguugaccagaaaacugacauguguagaacauuaauggcaagcugaacaagagacuuugauguguuuucuguuuggcugaauauagagcuaccaaucaaagcagguucuagcuggacccucuagauuaugcuggccaggugucuauaucacugcauucugugauaccagagguagcuugagcuguucuuccccaggaauguuagauauugaagaaugggguaaauaaaggaccugggaaggcaccuggccccuucuggauaagaaccuccuguaaagucucaugaaaagcucuuguucuagguacagcuuugccuguuuuggucuuuuagugucuagacaguaaauguuccuaugucuaaauuucccauaacccagguuaaccaaauugugcauuaugucugucucucuguguuaguuacauugcuuaggaugcuauuauaagagacccgaugaaagcaacuuaaggaagaaaauguuaauuuaugucagcuuagauguuuggggggacgaucacgcagugaaugcauggugguaacagcacaugcugcucucacugugguuagugaggaagcagaggcaggaaaauaccggcgcccagcuugcuuuauuuuauuuauuuuuuuuaauuuaaucguggacccuggcucagggugauaugccacccacacuuuggaagacuuguacuguaaaguuaaauguuuuugacaaacuuccuagacauacccaaagguguguuucuaugguaauuauacaucccaucagauugagaguggaaauuagcugacacagcaucuuucuccuuuauacucaaucuguguaagggcagaggcagggaagagcugaagucagucaaggccuugaagaugcauggaucacuccucuuucucaacagucugucucaggagagcagacaccuagaagacaacaccuagaguucuagcucagcuaaacaaauaauuuguggguugcuguuuuguaguuaucuucauguccuucugauuccucuucaagagugcucaaggauaauucuguaaucuaaagcuccaccuagugauuaugucucagaaaacaugaaauuccuuccuuucuuuucucuuuucugagucagaggcuccucaugucaccuuggcuggccucaaauguacacagaucagcugacuucugcgccacuccacuccugagugcugggcuugggaacguccaugaccaugcuaaguauugaaaucuguuuuaucagaggugggaagcacaguaucaggguccucuucuuucugaggugcaccugccaccuuguaaauuagaacagggauaaagaaugacaaccucugaaauuauacuauguuucuguccugaaucauaagcagcuuuugcagaugauuaaagugcaaaauugcagggaauucaagauucuugaaucaauaaaucuaaggcaaggcuaagaagggucauggguauagaaccgguugaaaaggaccacagauuuguuauauacaugcugaaaagggaguaauacuuacuuguggaugaaguaguccccagcaaggcuuccauuccuucaguguaggaaaaaccuccugcacuggcugugugaaucuguucaugggaacuaccacaaauguaugucagguggaagagaggaaagggugcagacuuaaaguggaauguuuaauuggaguuucaggucugagaaauuggccauuagaaaggagaggcagaaaauaaacaucuccaagaguacauggcucacauugucaugacuccgacacccaaaaaaaggugguuaauuuuucaauguccugaggcuccauccaguuaccaugcaaaauuaaacaucacaaguuacacaagauuugugggugcucaucacagugaccauguuuuuuuuuccgccacagugaggucaaccgggaaucucuggaagcgauccuuccacagcugaagugccauuucaccuggaauuuauucagggaaggaaguauguccagucauauggaagacagggugugcaaccaggucgaacauuuaaacucugaggagaaggcaacaauguaugacuuauuggccuacauaaagcaccuagauggcgaaagcaaggccgcccuggagugcuuagggcaagcugaagauuuaaggaagucagagcacaaugaucaaucagaaauucgucgacuggucaccuggggaaacuacgccuggaucuacuaucacaugggccgucucucagaagcucaggcuuacguugacaaggugagacaaguuugccaaaaguuugcgaauccuuacagcauggaaugcccagaacuugaaugugaggaaggauggacacgccuaaaguguggaagaaaugaacgagcaaaaaugugcuuugaaaaggcucuagaagagaagccaaaggacccagagugcuccucugggauggccaucgccauguuccgccuagaagaaaaaccugagaagcaguucuccguggaugcucugaagcaggccauggaguugaauccucagaaccaguaccugaaaguucuccuggcccugaaacugcugaggaugggagaagaagcugaaggggagcgauugauuaaagaugcuuuggggaaagcuccuaaucaaacggauguccuccaaaaggcagcucaguuuuacaagaaaaaggguaaccuagacagagcuauugaguuacuuggaaaagcacugcgauccacagugaacaacaguccucucuacucuuuggucaugugccguuacagggaaauacuggagcagcuacagaauaaaggagaugcugacagcagugagagaagacagaggauggcagaacugagacgauuaacgauggaguucaugcagaagacucuucagaggaggcgaaguccuuugaacuccuacucagaucucaucgauuucccggaaguagagagaugcuaucagauggucaucaguaaggagagccccgauguugaggaagaagaccucuaugagcgcuauugcaaccuccaggaguaccacaggaagucugaagaccucgcagcccuggaguguuuguugcaauuucccagaaaugaaaggucaaucgagaaggaagagguuaaagagcaaacauagcaagcagaucuuaaccuccaguagcaaauugugguggauucuuggcaguugcagggauaaaggaguggcugaaugguuuugggguuugggaggcaacgcacuuuggggcacaggcaggcuuuuccuggcaccaugaaccugaggacaaccggaagugugucagagugcagacagacagucucucagcucuguacugugagacagaugugcuguggagugcugcuuauggggagaaugugcugaaaaaagcaugagccuuccugccaaggauugcugacaaacugcucuugauuguuucuuuaaggaacugcuuucucucccugacuccucugcucauccuagccauacaauuuuccagucagcaaaccucauuacuaaucauguagggaauggagcuuaaagcagacagagcaccuuuugaucacauuuuuuuucucugcaauaaaugacaacucccaacaaaauucacucuuguuucuucauuccauuucacuguaguugcuuaagccugaaggauuaaccuuugccuaaggcuagaauauucuuugcacaucauuuuuguauucuacugugguuuuagggcugugugugugugaguguguguguguguguguguguguguguguguguguguguuuguguaucccuaagaaugauucuaaaguuaacauauaugccaaauagaaauuguagaauaaauguaaaaguuucaaucaaaauacagucuuuuguguggugguaagagacagcaaaauaauacagucuuauua

SEQ ID NO: 9248 - RNA, 1258 nt, Mus musculus
gagaguuguuggaaggaagguggagcacaagugcauggccuggagaagcugcaaguagugauuucauagcugggggagaaaguuguguagagguauaucugcccaauauaggcgugcagcuuauaaguauacaacugaguugcguuuucuuugcaugggcuuauuggaauuagagauucacagcaacaaacuuguguuuuccuuuaaugggcuuauugugguuggagauuuaccacaacaaaauggauggcuccccaaccuauugauuagagcucaacuaaccugagauuaaaaaaaaaaaaucacugucaauccucucauuccuaauacaaggcuaggguaucgaucuaagcugcagccguguguggacuaaaagcucacugggucugaagggccuacagagaacugcagagaggcuaaccacagguagacagcuucaaccaggggcagcaccccagccuggagcugaacuugagcagacacagugaacugaccgggcaucuacaccugagagagccuuuccguguuugcuucccugaaucuccccugucuacugugaccaagacagccagucucugaaucgaacagcagagugagccaaaaguacaaaaggcuccagaucagguaauaagcaucauacauuggaacuuaaagaugagaaacacaauaaauaucuuuuggucuuuaagggaugauauucugaaugguuugacuggcauggaguuaaaggagauagacaucuugucauuuacugguacugcaauauuuauucucuugaucuacuauaucuucucaaaagacagggcccuagauaaagaaaauugcuugccuuagaaaagagauuacagguaacacuaaaacuaaagguuaaggauuuuauaggucaagauaagcaagagaaagaggaaaauauagguuagagacaguaccuggaaaagacgcuagaaaaaaggauucaaugauucacagaucagacugaacaaacagcaaggagauagagauaaaauuuggaagcaaagucuagaggauaauuuacuaaagcuugaaaaucaaaaugaggcaggugcugcacuaucagaacuacaacauaaagagaagcuaaggaucuggaagcagggcuuagaacagaagauacaggaaauuauagagcaacaugaaaaacagaaagaaaaauuuaagacuaggcgauguggccuagaggaaacacuagagcugaagacacaggaaauuauagaucagaacaaaagacagaaaggug

SEQ ID NO: 9249 - RNA, 53394 nt, Mus musculus
uaaaguacaccgguauauuacugauauauuuauugaauuaaaauuauauacaagauaccaaucuauacagagguauuuaauauaucauaauauauauauauauacaaguaaauuuuagaacuuacaauuuacaaugacaaugaauauaaacuuuacacugaaacagucucccaaugcaauuuauuuggcugugcguguucgaagccgucguuugagaaucugaugaucaguuucuuuuacuuucuguuccauuaaaaucugaaauuaacaauuucaguguuuucaaauauagguaaaaauaauuugcuuaugagugauauaguaugugcuuauucacugauuauaauauauuagauuucauuuuuucuaaacaaauacauguaaaagaaaaacagauuuuguaagauucauucaacauucccuaauucaagaauuaaaaaaccuauaguccguauugaauccaaagcagaucuaagcuugaaauauuuacuaaaauauuuggacaccucaaaccaguuuuaagugaucagcugucacagcaauaguuccuauauaguaggaauauaauaauagcaauaagaggggaaacuacacuacucggaugggaaugugacuaguugaacaguaaaugaaauagcaagugguaacugacacuaaauucuuucuaguuccuucuggugccagcugguaaaauuucaaaugucacuucaugaugcauguuuguauguguguguguguaugcauguuuguaugugugugugugugcaugcauguuuauauguguauauacuauacauuauuaugauauuuauauuuaaguacuaauauaccugagacugaaauuauaacacccaucuuaagaaagcuaaagaaaagaguuuaggaccacaggagcuggagagaugguucagcgguuagaagcacggguggcucuuucacaagagcauccacauggcagcucacgaaugucugugaugccaguuuuacaaguuccaacacucuuaugaccucuacaggcgccaggcaugcauacgguauguauauauacaguaucccauauuaaaaauauaauguuuuaaaaagaaauuuuaaaaaaucauaaaacucaaauuguuacaaauacuuuggaauuaaaaagaaaauguauaguuuuauacuguugaaaaauaaaauagcuuaccacuuggccagauauguugaugggagaugaaauuucauuucuguauaauuuccguuuggcuuuuuuuggcugggacacauuuucuuuacuuacuucuaccguugauaacuuuggagaacucauuguuucaauuaucuuuuuugcuauaaauaaaaauguuaguucuuguguuaauuuucuaacugcaaagguuugaaauucuuaaugacaaauagauagaaaucaagaagaacagugcacuauacaaauggugacaagaaaugacuagauaauugaaaaacacauccaauaacauucaacagagagagggcagaaaagcaacaaaguaucacugagacucuagcagcuuuaaugacuuagaggucugcccacuguguaaauuaaaaguaacaugcuaaagucaggcaucacacacacacacacacacacacacacacacacacucccagaaaccugggaugaugaggcaggaagaguuugaguuucaggcuagccugugcuauacaggaagaccuuaucucaaaaacucaaaacacuaaauaaaccaaauaaaauaugguagauuugcuuugauagccauauuucaagaugaccauaaugacaauauaaccaacaaucuuuaugugcaugcacacccaauucauaguggauagauuuuaagaaaauuuacaacuagaaauuuuuaaauuuucugaggcauuaaaggcacggaaucaagaaaguuuggcaaccucguuagucuucacaaaguacuuucugucuuguuucaacuguaacucuagucuuuccuuccccaucuuccccacuuuuggucuccaauuucucuuauugcucugacgcagauaaucccacaaaaccucucuacacacucuuccuaccuggaauuucaugcacacuuuauacuguuuaaauauucuauauucugccaguauuaaaaugauacccuguaaugaauaugcacauaugcauguauacagauauauauaguacauauuuaaacaaagucauauauauaacaugucacuguuccuccauggucucugcaugagugccacacuccaauaauggacugugaugugaaauucugagccaauaaacuguuuguauguaagacaaaacccaaaccaccacaaggauacguaauacuaacaggcauuacuugcaaaagguggaagggugcagcccuacauuucaugcccauauuccauucccuuccuaaaaaagcuuucccaaaguucccucaucauucugauuggucuugucucuccuccaauacugcccaaccaauuuauuugcucuauauuauaauauauaauaaauauaucuuguuacgucugcucuaucuagaucagcuacuuaaauguuagccuuucuaguccaauaaauagugaacauguaggaacaucauuguuuuaauccaauucuucccauaguauccagaauaagauaaugccugucugcuuuaagcauuaggcuuacuacacuguugaguguauguacaacuagacauuaaaaagcacucugcacguauuuaaaaaggucauuuaacuauuccacaaaccuuuugauugaagaauuguuggagaaugcugcaagaagucuccaaauuucuguaguguucccucucuuuuuuuagaggcuauguuugcacuaacuguagaugcuuggcuccguaaggaguaaguuuucuuagaugauggaccaacggaaaccuaaaaacaaacacuuugucacugauaaugaaguggguuacacguaaacaguuauggccauuguuaauuaaaggaauuuguaauuaaguucauauauuaagaucgaaggucuaaacgauggcagaaccagucugacagcucgugugaacgaagugaacacgugaagaaaugacugcuaaugagcaaaugcuaaagguuauaucccagugugaauuacauguauaagaacuuucaauugaguuguaacuggacacaacuguaauuggacauaugaaaacuacuacucaaaauuugacaccuuaaauccaagguccugcuuuaucauguaaacagaaauggucagcuggagggagggcaaaccuuuuguuccuuuuugacaggggaauuucuaugcucugaaacgggaaacuucacauuacuucuggggguugaauucuucuuauuuucacauuucaccaaguccuacaagugaugaauguaguaacaguacugguuacuuuuuugauaauaauuucuuuagauucaagaagaauguccguaaauacuacauuacuaaucaggauaguuguucuuaaucagggucagcuacuguuuaaacaucaguagcaaugcugaaagcuauuuggucauuuugcuagacagaaagauuauauuauugacaacuaguggguaaaagcccaaaauaaaaaucacaaagccuuacaaaacagaggccucuggcuuagaagcaugagcugcugaggcugagaaaccauaggccaaagugugagcuuagcaaugcgauggagaaccuccaagaacuguaugggcagcucuacauaaucacuucccaucuccaaaaacauacaugccuaagaauucucacugaaaaaugaaacuucacaaaggcaaacuagggaaauaagauaugaucccagggcuggagagaugguucaucucagcaauuaagaacaauggcuuuaacuguucuauggcugaguguguuggcacucgacuuuaauuccugcaguuagaaagccgagccaggcagaucucugugaauucaaggccagccuggucuccauaguuaguucuaacacccaaggcuauguaaagagacccugucucaagaaacagcaaaaauaacauuagcuacuuuuucaaaggaccaagguucaauucccggaacccacaugauagguaaagcuccaggggaccuaacauccuccucuggcuuccauaugguacacaaacaaaugcaggcaaaauacccauccacuuaaagugaaaacaaauagguuuuucuuaaaagaagaaaaaaaaaaaagaaaaagaaaaaaauguauaugggaugaagcauuucagagcaagaguauauucagugaauuuaacugccacauuuuagcuguagucagaagaauacaaguguacacgaggugaggagaauacaggcagagcagcagaggggagaucuccaccaaauaucagaacccagguuacaaagcagaaggcacaaggucauaagcagacuacaugaagggcucaacaguaauuaugggaagcaaauaaggaaagauagcaaggcuagaccaucacauuuggauugcucaauaaagagcuucugggaguaguuaaugaaauagaauggaacacuguugaacagauuuucacaguggccccagagcugauuuauuacaacagugagauguaacgaaaucagauaacauuuucacauuucagcauuauaaaacuacaacaucagaagaucucaucagagauacugaugaaaacaucugagauacagaugaaagagggggcggggagaggaggaauugcauuuuaacuuuuucuucuuaauaguagaaggaaaagauguaccaaugaaacgucaauguaguauagaugauaaaauuuaaauauuuuaaucguauuuaaaaugugcuuaccauugggggaaaaauguuaaaaaucuaaauacucuauguagcacagggaagccaugcucaacacgguccacuaaggaauggauuaccugacagacagacaggaguaugguaacuacuauuuuuguucuuucaccagcuugaaaauauacucuuuaaagaaguaaaagaaaauuggggaaagguuucuuuccagacauguuaaguuuaaaaaagguaacuuuaaaaguaaauauaaucauucauuauauaccucccacagaaagagagaaaaagaagaacuuuuuuacaacacuaauacauugcuucugagaacuaaggaucagaagguuucugugacucuccacauuaaugcggcuaagaugcaaucaauacaaaguccagcagcccuaccaucaggaagcuguacuaacaaguuguaaaagcuuuuccccaccacuacaugaaggucugaauccuaauacuggcugauggaaaagaauuuauuuuccaagcuucccaugaccauaaagacuuaagauuuuaauuuuaguuaaaugacaaaaacacugaucaagcaagcuuguccuuucagucuaauuucuguaucagauauuuucuggcccaguggaggugauguaacuaguuuggaacacacuaguguacugaaauaggagucggguaagauccagcaucaugugaccuacuacagaugaacuauguaaggaauaaacaaauaagcacagcuuucugaggaccaugaagcucccguaucuagagugaguucuuaggaacagaacugggcaacagacauaacuaacuacccagauggcuacugaccuccuccacuucaccacucuuccucuuccgugccuuggggaucuuaauugugacuggugugggacaaccagggugcuucacugccauuuuguuuggcugcaaagguguaaacugaaucuccaauucagguuuuggaaaucgaguacuuuguacauuuucuguugacacuucacaagagucaagaacuacagauccguccuacaauauaaaaaugggagaaggcaucauuuacuuuuguaacauggaucuauaaaucacacagaaucaauuuucucaaaugcuguucaagacaaugacuugagaaagauaaaggacuaugggggcacccgaacggacagaagacugacauaucuacacucuccagguuacacaugguauauuaaaacagggggaaauagggucaagguucacuuccuaauaucaaauaaauuggaggcaauuuaagagacuggcauuacccaaauucucaggaaccuaagagagauauaggaggaaauucacuggacaucacuacaaaacaccaaagauaucaagacagaaacauccaaggaaaaauuugguauuuugaacaugcaccccaauuauaauaaauguaauccagcaacaaauucuuugugccuuuuuucauuuaggaaaugagucuuucauucuccuuccuuugaaugauuucuguagcuacuggagauuacaggagaccaugguucuaaagagcacaauuacaggagcaccaccacuuccauccugcccccucaacucucugggaugcuuucaggacacuucaccuauugaagucccaaacccaaauccagccacuagcuugugcacuaugcaaaaugagucacucagcauuuuagccucguugaugguaccaauaccacaaggacaguaaaaagacacagaagagaaugccaaacuugacucuuccaaaacuacaaaauagacaauaacugcuggaauuauuaauaggaaacuggaaccaagagauuuuaggacaaaguauauaaauuuauggggaaaguaacguuccaucauauaugagcagcaagagaagagcaggaguguuaucaugcuauuguguucucuaauccacagcaucccaagcgguguguguguguguguguguggggggggggggggucccuucuauccuuccaauaguaacacuacucuauauuagaggaccuucucuccaauaguccugaccaugcaaaugccaaucaugucucaguuuuguuugugcccuuaaguauuuacaaaauucccaaugcugaguaagcucaauauauuuuuuaaauaauugaaaugauuuuagauaguauggaauauuauuuaugaauuucauaauccaaauugaggaauucugcugaaacgcaaaaccauaaccccaauggaguucauuauaagagcuuggugguaguuauuacaaugaauacaauuuuaauacaaaguauaaugaaaacaaauauugaccuuuaucuuuuauagaaucuauuucugaccaucaaguuuauuuuuaugaacauuuuaaggaggaagcaaaagcccauaagaugaccugaggcucaucaccacaggcuacagaagaacagaaccaacccccaagauguucuuuggccucuucaugugccauguggcauacauacugccuacauccccaaauaacaccaagaaacuaaaauagaaauaaguaaguaaauaaaagacaagcguaauucugggaucuacuuucucaagagccucuaauuuuccuucacauaugucagcauauacauaguuaauuauguagcaagguaccuacaauacuugauuacauuauccuuguaauuauacuugcagaugauucauagcagguuaagagagcaaagaacugguugcauuacugaauaccaaccucugcuguguuccuagaaauuuccaaacuuguugacugagguucaguuucaacuccaccaagaucaacggaaucauuauauucaggcuugggauucaugguuugguuuuccuaaaacaaggaagcauuaaauaagaaaaucauuuuuaauuuaaaaaacaauacugaauaaaauuuuaaaaaugaagcugugcacagacucccauaaaccacuuuccauucccucagcuuucucaucuugagccucaggaaaggcuggccaacuuaacaccagccucugcucagucggagacguaucugaaagauugcacccacgugccauuacuugcgguguaacugucuaguuaaauguagagaucacucuuaagugggcaugguggugaaugguugugaucagcauucaggaugcacaggggaaucaugugcaugugcaucaugugcauguucaaggucacaguaagauucugccuuuaaaagcaaaaggcaaaaaacaagacaggugccucagcagguagaaucuccuggauuucagguaucacaaccugaauccaaucuguggaacccacaguggaaagaaagaacugaguccuaaauguuaccuucucaccuaugcaguugaguaugggcgugucugcaugccuucuauucuguucuauuuucuuaacaaagugacaagcuauguuaagccuuagcuggaacuuugaaucgcaauuuugauaaaaugauuuuugaaaaacucgagguggguuagcagaauggcuuaacaagugaaggcacaugccaccaagcaagccaugucagacugacacugaguuggauucuauaaccuacacaguagaggacaaaagucaauucccuguguuucugcucugacuuccagaaacaugcugcggucuauguguacacacacauacacacauacaaaauaaauauauguaaaaauuaaaaauaaaguaaugaaccuagaggcugcuuaguuaagcaaccacaacauuaagaauagaaaaagagaaaauaguaacuaaaucuuuucuuacaugccauuuuccuuuaagaaggggcuuauuccaaaacacuacuuaugggacucauaaagaaauacaacauguuuuuaacuuaauaaacuccaauauuuaucauagcacagccauucaagugugcucaugucaucucccuaauauuggcaaguaacagagauucuacauugcauucauauggagagcgagcaacucccaaguguuauaacuguaugaugcuaagaagacaguguucccuauuuuauugauggagauauccucacuaugcagcccugcuaggccugaaaccugcuauguagaccagguuagccuuaaacucacacagaucuacuuccaucugucucccaaucuucaaauaugccccgaugguuuauaaggaugugcuaucuauaaaagacaagcucccagauuaggauuuccaaccccaacuaaaaaaguaauugcuuugccaacuccugaugccucuucaucacuauacuuacuuuuaaaauauuuuuuuaucuuuacauaauaaaauuaauggugggcuagagugggugcauugguggugaugccuuuauuccuaguagaggcagguauaucucaacaaguuccaggacagacagagcuauacugagacugaccaccucaaauuuuuaaaauuaaauuuaauuaagagugggucuaauucuauaagacucaccaaaacuucaugccgaaccaccuuucuacauuuuuaagauagauuaagauaauccuaaauuauagacuuuuaauuauuuaaucugggaaguaugaaaaguaucaagacaaguuguuauauucuagacauugacuaaucaguaauaaacucaaaaaaauaaaaaaccaugaaaauauacaaaaugcuauauauccuuucugauauacugagucuacacagcugagaaguaauuuugaaaaguaauuuucaacaaggagauacagaaagagccggcguccacucacugucccggugcucuuugcugcagccuuucuuaguuccuggauuucuucauccuugugcuugcagcuggagagcagagccuucaucugugucucuacagcugugaccagcuggucacgcucuucucuccacuucugaagcucacuauuuuucucugccagcugugcugucaguguuuccuggacaacaagcacaaaggaugcauacugaaguguaaugacauagguaugaaacgucaacauggaacccauuaccuuguuucccaaccuaaagaacuaacugaaaaaucaaacauaaaucuuuguaaucuaagaauguacugagauuuuauuaaauauaacacaugaauaauauauauauuacgcauucaugugugaaugaaaugcuuauaaaauacaaaacaccauuuuaucuuuuaaguauauuugccaggagcagugguucacaccuuuaauccuaacacacaguagucagaggcaagucgguuccaggcuagccuggucuacacaaagaguucuaggcuugccaaagcuaauuagugagaaccuaacucaaaaauaaauaaauuucuauaaaucauauuuguucuuauaccaccuacaaaaaaaucaauuauuagaaauuucuuucaauaaauaauaauuauaguauuuauaauauuauuuccaauauuugaauaaaaaaauaaaacuauaguaaaacaaaugacauaccuuauaguaacuaaaaauaggaaaaugaagcagaaaacuggcugcuuuuucugcauuuaaggagaugaucauggaaaaaaacaauuaaaugaccauauccuuagaugcagaaaaagcauuuggccgggcaugguggcgcacgccuuuaaucccagcacucgagaggcagagacaggcggauuucugaguucgaggccagccuggucuacaaagugauuuccaggacagccagggcuacagagaaaccacgucuugaaaaaccaaaagaaaaaaaaaaagcauuugacaaaauacaacaccccuucauguuaaagguauuggagaucaggaauucaaggcccauaccuaaacaugauaaaagcaauuuacugcaaaccaacagccaauaucaaauuaaauggagacauacuugaggcaaucucacuaaaaucggggacaagaaaaggauucccacucuccccauaucuauucaauauaguacucaaaguguuagcuaaauaagacaacaaaaggagaccaaggggauacaaauugguaaagaagaaauaaaggcaucacuaugugcagaugacaugauacuauacauaaguggccccaaaacucuaccagagaaguucuccagcuaguaaacaacuucagcaaaguggcuggauaaaauaaaucaguagccuuccuuuauacaaaggauaaacaggcugagaaagaaauuagggaaacaacuccuuucacaauagccacaauaauauaaaauaucuugggguaacucuaaccaaacaagugaaagaucuuuaugacaauaacuucaagucuaucaagaaagaaauuaaagaccucagaaaauggagagaccgcccaugcucauggauuggcagcaccaacaguaaagauggccguccuaccaaaggcaaucuacagagucagugcaauccccaucaaaaucccaacacauucuucagacacugaaaaagcaaugcucaaauucaucuggaaaggcaaaaacaaaaacaaaaacaaaagcagaaaaagaauagugaaaacaauucuuaacaacagaagaauggcugggggaaaucaccaucccugacuucaagcuuaaauacuacagagcaauagugauuaaaaacugcaugguauuguuacagagacagacacauugaucaauggaauagaacuaaagacccacaaauaaaaccacacacuuacaggcacuugaucuuugacaaagaagacaaacauacaauggaaaaaagaaagcaucuucaauaaauggugcugugcugguauaacuggcugucuguauguagaagaaugaaaauagauccauauuugucaccuugcacaaauugcgguugaauaagggaaaagcuggaagaagcugaggaggagggcgaccguguaggaggaccagcagucucaauuaaucuggauccccgagaucucucaaacacuggaccaccaaccaggcagcauacaccagcuaauaagaggcccccaacacauauacagcagaggacugccaggucuggguuuagccugagaagcuauaccccucaagagacuggaggccccaggaaguuuagaggucugcuugugugagagguguggggugaagggugaagacauccucauggagacaggggcaugagaaggagguaugggauguggaauguggaacaguuggaggguggaccaggaggggaauaaaauguggaguuuaagaaagagagaggggcggcgggagggagggagggagggagggagggagggagggagggagggagggagggaggggauuuuuaaacaaaaaaagagcacuggcagcuuuucuagaggacuuggguucaaguuucagcacucacaaagcagcucaugaccaucuguuauacuaguugcagaggauccaacauacccucuggccucugaagguaccaggcacguucacacuacacagucauacauguagaauacacauaccuauaaaagaaaauuaacaacaacaacaaauccaaggaaaaaugaacauuaaaaaaaauucacuugugccagguccaagcaaguaugaaguauuguguuagaucacagcacacagcagauccgaauguggagacugcuagcacucgggaauaaccugggaagaguuggugcagcugucauuacaagcuaagucagucaacacugaaaauuucgaguuucaguugcagaggaaaguagacaucucuccagaacaaaaggaccagagcccacuacaaggaaagguaggcagagggccagagcgacagcuuaaacucuccucagaaaacacugcacugaucuuucuguaacaggcgcuugagagaagagaaaagggagucaaaaguccugucaagggcacucauggccucagcagaggaaggaggcaguggucucuuuuuccucuugacauacccaccagaacaguaacaaaugaaacaaaacaaaaacaguucuaaaaauccaguuuggccacgcuaggcccucuaugaaccacacucuggaaaaccagagcuguucacugaaauauggcccccaggacaccauuagccagaaggaggaaacugaaucagaaaaacacaguagucaaaggcagaaauguagucugagcuauuaucugcaguaaaauacagaagucaggggcuuccaccgacauggaccacaagggugggacaauuaucaacccacacuaccagaggccuuauccaggugugagauuaggaacuuggccgccggugucagaucaucaggaggccaaugaaagcucaccuaagggcauaaacaggaugagacacacagcuuuggaaaggcagugcaacaauaaagcugucaucugcaaguuggagaaggaacaccuaguguucaaacugaaauuugcaucaggcacgaucaaggcacuugaggaaaugcaaacuaaaacuacuuugugaucuuauauuauccuagaucagaauggcauguguaaggcccaacacaaaaauaaauaaauaaaugagugaaagcucaaaacucaaugucacaccuugaggucuuagaaaaacuaaggucaugagauaucucagcacgucuggcaaagcugaaggccugaguucaaacuccagaacccacaucauagagguagagcugaugcccucaagauguccucugaccuccacacaugagcugcagaaugugcuuaugugcauguauguacauauaugcaagcacacauagacacuaaauagauguaauuuaaaaaacaagucauuugcuagugggaaagagaucgaggcagagagggagggaaagaaaaagaaaggugaagaaggaagaggagagcuaaauccaaccugagcagauaauacgaacaagcuuugacaaacccuuagcuaacuaaccaaauuagagggaaaaauacaaauuuaacugagaaaauuuuaaaaugaaaaguagauaauacaacagucaucaaugaaaaaaaaacuauauucuaaauuagaaaauacauaagcagagacauuucuugauacaugggaagagaauauaaacuauuuaaauaaaauaaacaugagaaauauauaguaagaaguaaaaguuaagcaauuauaaaguuucccaacuaaaaaauccuaacugcagauggauucaaaccugaacuccaccaggucuagaacucacacccggggacugcacuguggcuaagacacucgcugaccucacagaggccccagauuccauucccaggacugccacuguggcucuuuacuguagguacaggggaucucacacccgcuucugacuccacagccaccacaaacagauggcauacauacagacacgcaagcaaaauacaacaacaauaucaaccaacccgaacucccaguacacauggagggacccauggcuccagucauguauguaggagaggauggcuuuggcaaacaucaaugggaggagaggcccuugguccuaggaaggcuccaugccccaguguagaggaaugccagggagggaaagcaggagugggugggugagcacccucauagaagcagggggaaggaggaugggauggggggucucuggaggauaacauuugaauuguaaauguaauauccaauaaaaaauagauauacauaugaaacaaaaauaaauacauuuuuuguuauauuuauguaugugcucaugaguacaaguaccugaggagucuggaagucagaggcaucugauccccuggaacuagaauuagagagagaggaaguucugagaugucauguggaugcugggacaugaacucacauccucugcaagaggaauaugugcucuaaacacuaagccaucucuccagcccucauaaaucuagaaaaaaaagccagagagagagacaggcaggcaggcaggcagagcacacguguguaccaaugcuccuuaaauuauccauagaccagaaacaggauaaauuuuaaauuuucucauuuuacaaagccaguauuacacuuauaccaaaaccaaacaaggacauggaaaaaaaauuauugaacaaucuccauagugaacauggaugcagagcaaaauauuauaaaaacaauggugcccauuuuuuccacuuauucaauaagacuagaugucucagugcaauaaaccaagagaaauagauaugaaaauagaaauaugaaaauacaaaaggaagaagucaaacuauuccuacuagcaaacaauacgauucuguacauaagaccacagagaaaagucuuaggacugaccuacguccugaacaaaguucaaguagcaguauacaaaugagcaaagucaguagcucaaggauaaacagagugaaaaggaaaaccagaaaaacaaucccauuugcaaggacuuuaaagaaaaauaaaaacuaaaauuaaaccuaaccaaugaagcccucuacaaugaaaaugcucaaacacaaagaaacugaagacacuagaacacaaaaagacuuccauauuuaagugucagcagaacuaauauuguaagaugccacaucaccaaacauaaucuacaguuuuaauacaacuuccuucaaauuccaaugacacucuucacaaaccggggggugggggugucaauccuaaaauucacauagaacuuuacaaaagaugacagaugaccaaagcaauccucagcaaaaggaacaaacuggagaaaucucaggucauacuacaaagccaugccuaaaacaguaccaucuuaguaccgcuuaaguacaaacagcauagcaacacacauguguuuccacagggaguaaaaaaagaggacaaagaugacacagacuuaaacucacauaguuaccaacaccguauuuuugacaaagauacuaaaacacaauaaaugggcaaacucggccacuucagcaccagggaaucuguauaacaaagugcagaauaaaaaugcuaagacuuucucucaagcuacacaaaaguaaacucaaagugaaucaaaaggccugaagcuuugaaacacuauaaaauauaaccauaggcaaagucuuucuccauuagugcaugaaauaaucucaagaacugauaaacaguauuauaaaaagguaaagagccugcauacacuaaaggaaauaaucaagcgacaugagaacauacagaauccuggcuagcuacacaucucacaagaugauuacuaucuaaacauaaagaacucaaacaaaauuaaaaaucaaacaaaccccauuugggcucaugagaacaguuuacuaaagaugaaagcacaggcagccaguaaacaugggaacuguuccgaaucuuuaacaaucagagaaacacaaucaggcauuuuccaaguggcuaaacgaagcgagaagaggcaggaaaacacaagaacgaacgucacgagcaaaugugggagggcuagcucacaaaaauaauuuuaacaaagcaaggggaagagaugagucauugccaccaaccacuucauucugcagcuuuaaacagcgcucccugucgucagcauauuuucucaucucccuguuucguacauuuucugcuucuuucgcuugagugguaaggacagcuuuuucuucuaaccacuucuuucuaucagcuuuauauuucucuucagauuccuugguaaagauaaaaguuauuuucgcaugacaaaagaguuaaguuuuaauaauaucugcauguaacccauccaguuaaccuuuuaaaacacuauaaaacaaguaguuuuuuuuuguuaaauaaagacaauuaugaauuuacuacagauuuuuaaaaaaacauuaacugggcuuauaaacaguaguuuccuaugaagucccuuuaccaacgaacuuaagacaaauuaaacaauugauauuucuuuaagaguuacagugacuacaauauucccaaaugccaucacauaguuccaaaaauaaaacacaaaaugacuuauaacuuauauaacuuauaaaaggaacauugagaauagaugcuuagagaauauagauuaagugauuuucaaacugaauucuauagaucuaagauuguucucaugguaauauaacuucagacaaagaaaacucuaaaacaaaacagcacuccuaucagaauuacaagcuuuguaacacaggagauuacauuaccucagaaaaaugcuaauacagcaacgaauaacaaucucaacauggcugauguacuacuguuugucacaauaaauggauaauuucuaucagcugcuuuuggauuuuuacaaugaaaaggauauacucucaaguauauaauuaaucauuacaaagaaaaaguaaauuuuccuguuauuuuuaguaauuuagggcacacugcuuuaaucacaacacuuuggaggcaaaggcagguggaucucugugaguuccaggaaugccagagcuccagagagagacccuguuucaaaaggaaaaaaacaaaaugcaaaaaaacucauauacagaaguaaguauggggccacacgcucauaaucucagcauuuggaggacaaagacaggaggaucaagguucaaggcaauccucaauauauguguguguguguguaugcaugcguacugaguuucaugcuagccucuaggaauuauuaaauaccaucaaaaaaguauguuucuuccaauuacuguauucuacauacagcauauuaaaccugaacaagaauacacaaaaauacaaaauagcuuucuuuuauauagcauauuuucauguuucacuguucagauacauaacacuacucuaauuugauaaacuuggaaaaaguuaacaacaaucaaagucucccaguggcugucuucugcagagcuauauuuacuaaguaaaaaguggaguagaaaauauauucaaagauaggaaaagcaguaacuuaaaaauucuauauacagugucagggugugagcuuaguagguaaaagugcuagcuucaaaagccuuacaacucagucauccuagaacuuaggcuuuaaaauauauacgguggcauacauaugcagucccagcacuccuacaacaaaacaggaggcagagauagaauuacccugaaccauugaacccgcuggccuggaagaugcugcuucacagcauaaacaagaguuccugucaacaacuccugaaaaaugucuucugaccuacacucacacaucaauuacacacauaaaacauaaaguugaggacacaaccaacaugguuucauuagcugaucauaaguuaugucuuggaaauuuuccccaggauauuuuucaaaaugcaaaguuuuuucucuauauuacuaaugcccauguaauauuuuacccauaaaacuaguuauaaaauacaaaaugcugaauucucuuaccagaaauacaaucuuaccaacagauacagcaagcugcuaggagggaggagggaggagaauaagggagggagggagggagggagggagggagggagggagggagggagggagggagggaaggagggagggagggagggagggagggagaggaugauaccugcagcucguccugaagcuugcugaacuuccugguaagcacgucuaggucauccaugguuccuguguuuaaccucugauuacuucugguuuccagaucuuugaauuuuucuuuccauuuauccaauucugauuuaaagugcagacaaauguuaugauagguagcaauucugauuuaaagugcagacaaauguuaugauauguagcgauauaacaggccaaaaacaagaaaaaaaaucagcggagcccaaaauauagacuaagaugggacuaaaauuauuccaacagcugaacuguacggagucucacaaaauucuuuaagacuacuuuguuuguacguauguaugugcaucgcauguauuuaugcaugcaucacacaugagccugguauacaaggaagucagaagaagguaucagaucccuggaccuggaguuacugaugguuauaagcuaacaugugaguguugggacccaaaccuggguccacuuuaaggacaaaaaugcucuuaaucucugagucaucucucuagcugcuguuaccaaauccccaguaaacaaaaacuacagggauuucucauguauccaaagauuauuuuuccaaguacagaguguaaacuuauuucaaucugaaauaacguauaacaaauucuugugguucucaaaaaauuuuuuuaaaaauuaaaaaaaaaaauuuaaagucugugaaaauggcuaugaaaguaugaaaaccuucauccaccaguucaagggcuuacagaguacucucaugcugacagaacacuaauaugcaaucacaaauaugccgcagucaccgucugcugugguucccaaauguagauaaugaggcuaacucagcaaauguacaaaauuauauguaaaaaguaucaaaaaaaaauaaguacauacauuaauucccuuuuguaccaaacuauaacuagcuuaguuauuagcaaguauaauuuucuacacgauacaaaaauaaaugauaaaaauguaaucaguaucaguauguacaaauaacaaacaaaucacuguuaaaagcuuacuuuaucaaucaaagcucacuuuuccuuuacaguuucucccccuguggaugaguguuuaucugcauguaugcaugugauccauguacaugccugggguccacugagaucaaaagaggcauuggaucuccuaaaacugaagugacagacacuuggcuaaaagccgccguaugggugcuagcaccuggaccuagauucccugacagagcuacauguacucuuaaucacuaagucuucuuucuccucagccccagcaugcaguguacuuauuucuucaugauauacaauuuuacuuagaaaaaaauaauuuucaucacaacgggaaaggcaagugugaaagaauuugaaacuuaugaauuguuauaaacgacacuagagaaggaagaaaucaggaaaaugaagcuuugagcugcagcugcucuguaccuguggcuagccagucugcuuccucugacuuggccucgagcacccgguccugcucugccugagucugcuccugcuccacuagcgucagucgcaugucuucaaccagcuucuccuuaacacugagaucugaagggaggaaagaaccaccaugacaucacaaacaacucaaaaucguuuaaaaaaacuuuuuaaauguguacaaaaauaaucacugaaacuugacuuaaacacaaagguauauccaucaccaaagaaaacagcaauguauaacagcaaucuucccaauuagaacaaugaauuuaacacaaucacuaccaaaauuacauauguucucacguacguaauaauaggcagacugauccuaaaauccauguggcaacguccagcaccuaacagagccaaaacaacuauggaggaggcacauaagcgggaggacucacaucucaaucucaaaaggcaucccauggcuuccauaauagugagcugaucccaugagggcauguacaacaauaaucagaaaucaaagaccagaaaauaaacuuaucacauucauaauuuauauuuucuaacaaagguacaaagauaaugaggaaagagaaaaaaauaggaaggcccgcuaucagcccccccacccccaccccccgcaccccagggauaacuguagaagggacaggaaggaaggucuugugcagaacaccaagcauaagaccuuugcaaaaccaaaucaaaccaaaucccagcauggagcgugaaauugggcauaaaaccccacuccuaguugagaagcuauuggcaacuguugccugcugggaaaggaaaggucacuuuucucugaggauagcgccugcuaagucagccucgcuccaguggaagcccacaaauccaagccacacaaaaguagcaaaaacugaccuuggacaaagggagggagggagggagugggcgggagggagggagugggggagggagggagguggagggguagagaaaggggaagagggacagggagagggagggagaggagacauaaaguugggagggacaggaaagguaagguggaucugagaauugggaggagagugaauaugaucacagcacauaguauaagauucucaaagaacuaauaaaaauguuuuuaaaauacacugagugaguauuacuuaauguuugucuaauaaucacaauuuuagguuuauaaguuauucagcagaauuaaucauuucaacauuuucaaagaaaaauguuaacuguuauuguacuauugaacagucaauuuaauucuagaacaagaacugggcucugaccuuugcacacuuucucauacuguuguacagcuucuuccauuuucugauuacuuaacugcuccuaaaaauuaaggaacacaauuaaaggcacacagaaaucaauacuuaacaguuguuaauaguaugugucagaacaugguccaggaaggaguuggaugagaauucugagugcuugugagaacacuccaaaauaaggacaaaaaucuugagacuucaguuccuucaaaaccuggaauuguuccuggaauguguuuugugcuccucuaaggugcaguguauagggcugacuugacuucagauuacucaucauuacuugcugcuguuacucaaugacauguuuaaacuauccuuuauauauauauauaccucuauggaaaaauaaaacaagcucuugccauguguggcuuguccuuguaugugccuugugacugaauacagcuugaccucaugacaacuuuacucaugugaccuuucuuaacucugagaauauaaacugucugaggcucugaauaacguaggcuauugcgugagacuuuagucucauucacugggucgauucucccagaucacaaagccuuuagaauagugaauacguaggucuuuauaggaccuagguguaguggcacacacauuuaaucuccaugaguacaaggauagccagccaaggcuauaauuagacacagugaggcgcugucugcacuguaaaaaagucagaaaacaaggugaguaagaugggccgaugaguacagcccagccaagccuagcaagcuccgcuccuggaacacaggauggaaagucucacaggcugccuguccucugaccaccacacaugacgugggguauacacgugcaugacaugugcggacacaccucuacucauauaaacaccugcacacagaaacaacacacgugguuuugacuaaaaauacagacaacaaucaaaaagauuauacuucuaauaucaguugucaucacaccuacucagaaauguguucucacauauccuaaaauguaaaaucaagggaaauggaaguauauuauauauucagaauuuguuuaaauccccauuaugaaguacaaacuauagaaaacauaagagcccucuaucaaaaaagcuguuguaaaguuugagaaaagaaaucaggagucuuaaggggaaaguucacuagggacagcaaggucuacaauucuaguuauaacaugucugaccaccaagacuccacucuccauucucaucacaaucuguagaccagugguucucaaccuuccuaaugccgggacccuuuaauucagucccucauguuauggggacuccugcauaaaguuauucuuguugcuacuucacaacuguaacuuuguuacuguugugaaucacaauguaaauaucuguguuuuccgaugguguuaggugaccccugugaaacagccauucaauccuaagggguugugacccacaagacucugagaaccgcugcucuacaaucuguuuuaggauggaucauuacagaucaaucuggacuaucauaacacucucucuagacuuacacaaagaaaugaucauaugguaguagggucugauggcuagugccuauaauccagacaucugagaaaagauggcagaagaauuugccaugaggucaaugccagucuagacuacaaaguaagacccuauugcaaagcaacaaaauuuaauacaguagauaaaaaauguaccuuauugggcaauagaauaauauuacagcagaauggaaugcaacuaucauuaacaacaaugaccgcuaccuuaaguugcugaaugguucguuguuucauaucuaaguccugagaauacugguuuuucuuuuucuccaguucauuaauuuuaauccucaauaauuucucuucaucacgcauuacagauaccuacaaagcauaauuuaugaagcaaauugaacauuuugagcauuuuuauuauuguuuaaauaaucaugaagucaugucuucagggaauauguccuuuaaucucaucagaaaagaacugauacuguuaaagguaauacauuacuaaguggcagaaguuuagcuuuuuuuucuauuccuugucuaagcaugcuuucccuaacucauuggucuuccuuucuccaucuuuacagccccuuugccccagcaaguagcuuccuguaucacauggccagccauauggucaaccuccuugucaguuaaacucaagcaccauuacuuccguggucccccucuucucuacaagguagcugccaagauuuacagcuugccugcugcuggaaagcaagaaaagggaaggggaugggaggguuggggagaggaaggcuggguucuaaagaugcuuucagauuuuuuucuuugauugagacaguuucucuguguaguccuggcuguguuguagaacuugcucuguagaaauggcuagccuccaggaugcagggauuaaaguugugcgucaccacacccagcaagauguuuucaauuuucaucagaagauacaggggugggggggcgggggauacugagcaaaggaaaacuaaagagcaggaaaaucauuuggucguauguauuaccuccacaaaaaaugacuugaagaaauggaauggacuuuuuuucccuccccaauuguauaauuaaauuucuuuuugaaaugauguuaaucuauagcccuaccacccugaagguggcaaacaucuaaauuaaauuacaaugaaaaugaguuauaaguuacucugccuauccuaaauauuaacuucaaacaaaacuacuuccuguuuuuuagagaaacaaauuuauacuuuuuaaagaaagacucuagaacuauauauaaagcauacauuaugaacuuuauucuuuuuuaaagaaauucuaguccuauaaagcacauacauucuguauauacacaccuuuggcaggcaggggucauuuccaaagcuauuacauucacauauuuuauuucaugauaauuucauuuuauuugaguuaguuguauuuucuuuuguaaaauauuagcacucaucauuuuggagaaaaauucaaguucacagauauucuuuuuaguccuaaaaucuaucccuaaucuuggaaccuaaagaauaucuguaguaugcccaacagcccacacagcuuuucauauaacucaccucccucuguaccugcucaaucugcuuuuuggcaucaaugaacuucucuuucagcucagcacaaucuucuuccuucuucugaaggucugcuuugagauucugaguaagaauagaguuugcagcaagcuccucuuucaaccuaaaaagaagaaaagaaucacaaacugcuugucuauccuaagcaccauuggcugcuuaggaucaaugugagaaagggggacgugucacagaacuacaucuuuuuacaacauaaaacuuaacgcauguaaacuagcaaugagugcuucaaggggugucguggggauuuggaggaguuguauguaaaacuuuuugcauacaacuguuguuucuaaagguuuuuaugaagaaaguucaaguguuucucucguuauauaugcuauguucuaccaaauuaauugacguccaucuaaauguacaaaagugacauagaaacaugaaagcugggaaccugcaagaguacuuaguggagagaggagcuugcugucaaaccucauaagcugaguccaauuccugggccccacauguuacaggaaaauggacaaacuccuacaaguuguucuuugacucccacaaacauguggguaugcacaaacacacaauauaaaauguuuaauuuaaauaagacuuagcucacuuuucugucucuugucugcuaauuucauuuucuucuuccuuugacugaaguaacuguuucguaucaugcaaauuauucgccaaccgugugacuucuucucugaacuugacuuccuuugcacuuagaucguugguucugaugugauccugaugcuuugcuucacauuccuuuagauuugcuuccaguuuuaagauggcagauuccuucucuaaaaugcuuugcucuaacucaacuaagcgcuuacacucaucuuucugggucucuacuaucaccucaagguccuuuauuuuugccuuguagcagguaacauccugggaaagcucugaaagagcuugcucucuuuccgcuacaagcuguacuugaacacggagacugacacuuuuuucuugcaguucuucucugagcugcuggaugagacuuucuuucuccuucagcuggugaucucuauucuuacccuggcucuccugugcucggaggucacuguucuccucccuguauccuuuuacuuccaccuguaauuuuucaauuuguucuucuagucccugaaucugaugagacuuuuuggaggaagccuucacaaucucuuuacauucuucccagauggcuucaauacucgcguggaaggaauuuucccugcugaucuccugagugugauauucuuuaacccacguacuugagaagucaccaccuggaagcugcugugauguguucagacaauuauccccuuuagcaccacuugauagauccuggagauuaaguaaaucuauuuuugaaauaugagaaggugaaucaagugaccgcaauucaucuauuuuuguuugcauuuguuuuaucugugaaacauugcucucgauacuucuugcagcagucuccaucuccugugauaauuucaggauccugucccucugcuccugguucacggcuuucuguguuugcagcucggcaacugcacuguuguaacuggccuggauuugcucuacaucugcccucagggaugaguucuuuucuucaaagaaacgaaguugcugcugcaaacucacaaccuguuuauuuaauucugcuuuuuccuccuuuucauuucugaguucauucucaccaauaguuaaaagucuuuuuagcucuucauucuuuuccuucaaaacucuauugccuuccacaacuucugaaacagacuguugcauuucucccauuuuguuuugcucuucggugauggguggacuaacgaguauaagcccuuuaaaagaacauugguauauuauuaaucuagaaaaaaaaucaaaguaaaauuccugaugaaaaagugaaauggacuuaaaaagaacauacagaacuuuuauguaaaaaguauagaccugggucagaguugacaaaaaaggucuaaaaaagugauggcugcuacuucugaucugaacauuuccaauauuuauuauuuaacuuuaaucccagaccuuuaccuuacauuaugagagagggaauuagugaaauucuagcaaccaacuacauccugaagaacaguuucaaaguaaagguacuauauuaaugauuuacagacugaaaaucucauuaaauuuuuuacagauaaauauaaagaggggguugaaauucucagaauuuauucaguaucaaagguaggacaugcagccccaccuuucacuaacuaaacggcuaaguccuaauuguuuccucacuggagaaaggagccagugcuaguggcucgggugcuguagguauaaagagaaaggcaagcgcagugcuuuagagauaggacagcugcuagcagaaucaaugcagggcucaacuaacuaagcacgaaugcaaagcacguuuguagucuuaacguguacauuucuaggauagagacugcucuggcggccuuacucaaagacuggcgcuaacagacucaaaucagagauucaggugaaagccugccguguaagaaggaaagcccaagauugauucccagaacccacaggaaaaaagcggagucauagcacacaucugaaaccccagcacugugucauagcacacaucugaaaccccagcacugagcacugagaaacgugcauguccggggcuugcugacuugugaguccagcuuagucaaugagccugcuuuccuuaacuugcucucuucagcauuugucagagcaguaaggaacuaagaccaagaucuaucuaucucauuuacuaugaauuaacuuaaaagcucacuagauacaguuuuaaguaacuuuaaaucuguaauaucuugagcuggguagaugggucagugauaaagcauuucuuugagaaguuccauuucugguacccagaucacaaucaucuguaacugcagcuucaggggaucuauugccuucuucugaucacugagggcaccaggcacacacauauacaugcaggaauacucagacagaaaaauaagcacauuuaucuuuuaaaacauauaauuuacuuuaucuaaaguaaauuuaccuccuaaaggaggagguaaaacuuuuggcauugucucauuuggcauugguacagccuucuccauaucucuuuuuauuuaauucuuauuguucuauugacgguuugauauauagcccaagaauggcucaaacacacacacacacacacauacacacauucaggccugagcacagggccacaggcacacacaacauccagcaacuuucuuaaaagcugcugagcugauuuucaaaguuuuccuaaauuugcaauugauacuuuguuaaugauuucuuaguuuaaagagacuagcaacucuacaaucuuaaggauuugaccuuuuucuuuuaacaaaguuaaccauuuuuaaguacuucaaaaaaguuuucaauuuacaguaguauuuuccaagagacuuucuucuagcauuuuaaguacaguacaaguacagguuuguuaguaauauuuggcccaaaaucugucaacuauucccuauuuguccaaaugcauaaaaaaugaagagugaaaaaaagaaugagaacagauuugggcaaaaccaccaccuuuuuaugaaagggacuucuaccuagcacagaaugaacgaugaggcagagugguaaaagcucagcaucuaaccgugcugauaacuguaagacagcuuuacauccaucucugcccugacagauuagagcaugcuaacauaaauacucauggugguuaggcuuuccuagugccugcucuugaucagguuguuuccuguuucugaggcaucccugcagguagcuaaagagccaguaccuuucuuugcugguggcucaccaagcugaaguccaucuucauuuaaucuuuuccuuucugaaugugucugggcucuacuguucuuuggcauuucacuuguuucauuacaaguugacuuauugcugguuaaagauguaucaaccuaaaacaaaauaauucaauauguucucaugcaaaaagccaaaaacacaggaacuacccacauuaccucucaucagucuguucucaaauucugaaaugcuuugcaugcuguuuacaucucacccuaaaauaacuggugccuuuggcagcagaaagcauuuagacagauaucacuaaagucacucugaaaacacccugugccucagcuggaaugagaaagcucauguucccagcuacucagaaaaaugaugugggaagauggcuccagcauacaagcucaagaccagcugaccaacacagugauagucugucuuuaaaaacuccuaagcuuaaacuaaaauaaagaacaaagugugcuuugaaauaaaaugcgggcuggugagauggcucaguggguaagagcacucgacugcucuuccaaagguccagaguucaaaucccagcaaccacaugguggcucacaaccaucuguaacgagaucugacucccucuucuggagugucugaagacagcuacaguguacuuacauauaauaaauaaauaaaucuuuaaaaaaaaaaagagagaaauaaaaugcaaauaaaguaucacauagauauuuuuauuaaucuacuuccaauaaccuauuauaguaauugguagacaguagacaguagguugccugaaagaaaucacuuuuguuuuucuccugcugaugcccuuaccuuauuaaagugagucauuucccucaaaacagauucuugucagaaaaacagagaaacauauaaauuauuuaaagaacagauaucugugagguguaauauagagagcuaccccugcccaauuaucaaaauauuaaggcccauccagccuggaguaggucucaauggcaggauguuugccauuauaauguaugagguucuggguuguagacuuaaaauauaauaacguaucaugcucagauaauuuagagaauaaugauugguacugaauauaacuuucugucaaaauacaaagaggucugauaaucuugcacguuauaaucauuaaaaacauauagguacggguguuuccacuccauguacauaugugcaccacaggacuaacuagugcuggccagaaaggucagaagaaaguaucagaucuccuggaaguugagguaugaaugguugugagcugccaugugaguacugggcaacaagcuggggccuucugcaagaacaacuagucuuuaccacuaagccaacauuccagcccccuagaaaagcauuuuaaacaaagcauguacacuuagcuaauaguuuauauguuaugguauuuuccuauguuacauuccuauacuagaaaauaauuuaaagauguucuaauuaaaaaaaaaaucuauaaaaggauucagacuagcaagauagcuaagcaaacucuugucacaaggcuaacagucugaguuugaucucugaggccuaugguagaggagcagaacugacuccugcauguuguccucugaccucuuggcagacaacaugcccaugccauguuaagaauuaaaggacaaauguauaauccucaccuaaaccaucugaauaggaaauuuguauuuaugagaugcuaaaaaucaaagacucucaaggucauaguauguaucuuucuaaagaaaacauacuuguaauaaacacaugaaaaacagcaauuuuauucuauuuaauuucauguuuuggacccaugacucaauaccaaccaccauuaucuaaauguauccaaauuccuuuauuuucagaaucccuuccaacuagccuaggcuaaaaccuacaguaugcuggcuuguuuuucaugucaacuuaauauaugcuagacucaucuuugaagagaaaggucaacugagauaauguccuacagauuguucauugggcaaaccugugcggccuuuccuugauuaaugauugaugugauagagccuaucucaaagcagcuguugacaccaccucuuggcaggugguccugagcuguauaaggaaucaugcugaggaagccacugaggagcaagccaauaagcaacacuuccuccaugaacucugcaucaguuccugccuccccauuccugucuugaguuccugcccucaauuccuuuggugauagacuauaauaugaaaaugaaagcugaaauuaacucuuucuuccccauguugcuguuggucaugguguuuaucacaccagcagaaacccuacgacagccagugcuaauguaugagaaggacuagucuccuucucaaauacagaguacugucagcauacuuaagaaaccauguuuuaaagcagcugaaugcccucuuuuacauuuucaacaguuuagaucugugcaacuaaauaaacugaccucaguggcaggauaaagugauucuuguuucuuagguaaaugacuuuggggugcacaugcaauuuaaaauaucucagccugaaccacaguauaaacaucacuaucuaauaaaaagaugcuuuauaaaguuaaagucuuaaaauauuuuaaaaugcguuuuucauacauuagacucugaaauguaucgacagugccacuccuuuaauucuaccucacagcucuuaaacgcuccagucuauaaccuuuauguuuucaaaggcggcaacucacuauguaguuccaguuacccuggaacucacuauguagacaaggcuggccucgaacucaagagaccagucuucuuugccaucucagugcucgaacuaaaggaauguaccucaaagaccagcauauagaaauauuuccauuaaaaagaaaaugacaaugauuggaauauauuugaagaaaacuagaauguaaacaugaugcagcauuagaauacuuucaauuuuuaaacaaaaauaaccaauagcaacaccuuaucuaguaugaucucauauuuuuauuauugcuacuuuuacagacagggucucagauagcguaggcuaacuuaaaauuacugauucucccuccuuuaccucccaaguacuggaauuagaagcauguaccaccauaccucacacaauauuacauuugcuuucaacgaaauguuaguggggcauaggguucauguuuuuaaucccagcaugagagaggcuaagccaagagagcugccauaaaucugaggugguguguguguguaaacacacauaaaggaaagagaaccaauaaauuaguuaagaaaaaaaaaaaaaaacagaacacccaaaccagucuuccuggguuuaagucuuugcucuuugaccuucaucuaugucauccuacacaggucauuuaguucuaggggaaaaaaaaauggcacaauggcacaagccucuauuucaguacuuggaagggaaggaagaagacauaaugucgaagcccugggcuacauggcaaauuggagggcacucugagcuacagaagacccaaucucaaaagaauaagcaauaaacaucuguaucaugaaauuguugauauuuaaaugaguuaauauuaaaaaaaacagcuaagagugccugggaaaguguauauauaugcauauguauacauauguacuuauguacaugcauauguagauacauauguauguauguacacacacacacauauguaagucaucuucuguucuuuccuuuuuuccucuuuaauuagaagaaacguuacaugagggcuuuauuuucaauuuuagaacauuaauaucauuuuaaacuauaauuacuuucaguacuagaaaaacaaaagaggacccacagguaaaacaacaauauuaaccaaccaguccucccagagcuaccagggacuaagccaucaaccaaggaguacacagggcuccagcugcauuuguagcagaggauggccuugucaugcaucaaugggaggagagguccuugguccuaugaaggcucaauagaugccccaguguaccccuacacugagggcagggaggugggagugggugaguggguggaggaacacccucauaguagcaggggaagggaggaugggauugguggucuggggggagggggugggaaagcagauaacauucgaaauguaaauaaagaaaauauucagcaaaaaauaaauaaauuaaaaaaaaagaaacuauaaaaccauaguacaaaaaaaaagaaaaagaagaauuguguaaacucacuguaaugucuaaaaaguauuguaucgacuaucucuucaaauauuagucacaucugaucauaucuuucuuaaaauauuuugcuauuuaacagcauaaauaauaagacagacagaaaaaguggcaaguucuuagcauuaaauuuacuuuagguccacaaucuuguuuuuggaccguuaauuauccaagccaccuagacccagcaucgguaacuaucugaccugaaguuaacaagcucugcccaccaagcagaaacagucuugggucagacuguacaaugcccaguccaccccacauuuaaaaacaccacacaauuugauaaacacuaguuaaugcaucaaaucaacauaaaacacaacuaaaauaauauaauuuaguauguagugacagaauuaauuucuagauuauccaauaaguccaaagauacaaucccauuuuuagaacauuuuaaagaauggaaguucgacauaagcauaaaguagaagauuggaagaaacuuucuguugaccaucacugaacaguagugcacaggugaagacagugcugagcacuuuuauauauucacguuuauuugcaacugugugcuugugucagugagagagagagaggggugugugugugugugugugcgugugcaugcacgugcacauaagugcaggggcccucugagaccagaugcuuugaguuccucagagaacuugaauuaugugcaaucugugauccaccugauggaggugcuggcaauuuaauguucugaacuacuggacccaucucuccagacccgaaccucugcauucuuuacaguaccuucauuuauagcgccuuucaaaacuauuuuaaaagaaguacacaaacacaauucauuccacuuuauucacucauuauauucuugccaagacaaaguaaaauuuaaauuaccuuacuugaugucuugagugccugaaccaaagagucuguaaagauaaagaauauuaauaagaaaaaucuaugcaucuaaaaacaaaaggaacccugaguggaacacagcuauuaaauuacacuaaauucagaaaacgaauuuugucagugcuauuauuaaacuacaagauuauguuucagaaaaaguaacuuucaaaauuuggaguaaacugacaaguacauguaagaaguagaaacacggugacacagaacuaacagguagcaccggccugguccacuucacagggcaccacugaccugcuaucuucuaccucucugcuuucacacaauaaaagguggagugccucaccucucuuaaaacccaaaugccacuacacuuaaagaucaaaugaaguaucagaucaaaagacuguuuuaaaccauuccaaaaacauaaucccacccucaacuauucaacguaaagguuucauaaaaauuauaaaugaacaaauuuaacuucuuuauacuuuucauuaugauuucuuauaaagacucuugcuuuauuucuggguugcuccuguuuauuuccucucaauuugagaagucuuuuauaauaauaaacgcuacuuuaguuauuuguguguguacacacauaccugcacaugugggugauguauacauguguaccgguagaggagagaggucaaccucaaaugcccuuccuuaggcacuguccaccuuacuccuuuugagccacaaucucuaucuaagcuugugcuuaguuaagcaaggcuggcuagucugcaagucccaagaccugucucuguccaugucccuagcacugggauuacaaacacaagccaccauguccggcuuguuuuguauagucuggggacucaaacucaggucuuaauacauggcaccaacuuuacugagccaucugccugguccuaaaaaauauuuacaguaguaaaucacagaacagaugguaaagauauugagcuuuguuauguagcuuaaaacauuuucuggucacuacaguugcacaaaucccuauacucaccaacaacagcuuuuauguauucauaaaaacccaaauaagaguaaaauacaugcacuuacugcucucucuguuuuuuagcucuucuugggcuuuaauuaauucuucuuuaguuucagcuaauucugcuuuaacuugauuaaacuuuagcugcaaacaggcaauagcuuccuggggaucaacaagagauguaauauacaaaugagcaaguucggccuguuucuuaauaucagugacaucaucuugaagagaaugaaaaauaucuucaacuccuacauaauuaugagcuuccuagaaauaacaaaaaccacaugucuaacauuaacaguggacuucaauacaugugggcauaccuuaaagauucuuuaaauuacaugacccaccuccccccaauuauuuaaaauuuguguuuuaauauucauuuuuuuaaaauauagaauacaaagcuuguuugcucaggaauauaucauaaaucuuaguaugucauuacagaacaauuugaucaucuaguucaguaugccuccaaucucauauggacgcuuauguggcuccuccauuucauacauaaguccacaucccaaaccacguucacauuacaccaggauguagugacagaaagcccgaagcucuguggccaugacauccagcgguugagaaacaaagcacagcacacacucagaacucaaacaaucccuugcaaaugcccucaucagcuucagugggagcagcaaaacucaucaacuuuccuggaguuauuuuccaacaaaggcaagccuuuucauacacaaguguuucugacuggaucagaacaauuaaguaagggacccuuuacgggcucauuucugaaaagaguauucuguaagccaacaaaaaugacuguuauugccuacaagcaauagugacucaagaaaaaaugaaaugaaaacaaaugccacaaaauucuaaguuuuucuaaaacuaguucuguuuaaauuguuugugcaucuagcaaagugacacagugcugucaucucuguacucaggaagccagggcaggaaaaaugggguuccagacaagccugggcuauauaaugacggucugucucagaaacauaauccaaaaacucuaccuauuuaccuauaaauauccaauacaugccucauuacaauaaagccacaaaguacuguuuuagacacuaauauuucauagcauuagcauuucucaucauuaaugugggguauuaaauccugguaccaaaagccucauuauuuuuaauauuuucauugacauacuucaguuucaaguucuaugucacaaauucuauuuguugguucaucuugacugucacauuuuccaaccaaaucuuugaagauugccaagcgacguucagcguuuucuucuaauaucucucguucaugaagaagugucucccuuuaaaacauaaauuaauuccauuaagagaacaauuuaaucauauguagcaucuauuuguauacagucaucacuuucaaaaauucacauaauauaaauuaagaaauagcuauuaaauaaauaaauaaaucucaauucuugccagguuaugaagaaauaacuuacuuaaaaucggcuucccguuggcuccaauacugagugaauuccuguguaacuucuucucggauuuuaaguuccaauguuaauuuuucuuuauuuucauuuauuagucuuuuauucaacuuuucuauuaaauccaacaguuccuaaaauaagcacauauacuucauagucaauuauaauuguauccuuuuuaaugcuaauagucuugcacacaacuauagauuccuuaaccugaaaaaccaaguaugacucuacauuuuagaaacaaaccauuacaaaaauaauauuuaucuuaaagacagaucuauaaaagauguuucacugucuagcaaacaaacauguacuguaaaaaucaggacacuuauuuuccacuaagaaguguucaguaguuauguuuucucauuuuauccaugaguuugauagcaccacauuucagaaacagagaauauaaggaccaaaucuauaagaaaugguaaagucgggguuaaaauguccuauucacugagcaugguaaccuaugacuuuaaucccagcacucagaaggaaggggcaggugaauucuaggccagccuggcuauacagugagauuguauacaaaaaaaaaaaaaaaguguccuguuagggaaaggaauaugacccagaagauaacacucuugcuauggaagcauaaggacaagaguucagauaccaccccugccccaacacacacacacacacacacacacacacacacacacacacacaaacuagauaaagcccagggaucucgaggucuagugagcccgguuaaugcaagagcaguggacucaagggcuugcuugucucaaagaaaggaaaaggcacugggcaugguggcacacgccuuuaaucccagcacuugggaggcagaggcagguggauuucugaauuagaggccagccuggucuacagagugaguuccaggacagccagggcuacacagagaaacccugucucgaaaaacaaaacaaacaaaaaaccaaaaaaaacaacccccaagccaaaaagaaaggagaaggcagggaccaacaccugagguuguugcccucuauuucgacaugagcaccauggcacaagucucaucacucaugcaugcucgcuugcgugcucucucucucucucucucucucucucucucucucucucucacacacacacacacacacacacacacacacacacacaucccacacuuauuccugacauugaccucugaccucuacaugcacauacucacaugaucauuuacacacauacacacacacacacacacacacacacacacacacacacacacacacacacaaaagagagcaucaagaaugauuccuaacuucaaaacaaguaagucaagcaaaguucuuaauacuaccuuguucuuuuuguggcagguggaaacucugcauuccucuaaugacuuaucacuaucuucaucuguaaguuccguuuccauguuuuguguuucuucauuuucuucuaaguccucaaccaaaucuucauuuucaagcacaucuucuagacuauuuucccaugaaacaguuuuucuuuuuacauuuaguauuuuauuguccaaauuacugucuaaugauacaucuuguaaagauuuguuagaugcaaaagauuucucuugagaagaacuuaaaguauccggaacauagaccuguuaaaacauccaacauggcuuuuacaagagaaaaggaaaaaacuucuuucauugaaguuauuuuuugagaguuucucaccggauagcaucggccugccuggaacucaucugccucugccugccaaagcuaggguaaaggugugagccacuccacccagccuaacuuuguaaaguuaagucaagugacaauuuaaauaccaaccaacauuuaaaaaaggaacuagcauugcuaaaugaaucuuaaaguaagaaaaaccuacuuugcacccaaucuauagguagacaugccuuucuaugaucucuguauuaucucuggcaaagauggccaucacucauauaggucagaugaguggcagagugaacaguucauuccauaauuacuaugaaucuauagucuguucaccacuaaugcauaauaguaaaugucauuuuacuccuuucagggacaaauucaaguuuuuccugguuuucuaguuaguucaacaauuacaauuuuauuuucaaguacuuccuagucucacaguaacagacacaaaauacuacuuauuucacagagccauuaccaaggcaugggugguggcacacaccuguaguuucacacugaagaagaaaaggcgggggaaagugggaauaucugcaaucgcuaggucaggcuaucucaagaaagaaaaaaaaaggcaaagcaaacaaaacaaaacccaaacaucugcucuuccaaggcaagcaguuaaugcugugagauggucauuauuuagcacaaaucuaaaaacacucacccuuugcgcagugguugagaacuucaggacauugagugucucaucauaggcagagcaagacugacuaauauugaugaucaugcauauuuucccuuuuccagugaaaaaacuuuggaaauagugggucaguuuacuuucucggaaaggcacaugcugaacccuaugggaaauuuugaaaauacagcacguuaaagcauauuuccauguaggguuauauggcucaguaugagagcucuugccuagaacauaccuaugcacgcacugcacacacauaucugcuaugagaagaaaguaaucacuacaugugguuguguaagaaacggguuuccagaaagugcuuucuaaagaaugcaaaguuagacuuucauauuuacacuaaggacacuuacuuugacuuuucacuguucuucaaaacauugauacacuuucccagagucaauaaagaaguguugauauucccagccucucuuaaccuuucaccuucguuuugugucuucaugcuucguucugaaccagcaagaucacauagagacaaucuaaaucaacccccgccccaaaaaaagguuacugcaaaauuuuucaaaauguuucaaaauaacuacaauuuuaaaaauguucaacuuacucacuaacucguguuacacgagguauuucagaaucuucuaucuguaauauucuaauagugaauaugcugugacuaaaaagaggaacacaaagaccaaguauuaucauuccauuucaaugcccacgugagagacaaacaucucaaacuggacuucucuacacuaguuccuucuaucauccgccacagguacauuuuugcaacuagcuaccagacauaucaaccccauacuccacucucacccaggccugcccaacuaucuagcaucaugucaucacuugccaaacaccaaaucccucaaaccuuucccucuuggcgcuccaauuucuauuaauuacuaauaaaaucauguguagugagauucaauaugcagcuacuugugaggauaaaucaaacaguucuaaaguuaaagccagccugggcuacugaaugggucucuguuuaaaaauaagaaguaaaacgauggcuggagauggauauaggucagccuagugcaugugaaacccuggacucgaccucuagaaccaugggggaaaacaagaauguccuuacagaggucauacuauuagugaaaaugcugugaucuacagcuacagucuuugaaaauauaccuaaagcaaagcagaaaucugcccuauaugcaugcugcuauagaucacauuaucacccuauguccaucucauuguagagagucaaggcauuucuuccuuaagagaaagaauuuaugcaucucacugauaaaacuuauucugucuccuaccuccuuaccccauucaucacaaacaucccucuuuaaccccuugaggccugaaucauucauuuuccaaauaguacauauuaggguaaggcagagagaaauggccaccucuuuaagcaacuaggaaaacuauccaggacacugacauaaacaguaaaaaaugccucagaaacauuccgcauauuagaaaaccuaauauccaggcaaaucaacuaguauuacagguaauuuucaugucuacaaauugacaguacauuugagaaauccuacuggucacauccaucuaaaccuagcuuccuacauuugcagcaacuacugugguuuucucaggauuguacccuaggggccaagacuuaccuucuacuagaagcauuguucaguuuggugaaagcaacgcucugaugcuucacuccuaguuuuaagagucuauaugcuucuuuagagucagauaccuggacccacugcagaucuuuaacaaauaaagaggaaaugcacuaauuuagaaaaaaacagcauuuguauuacaguauaaccuuuucaaaguauuuuccuagcaccacauaaaaucuuucuucuggucacacauccuagaacaccaacuaaaacuacuccuuauuccacaagacauguaaagauagacuauaagacacccuguauuuaaguuccgcaagcacacauggaggacuuaacauuuaacaguuccaauacaaagcaaaagaguguagagaagauccugcacuuucaccagcaauauagcuaacacucaagcaaaucaaccgggccagacccgcuucuacucaguuacaagaaacacaaaauauacuuccaaagcacaaacuucuuuuuuucugcuaaaaauggauuuuaaaaaauuaauuuaaaaaauucccuguuuauuuccuauacucaucacaaaaccuaauaguaauuuuggaacaauauuaaaauggucgcuaacauaccuuuuauaaaagaauagcccuuuauaucuugggaaagucguaacauuuuucucuuuugaaacuuagaggacacaggaacaaacaaaucguaaauacuuucauuguaaauuucaaagaaagaaacccacacagaauacuuuauauuauccacauucagacuggacuggucacaacuguucacggauucuucaaauucugggauagucaaagaguuuguuaaguguccuauaacaacaacaaaaggcauaaaauuaagaccuugacuaaauaagaaacagaaaauauauagaucaugacucuuaaaauccuuaaucucuuuaucaucuacacugaaacauuuuagggagcaaaggaacuaauauuuguugcaaucaaagcuuaguuucuuuuaaucuuacuuguuuugaaguaagaagaaaucaaauacaaauuaaugcaaaugaccaagaaaaauaagaacaauucucuaauuauauauuaaagucagagaaaauacauucaugauacuaaguauaaaugaaaccuuacaacuacucacaguucauauagcuuugaaacauuuuguagguacuguaggcacuacaugaucaaaagaucaacacuaagagugauucugaaaauaaaaccuuucaaauauauuucaagacaaguaaaugaacauaagugagaaaagaauccuuaccacaaagaacgucauaacugucauuauguaugguaaccuaaaaaagaaagaguagaguuuaaaaacacuuuuuguuaaaagcaaaauaauauuuuaaucagcuaaccaauuaagccaaaaacaaauucauaaccuuucaaaaacuguugguguugguguuggguuugguuugaauuuuugagacagguuuuaugaagcccagaauggcucauguauguaccagaguauacccuuaaaauucugaucugccugccucuauucuuaguugccaggacuacagguauaugcaccaugccuaguuuaaucuuauccaggcauccauacugauguaaauugaugaguacagagguccugucauagccagaagauauuacuucugguccucuccagacuuugguacuuacaaucuuucuguucccucuuccaaaauagguccugcucuuuggagugggaggugugauacagacauuucgacuguagcuaagcacuacacugacacuuacucucuguccuuugaccaguuguaaguuugaaauaggaucugggaugggagucacaacugaacaaauggcucacuuguuaaaggcauuggcuucuguugaagaggaccuaaguuugguucccagcaccauggugucucauaaguaugucuaacuccaguucuaagagauccaaagccuucuucuggccucuguaggcaccaggcauguacauguuauacauacauacauacauacauacauacauacauacauacacagacacacauacacacacacacacacacaugcaaaugcucauacauaaaauaaacagaagucuuuaaaaacagagacauaaaggaggaucucacuauguuuuccagacuagcacuaaaaaccuggacucaagaaauccauccgccucaguauuuggaauaacuuuuaauuacaggcacaccguaauuacuccuaaagucuuaaaagaggaaaaucauuacuauuuucaaaguucuaauuaaaacaaauuaauagcuuuuuaaucuuuaacaguaaaaauaucugaacacuuaaaauccagaaagacagaagauaaaaucauuuuaacucuuugaaacuaacaagguacuaucuuccauaaaacagcaucccuccauagcauagcaccccuucauagcauacuauguauucauuuuucuauuuaucagucuguauuaugguuugaauguccccacuaaacuuuauauugaauaauccccacugugaauuauuaagaggugauaggccaggcacuccacccuuuaauuucaacacuggcaauuaaaggcagaucuuugugaguucaaagcaagcauggucuacauagcaaguuccaagccagagcugcagugagaacccuguuucaauuuugaagggaaaaaaaaaaagaugugauuaaaucacaagggcccuggccucauggauuaauccauuuauuaaucaguagauuaaugauuuaucucagaauuggugagcuauaaaaaucuguuuggcucuauaccugccaugugaugcccuagacuaccuggagacucuguacuaaguccccacaaacaaaaaggcccuuccuagcugauaacuuucuggauccagaaucaguggcaauggcuaagaggguacaggcacuugguguugggcaugaagaccuaaguaagauccccauggcccaauuaguagagaaaacagacuuaucuaaguuucccuacaaccuugacagaaccagauauacagacagacacacucagacauacacacacccacauccacacaugcacguacucacauauuaaauuuaaaaguauauauauuuaaaaaaaaaaaaaaaagaauuucuggcugcagaacuaugggcuaacuauaaacuacccagucagaaguauucaauuauaacaacuauaauagucucucuacacaaaggcaaguccauauucccuaaacauuugaaacauugugagaucauaguacauugacaaaauauuacauacuaauauugaaaaacaaaagaaaacagauaaaggcccgggagauggcucagcagaugaagcgcuuguuacauaagccugaugaucugguuugguccccaaccaacagcagaaggaaaggaccaacuuuccaagucguccucugaccucauugguaccuugcacacacaacagcauucucacacacacaugauacccauaaaaaacaaaacugcauucugcaugcaacaaagggggagugagaguauagcucaaauaaccaguaucagaaaaauaaaaugugaaggugcugcauaugugugcauccauucagagacaaagcucucugcauaaggcaggaguguggugacccagugagucgagcacccaggacacagaggcaggaagacuguaaagcugaggucagcuaagcuaacuagggagccugucauaaaaucuccuuccauuucauacauucuuuucacuaaauuuuuuucuuuguauuauuuucaaaugaauauuucauauuuucaaaguauaauacuaauucuauaucaaaaaagacuaguaucauuugcauuucuacuuaguauugccauuugcugucuuacauaauuuugguuuugaaaaacacuaugaccaaaaccagauuauaauacaagcuaaaauuauccugauaguauacaaaaaaugucaugaauuugauauuuuauguacuaaaauacuggcguaccuccuuaauuugucgcagcaauguauuuuuguuagcacuuuccuccuucucuugaucagaugauaauuuuaaguauucucuacaucugugugguuugaagcucaucuucguauauagucuuuccugaagacuaucaaacaauacauucaguguucuaggcaaaauaccaauauuuucuucugugccuauaaaagaauaggacaaaggcaacuuuuuuggauuaacaaagcuccuuuuacacuaccuaauaagcaagaguaaaaaggaaaaaugcaagaacuuaaggaauuauucauguuacuaucauuuuaggcuuuacuggauugucaacauauucugauccgacacccagaaauuauauucagaucuagcccuaauauaauuuccuaucgcccauaauuacaaaaugaaaaugcaaaauuucucauuuauuccaugcuuaauuuucuaaagcauaucuuaauucuuaacauuauuuuaauuucuaccauauguauaaaauaauuuuauacauauauuugaauuaaauaccaucagcaacaucuaugugagauguuuuaaaaaauuaaaaggacagcuagauaagauggcuaguuagaagguugaggagaguuaggacaagaaaaugauagaauauagcuggggaggugguauaauuguaaagugcuuguccagcaacaaaauggacaucaguguucagggaaauaagucaaauguagaaaccaaguguguguauuuccucuccuaugcaggucuagauuuaaauugagaaagauaauaucacuaaauuaggaaaaaaacugugaaagugaagaagagaaaugaagggaagagaaggcaaaaacagggcuagaauauauguaacuaugaacauaugcaucauauaucuaugauauauaacaagcauaugcaucauauaucuaugauauauaacaagcauauaugcaucauauaucuaugauauauaacaugcaagcagaaagacuacugagaggaggaagaagacgagaagaggaaggcauggggugagugaguaaaguaggguaagugaaaacagcaugcaaugauauauauacacgaaaaugguggcaaaaugaaaccaauacuuccauuuuguuuucugagauaaggucccauuuuuuuagcucuggcuagccuggaacacauuauauaaaccagucuguccugaaacucaaagagcagccugccuuggccuccuaagugcagggaauaaaagagugcgccaauaccuccagcuccaauacuuuuuacauugucguguuuauaggucuuaaaaacauguacauaucaacaauauuuaacacucaguagguuaugguuacauauuuauucauauauuguggugguuugacuaggaguggccccauagacucauaugcuugcuugcuuggcccauagggaauagcaccauuacaagaugugaccuugcuggaggaggugugucacuguaaaagugggcucugaggucucagaagcugagucugcugaacugaauguaaaaacuccaagcuccuucuccagcaccaugucugcucgcauacugccauguuucccaccaugaagauaauggacuaaaaaccucugaacuguaaggcaaccccaauuaaauauuuuccuucauaagagugcuguggucauaguuucucuuuacaguaauagaaacuuuaagacacacacacauauaugcauaacaauaauaauuaaagaaaacgaggucgugaguuggagaaggagaguagagaagauauaaaaggagcuaggggagaagaaaugaugugguucuauauaauaaaauaguaaaacuuaaaauauggacuauaugauggaaauauuaugacaucauugggaaaauacugaauuaaugguucuuuucuagucaaaauaaacaguauuuaccuugaaauguauauguuuuuccagaauuggucagaccauaugugaagaucagucgacuguguccuucuaagagguccuuuacuggcugcauaaugcaacccagaaagaacucuuucugugaaguuucagguccaaaaaccuguaagaccauuuuaggauagagguuuuaagaaaauucauguuccaaaacuauuaaacauuuguuuugaaauagguaucauaucucuaccacaaaaguacaauaacagauauuuaacugcuauuaaauaaauguuuaggauaggaacuucaaggcuggcaauaugauucaguggguugaggugccugccaguaagucuaaaaaccugaguuaaaucccugagaaccacaaggcaaaagagaacaaagaaccuugcaagguccuuacaugcaugucacgcaggccauggcacacaguuaaucaaauuuaacuaaaaaauaacucuaagauagaaaacucacacauccaggggggucaauuuuucagaguuugaaaaaauguuuaauuagaauaagaaggacaauaaaagaauucaugacuaacacaaugauuuacuaagggacaguguaugugcuuuacaugugcacggcccucacucagucugcuucauagcucccucaaacacaaaagcuuccucagucuaacaggguacuuccucaccuuagaaaaacugaauuucugugccaccuguccagagcucuucucacuuaaguggccaaggaugcuuugagggucuuucagcagaacagacugugaauccaaaacuugcacacagcccuaggaaacauguccacaauaagaauugcauuuaugaaugaaagcgaaacauuaaaaccuaaucaaauucaauacaaaccucagccucauguucuuuuucugacuguguaaauggucuuauucgaagacaaacuugaagauaguuuuuagaucccaaacuguuugccuauaaaacaaaacaaaacaaaaaccaaaaagccauuuaaaaaaggaaaguacaaaacauagcuuuucggagauuaacucuucauacagaugauuauguaauaaucuacagaauuuuuauucaguaacuaaccuguauuggcuuuguuucuuaguguuucuacaaccaaggucuugcuauuauauagcuaaggcuagccaaagaugcacaauuuuuguuguuggugguguuuuuuuguuuuguugggaaaggcugucuuggcuagcauguggacuuuagaggacaacuuucaagaguugguccuuuccuucuccugugugggucuuagaaucaaacacagaugguuagauagcaucucaacaucaccuacucccauugagaaaugagccagcuaccaaacuguaauucucagauacugggauugcaggucugcaguuauaccuagucacuacauguuuagcuacuuauacauuuaaaaaaagaaaaaugggccggacagugguggugaaaaccuuuaaucccagcauuugggaaguaaaggcaggcagaucucugaguuccaagcuagccuguacuagagugaguuccaggacagcuaggacuacauaaagaaacucuuguccucucaccccccccaaaauugggugaaaaaugggaaagggcuggagagauacuuuaaggauuaagaguguauaguguucuuguagaagaccugagaugcuugcaaucccaccaacaauggaggaguguuccucuuucuccacauccucgccagcaucugcuguuacaugaauuuuugaucuuagccauucugacuggugugagguggaauaucaggguuguuuugauuuacauuucccuaaugauuaaggauguugaacauuuuuucaggugcuucucagccauuuguuauuccucacuugagaaugcuuuguucaacucugugccccauuuuuaagggguauuugguuuucuggaguccaucuucuugaguucuuuauauauauuagauauuagucuaucugauuuaggacugguaaagagccuuucccaaucuguugauggccuuuuugucuuauugacagugucuuuugccuuuuagaagcuuugcaauuuuaugaggucccauuuguuaauucucgaucuuacagcacaagccauugcuguucuguucaggaacuuuuccccugugcccauaucuucgaggcuuuuccccacuuucuccucuauaaguuucagugucucugguuuuauguggaguuccuugauccacuuagacuugaccuuaguacaaggagauaagaauggaucaauuugcagucuggcaguuccucagaaaaugggacauaguacuacuggaggauccaguaauaccucaccugggcauauauccagaagauguuccaacugguaauaagagacaugcuccacuauguucauagcagccuuauuuauaauagccagaagcuggaaagaacccagaugucccucaacagagaaaaggauacagaaaaugugguacauuuacacaauggaguacuacucagcuacuaaaaagaauuaauuuaugaaauuccuaggcaaauggauggaucuggaagguaucauccugagugagguaacucaaucacaaaagaacucacaugauaugcacucacugauaaguggauauuagcccagaaacuuagaauacccaagauacaauuugcaaaacacauggaacucaagaagaacgaagaccaaaguguggacacuucgcccuucuuagaauugggaacaaaacacccauggaaggaguuacagauacaaaguuuggagcugagacuaaaggauggaccauccagagacugccccacccagggguccaucccauaaucagccaccaaaugcagacacuauuuacgccagcaagauuuugcugaaaggacccugauauagcugucucuugugaggcuauaccagugccuggcaaagacagaaguggaugcucacagucagcuacuggauggaacacagggcccccaauggaggagcuagagaaaguacccaaggagcuaaaggggucugcaacccuauagguggaacaacaauaugaacuaaccaguacccuccagagcucaugucucuagcugcauauguagcagaagauggccuagucagucaucauuggaaagagaggccccuugauccugcaaacuuuauaugccccagugucggggaaacaccagggccaagaagugggaguggguggguaggggagcaaggggcuaggggauuuucgggauagcauuugaaauguaaaugaaguaaauaccuaauaaaaaaugggaggaaaaaaagaccugagaugggguggcgagauggcucagcgggaauaagagcacugacugcucuuccaaagguccugaguucaaauuccagcaaccacauggugacucacaaccacacauaauaagaucugacacccucuucuggugcgucugaagucagcuacaauauacuuauguauaauaauaaauaaaucuuugggucggagcaagcagggacugagugagcaaggccaaccggagcaagcagaaguccuaaaaaauucaauucccaacaaccacaugaaggcucacaaccaucuguacagcuacaguacucacauacauacauacauaaauaaauaaaucuuuaaaaaaaaaaaaaagucaggcaugguggcgcacgccuuuaaucccagcacuugggaggcagaggcaaguagauuucugaguucaaggccagccuggucuacaaagugaguuccaggacagccagggcuacacagagaaacccuaucucgaaaaaaaaaaaacaaaaaacaaaaaacaaaaacaaaaagacaaaaaagaagaagaagaagaagaagaagaagaagaagaagaagaagaagaagaagaagaagaagaccugagaucaauuccagcaucaauaucagacagcucacuaccaucuguaacuguaauuccagaaucugacaucuucuucugacucccuaaggcaucagaaaaacaugauacauacacauacacacacacacacacacacacacacacacacacacacagaggcaaaacacugauacaugcguaauaaacaaacaaaaccaaaacuaaaucugaguguggcagguaugcugucacacagcuauaaucccagauacucugaagguaaagcaggaagaucaaaaauggaagccuacaaaacauacgcaaguucaagacuagagugggcaacuuaaaagaucuuagagauacaguucagugguaaagagauugccuaacauauacaggccauggauuuuaucaagauaauucagauuucuuaaaaaaaaaaaaaacagauaaauaugagacgcuuuuaauguccauaggugaggagaagugagagggaacucacuugugagaccucaguauguaauuuuagucggagguucaggaauucauggucauucucaggcacauacaaguuccugagcagacccagauuaagugauagacagagacauagagacauagauauagcuacagauccuucucagaaacagcaaagcccagggcgccagggaugccgagacugaaggggaggaugagggagagcuacaaagagagacccugccucagaaaugaaaauaaacuuucuccuaacuggauaaaagucacagagagguagaguuugggauuaggugaguguuccaguggcuucuuuaaaccagcugugugauauucuauuucuaaauuaauuaaaauaaggugauucuagccagacaguaguggugcacgccuuuaaucccagcacucgggaggcagaggcagguggauuucugaguucgaggccagccuggucuacaaagugccaggacagccagggcuacacagagaaacccugucuugaaaaaacaaacaaacaaacaaacaaaaauaaucuaccagaugcacaauaccagaaagaaaaggccaccucucuccuaauuuuucaaagaagcggauuuaacaaucuaaaguaccuagcaccgugauuccuuggcgcacaauaaucaaguguuuuucuuacguuguacuuaccgcaggguuugaggcgacuaaggaaaacucaugagagagaucaagcuuaacaccaucaaaauugauuuccaaaggccuugcaauugggucagcacuaaaaacguaagacggucuaggcacuccaucuggauucaagugagauuccauccugcgagaagaaaagcaaccucuguaagcagccuuaauaaaucagcacgcaagccgccuacaauguuaagucuacuuggaacuccugggaacuuggaugcaguugagcugacagacuaccaugcacaacacucuggguuccaucccaggcauacacgggguaugauggcauggcucucuauacucccaacacguagggagguugaccuggaaaaucaccaaguuccaggucaucuuagcuacauaggguguccaagaacaaucuaagccaaagaccuugucucaaaggaaaacaaaauaaacaaaaguaagcucgauaggacagcaugagcucagaccacccaccccgucugcaaaaaguagguaaaucugugaguuugaagauagcccgauccauauagugagggccugucucaaauuaaccaauuaauuaacauaaaaaauaauuugugugauccaauuuuauuaagauuuauuuuuuucauuuuauguauaugaguacacuguugcugucuucaaacacaccagaagagggcaugagaucacauuacagaagguugcugggaauugaacucaggaccucugaaagaguacucagugcucuuaaccacugagccaucucuccagcccauaauccaauuuuuuagguagauuuacccaaagacaugucaugaacaaugcaauuagcaaaagaaaaaaauaugaacuguucacuuggccugauacccuccucucacaugucaaacagcagagacagcagggaugacuuaagaucuucugcuagucucguuacuuaguaucucccagaaaauuguugcaaaccaaauuuuaacauuuaggacuaaaacucgguuauuugcaaaauaaauuccuauuuauuuuccgauuauaaguaaaaaagugaaauaaugcauauaaacuuuacauuuaaaauaagagaauuggguccuagcccaguaggaugcaacucuggguaccugagguaccacagccagaaucuccaauaauaaugaugaugacgacaaugaaaaucacuaacugacacaucacaagguugaaugugaauauggaauaaugccaucacugaacuauuaaaucugaauugcacaucaaaucccuauaggauaaaccuaacccuccaccccccaaaaaauuaacauuuaaaauuuucuaagggggcuggugagauggcucagcgguugagagcaccgacugcuccuccaaagguccugaguucaaaucccagcaaccacaugguggcucacaaccaucugucacaaaaaucugaugcccucuucuggaguauuugaagacagcuacaguguacacacauauaauaaauaaauaaaucuuuaaaaaaauuuuuuucuaagaaucuaucacgccgggcaguaguggcucacgccuuuaauccuagcauuugagaggcagaggcaggcggauuucagaguucgaggccagccuggucuacagagugaguuccuggacagccagggcuacacagagaaacccugucucgaaaaauaaaaagaaagaaagaaagcaagcaucuaccagaugcacaauaccagagagaaaaggucgccucucuccuaauuuuucaaagaaacagauuuaacagucuaaagcaccuagcaccgggauucccuauuuaaguagaaagacaaucaucuaaauuuguuuacucuucacgacaggcucaaaauacagaccaacggaaguaguacuggacuaaaacugacucacuucaauuuccuuuauauacacauaaaacccaaauaugcuucuuuucuagccacaaaguaaugugacauuuuuuuuuaaaaaaagcccccacuggacucaaccuagaaagagaucuugucacgugacaaaacaacugcucaccucccgaauucaggcaaccagacguggcaaaucuuuuugugucuaauaaaacuagugucugugaaucuaaaguguaccuccuuuaccggaccaggaaaccgaggccuagacagaccgaagucuuccgccucaaggcuuaacucgcuuaacucccugaagcucagccccaccuucagcagccccgcaccuagacuacgggcaucacgagccccgacaacgcugacacggccgaggcgucgcagcuucgugcccucugugcaagcagccacccucggagcccccaaaaucgucagcuccucacuuacugcaaucgcuggucccugcacgccuccccaccugcagaauuccacuuccucccgguuuucaaauucaaacaauggcg

SEQ ID NO: 9250 - RNA, 2083 nt, Mus musculus
caugaucaaaauuaucuaaauuauguggugaauacucuuuagaaagcagagugaggaauugauuuuauaccagcuacauuacaacugucaaguuuacacaaaggggauuaggcugacugcagccuaaaggccuuuuuaauuggccacaguucuccuagguucauaaaugauaaaugucucaaaaugcuagucccaguucucuaugacugaugccaguaaauggcaagaacugggaaaaugcauuuuuguuuuguuuuguaaauuguguugaaauucucugcagagagugagccagugacucaguguauuuccaaauagagugucaucuacucauguucuguuucauagaucucaaacucucugacuacaguuacucucugcucaagacuagauucauuagucacgacuaaaaauggcauuaccauugauguucacuaggaaaugaauccauauaaaaccugaaagcaaauguguccuuuguucaaaaacugguacauauucuuccuaaacacacacacacaaacacacgcgugcgugcgcgcacacacacaaaucaaguucucucuucuguuaauuaauuacuugucuucuugcuuugacaaaguacaugagggaaggaauguaagaagucauuuauucugacucaguuugauuguugaguaguagggaugucaugauaacaggggcuggcagacucacaagaauggagaaauaucagaguuaaaaugaaaaauuguugucagagaaaucacagcaacaauacguguaacagcacgcaagaaaggcacaugagaucuguggcagaagacaaguguaauguaagugaccuguaagacauacaaacucacauaccuugugauuuugcaguauggaccuguccaggcucacuaguccacuuccauucuugggggggggggugcuuucucuccuucaauaaacuguuucuauuuguaucacuauccaaauucuccgacccaguucuuuguuucaggacacaagaaaccggaaaucucagccaaugccccucugccuuugauucacaccuauuacaggaguccaaggcaagagagucacaugcuagagcuuagcucauuuucuccuguuuauuucaucgaggaccuaccauccacgaaaagaugcugugggagaucucugcagucuccgaggacagcaaagguaucuaagagaaauaagaaguugaaucaguucgacucaacucaguagccaagagucugacuuugaguaguuuauauauuuuaggcauauuuaagcacagcacauuuugggggaaaaaaguuuccuggugauaauuaacucaauuuugugugcacaauaaaccuuaagguaugacuacacugaaacucuguuugggucacaucuuccgugaauguucuguagauuaaaugaacaaacagauucaagauaagggucuagggaagaauaggauauaaguagagacaagcucaguaaagagucuggaggaagaacuaguauggccuugguuacauagcucaaaggucacuauuaacuacaucaguucccagccuucuagguggaaaacaagugguuguacaucucucccuuugaagaggcaacccuguguguuucaaauuccugauucccuagugauuaucugugaguacaaggaccuccaugccuccuacagagcugcccacaauuaaagugggucuuuacauuucuauuaacaaacuagaagcucucucacagauauguccagagguuuauuuccauggugguugcuguuguuguugguagugguggugguaguggugaugauggugauuugguuugguuugguuugguuuaguuugaguugaguuugaguuggauugggauuguguuggguuuuggguuuuggguuuuuguuuuucugguuuuuuuuuuuuuuuuuuuuuuuuuuagacuguuucacuauauaucccuggcuguccuggaauucaccaaauagaucaggcuagcccugaauucacaaagaucuuccugacuaaaccucucgacugcugggauuaaaaggauauuccaccauaccagacagucauggggauuuuaaaucccaucacac

SEQ ID NO: 9251 - RNA, 4048 nt, Mus musculus
gggaaacucugggaagaagcacgagaguagagcaaacguguuuccucccugcucuccuuuagcugugguggggacauuucacagugaccauguuaauauuccuauugaaaacacucaccuuuggaaagauaaugagaagcagggaauuauuuugagaaaguaagguuagaugcugauacaagauuggaaagauuucugucucggugcaauagcuauuuaggaccuugacugucauagaaggcagauauaagucuacagcucaaauaagcuggaauuuuacagaacacagccuauagcagaagaacagagggugaauugguuguggccauacauaggaaguguggguuaccauggaaacacacaggaaaaaaaaaaacauuuaacucuggguuagggauuugaggaaguuuccuccauugugagaucgauacaacggaaaaccaaaacauaugaguggaaaaaauggaaugaaguguuuacuuuaggggugaccuugugaugacagacagcagggcauauucauuaaucuaaaaggagauuagugugacaggcaggugagugggugggagagaaaggggacuauagaagccacagucucuuuuuuuuauuuuuuaagucuuuuuauuuccgaauugguguuauguacagacaucaucaacacauguacagaauauuuuccacaacauaagagcuggaaauaaagucuaagggccauuagaaccaaaacugucccacagaaguccaaagaugguuucuccuuaaauguccuugaucaucucuaguacucccuuugugaacacauggaaacucugagcagacugcauuguggcuagcuagaugaugcuaguuguguucggcuucuccuucacgacuugcuugcggaugaugaugagugaagacuugauggccuccuucagagucauagacuucuugcaaggagcucugggcacccucugaagcagagccaauugcuugagcaucauacuguacuaaaggucccagauggguccaugugaaacaguuggguuccuuucucauuagcuccuccaaacaacaaugcgacuccaaagggacgagacauggcaccuguaucugcaucuucuucuccaaacugcaaagccagauuggacacagccugggucaugcucucaacugucauugucucauuauaggugaacccgggguucugugucuccacucuggcuuuaucaguuaaaguuuuagcaucagcaacuaucccauucauggcacaaccuauaugagcaucaaucuccacaauuuucucaaugcugcuaggcuccauuagcagagaggugauucucuucuccacaacuagacacauacccucggaugucuagaugccaauggccauagaaccaagcuugguagccucaauggcauauuccacuugaaauaaucuuucuucaggaggaaaaguaaucacacccaugccagacuuggacugagugaaggacauggagaggacaggaagaggcagcagugggggcuuccaaaggccacgcgacuaaaagcagcaccccaauuugaaguaacagacuuuuaaaaaacacuuuuaaaaauuaaguuuguuauuuugacaauuuuaugcuugugugcaaugcauucugauugaccuuaccucuacuuucucucaccugcuuuucucccauguauaauguccccucuucccagcuaauccucagcagauacacaacuggagacaguguuugcuuccuccucucacagaguccaucaguagccuguaauucagcacuaaggaaugaaguccuauguaccuauuccccacccuuaaguuauuuugagaaggugaaguuagauguugauagaagauuggaaagguuucugucugacagcaugugaagaaaacucguuuuuaauuuaaaugcuaugggaaccacugaacaguaaguagaacuguugaauauguccugguuauauugaaauaggaacuuuuaggaagauacuuccagcuacacaguggagagaggacuggaagcagcaagucuagaggcggagaaacuugaggaaccuacagaggguuugguaauccaggugaaagagacugaucuggauuaugaugaugguggugggccuguacaggaacaguagauccaagagacauuccgggaagagaccagauaggauucaaagagugguauguggaaaaauaggagaaauggguucaagguggcacccaaagaccguggcauggcuacauuuguguuaugaccuuucauucuauuuguuuuaugaagaacauucaggauaacaaugauacuugccauaccuuggccaucaggagcuccagccauaggccucccaccaccaugacuugcuacuuuugcuugguguagggucucuuucuggggugaguaguaugugguguguguguguguguguguguguguguaugugugugugugugugugagagagagagagagagagagagagagagagagagagagaggugcuuucauccuuacauggcacucuucuuuuggccaguauuagaagaaaaaucuuagauauaauuguaccuaguuuuccucagacuccaagcuguuaccacuuuguacuaugucaaguauggcauuucagcucugacggagacaguccuucuaagaauuagaaacacugguaacauuuuauaccuugcugagggcaguguuuucugacaaauaacauuuauaaauaucuuaaguugucugcaaacucagccccagcccaagaugccuugacacgaauuacagaguguuuuuggaguuucaucacacacuacucucugaauuuaguaacugagcgaauguaucacauaccaaauucuugcuuguuuaaagacauaaagagcaauguuuuccaacugaaguaauucucagaucuugaagauguuaacauaggggagccuucccaacauucuagacauauuuggagagacuuuaaggagaaaagaaguagaacuaagaaaacugauucaucaaccauaauaaaaaggcauggaaaguauagacuacauagggcuuaggaaaccugucuuuggagcuaaagauaagcuccauagcccaguucuuauccagacaaguguuccuaaauaucuucccucuccuccacuccuuuuaaaaucaaaagcagaaagcuucuauacaauggaagugaaauaauaucuccuucaggagauuuugugaagauuaaaugagggguguauuugacaucacaauggacgugacaaaucuugagggaugacaaggguuauuuguauguacgaccaagacagagcugacugaguaggaggcuaucaagaaaguaugaucuacuguuaacuuagauauuuucuggaacagagcaugguaaagaauacucaugagagguaaguccggccagcaugaugauguugaaugaacucgauguggaucuuacuguucuagagggaaaaaaaaaagcaacuguaaacaaugacaacagcagccgcaucagaaccagcagcugcagcagcagcagcagcaacaacagcaacaacaacuccgugggagggaauaaagauucucugaaugcggggagaaggauaguaaaaaacaugugauaagaaaauggauggcaaaaaucuguuguuuaguauuuuucgaaacguuacuaguuguacuguggcauagccuuagccagggaaccguagggguaaagcucucagcuacugcuccaacaccaugccugucuacuuuucaacuuagguuuuuugccauccauuuucuuaucacaaugcucauauuuucccaaaugagaaaucauugggcaauauuauaaaaagauacccacuugagucccauuuuucuuucucuuucuguaauacaauuaacauuuugcagaagccuacccucuugauuaucuauggcacuaauaauauguacuauauuagaagauaauguguggcaaagaaaugauacuauauugauauuugauuucaacuaaauguuacuuucuacuuacuucccuaacuggagaaauaacaggacaaauaaaaauuguuauucgca

SEQ ID NO: 9252 - RNA, 2068 nt, Mus musculus
auucgcucuacuccaauagggcccuuccaccucuucuagaauucgguaagcuaaaaguacauguauccgauuaaucugaaauaauuuuguagacaguuuggugacggguggagggugugugguugcgugaucauuaaacuucauuuuucuauuuuagugaauguuaaaaaacgauuccuuaaacauuaaguuguucccuuaggacagacagcucuuuaaaggggcuucucccugcuaacugagaacacugguuucgggaaaguccggucaggagaguuggcagguuccuguguccagggagagggcugagcgggacucauccguagccuucauucgcagauccuaggaugcuccuugccuccuguugccugcgcugaggucccaggaaucccagaguggcauggccaacgcgggcaugaguccuccgaggccgcgggcgucgcucuccccgcugacgcugcuguugcugcugggaggcugccuccucucggcugccgggagggacaagggggcagcaggcagggaagugacccgggccucccgacccacggucggcuccuccggucgcuucgugaguccagagcagcacgcgugcagcuggcagcucuugguacccgccccggggacgccgacuggcggagagcuggccuugcgcugccagaccccgggcggggcgagucugcauugcgccuaccgcgggcauccggagcgcugcgcggccaccggcgcccggcgcgcgcacuacuggagacggcugcugggcgcgcugcgcaggagaccacggcccugccuggaccccgcgccgcugccgccacgccugugcgcccgcaagacggcuggcucagaccugcacucgcccgcucaccccagccuacccgcgcgucccagcgagccgccccgguccagggcgcggagcccggcucggucgcgacagucggugcgguccccaagcucccagccggaaaagaagcccuugcuagugaaguccaacucgggcgggaggaaagcgggcucagacccaguuccggagccuccugcggcggccggauuccaacccaaugggcuggaccagaaugccgagcucacugagaccuacugcaccgagaaguggcauucccuuugcaacuucuuugucaacuucuggaauggcugaggcugcgggcuggcaaggggcacuagggguaggugcugagaagcagaggguagcgcagccgaggcgggagauguccuuggacagggaaccgggauggagaauaagcuagucggcuagucgggauuccaaaaugggucaggggucaggguaagaagaaucugaagcagcuggagagggcuuuuguuuuuuauuuuauguuuauuuuuauuuuuuaaagcaucucagcucugauuuaagagcagaagaaaaaguggaaacaaauagauuuauaucaaguaugggaaaauuguagacuagggagagaagcugagacuagcaagaaugaagugacuaaagaggugagaaucuuuccuaggaagugggauacaauguauaucaacacauuuucauuaaauguaacugugaguaagaaccugaaccauguugaauauuucaagaucuucuugguuuucaacuugagaaaaugaauacccacccaccccccuuucuggauuguuaugaacucugggugugacuggcaucacacuuucuauguagauuaaaaccuuauagguaaauaauaaaucuacgacuggauuaucaggacaauugcuuuucagucccuuugcuacuuuuuaacugaauuuugagccuacuguccagaaaaguucauuaacuaccuaaaaucagaagugaauuuuagaaguucagugcucucuagaucuccaaauacaaacaaaaacuccaagccuuuaaauuuugauuacucuuuuuaaaaucagcuaaaauguaaacacguaucugggucauuuggcccuucaucucuucugugauuaaauuuaaaauguguguguuuuuuaaauauguuguaacaacugucuuuaauuaaaaacaaaaaaaaaaacugauuggauuuaaagaguuguaaaaugaugg

SEQ ID NO: 9253 - RNA, 15019 nt, Mus musculus
acgcggccgaggcugacccgagcgcccggccucgcgccgccgcggcccggcguacuugacccggcccagaaacuggcccuccacgccgccaccccucaccuggcucugucccaccugagcgcgagagcugaggggacaagacgcggagaaggggcgcugaccuuguugcuacugacagcggagcgccacaugcugccgcuucccggacagcggcccgaaggacauuuuuuuuucccccuggaggaaggaaacgggagggcgccggcccggcggcggcgggcacggcggcgggggucccggcgggcugugcagccucuagcggggacgguccgaggacuacaucucccaggcugcuccgagccgccccugcgucgugaccccggcgcgcacggaggcggcgacucuuaccucacagagguagcuccuccgccggcagcagcucggcgccccggcgguccauggaccggaacccugggcggaccggcaggaacccgggccgcgaccgccgccucccggccccaggcuccuccuccucacuccccgccgcccucugcggucgcccgccggccgcgcagcgccaccgcgggccucugggagccacgccgggaggcuguguggcggguccgcggccgccgcgggacugaggccuacuccgccgccucucagugcuauugucccggggccuggcccugagcggggcugcgggcgagggccgagcucgccggcuccgcggaagaugccggaccaagcccuucaacagaugcuggacagguaggagcaacguggggccgggaacugccggccuucguccugggccugcccaugcuggccucgaggccccgagagcggggauccuggcguccgccgagaguuccacggcccggaggccgggaaaagggcucugaguuuggagguggcacuggggagaagagcgggcgagaggucagggucguagacuuugaaacuuaguuaaaggagggaggucuacuuuggccgccagccuguuuggguuuuuuuuuuuugguuguuguuuuguuuuguuuuuugaggugaagaggcgcuauuguuaacccauaguauuaguuucuauuucucccccuccuccccggacaauguaguaaagggguugacagcgacgccacugggaaguacccgauugucauucuggagacuggucccuugcacuuucacaaugcaaggauaggcauuccuucuuuuaaagccuggguuucguuucucuuuccaacucccccaccacccucccccaaucccaucccuacccccaaaccguaaggucagaauauccacaagggagccuuaacggucggucacacuagaguagagguuauggaaaacagccacaagcaugcaacauugaacacguagcacacuugacgaucgcuaaguucccagacacguuugggcuuguacugggaccaguugcccauuccuggggucuccagccacuaaaacucuuugagaaagucuacagcacugcccucugccguuuaaauuccagccagugaguuuuuggaaacuaaauuaaauccaccuuuucaccaaggcagcugcuugcuguucugaccaauuggucgaucuaauucauaauguuugagguugcuugcaacucuaaauagacuaacuggccacccacuucagcaggugaugcucucaaugcacuuaagauucagcuuugaaacuuauuaaaugaaggcccucucuugauugagguuauagccauuaacuacuggggcugggaggugggcaucaaagauccaucagggaaggcaagaaguuacacccucauauuuuaugacaggauuuagccuaaaucucugguacuuagcagcuauucugcuacaacuaaugaacuuguccguuucuccaguugucuagaagucuggucacuucucaaguuuuccuuucauuauaauuuaucauacuugacuagaugugucauacuaaguaugcccagagagauuacugccugccacaucgauuccaguuauaugagacgcaauccuuguauugcguaguuaaucauuugcucugaugacaucccacuuucacuuuuccgugacgacacuuagaaaaauucuucugucuagauguugucuuggcuuuucauguauucuucagagguuuucauaaaagccagugagugcucaugaaacauuuacagaaacuugggaauucuggcuauccuuuuuagaauguacauaacuuagucguuuccucucccaucacccuagcucaccuccauccucuaccuaccguuuucuucccaaguccuuucccauuccgagucccaucacccccucguuucugugugugugugugcguguguguguguguguguguguuccauuaaauuuaauuaggauuguuugcauaagcauggguccagguuauuuacaagagcaugggcguguuauuagcacaacacuaaauuuacucccuccuccucuaguagcaguauccaaaguucaggguaggccuggaguuuugagucccuccucuaucccugaugcaauaguguguagaucuuacacagauaaccacagguacgguagguguguaagcacaaggccagaagaccaaaugcacagcgcuccucgucucacaacucuuacauucuuucugcccccauccaacuguuccugccucugccauacucuguuuauccagugccaugcaugcuagauaaacacugguacaacugaaccacauucccauuccuuacuuuaacacugauaaugauucugguauauguagcccuacuugucuacuuacgcccucuacuggugugucugaggucagcuacuguguacuuauguauaauacuaaaucuuugguccgaagcaaguggggccgaccagagcaagcagagauccuaaaaauucaauucccaacaaccacaugaaggcucacaaccaucuguauagcuauaguguaagcacauacauuaaauaaauaaauaaaucuuuaaaaaaaaaaggaccucuugaacuuggaaagaaauuguugugauguccuuuuucuuccuauagcuauccuuuaccauuaagaaaacggagucggcuuuuuaaaaauugguuuccucaguugaaaauugaauggucugagaauauggcucagaacauucugccuagaauguuuguaauccuggccugaaggguaggggaacuauauaugaaaacacuagcacuuuguuuuucuaaguucaagaggucuuaauaagcagaagauacuugaaacugugccuguaugcuaguuuacuagucaggggaaauuacuagaaagauggaguccaaaaaaaagauagauaaaaacaaaguucaaaaaauagguucuguaguggaagauaaaaaacaaaccagaagaaaagcucuacuggaaauagauugguuguuuggcucuguaauuuuuacaggacuucuucaauacugcaugauaguuccaucccauuagcuaagagcuucaugcaggaaggagacuggaacccuaaagauaaaacuuuuuuuucuuaauuuacagaaguugcugggugugcuuugccaccgaugaagaugauagaacagcugagugggugagaccaugcaggugcagaggaucuacuaaguggguucaccaggcuugucuccagcgcuggguagaugaaaagcaaagaggaaacagcacagccagaguggccuguccucagugcaacgccgaguacuuaauaguguuuccaaagcuggguaaggacuaauggaagaacaacacagacauguucacuguuuuauuucuguguguguguguccccguaguuaaaagcuuuuuuuggggugggggaaggaagaggugaagaccugagauaaggucucacucuguaucccuggaauucaugacaguccuccugccucauccuccucaauugcugccauuaugagcaacaacacccagcucguugguugguugauugguugauagguuuuuauguguaugaguguuuugccuacaugacuguaugggcugugugcaugccuagugcccaaggagaccagaaaagggcauuggauccccugaagcucgagugugaugguuguaagccaccaugugaguguugggaacucguuccaguuccccugcaagagcagucaaugcucuuuacucuccagcuccuuggauuuauuuuuaaaugauuucuuuaucuuugcuuuuuugugaauuuauuuuuuuucucucuaaaugucagacacuuauuuugcuaacaguuuacaauaucuuuaacaaguccccagacuugccuguuugucaguacauuaaauauuuuuauuugagaagaaaaggacuuuaugacacacuauggauguaacaagagaggugacuuagggcuggggauacagcuucaucaguaaaguguuugccuggcaagcuugggaacccgaguuucguuuucauaacacguguaaccuuagugcuagagaagcaggaacaggauaaucccugggcuuacugcccagcuagucugugcuagcugaucaggccaaugagagaccuugucucaaaugagauagauggucuuucugaggauuacaccugagagugcauaugcauuaaaggggguaagggguggacauaaggaacaccuuucuuuagagacaguuuaagagaaaaagcagcagugaguauuccaguauucuuuaauucuuguauuaagaaacaaaaauagaaaauuaaaguuuugcuuuggguuuuagcuaugcuaggcacugaacucugagacuuucccauuuuaggccaguguucuugcucaaccacugagccaauacaguuaaauucauuuuugagaauucagcuuauauuguaaucuuucaggaaaacugcccucuuuucugggcauuacuggacaugaaaauaaccagaagucuuugagaaugggacuagccuggaaaaaauuaucacucuguucauuuauagccauauguuucugagcuagugucauuuuuguaaggaauguauuccuugcuauucuuaaaaauauuuuuuucccgagaaggauuucucuguguagcucuggcuguccuggaacucacuuuguagaccaggcuggccucaaacucagaaauccgccugccucugccucccgauugcugggcuuaaaggcgugcaccaccacacccggcuuaaaaauauuuuuaauauuaaccuuaccaauaacaaagagguauggaggagcugggcaguguuggcacauaccuuuaaucccagcacucgggaggcagaagcaggcagauuucugaguuugaggccagccuggucuacaaagugaguuccagaacaaccaggcagggcuauacagaggaacccugucucgaaaaacaaaaacaaaacaaacaaacaaacaaaacuggcuggaacaucucuguaaucccagcauuugggagaggaaagaagaugauacagaguucaaggccaccuuagacuaugaggauguucaagaguggucugagcuauccggugggacuaucacaaaggaaaaaaaugaccuaaggaguuuucuuuuuucuuguccuuuuuauguauaugaauuacacuaucgcuaucuucagacauaccagagagggcauagauccucauuagagaugguugugagccaucgugugguugcucagaauugaacugagguccucuaggagagcaaucugugcucuuaaccacugagccaucucuccagucccagguauuuucauuuuaagugcaaaacaauauuuuaaaacauuguaaacaauccggaggcaaacagauaucuaugaauuuaaggccagcuuugucuacuagcgaguuccaggacagucauagcuauguaaugaggcaucacaaaagaaggagagccgggcggugguggcgcacgccuuuaauccuagcacuugggaggcagagacaggcggauuucugaguucaaggccaaccuggucuacaaagugaguuccagaacagccaagacuauacagagaaacccugucucgaaaaaaaaaaaaccaaaaaaaaaaaaaaaaaacaaaagaaggagaaagcacuuaaaguagguggguggacagauggcucaguguucaggugugcuggcugcucuuggcugaggggaaccugaguuugagucucagaaccuguguuggacaacucgcagcucuagcuugagcaccugaggauuugauacccuucugaccuucucaggugcacacauaaauaaauaaccuuuaaaaucauucagccugagccuuuggauggaagugcaagguuugaagguucguggagccacacccagcuccgcugaauccaaaucacugccuguagcaaaguuauguuuguaaugucgugacgcaaaacugauuacuccuuuuugaguagccuaauauguuuaccuaaaauuuuugguuugauuuuugucacuuaaauuugaaaugcaaaaacuuaaauuuaccuaggauauuaggauguuucugucuuuguaagaaucuuuguuauuuaagagaauucacaauaagcuucuuuauaauuuaaaaaaaaaaaaagcuuuucuaguacccuuuaaauuauuagauuucuaaaaguugguguugauucaaagcuucgguugccauccaucauguaauggauguacuguugaaagugccggacccaccgagccauugaaaauugaaugacguggaguggggagcaggggugucguuuaguggcagaacacaugcuugccaugcgugggauccugaguuuaaucaucagucagugcugaaugcuaacacgucaugucuaaaguccugaaccuuuguguccuuagguaacugguacugagcauuuauucaugcuuucucuuuccgauuaggacaggaguuuuuaagggccuccaacacuccaaagcucuuuguguuguaaccuggugcuauuuuuccuaaaauuauaauccccuacccccauccccuggucaugagacaacuucaccaaguuccugauuagcacacagaauuggggauuuaccauucagaggauuucggaaaaaaauuuuuuaacaaaauacuugccuuagauaaucuuuuguucguagaaauaucuccucuggcuaccauuuuaucauaaugguauguuugauacuaaguauuuauuucuuccuuccaaauauuaauacuaaucuuagacuggucucucaggaguaaugaaagauuugggugaaauaaaauuaagauaaaagacaagacaagaauuaugucaggaaauaucuagaucuaaguaaaucagcccauuccuuaauuuuucuagacauguguuuuaccuauaacccaagggauagucacaaaauuuccaaaagaaaguauaaggauuuggggauuuuguaaaauuuaaaaauucacaccagauaauuaaucaggaaaguuuagcauauuuucuauaguuuaucagaaaaacaauucagacaucuaggcuauuguccauagucuaauaaauaaaaguaauuguggccugccuuuuaagaauucuuuucacccaaauacauaugacuuauauaaauuauaucacugaacuaccaauaguuucauuuacuauauacauaccuuaagagagaauucaguuaaacaaauacuuggggauaauaagaauuugaaauauaucaguaaguaaaucagaccuuucccuuuuugagucuguuucaaagcaggucucuucuguaaauauaguuuuaaacucugcggcuggccauuuuucaguaaaacauuaguuacaaaaauagcuguuggauuuggccaagggccagugguucuccaaccauuguucuaauacugaaaauagauaaggaaaguauguucugccaugaaacugcuuuaggaaaaacagaaauaccacgaagaagaaaguauggugugguaggaauugucagagggaacuuuauugaaguaaagacagaaucagcaaaggaaacugaaaauugaguaaugaaauguucuggauagagaaaaacccaaccauaugucagaaagaaaauaugucauauguagcugauaguauaaauaaaugggacugagauuagaccacugaauuuagauaaguggagguugucagugauaccaaggaauagcuuggguggaauagauucauggaaaaauuagauaauuauucaaauacuuuacucagaggaagcaaggaaagggaauaguaggacaaaaaggaucaaaagguuuuaguaggcugaagccuuuagucccagcacugggcagguaacgcaggccaaccuuugugaguucaagggcagucugaucuacucaguaagaucuuaucucuaaagacuuuaaggggguuggugaaaaaauucagcagauaaggacguuugccccagccugcccauccuuggaccaccugguaacgggagaagcccagcuccucaaguguccccugcccuccuuggagcacugccuaccccaaacaguguaauaacauuucuaucauguuugucugagagaaauaagcugugcaggaugggaaugguggaggagaaugggaagagaacaacuggagcgcugaccugaguuagugaggaggagauaagugugcuuuacaagugagugacuggguuuugagaugugcacuguugaucguggagcugugcagaggaggaacuuuagaucuugugguucauaacaaaauucaaaaucggagcuuuuauuauauaaccaugguuucuagcuuccagugccgucaucgggaucuuaaaaagcucacuaagaugaaauuuguugugucuucugaggaagugauaaaucuagcuguagauugagauuagaugauacauacaguaccgauagcauggcacuugguguccugcaagacaaaugcugguagagguuauaaaguuagaaagcacuaaauuaagcuuacucuaucucuuuggcccccaaagauaccuuauuggguuuuggggggaggguugguuugguuuuucagguuuuuuaauuuaguuauacuaaauuauuaacuuuaccugcucacugccucccuccccaauacuuuauuauuuuaaauguuaaguuauagcuugcaaaugaugaguagcaacauuggaaccagaaggccuucagcgucucuccucaugcuaucuuuacuucagugccaucucucuguuuacaguggcuggcucuagaagccaguagggaguuuugaucaggggcuucaacggauacauuuuuuuccccuuguauguuuaguuauuccaucaucaaauuacuaugcuaguuucuuuguacaaugaugguaacugcuuuuguuucuagcauuguuuagauugaaggccccaagaaagcaagugauagagaguucauacauuucuaagaaaaugucuaaaguaacaguuuguguauaaaguuauucaguaaauacaguaccuuagccaacaaguuacauauacaucugguuaaaugcagauguucaguuccuugguuuuauuuugaacaaaucuaagacacuuuuucuucucuggaaaauuccagagcuaaauuaaauuggacuuaauugcaaguaaaauaccuccaaaaauaguaagcauuuaauugagaauuggcacauguagcuguugaaauauuauaaauacuggcaucauaauuuuguuuguugguuugguuugguuuaguuuuuuugagacaggguuucucuguguagcccuggcuguccuggaacucacucuguagaccaggcuggccucaaacucagaaauccgccugccucugccucccaagugcugggauuaaaggcgugcgccaccacugcccggccauaauuuuuuuuuaaagcuuguuagaagccaggcgugguggcacauauguaauuccaguuucagaaggcccaacacacacacacaaacauacaugcacacacacaccuaugacuaaagaagucuaaaaguaccuguuguuuaacaacuaauuuuagaucaucuaacuucauacaaauguuuuagcuauagaaaauauugaagucauuuuaaagcccuaccuuauguugaaacuuuucucuuuauauuguagguccagugguuuaugucuuggaucuugcagauagacugaucucaaaagcuugcccuuuugcugcagcaggaauaaugguuggaucuaucuauuggacagccgugacuuauggagcagugacagugaugcagguucaccauucucuauucagugacacuacuuuugaugugaaggucuauuauauauuugcuaggaguuuuaaaauguauuguuuuaaauagugaugcuaucaugauuaaagaauaagaauuuauauaaaaaggagacuagagcugaccaaauggcuuaguggguagagaugcuugccacagaaccuaaugaccaaguuaaguccccaacacucacaugauaaaaagugacucccaaaagaaauuguucucugaacuuacacaugagcuguagcaugccccaucccugauagcaugcacauaguaaauaguguugcucaaagcuggcuagugaaaaaaaaaaauaguggaagcuagaaagaccucccuuacucauugauuggcaggguuaauacauaaaugucuguauuaucaaaaucagaagauaggcgcaacauaaucugcauuaaguuccauugucuucacagagcuagagaaggcaauccugaaauucauaagcacuaaaagacccucgauagccaaaacaaugcuaaguggaaagagcuaugguggauaaaucacuguaccuggucucaaccagagguauugggucacaccuuuaaccccagcauuaugagaguuccaggucagcaagaguuaugugguaagacccuaucuccaaaacaaacaaacuaaauuaaucucaaacuuaccucagagccauaguaauaauacuaugauccuggcacaaaaaaaaaauguagaccagucguauagaauaaagaacauagacgcuuauauacacagcuguauccaccuaauuuucaacaauaaugucagaaacaugcauugauuuagaugugauguccagcauguauaaccccacuguuugaguagaagcaggaagaucuaguguuuaaggucagccccagauacauagugaguuugaaacagcuagcuugggauauaugguacuaugucucaaacaaaaacauacauugaggagaaaaauccagcuucucaaauagugugaagaaaacaggguauccgcuugaaggagaguggaacuaaaucuaagucugucacauuucuaacagcagaggaaacaaucaccacagugagaauaaagugagucucggcauauagagagaacaguggaaaaaauuucauuugcauuuuuaaauuuuaaaaauacuuuuguuuauguguaugcauuuuguauaggccuauuugcuuguagaagucagaugacaacuacugagagccaguucuccugucaccuuuuagaauccuaugaucaaaccuaagcucucugcaaguuccucuaccacugcgcauccucccauccucuauaugcauuuuuauugaaaagacagaauauuauuaacuuacccagcacuggaaugaacaccuuauaaguauugaugcauuuaaauuauaagaacagugauguacuguaaauaaccuuauucuugguuuacuaauuuaggggauugauugugucaugugucacauaguaaagacccaacauuaggcccucccucuaaggugaaaauaaacuccauaaacacugaaauuuuuuuaccuuauuugagauaaucuuuugaacaacuaaguagcaaguagcuaggaauuacuaggcaugugccauuacacuuaggccucacacaugcaaagcgcauacuggggcugcugaacucuacacccucagcuacuggcuguggugugggccaucaaauugaggacuggaaguaaaggacagaucucccacacugugugcuggugcaugccuuugucugguaaggaaacuucagucuccgugcuucuuuuccucaccacagacucagggagcauggguaucucaggcuucuccucucagcucucagcguacuuaauaugcucagugaacacauucauucucucugacaagaaucuugcccuuaccuugcuuguuuacagggacgcccaaagcaugcuagagaacauuguaaacuugcgguuuugcugugguaacacuuaauggagaauuccuuuuuguacagugcccguuguucccucgauggucucguagauucagauguuauguagccagaggacaccucuguuucuugaacagucuagagaacauacagugggggccuuuccucuuucccuuuguguuugucauuguggcugguuacuggaagauggcucccgcacugaagagcagugugugccuuuaaucccaggaguuggaaggcaaaagcagguacaucucuuugaguuuggggccauccugaucuauaugaugaguuccagaccauccagggcuacacagugagacccuaucucaaaaaguuaaguaacaacaaaacucaacugucccuucacaacucuguugagauaucaucagugcauuuuuguaaaguucuuuuaucccacauaaaauuaaacagcuugcagauuugcaccaccuuagaugguuauuuuguauuucauuuuauuugaggcaaggucucacuguguaacccuggcugacagagcuauguagacuaggcuggucucacagucauggagaucuaccugccucaguguuccgaguacugggacuaacggcauguuaugggugaucuuccuuccuuucuuuuccuuuuuuuaauuuaauuuuauuuuauuuuuucguuugagguuuguauauguaccaacuauauguagugcccacaaaggccagaacaacuugucagaucccugggaacuacaguuacgggagguugugaguugccauaugggugccaggacuugaacccaguucuacuguaagagcagcugauguucuuaaccacugagccaucucuauaucaccaguauuacuuuuuauaaauaauuuaagacuaauagcuuuuaggcuuuuuaaaaaaaccuuuguuucuguguuuugaaacuaaaugugucuuacaaaauggacuauguacuuaaauauguaccccugcuuuaccugagaaaguaacuguaggaaaugcugucugcuucccagguuguaggccauaaagaagggcuggauguuauggagcgagcugacccuuuauuucuuuugauuggacuuccuacuauuccugucaugcugauacuaggcaaaaugauucgcugggaggacuaugugcuuagacuauggcgcaaauacucaaauaaacuacaaaucuugaacaguauauuuccagguaagguccugaguuguggcuauauaaagugcauguuggauugauguuuagaagaaccaacgcaggauuuaaaaaaauauaucuaaagcuuuuuuuuuaagcuauuccuaagauuuaagauuuaguucuaacauaaugcuuuuccccucuagggauugguuguccuguuccucgaauuccagcugaagcuaacccuuuagcagaccacgucucugcuaccagaauuuuguguggagcccuugucuuuccuacuauugcgacaauaguugguaaacugauguucaguaguguuaacucaaauuuacaaaggacaaucuugguaagauggauuuaauguuacuuguuucaaguaguauacagaugagagcuaacuauuuguguuuaaagggagagauguuauguaggggcucugucugcucccuccaucaacccccacugucagcauagcuugagagaaauuaaaaaaagaaagcagguccugugccagcugccuccuggacccucccuguggguaccuucucuucuggacugcgcucuggguucaguccccaguaccagcaucauaaauaaacaacugagaugaaacuggcucauacuguuuccugucauccuguuugcccuccuugguugcagcccacauagugccuggcauucuccucucucucaguguguaagaacuccaugggaagaaagcuacacaagugauguaggaacagggccucuuccuuugcuacuugaagccugcucuuucccaacuucugcccucacagaagagaauguuucacuuguaauuaucagcauuuacuuggcuucaaauccugucuuuugugauagguguaaaguucuuuuucuuguuuaucugauccugcauuauaaaaacauuaauuucccuuuuuauuuuaggguggaauugcuuuuguugccauaaaaggagcauuuaagguuuacuucaaacagcagcaauauuuacgucaggcacaccgcaaaauccuaaauuauccagagcaagaagaagcauaaaacugacuucugguuguucugaggccucucauccugacgagucuguuguguucugauuccaucauuaaugcgcuaguggagacuugugacgcugcuccuauauucuaagagauacaauaaagcacgcagggccggggcaagccgcccaguaaucacggaccuaaggacacgcgucagcucugucauuuguauguucuacuuuuauggcagucggcuaaaccauuauuuuagcaugggaaaccugaguuuguucauauuuuuccagacaagaauguaaagauaaaacuguacaaacauuaaaaguggacauguuuuauucugacgccucuuuuguauauacucaguucaguguuuucuuaggaauagcaacucgaugaaggaacugugagggcuuuucucauugguguaauugauuguaugcuacaaaggagccucuguuaacaggaggaaguguaaacuaguucugaauaaauaacaaacccagaaauguaugucagcauugaagugauuaucugaacaaaagagauuuuguuuucuuuuccuaaacccaugugacaucucagaugugaagggucaguuuccagggcuuccaaagcacuuuuucacuauuaaacuuuauuuaugcaauguugacaucucauaguuc

SEQ ID NO: 9254 - RNA, 15019 nt, Mus musculus
gaacuaugagaugucaacauugcauaaauaaaguuuaauagugaaaaagugcuuuggaagcccuggaaacugacccuucacaucugagaugucacauggguuuaggaaaagaaaacaaaaucucuuuuguucagauaaucacuucaaugcugacauacauuucuggguuuguuauuuauucagaacuaguuuacacuuccuccuguuaacagaggcuccuuuguagcauacaaucaauuacaccaaugagaaaagcccucacaguuccuucaucgaguugcuauuccuaagaaaacacugaacugaguauauacaaaagaggcgucagaauaaaacauguccacuuuuaauguuuguacaguuuuaucuuuacauucuugucuggaaaaauaugaacaaacucagguuucccaugcuaaaauaaugguuuagccgacugccauaaaaguagaacauacaaaugacagagcugacgcguguccuuagguccgugauuacugggcggcuugccccggcccugcgugcuuuauuguaucucuuagaauauaggagcagcgucacaagucuccacuagcgcauuaaugauggaaucagaacacaacagacucgucaggaugagaggccucagaacaaccagaagucaguuuuaugcuucuucuugcucuggauaauuuaggauuuugcggugugccugacguaaauauugcugcuguuugaaguaaaccuuaaaugcuccuuuuauggcaacaaaagcaauuccacccuaaaauaaaaagggaaauuaauguuuuuauaaugcaggaucagauaaacaagaaaaagaacuuuacaccuaucacaaaagacaggauuugaagccaaguaaaugcugauaauuacaagugaaacauucucuucugugagggcagaaguugggaaagagcaggcuucaaguagcaaaggaagaggcccuguuccuacaucacuuguguagcuuucuucccauggaguucuuacacacugagagagaggagaaugccaggcacuaugugggcugcaaccaaggagggcaaacaggaugacaggaaacaguaugagccaguuucaucucaguuguuuauuuaugaugcugguacuggggacugaacccagagcgcaguccagaagagaagguacccacagggaggguccaggaggcagcuggcacaggaccugcuuucuuuuuuuaauuucucucaagcuaugcugacaguggggguugauggagggagcagacagagccccuacauaacaucucucccuuuaaacacaaauaguuagcucucaucuguauacuacuugaaacaaguaacauuaaauccaucuuaccaagauuguccuuuguaaauuugaguuaacacuacugaacaucaguuuaccaacuauugucgcaauaguaggaaagacaagggcuccacacaaaauucugguagcagagacguggucugcuaaaggguuagcuucagcuggaauucgaggaacaggacaaccaaucccuagaggggaaaagcauuauguuagaacuaaaucuuaaaucuuaggaauagcuuaaaaaaaaagcuuuagauauauuuuuuuaaauccugcguugguucuucuaaacaucaauccaacaugcacuuuauauagccacaacucaggaccuuaccuggaaauauacuguucaagauuuguaguuuauuugaguauuugcgccauagucuaagcacauaguccucccagcgaaucauuuugccuaguaucagcaugacaggaauaguaggaaguccaaucaaaagaaauaaagggucagcucgcuccauaacauccagcccuucuuuauggccuacaaccugggaagcagacagcauuuccuacaguuacuuucucagguaaagcagggguacauauuuaaguacauaguccauuuuguaagacacauuuaguuucaaaacacagaaacaaagguuuuuuuaaaaagccuaaaagcuauuagucuuaaauuauuuauaaaaaguaauacuggugauauagagauggcucagugguuaagaacaucagcugcucuuacaguagaacuggguucaaguccuggcacccauauggcaacucacaaccucccguaacuguaguucccagggaucugacaaguuguucuggccuuugugggcacuacauauaguugguacauauacaaaccucaaacgaaaaaauaaaauaaaauuaaauuaaaaaaaggaaaagaaaggaaggaagaucacccauaacaugccguuagucccaguacucggaacacugaggcagguagaucuccaugacugugagaccagccuagucuacauagcucugucagccaggguuacacagugagaccuugccucaaauaaaaugaaauacaaaauaaccaucuaagguggugcaaaucugcaagcuguuuaauuuuaugugggauaaaagaacuuuacaaaaaugcacugaugauaucucaacagaguugugaagggacaguugaguuuuguuguuacuuaacuuuuugagauagggucucacuguguagcccuggauggucuggaacucaucauauagaucaggauggccccaaacucaaagagauguaccugcuuuugccuuccaacuccugggauuaaaggcacacacugcucuucagugcgggagccaucuuccaguaaccagccacaaugacaaacacaaagggaaagaggaaaggcccccacuguauguucucuagacuguucaagaaacagagguguccucuggcuacauaacaucugaaucuacgagaccaucgagggaacaacgggcacuguacaaaaaggaauucuccauuaaguguuaccacagcaaaaccgcaaguuuacaauguucucuagcaugcuuugggcgucccuguaaacaagcaagguaagggcaagauucuugucagagagaaugaauguguucacugagcauauuaaguacgcugagagcugagaggagaagccugagauacccaugcucccugagucuguggugaggaaaagaagcacggagacugaaguuuccuuaccagacaaaggcaugcaccagcacacagugugggagaucuguccuuuacuuccaguccucaauuugauggcccacaccacagccaguagcugaggguguagaguucagcagccccaguaugcgcuuugcaugugugaggccuaaguguaauggcacaugccuaguaauuccuagcuacuugcuacuuaguuguucaaaagauuaucucaaauaagguaaaaaaauuucaguguuuauggaguuuauuuucaccuuagagggagggccuaauguugggucuuuacuaugugacacaugacacaaucaauccccuaaauuaguaaaccaagaauaagguuauuuacaguacaucacuguucuuauaauuuaaaugcaucaauacuuauaagguguucauuccagugcuggguaaguuaauaauauucugucuuuucaauaaaaaugcauauagaggaugggaggaugcgcagugguagaggaacuugcagagagcuuagguuugaucauaggauucuaaaaggugacaggagaacuggcucucaguaguugucaucugacuucuacaagcaaauaggccuauacaaaaugcauacacauaaacaaaaguauuuuuaaaauuuaaaaaugcaaaugaaauuuuuuccacuguucucucuauaugccgagacucacuuuauucucacuguggugauuguuuccucugcuguuagaaaugugacagacuuagauuuaguuccacucuccuucaagcggauacccuguuuucuucacacuauuugagaagcuggauuuuucuccucaauguauguuuuuguuugagacauaguaccauauaucccaagcuagcuguuucaaacucacuauguaucuggggcugaccuuaaacacuagaucuuccugcuucuacucaaacagugggguuauacaugcuggacaucacaucuaaaucaaugcauguuucugacauuauuguugaaaauuagguggauacagcuguguauauaagcgucuauguucuuuauucuauacgacuggucuacauuuuuuuuuugugccaggaucauaguauuauuacuauggcucugagguaaguuugagauuaauuuaguuuguuuguuuuggagauagggucuuaccacauaacucuugcugaccuggaacucucauaaugcugggguuaaaggugugacccaauaccucugguugagaccagguacagugauuuauccaccauagcucuuuccacuuagcauuguuuuggcuaucgagggucuuuuagugcuuaugaauuucaggauugccuucucuagcucugugaagacaauggaacuuaaugcagauuauguugcgccuaucuucugauuuugauaauacagacauuuauguauuaacccugccaaucaaugaguaagggaggucuuucuagcuuccacuauuuuuuuuuuucacuagccagcuuugagcaacacuauuuacuaugugcaugcuaucagggauggggcaugcuacagcucauguguaaguucagagaacaauuucuuuugggagucacuuuuuaucaugugaguguuggggacuuaacuuggucauuagguucuguggcaagcaucucuacccacuaagccauuuggucagcucuagucuccuuuuuauauaaauucuuauucuuuaaucaugauagcaucacuauuuaaaacaauacauuuuaaaacuccuagcaaauauauaauagaccuucacaucaaaaguagugucacugaauagagaauggugaaccugcaucacugucacugcuccauaagucacggcuguccaauagauagauccaaccauuauuccugcugcagcaaaagggcaagcuuuugagaucagucuaucugcaagauccaagacauaaaccacuggaccuacaauauaaagagaaaaguuucaacauaagguagggcuuuaaaaugacuucaauauuuucuauagcuaaaacauuuguaugaaguuagaugaucuaaaauuaguuguuaaacaacagguacuuuuagacuucuuuagucauaggugugugugugcauguauguuuguguguguguguugggccuucugaaacuggaauuacauaugugccaccacgccuggcuucuaacaagcuuuaaaaaaaaauuauggccgggcagugguggcgcacgccuuuaaucccagcacuugggaggcagaggcaggcggauuucugaguuugaggccagccuggucuacagagugaguuccaggacagccagggcuacacagagaaacccugucucaaaaaaacuaaaccaaaccaaaccaacaaacaaaauuaugaugccaguauuuauaauauuucaacagcuacaugugccaauucucaauuaaaugcuuacuauuuuuggagguauuuuacuugcaauuaaguccaauuuaauuuagcucuggaauuuuccagagaagaaaaagugucuuagauuuguucaaaauaaaaccaaggaacugaacaucugcauuuaaccagauguauauguaacuuguuggcuaagguacuguauuuacugaauaacuuuauacacaaacuguuacuuuagacauuuucuuagaaauguaugaacucucuaucacuugcuuucuuggggccuucaaucuaaacaaugcuagaaacaaaagcaguuaccaucauuguacaaagaaacuagcauaguaauuugaugauggaauaacuaaacauacaaggggaaaaaaauguauccguugaagccccugaucaaaacucccuacuggcuucuagagccagccacuguaaacagagagauggcacugaaguaaagauagcaugaggagagacgcugaaggccuucugguuccaauguugcuacucaucauuugcaagcuauaacuuaacauuuaaaauaauaaaguauuggggagggaggcagugagcagguaaaguuaauaauuuaguauaacuaaauuaaaaaaccugaaaaaccaaaccaacccuccccccaaaacccaauaagguaucuuugggggccaaagagauagaguaagcuuaauuuagugcuuucuaacuuuauaaccucuaccagcauuugucuugcaggacaccaagugccaugcuaucgguacuguauguaucaucuaaucucaaucuacagcuagauuuaucacuuccucagaagacacaacaaauuucaucuuagugagcuuuuuaagaucccgaugacggcacuggaagcuagaaaccaugguuauauaauaaaagcuccgauuuugaauuuuguuaugaaccacaagaucuaaaguuccuccucugcacagcuccacgaucaacagugcacaucucaaaacccagucacucacuuguaaagcacacuuaucuccuccucacuaacucaggucagcgcuccaguuguucucuucccauucuccuccaccauucccauccugcacagcuuauuucucucagacaaacaugauagaaauguuauuacacuguuugggguaggcagugcuccaaggagggcaggggacacuugaggagcugggcuucucccguuaccaggugguccaaggaugggcaggcuggggcaaacguccuuaucugcugaauuuuuucaccaacccccuuaaagucuuuagagauaagaucuuacugaguagaucagacugcccuugaacucacaaagguuggccugcguuaccugcccagugcugggacuaaaggcuucagccuacuaaaaccuuuugauccuuuuuguccuacuauucccuuuccuugcuuccucugaguaaaguauuugaauaauuaucuaauuuuuccaugaaucuauuccacccaagcuauuccuugguaucacugacaaccuccacuuaucuaaauucaguggucuaaucucagucccauuuauuuauacuaucagcuacauaugacauauuuucuuucugacauaugguuggguuuuucucuauccagaacauuucauuacucaauuuucaguuuccuuugcugauucugucuuuacuucaauaaaguucccucugacaauuccuaccacaccauacuuucuucuucgugguauuucuguuuuuccuaaagcaguuucauggcagaacauacuuuccuuaucuauuuucaguauuagaacaaugguuggagaaccacuggcccuuggccaaauccaacagcuauuuuuguaacuaauguuuuacugaaaaauggccagccgcagaguuuaaaacuauauuuacagaagagaccugcuuugaaacagacucaaaaagggaaaggucugauuuacuuacugauauauuucaaauucuuauuauccccaaguauuuguuuaacugaauucucucuuaagguauguauauaguaaaugaaacuauugguaguucagugauauaauuuauauaagucauauguauuugggugaaaagaauucuuaaaaggcaggccacaauuacuuuuauuuauuagacuauggacaauagccuagaugucugaauuguuuuucugauaaacuauagaaaauaugcuaaacuuuccugauuaauuaucuggugugaauuuuuaaauuuuacaaaauccccaaauccuuauacuuucuuuuggaaauuuugugacuaucccuuggguuauagguaaaacacaugucuagaaaaauuaaggaaugggcugauuuacuuagaucuagauauuuccugacauaauucuugucuugucuuuuaucuuaauuuuauuucacccaaaucuuucauuacuccugagagaccagucuaagauuaguauuaauauuuggaaggaagaaauaaauacuuaguaucaaacauaccauuaugauaaaaugguagccagaggagauauuucuacgaacaaaagauuaucuaaggcaaguauuuuguuaaaaaauuuuuuuccgaaauccucugaaugguaaauccccaauucugugugcuaaucaggaacuuggugaaguugucucaugaccaggggauggggguaggggauuauaauuuuaggaaaaauagcaccagguuacaacacaaagagcuuuggaguguuggaggcccuuaaaaacuccuguccuaaucggaaagagaaagcaugaauaaaugcucaguaccaguuaccuaaggacacaaagguucaggacuuuagacaugacguguuagcauucagcacugacugaugauuaaacucaggaucccacgcauggcaagcauguguucugccacuaaacgacaccccugcuccccacuccacgucauucaauuuucaauggcucgguggguccggcacuuucaacaguacauccauuacaugauggauggcaaccgaagcuuugaaucaacaccaacuuuuagaaaucuaauaauuuaaaggguacuagaaaagcuuuuuuuuuuuuuaaauuauaaagaagcuuauugugaauucucuuaaauaacaaagauucuuacaaagacagaaacauccuaauauccuagguaaauuuaaguuuuugcauuucaaauuuaagugacaaaaaucaaaccaaaaauuuuagguaaacauauuaggcuacucaaaaaggaguaaucaguuuugcgucacgacauuacaaacauaacuuugcuacaggcagugauuuggauucagcggagcuggguguggcuccacgaaccuucaaaccuugcacuuccauccaaaggcucaggcugaaugauuuuaaagguuauuuauuuaugugugcaccugagaaggucagaaggguaucaaauccucaggugcucaagcuagagcugcgaguuguccaacacagguucugagacucaaacucagguuccccucagccaagagcagccagcacaccugaacacugagccaucuguccacccaccuacuuuaagugcuuucuccuucuuuuguuuuuuuuuuuuuuuuuugguuuuuuuuuuuucgagacaggguuucucuguauagucuuggcuguucuggaacucacuuuguagaccagguuggccuugaacucagaaauccgccugucucugccucccaagugcuaggauuaaaggcgugcgccaccaccgcccggcucuccuucuuuugugaugccucauuacauagcuaugacuguccuggaacucgcuaguagacaaagcuggccuuaaauucauagauaucuguuugccuccggauuguuuacaauguuuuaaaauauuguuuugcacuuaaaaugaaaauaccugggacuggagagauggcucagugguuaagagcacagauugcucuccuagaggaccucaguucaauucugagcaaccacacgauggcucacaaccaucucuaaugaggaucuaugcccucucugguaugucugaagauagcgauaguguaauucauauacauaaaaaggacaagaaaaaagaaaacuccuuaggucauuuuuuuccuuugugauagucccaccggauagcucagaccacucuugaacauccucauagucuaagguggccuugaacucuguaucaucuucuuuccucucccaaaugcugggauuacagagauguuccagccaguuuuguuuguuuguuuguuuuguuuuuguuuuucgagacaggguuccucuguauagcccugccugguuguucuggaacucacuuuguagaccaggcuggccucaaacucagaaaucugccugcuucugccucccgagugcugggauuaaagguaugugccaacacugcccagcuccuccauaccucuuuguuauugguaagguuaauauuaaaaauauuuuuaagccgggugugguggugcacgccuuuaagcccagcaaucgggaggcagaggcaggcggauuucugaguuugaggccagccuggucuacaaagugaguuccaggacagccagagcuacacagagaaauccuucucgggaaaaaaauauuuuuaagaauagcaaggaauacauuccuuacaaaaaugacacuagcucagaaacauauggcuauaaaugaacagagugauaauuuuuuccaggcuagucccauucucaaagacuucugguuauuuucauguccaguaaugcccagaaaagagggcaguuuuccugaaagauuacaauauaagcugaauucucaaaaaugaauuuaacuguauuggcucagugguugagcaagaacacuggccuaaaaugggaaagucucagaguucagugccuagcauagcuaaaacccaaagcaaaacuuuaauuuucuauuuuuguuucuuaauacaagaauuaaagaauacuggaauacucacugcugcuuuuucucuuaaacugucucuaaagaaagguguuccuuauguccaccccuuacccccuuuaaugcauaugcacucucagguguaauccucagaaagaccaucuaucucauuugagacaaggucucucauuggccugaucagcuagcacagacuagcugggcaguaagcccagggauuauccuguuccugcuucucuagcacuaagguuacacguguuaugaaaacgaaacucggguucccaagcuugccaggcaaacacuuuacugaugaagcuguauccccagcccuaagucaccucucuuguuacauccauagugugucauaaaguccuuuucuucucaaauaaaaauauuuaauguacugacaaacaggcaagucuggggacuuguuaaagauauuguaaacuguuagcaaaauaagugucugacauuuagagagaaaaaaaauaaauucacaaaaaagcaaagauaaagaaaucauuuaaaaauaaauccaaggagcuggagaguaaagagcauugacugcucuugcaggggaacuggaacgaguucccaacacucacaugguggcuuacaaccaucacacucgagcuucaggggauccaaugcccuuuucuggucuccuugggcacuaggcaugcacacagcccauacagucauguaggcaaaacacucauacacauaaaaaccuaucaaccaaucaaccaaccaacgagcuggguguuguugcucauaauggcagcaauugaggaggaugaggcaggaggacugucaugaauuccagggauacagagugagaccuuaucucaggucuucaccucuuccuucccccaccccaaaaaaagcuuuuaacuacggggacacacacacacagaaauaaaacagugaacaugucuguguuguucuuccauuaguccuuacccagcuuuggaaacacuauuaaguacucggcguugcacugaggacaggccacucuggcugugcuguuuccucuuugcuuuucaucuacccagcgcuggagacaagccuggugaacccacuuaguagauccucugcaccugcauggucucacccacucagcuguucuaucaucuucaucgguggcaaagcacacccagcaacuucuguaaauuaagaaaaaaaaguuuuaucuuuaggguuccagucuccuuccugcaugaagcucuuagcuaaugggauggaacuaucaugcaguauugaagaaguccuguaaaaauuacagagccaaacaaccaaucuauuuccaguagagcuuuucuucugguuuguuuuuuaucuuccacuacagaaccuauuuuuugaacuuuguuuuuaucuaucuuuuuuuuggacuccaucuuucuaguaauuuccccugacuaguaaacuagcauacaggcacaguuucaaguaucuucugcuuauuaagaccucuugaacuuagaaaaacaaagugcuaguguuuucauauauaguuccccuacccuucaggccaggauuacaaacauucuaggcagaauguucugagccauauucucagaccauucaauuuucaacugaggaaaccaauuuuuaaaaagccgacuccguuuucuuaaugguaaaggauagcuauaggaagaaaaaggacaucacaacaauuucuuuccaaguucaagagguccuuuuuuuuuuaaagauuuauuuauuuauuuaauguaugugcuuacacuauagcuauacagaugguugugagccuucaugugguuguugggaauugaauuuuuaggaucucugcuugcucuggucggccccacuugcuucggaccaaagauuuaguauuauacauaaguacacaguagcugaccucagacacaccaguagagggcguaaguagacaaguagggcuacauauaccagaaucauuaucaguguuaaaguaaggaaugggaaugugguucaguuguaccaguguuuaucuagcaugcauggcacuggauaaacagaguauggcagaggcaggaacaguuggaugggggcagaaagaauguaagaguugugagacgaggagcgcugugcauuuggucuucuggccuugugcuuacacaccuaccguaccugugguuaucuguguaagaucuacacacuauugcaucagggauagaggagggacucaaaacuccaggccuacccugaacuuuggauacugcuacuagaggaggagggaguaaauuuaguguugugcuaauaacacgcccaugcucuuguaaauaaccuggacccaugcuuaugcaaacaauccuaauuaaauuuaauggaacacacacacacacacacacacgcacacacacacacagaaacgagggggugaugggacucggaaugggaaaggacuugggaagaaaacgguagguagaggauggaggugagcuagggugaugggagaggaaacgacuaaguuauguacauucuaaaaaggauagccagaauucccaaguuucuguaaauguuucaugagcacucacuggcuuuuaugaaaaccucugaagaauacaugaaaagccaagacaacaucuagacagaagaauuuuucuaagugucgucacggaaaagugaaagugggaugucaucagagcaaaugauuaacuacgcaauacaaggauugcgucucauauaacuggaaucgauguggcaggcaguaaucucucugggcauacuuaguaugacacaucuagucaaguaugauaaauuauaaugaaaggaaaacuugagaagugaccagacuucuagacaacuggagaaacggacaaguucauuaguuguagcagaauagcugcuaaguaccagagauuuaggcuaaauccugucauaaaauaugaggguguaacuucuugccuucccugauggaucuuugaugcccaccucccagccccaguaguuaauggcuauaaccucaaucaagagagggccuucauuuaauaaguuucaaagcugaaucuuaagugcauugagagcaucaccugcugaaguggguggccaguuagucuauuuagaguugcaagcaaccucaaacauuaugaauuagaucgaccaauuggucagaacagcaagcagcugccuuggugaaaagguggauuuaauuuaguuuccaaaaacucacuggcuggaauuuaaacggcagagggcagugcuguagacuuucucaaagaguuuuaguggcuggagaccccaggaaugggcaacuggucccaguacaagcccaaacgugucugggaacuuagcgaucgucaagugugcuacguguucaauguugcaugcuuguggcuguuuuccauaaccucuacucuagugugaccgaccguuaaggcucccuuguggauauucugaccuuacgguuuggggguagggaugggauugggggaggguggugggggaguuggaaagagaaacgaaacccaggcuuuaaaagaaggaaugccuauccuugcauugugaaagugcaagggaccagucuccagaaugacaaucggguacuucccaguggcgucgcugucaaccccuuuacuacauuguccggggaggagggggagaaauagaaacuaauacuauggguuaacaauagcgccucuucaccucaaaaaacaaaacaaaacaacaaccaaaaaaaaaaaacccaaacaggcuggcggccaaaguagaccucccuccuuuaacuaaguuucaaagucuacgacccugaccucucgcccgcucuucuccccagugccaccuccaaacucagagcccuuuucccggccuccgggccguggaacucucggcggacgccaggauccccgcucucggggccucgaggccagcaugggcaggcccaggacgaaggccggcaguucccggccccacguugcuccuaccuguccagcaucuguugaagggcuugguccggcaucuuccgcggagccggcgagcucggcccucgcccgcagccccgcucagggccaggccccgggacaauagcacugagaggcggcggaguaggccucagucccgcggcggccgcggacccgccacacagccucccggcguggcucccagaggcccgcgguggcgcugcgcggccggcgggcgaccgcagagggcggcggggagugaggaggaggagccuggggccgggaggcggcggucgcggcccggguuccugccgguccgcccaggguuccgguccauggaccgccggggcgccgagcugcugccggcggaggagcuaccucugugagguaagagucgccgccuccgugcgcgccggggucacgacgcaggggcggcucggagcagccugggagauguaguccucggaccguccccgcuagaggcugcacagcccgccgggacccccgccgccgugcccgccgccgccgggccggcgcccucccguuuccuuccuccagggggaaaaaaaaauguccuucgggccgcuguccgggaagcggcagcauguggcgcuccgcugucaguagcaacaaggucagcgccccuucuccgcgucuuguccccucagcucucgcgcucaggugggacagagccaggugagggguggcggcguggagggccaguuucugggccgggucaaguacgccgggccgcggcggcgcgaggccgggcgcucgggucagccucggccgcgu

SEQ ID NO: 9255 - RNA, 5667 nt, Mus musculus
uuuuuuuuuaaugacacaaggucuuguagccuccugggcggcugagggaacaagauuuccauccuuugcacuuagcuuuaauugaagaugcugagacugacucaggagguucuagaguucuccagaagcaagaaucuacuccagagcaacugagcaggcugagaccacccucuccgugcuuaggcugacacuaaagugacggcuuacucuggcguuuugucccaaugcccguuaaauggcggcaucacucugaaacccgaguuuagagucuuaagcgaaguugcucugauaaagcucuggaaaaaaagccaaacacugcgagcccugugcaaacuagagaugagaaggccauugaagaaucuuauagguugucauuucuaauaagguaaguauugguaaucaggacccacauaaaaacaaaagcccuuugggaccuuguauaguuuccuuuaagcaaaggggccaguugagaauucuauuacugacuaccccagccuugccaugcaagugacuuuauaugaaacugucguuuuacaaucgcaaacauuuuacaauccccugggaguccuggcugggucugguuuguugcuccucuuagcucucccuaguuuuaaucuuuuauacuuuucacuucuuuucuuuuaaucacuuuuuccuuugaaaauuauuuaaaaaaauuuuuuuugguccagcagugcguuuauuucuacuauaaagauaacuucaccaggugaaccuucggcucucaccugaggugacuugaaacaagugcacaccuuucucaaacuuaagcucacucuccccaccuccccgccccacccugugcccuugacucugaggcccaccggcaggucuggacaagcugcagggccccucagccauaucugcuugagagaaagagagaccccacacgggcagcugcugaagauccucagccaagauaacccagcauucucaauguccacccauugcauccucaaugcaaagcacgccucuaccauccagagaacauccugugagcuaaggaugcaugaagaccccaacaaucccaacaagagugauccaaaugaucgacacugggaaaucagccuuguuaugaaaccugcuaguggaagagagguauuuggguacccggugccucguggcagugggagagaaaacagaggccugaagcaaauuccaacaguagugucuaaugugccaccagaagugcacuguccugacagccuucaaggcagacaaacccucagaggcuggcgugaacaucaagauugcaaacugugacuucaacagcaaauuccaucuuuuacaaccagcaggguaccuuguggggcagccuggcauucuccgcguguagacgcacaaagccugguacuuaacaugcauuggcaaguggauuccugcccucugaccuacagauucaggggaccugccagagagguggcaaacagaugcgacauucuuccuauguggcuauggugagaacacauucaaagaccaacucuuucauucucagucccagugagagaugagcgcuggagagcacugugauggauucaugugggucaucaaggugaggaacuuaugugggggucacauccugucuucaagguuacaguccagacuucuuaaugggccagaaaauccagcaagacaauggcuuccuaugucuucucccgagcucguuuuaacucugagcuagcugcacagcuagcuacccuggcgcuugaagggucagccuucagaugaucccaccgacaacagcacaccuuucccaucccauaggauacagcuuaggccgucggauaaccucaagggggcguguuuucagcagcccgagguugaccuuucauugcuucucuuagaggaacagcauggaucccgggacaaggagauagagcggaggagagugguagaagcuccuaccagcuccaacccacccagacagcaauaagacgccucuccccucccaccgucucccaacaucgcccuuccaccaaacacauguuacaauaauaauuccccgcuuuggggucagccagccuugacuaaacaaaacauccaugcaggauggcagggccugggcuguuccauggagcacaauagcugugaggucucccugcccggcacagccaccgccuccccuguggucuuucccucugcccaggcaguauagcacaagugauggagcuccagacaaaccaguuucuacgagguauguccgaaaagaaauccauccccgcugggaagcauggaccuguacuggcucaagacucugccuaaggaccuggcuauagccucguuguccaagaacuggccaagaccaccaggggaccaauccuagcugcuuuagcaaguucagcuuccacagcacagaaagaaauggcugcuucaaggguuacgauuagaaucugaaugacuccuggagaagucaguggcucaguggaacacuugggaagagaggacacaguuuuccaagguucaaguugggcucuuugcuggcagaugcuuggugcugggagcuccccugcauggcaaacuccacacggccucaccacgcgaucucuggaacccuucgguccgaaucuccauggccuugaggaguggacacgcgccaugacaaagacgggaguuuucccucaccugcugggcucagcuuucaauugauugauccaucagccucuguuggaaaagaggagauucuguaaaguaacccagcaggagagagcaagacaugaguaagccacaaagaauucagaguuugggucccccgccccgggcaggagccagucacuaugccacuugccugucagggacugaggugggcaggggaacaugaaaaccugcuggagggcccuucuaccgcgcucugagcagcacccaugccaugugguaacauauaugcccaugcccaugugguuacauauaugcacaugugguugcauauaugcccaugcccaugugguuacauauaugcccaugugguuacauauaugcccaugcccaugugguaacauauaugcccaugcccaugugguuacauauaugcccaugcccauauaguuacauauaugcccaugcccaugugguuacauauaugcacaugcacaugugguuacauauaugcacaugugguuacauauaugcccaugcccaugugguuacauauaugcacaugccuaugugguuacauauauguacaugcccauauggaaacacacacaaacagggguggaauacuggccuuuguuuguuuguuuugagacagaguuucucugugcagcccuggcuguccuagaacaaucuuuguagaccaaacuggcccaaagagaucugucugccucugccuccugagugcugggauuaaaggcgugggccaccacuuccuggcuggcuuuaacuuuuguuaacuguacuuguuugggcuggaaauauaaaccauaugagaaugauaugcagaacaaaggccauaugcaagaucuauugucauaaaccucccaucagugagugcuccaauaaauuuuugugcuuucuuuuuuaacuuuaaaaaaaaagauuuauuuauuuauuuauuuauuuauuuauuugaugucuaugaguacacuguaguugucuuuagacaaaucagaagagagcaucagaucacauugcagaugguugugagccaccaugugguugcugggaauugaacucaggaccuuugaaagagcagucagugcucuuaaucgcugagccaucccuccagccccucuuuuaaacuuuuaaaagguuuggguuuuuucccuccuaauguguauaauacacaaauauauuuaacaaaaacaugaaagagagagagcgauccuacucuauuugacacagauuuagugugauugugugaaagaucagguuuuaugaccucaccuauuuauaaaaugugaaagagauguugaauuugugauaaacauagcaacagcaaacagcauaaaauuaaagaccagcugaguaugugagcccagggcugaugcccucuuacuucaauucaacagaacugaguguugaccugagggcaccagacaccagauuaaacagugaauuaaaugugcguaagagguuggagauguuucccauuagucaucaaagaaugaauguggacauuuaccuccacuugccaacgcaaaccucacuagcauaacagcagagauuuaaguuuaaaggucaaccucagaauaaacaggcccugcaaggagaaacagaagcacgaaaccugauauauguuagcuuuucagcaaacacgagaaaacccaaaugaguaggcaggccuugugccucauccuguaauccuaucacuggggaagcugaggcaggaggaucaccuugaauucaaaaccagucuggacuacauagcaagcuacugcagagaaagguuagagacaugacuuaggcuuaagaaaacacacacucucucacauacacauguacacacauacacauacacauucauucauacaauauacucauucauauauauauauauauauauauauauauauauauauauauauauacacgcacauaguuaaauauacacacucacaauacacauaacacauucauacacacuaacucauauguguauauguauaguuacauaugcauacucucacauauucauaacacaguauacauucauacucauacauauauacacacucauacacaagcauuuacucauauacucacucauauacacauacucuuuuuuuauacacacauacacaauacacacucauauacacaauuuaaauaauaaauauauuuaugaaauugaaagagagagguuaagucagcaagguguaccugcaauuuuuuccccugcugaguacuuaaaagcucugaacagcagaauggggagggagucagucagucaauugagaauucaugucugaucccuagcacacacacaaaucaggccugguagcacacacuuguaaccccagugcgggcaaggcaaaggcaggacagucccuaggcuuugguggccagccagccuauccuucuuugugagcaccguuucaagagcaagauagauagcuccuggaaaauaauauccaaggacgacuucugccgcccucccucgcccccccccagccccccccccccacacacacacugaagggaugaacaaggacucacugcaaauaagauuuacagugauacagguuacaaugcucacugcacgggcagaccauuggagauuuacucucccaagugacgacucagcaaagcucuggacuucagggccucagucaccccugcaggcagcaaggcuguucugaaaagaagagaauccauaagugccuaggcgccuagccacgccccauucccacaaacccuugucugcucagcauccuggaugguagcagguaauuucgguguggcuuucaggcuaccuuuacuguuucugauuucuuguagaaguccacauugcaauuccuuucuggguggcgguuugguaacguaucagaauccuuaaccgugguuguuaggcgcgaggacccacagcuucguggcuguccugggcuucucugaccucagcuccagcuucgagggacuccgggcugacccagaguuugccagagcugcaggagguguuggaucacucagagaagauguuugugcaaagcg

SEQ ID NO: 9256 - RNA, 5667 nt, Mus musculus
cgcuuugcacaaacaucuucucugagugauccaacaccuccugcagcucuggcaaacucugggucagcccggagucccucgaagcuggagcugaggucagagaagcccaggacagccacgaagcuguggguccucgcgccuaacaaccacgguuaaggauucugauacguuaccaaaccgccacccagaaaggaauugcaauguggacuucuacaagaaaucagaaacaguaaagguagccugaaagccacaccgaaauuaccugcuaccauccaggaugcugagcagacaaggguuugugggaauggggcguggcuaggcgccuaggcacuuauggauucucuucuuuucagaacagccuugcugccugcaggggugacugaggcccugaaguccagagcuuugcugagucgucacuugggagaguaaaucuccaauggucugcccgugcagugagcauuguaaccuguaucacuguaaaucuuauuugcagugaguccuuguucaucccuucaguguguguguggggggggggggcugggggggggcgagggagggcggcagaagucguccuuggauauuauuuuccaggagcuaucuaucuugcucuugaaacggugcucacaaagaaggauaggcuggcuggccaccaaagccuagggacuguccugccuuugccuugcccgcacugggguuacaagugugugcuaccaggccugauuugugugugugcuagggaucagacaugaauucucaauugacugacugacucccuccccauucugcuguucagagcuuuuaaguacucagcaggggaaaaaauugcagguacaccuugcugacuuaaccucucucuuucaauuucauaaauauauuuauuauuuaaauuguguauaugaguguguauuguguauguguguauaaaaaaagaguauguguauaugagugaguauaugaguaaaugcuuguguaugaguguguauauauguaugaguaugaauguauacuguguuaugaauaugugagaguaugcauauguaacuauacauauacacauaugaguuaguguguaugaauguguuauguguauugugaguguguauauuuaacuaugugcguguauauauauauauauauauauauauauauauauauauauauauaugaaugaguauauuguaugaaugaauguguauguguauguguguacauguguaugugagagaguguguguuuucuuaagccuaagucaugucucuaaccuuucucugcaguagcuugcuauguaguccagacugguuuugaauucaaggugauccuccugccucagcuuccccagugauaggauuacaggaugaggcacaaggccugccuacucauuuggguuuucucguguuugcugaaaagcuaacauauaucagguuucgugcuucuguuucuccuugcagggccuguuuauucugagguugaccuuuaaacuuaaaucucugcuguuaugcuagugagguuugcguuggcaaguggagguaaauguccacauucauucuuugaugacuaaugggaaacaucuccaaccucuuacgcacauuuaauucacuguuuaaucuggugucuggugcccucaggucaacacucaguucuguugaauugaaguaagagggcaucagcccugggcucacauacucagcuggucuuuaauuuuaugcuguuugcuguugcuauguuuaucacaaauucaacaucucuuucacauuuuauaaauaggugaggucauaaaaccugaucuuucacacaaucacacuaaaucugugucaaauagaguaggaucgcucucucucuuucauguuuuuguuaaauauauuuguguauuauacacauuaggagggaaaaaacccaaaccuuuuaaaaguuuaaaagaggggcuggagggauggcucagcgauuaagagcacugacugcucuuucaaagguccugaguucaauucccagcaaccacaugguggcucacaaccaucugcaaugugaucugaugcucucuucugauuugucuaaagacaacuacaguguacucauagacaucaaauaaauaaauaaauaaauaaauaaauaaaucuuuuuuuuuaaaguuaaaaaagaaagcacaaaaauuuauuggagcacucacugaugggagguuuaugacaauagaucuugcauauggccuuuguucugcauaucauucucauaugguuuauauuuccagcccaaacaaguacaguuaacaaaaguuaaagccagccaggaagugguggcccacgccuuuaaucccagcacucaggaggcagaggcagacagaucucuuugggccaguuuggucuacaaagauuguucuaggacagccagggcugcacagagaaacucugucucaaaacaaacaaacaaaggccaguauuccaccccuguuuguguguguuuccauaugggcauguacauauauguaaccacauaggcaugugcauauauguaaccacaugggcaugggcauauauguaaccacaugugcauauauguaaccacaugugcaugugcauauauguaaccacaugggcaugggcauauauguaacuauaugggcaugggcauauauguaaccacaugggcaugggcauauauguuaccacaugggcaugggcauauauguaaccacaugggcauauauguaaccacaugggcaugggcauauaugcaaccacaugugcauauauguaaccacaugggcaugggcauauauguuaccacauggcaugggugcugcucagagcgcgguagaagggcccuccagcagguuuucauguuccccugcccaccucagucccugacaggcaaguggcauagugacuggcuccugcccggggcgggggacccaaacucugaauucuuuguggcuuacucaugucuugcucucuccugcuggguuacuuuacagaaucuccucuuuuccaacagaggcugauggaucaaucaauugaaagcugagcccagcaggugagggaaaacucccgucuuugucauggcgcguguccacuccucaaggccauggagauucggaccgaaggguuccagagaucgcguggugaggccguguggaguuugccaugcaggggagcucccagcaccaagcaucugccagcaaagagcccaacuugaaccuuggaaaacuguguccucucuucccaaguguuccacugagccacugacuucuccaggagucauucagauucuaaucguaacccuugaagcagccauuucuuucugugcuguggaagcugaacuugcuaaagcagcuaggauugguccccugguggucuuggccaguucuuggacaacgaggcuauagccagguccuuaggcagagucuugagccaguacagguccaugcuucccagcggggauggauuucuuuucggacauaccucguagaaacugguuugucuggagcuccaucacuugugcuauacugccugggcagagggaaagaccacaggggaggcgguggcugugccgggcagggagaccucacagcuauugugcuccauggaacagcccaggcccugccauccugcauggauguuuuguuuagucaaggcuggcugaccccaaagcggggaauuauuauuguaacauguguuugguggaagggcgauguugggagacggugggaggggagaggcgucuuauugcugucuggguggguuggagcugguaggagcuucuaccacucuccuccgcucuaucuccuugucccgggauccaugcuguuccucuaagagaagcaaugaaaggucaaccucgggcugcugaaaacacgcccccuugagguuauccgacggccuaagcuguauccuaugggaugggaaaggugugcuguugucggugggaucaucugaaggcugacccuucaagcgccaggguagcuagcugugcagcuagcucagaguuaaaacgagcucgggagaagacauaggaagccauugucuugcuggauuuucuggcccauuaagaagucuggacuguaaccuugaagacaggaugugacccccacauaaguuccucaccuugaugacccacaugaauccaucacagugcucuccagcgcucaucucucacugggacugagaaugaaagaguuggucuuugaauguguucucaccauagccacauaggaagaaugucgcaucuguuugccaccucucuggcagguccccugaaucuguaggucagagggcaggaauccacuugccaaugcauguuaaguaccaggcuuugugcgucuacacgcggagaaugccaggcugccccacaagguacccugcugguuguaaaagauggaauuugcuguugaagucacaguuugcaaucuugauguucacgccagccucugaggguuugucugccuugaaggcugucaggacagugcacuucugguggcacauuagacacuacuguuggaauuugcuucaggccucuguuuucucucccacugccacgaggcaccggguacccaaauaccucucuuccacuagcagguuucauaacaaggcugauuucccagugucgaucauuuggaucacucuuguugggauuguuggggucuucaugcauccuuagcucacaggauguucucuggaugguagaggcgugcuuugcauugaggaugcaauggguggacauugagaaugcuggguuaucuuggcugaggaucuucagcagcugcccguguggggucucucuuucucucaagcagauauggcugaggggcccugcagcuuguccagaccugccggugggccucagagucaagggcacaggguggggcggggagguggggagagugagcuuaaguuugagaaaggugugcacuuguuucaagucaccucaggugagagccgaagguucaccuggugaaguuaucuuuauaguagaaauaaacgcacugcuggaccaaaaaaaauuuuuuuaaauaauuuucaaaggaaaaagugauuaaaagaaaagaagugaaaaguauaaaagauuaaaacuagggagagcuaagaggagcaacaaaccagacccagccaggacucccaggggauuguaaaauguuugcgauuguaaaacgacaguuucauauaaagucacuugcauggcaaggcugggguagucaguaauagaauucucaacuggccccuuugcuuaaaggaaacuauacaaggucccaaagggcuuuuguuuuuauguggguccugauuaccaauacuuaccuuauuagaaaugacaaccuauaagauucuucaauggccuucucaucucuaguuugcacagggcucgcaguguuuggcuuuuuuuccagagcuuuaucagagcaacuucgcuuaagacucuaaacucggguuucagagugaugccgccauuuaacgggcauugggacaaaacgccagaguaagccgucacuuuagugucagccuaagcacggagaggguggucucagccugcucaguugcucuggaguagauucuugcuucuggagaacucuagaaccuccugagucagucucagcaucuucaauuaaagcuaagugcaaaggauggaaaucuuguucccucagccgcccaggaggcuacaagaccuugugucauuaaaaaaaaa

SEQ ID NO: 9257 - RNA, 891 nt, Mus musculus
uggugacgacggggcgugacccgaagaaauggauggcggugcaggcuggcuccuguaguccgaaguucacugugcaagcuuucagugcugccgcuggcgggcuucuggggccugggacgccuacaucgccgcauucgcuggguccuuaccgcccuccgaggcuucucgcuuuccguagagaggugacgaacaacucggccguuuaagguguagguggggaccggggaaacagaaaagccgaguccuccgccucaucggguuuccggagcugcuuuuucuguuucgcgggaucuuaaaugcgguuuagccucuccgauguaacuuagcgaggaucagagaaagcgccgccgaccucgccaaauacccgccuuccgcacuccagaucccugguccucuggauuaagcaaagccaacugucuacugguaaacuacucucggaggcaggaguggcagaggagcucuccgaguuccagaccagccugaucuauaaagcgaggccaggacggccagggcugguugcacagagaaacgcugucuccaaaaacaaacaaacaaaaacaaaacaaaagcuagccccagagacucacugcuaucucaaaaugucccacaaagugaacauauugaacaucuuuauacccuugccuccggccagucuuucucacuucaacacguguuuuuaaccagacccuuccucugcaaucaccuuccuccaagacuuugaaucucgucccugaaugacuuccuucgauguuccuacugcuacccuuuuuuucuccucccugcuacugcauucacucagcaaauauccuuuaaaaagcaaaccaaacacauauagggacagaggcagaaagaucaggaguucaagcguccauuucauacauuuccaguuua

SEQ ID NO: 9258 - RNA, 476 nt, Mus musculus
guuuuucuuuuucuuuuuuuaauuuuuaaugaugaaaacaaaaauauaccuaaaagcgaagcuucuggaaaaaccauuuguucuucccugucuuguauugcuccucaaacuugaccuuggccuccugccuggccuugcuuuucaaagcugggucccugaacacauccuuguugacaacagucuuguccaaggggauauccacagaguaccuugugggcaugaggugguuguaguuauaaacuuucacaaaggacuugaucuuggaucgcuuggugaucuucuucuugcccauggcagcugucacuuuccggggauagucgucaauuccagucaccagggcauggcuguaaguguggucugaggugccaucaucaauguucuucacgaugauggcuuaguguccgcaguagcguccggccaggaccagcaccacuuucccagguuucaugaacuugcccaucucgacagcaggcagc

SEQ ID NO: 9259 - RNA, 6582 nt, Mus musculus
ugagaaacaugaggacauuaggcgagugagcaggagcccugaaggcgauggcaggaagaggaauugccaaggugaauggagucugagaacacuaguuauuguaagggacagaguauguaaaaacacugaaaagcccuucagcggacagucaccauuuugggacuucccaccccggugagaucugggacuggacagcucuguuguagggggcuguccugugcagguaagguguugagucucugccuagugauaccagaagcucccuuuccacgccuccaagcaugauaaagaucuuugcacgcuguaacacauucccugggaacaaagucucuaguugagaaccguuuucuagauguacaauuaugaaucucaagcguggcuuucucuccagcuuuguccauggugucauuuaagaugacugaacucugaccgccuucaggggcucuuccucauggauggcucugccaucugaccuucugcaguaagaucuuucguuugcacugucccauccuuagcuucucuuuuuucucuuccuucuccucuuucuuauucuaugcacggaaugcagcucugagcaaccauucaaggauagcuuaacaaucaauucagaguucuuuuucccugaugucaucugugacaccuugaaugaaguccagacaaaauuuuucuaaucauuucaaaagaacaugaaugcuuuauuucuuaucuggggucuuacuguucugccuaggguagccuugaacucccaggcucaaguuaugcucaugacucaaacuucugaguauuggaacuaaaaacauaugccauuacacccacagauuaaguauuuuuucauuugaaacaaaaaucuaaguuugagaaacuuaugaguucugagaggccuucggaaggaauggcagagucacuaaugcuaacaacagcucgggcgcaugguacacucucuaucggugccacaggcacaauucgauccagugcacucugucacugcucugucagugcuuuguaguugagggcacagagguuuaaugaagugauuuauucaagucuccagagcugaaggggcagcaugaagaguugaaccaaggcagcaugacucucggcuguacuucgacaccucccucccugcccccaucauuuagauguaguccuuaagggauaaagggucaccaaaugagaccugagcacaagaggagggguggcuuuucaggaguucuaagaaggcauuggcugaguccugaggcuccagcuugcaguggcuggcccuaugcaaauaaccaagugaauguggucccauuucuguuuccaucugucuuagugaaacugccucugcuuagcgggguggaguauugcuuuccaguuuagaaaguuaaucuacugagggcagcugaagugaagaauaugguucaagagagugacccagcuagcagguguugggggcagaagguggggguggagaauggagggccgcagaauugagaggaaguugaacuuuugaaucauuuaggaacauggggugugugugugugggggggggaagugugugcgugugugggggaagaauccaaaacuuuaauagcaccuacaccuuagcuuuucuaaauucuuuuugaggcucauuuuguauuuucaauagaaaaaccagaaaaccauaguuucuaggauauuuuuugguggcacacacacacacacaccacaaaacaaaacaaaacaaaacaaaacaaaagacccacacaaacuugaaaaggaccauggcauccuucaccagugcaaaaguaagccugugucagaaauagagagaaauggggaagaaccaaaauauaacccacagucccaccaccagcgagucuguugaguuauugugagccuuauucuugcagaccacagagacaaucuucacauaaguugccauccaauaauuguguugaauaagaugagaaagaggaaggaggaaagccaucgagcaggucaccaagaacagguuaaccucggugccagcugcuaucucaagguucaugaagcaaaacguuacuuccugaagauggagcuaccacaaggucccuucuucagaggcuguacccacccugagccugagcaaugcccccauaaguccuaggaaagcccggcauccacccuagaguucacucuaggaagcagucauccaugcaggccuggacacacuccugaacauuuggucauggguagugccuugagagcaacggucuuaacagacuuucaaaacuccagcauucucuggaauccauccuuccugaggcuuuuggaaggccauguuucuaaaggcagaagggucacuagggaacuuuuggaaggccauguuucuaaagucccacggucacuagggaacauugguuuaggcugaaauaugucaugugucuaccuuacauuugacugcuauauaacucaauggugacugagcgugugugugugugugugugugugugugugugugugugugcgcgcgcgugcacgcgcgcgugcgagugcaagugcaucuauguguguacauacacaugaauauauacuugugacauguggcuuaaauauuuuuuggcuuugagagaaggaauuauuauucucuuacaaugaguuaaaaaauuuuuuuucaauagaaaaguccaucaacagaacacccaaaauaccuaaggaaaagacaaccaaggggagaagguucccuggccccucuguagugaagaggaaauggauggcccugggaggcagauucucuuguuugagaaaaagccuaagaauuuggcauccaaaagaccauuaguccccaaagaaccuuaccugcuguguccaauggcucacuacaucugggucuccucccuggcuggcuaaaagagccuccuugaaauccagcaguuaucccuggcuuggggccacccaagccuuccacccuggccaguaaccucagaccaggagaaaagagacucuaguaagaagucacccgugccuccagcaggguguggcacugucuucaucuuggagaaccagaggcuggcaccugcaugaggugugcauucuggcuggcuggcagugcuccucugccugcuggguuugaggugaaaaccugggggagccaagcacugcugcugguuaacuuagaggauggaggcacucuggccaaguugguugacgcucuuugaacuaauacacuaggugugggguuacaggccagucaccccagcauuucagaagcugagacaagagaauugucaugacaagggcaguuucagugauaagagcgagacccuaugaaagaaaucaaggaacucugaagaacaaauacaauaacagauacaagaaaaucugcugcccucuagggagggugagugugucuaagaucugugccuugcacugccuggugggauaggaaucaggacaaagagccuaccaauggcuuagguugaauguauguggcugaauuaucuugguacgcaaaaauaaucaaaauuauccuuuaugaccaagcacacagcaugaaaaugaagccucuuucuaaucuuaucuaguuuuccaguucccacacccagaggcugcuacuguauugacuucauguguauccuuguaaagaaauccauucauacacaaacaugccccuucugucugcucccggugaucaaagagcucucuagugggcaccugggccugccauuccccuuugaggcuuuucagcagauugagaacaaacaggauccccaagaugcuugcucuuccccaacccucucuuucugugagugugugugugugugugugugugugugugugugcgcgcacgcaggggggacugggucuugacucacugagaauaaccuugaacuucugauuuucuugucugcacuuccccagauguugggauuacaggcaugggccugaagugcugaggacugaaaacucagggcuuuuuguauauuaagcaggcacugacaacuaagcuacaucuccagccccccuaagccuuuaguuucuuuaugcgcucuguguccuuccuuuuuguaauuuaucucuuuuucaggccuuggauuucaagucaguuccucaaaggagcugucucuaaaugucuuuaacaccaucaaagccuuccuuugaaguaauccaugcaaauguuucguuugcauauaacugcauaugcauuuauaugguaauuuacucuagcuggacuagaagcuccugaggguagggauuccagcaucccuugcacaaauaauacucaaaguccugggcuacaggauuugagaaauaugucuuuuuucauauuauuuuucuuuuaaaaauuuuccauuacuuauuuuauguauagaauagggggaaugagcacaccacaggguacguguaaaggucagaggucaaguuuuggagucaguucucuucuuccacuguguggaaucuucgggcuugguggcaagccccuucaucugcuuagcccucucaccagccuagauaaauaguucuugaggaaucaagacuugacuaguagagcugaaaaggauuguggaauucuuccuuuuuuuuuuuuuuuuuuuuuuuuuuguuuuuuuuguuuuguuuuucgagacaggguuucucucuguagcucuggcuauccuggaacucuguagaccaggcuggccucgaacucagaaauccuccugccucugucccuuccaagugcugggauuacaggcuugugccaccaugcccggcaagcucuuccuuuucaccuugaaaaguuuacaaaaguuuuagaugugcacagaagucaaaagagcaccacaaugaacuucucuauguacguccccuggaaucaggagcugucacaguuuuuccacauuuucaugaucuucccuucuuucauuaaacacuuuccuagcuuucugaaagcacagagaugguaaucaccauuuauugaggguuuacuauaugcuggacauugugcuaaaugcuuugcccauauauugucaucuuauauucucaauaacucugccaagugacauucuuaguccuauauuagugacaaacaaaaaacaaaaaacaaaaaaaccaacacaccuuaaaucaguuuauucugugucccuagcucagguggguaucugguauauaaggcucauuuuuuuuaaaaaaagaaaagauuaauuuauauugguguguguguguguaugugugugugcacccugugcaugcagauacucuaggagaccagagagaguuagaucucuggaaccagcuacaggcauuugugagcauugggaacugaaccuugguccacuauaagaacaguguguucucuuaaccacggagacaucccccaagcccauguucucagugauaaaacauugcuugucauaauuuuaaucaaacuuccuuucuauuaucuuuucuccugcccagcucuauggguuucaaagaaaaauugaagcauuguuuuggucuaagguauaaacggaaggauauuaugauuguggaaaggaaacagagauuggcccuauuauuccccuauuaaaaaucaauucugcuaggugguggugacccacaucguuaauccuagugccuggaagguggauuucugaguuugaggccacccugguuacagagggaguucaagcuacacugagaccugucucaaaaaaaaugaacaaaccaaaccaaaccaaaccaaacucagcucagugagcuggcaauaugguucagaugguaaaggugcuugcugccaagugcaacaagccgaguucaaagcccaggagccacacgguggaaagagagaauuuauuccugcaaguuguuuccuaacccccuggcacuccuccucuccccaauacacacugugucaagugcacccccccccccaaacaaauacacaggcagacaaagauauauaauaauuuaagaacaauaauauuuuucaacgugucagagguuuacuggggggagagggaaggugguggcagaaagagaaagugaaaaagagagacgacaauaauuauugaaaccuuuauuuauuaagcuucacugagaucgggaaauaacggugagccagauccauacuguccuggucucguggaucaaagaugagcccuguugaagccaucuugcuuaaauaguccuuggccucuuccgcuggaguuguggauuuagagugagaggauacggagcagcugacauggaggccucauccaauccagucuaagccuuacucaguaauugcggccccugccuggacacuggagcuuucagcugcuaacccaccccacacuagguaggugggcuucgaaggcggagcuccccggcgccucaagguuuuguuaacacugagaauugaaagacccggcgcaccauaggaaacaugcaggaugcuucaagauaggaaacaugcaggaugcuuccagacacaagcuugacaacggugcacaggagacuuccugccgguccccaacugaaaagaaugggaauuggcgacaguuuacagcugacuuauuucuuagacuucauuucuagaguuacauuuagucaacuuuuaacaaugaugaaaaaaacaauaccaccuguguagcccucaaagaauaaacccagaaggcuuccguacaaaac

SEQ ID NO: 9260 - RNA, 1548 nt, Mus musculus
uuucuuuacugugggucucaguuuaccuucugggaggaaguugguuugguuuuuccagcucugauacuccauaugagguggggguguuugacgaauugguaacguugaggucuggggaauucacacagcagaacuugagggccucuaccugaagagcuuugcugcaggauccgagcaaaguguguguguguguguggggggugucauugaagagaagcgauuaugcccacagagaguuucguguguggggggggggggggacgggacaccaagaccauggagugaagcagggagagagcucucucauguuggaugauaccagauaaagggaugaacugcccagaagaggaacugcccagucuaaggcuguacugagaagugacuuggaugcuugcacuugaugcugcaggguugaugugcccaggaaaccagaagagaaacagaggaccaggcagcuuccagggcaguagaugggagcgcagggaaggcccuacucacuacucucugucgugcagauggggagacugagagcgaggagagaauaucccuagugagagccugaguagugaugaccguccacaggaaauggcaaucuucugaggggcaggugguauuauaguucagaaauugaagaggcaacaagcagaauaggcgugcguguguguguguguguguguguguguguguguguaggucaguggcaggagcccauccuagcuggaaugaggcccugaguuugccacacccagcaggggguaauggaggagggaggaugguuaaaaggacugagggugagggugggcaaggacggugugcauccccuuaaagcaguaaccauaagguaguauaagaguccagaggugagcgagaaggugggaaagucuuuagguaaaugcaaagauuuuuauaauugaacugucccagagguaugacgauucucagucauuugucugggcuguuucagcucagacagcugguagcuacauucuuacaauguuagucuccuggguuagaagaaaacaggaacagaaagccaacaaacucauaaguaauuuucgaucucauggguacuacuaaugcgugccaaccuccucuuaaaauucccucaacaacgugcccauuuuuuauucuuacuuuucccaacuaagaaauggggggcugggaggaagcaguccaagaacuuacagcucaccagugaaggcgccaaggagauucugcaaucuucuggcuucaggauuaauuaaucacaggccccuggagguuuauuuggcgcuccuggggugaggcgcccggggcgggguaggcuccagccauuucccugugcuuaacgaucaacacggcccccucacuucgcaggguuaccagauccccaaaggcuggagcgugauguauagcauccgagacacgcaugagacagccgcaguguaccguagcccgcccgagggcuucgauccggagcgcuuuggcguggagaguggagacgcgcggggcuccgguggccgcuuucauuacaucccguucggcggcggcgcgcgcagcugccugggg

SEQ ID NO: 9261 - RNA, 3742 nt, Mus musculus
agcacuuuuuaauuuuacuuuauugggaaaucauacaaauucauuauuuuaauauuuaagaccacgggacuguaguagagacacauaaauaucauacuauacauuuagaaauuaaauaaagucaacaugacacuauuuuaaaaaaaacaauauacacuucaaauaaguccaagaauugaaauagcuaucagauaucucccuggaaguggguaaaucuugcagggagauuguccacaggguacacaguggggcuugucuucauuguaggagguccauuuagaagcugccaaucacagugccuagccagcuccacuguaaauaucuuaagaagaauuuuugcaaacucuuugccuacacagcuccgaaggccuccuccaaauggaaugaagcugaaccgggaagcauccucuggaugaggcacuauaaagcggucgggauuaaauuccuccuuguuagugaagauaucugccacaucgugggugucacagauacuguaaauaacauuccagcccuuggggaucugguaucccuguuuaaaaaaaaaaaaaaauccuaagaauugacaaucccggcccugagcuugcaacaacaaaaagucauuacuagcauggauggcauuaagagaggagagcaaauugguucccaguaccauaggaggcaggacacugucaagggcagugagccacugcucugggcagcugaugcucaacagcauagcagaguggacguggacgagggcugggggugggggacaggaggugcacucacauucagcucaaaagucuucagagcaacccgaaacccuccuggaaccggaggauucaaucgcagggucuccuuaaugacacacccaguguauuuaagcuguuccaaaguuuccaugucuaacuuguugucuugauugcucuugcaaaguaagcccuauggaaacagauaaaaaagugagugauggaucccugggcacuccaaaaaaaaagucagcccagcaggacucaccuguuaacuaaaccugaaggcgucuggaugggagaggauaaaagggaaagagcugauggccugauggccuuccuuuccacacuuccucagccuaaacccauuauccagacaauguugcuuaucagguauauaaagggucauacccugagcccucaccaacacugcgacccugaucagcuauuggcucuaaucacauuauucauguucuuggucagggaaaggagaaccuugcucuauaaaagguggugauggugguggugguggaggaggaagaggaggaggaggaggaggaggaggagagggucaaauucugcccaagagagagcccaguacaaacaacugccuuuuuaaauucacgagguggagucucucccccacagucccaccuagcucucagaucuucacugucauaguacuggguguaucgagcaaacuuauauacaguggggguggugguggugguuaauagaggaauguccuaggcaaauggggaaccucuagaaucauccuaccuugcucuuuaucucuucucgaacuuucuggaggacauguggguagaguccuagguaagugaucagugacgucgcagcacuggcuguaguuucaugaccaccaaagaggagcucuguugacgauuguuuuagugccuaaggauaaaaacggaaguuuauacagaucugagugcaguuuauagcacuguuacaaagaccugaccugagaauauugcacggaagacuucaaggguaaaauccguuuuguucauagaaagucaaagaccacaaacaaaaacgcaaaacucccuuaauccugcucuuccgcuuuaaccuuuguagaugagccuugcccuuugaacuuugggaucuuccccauugcucagccacccccuuccacagcucucuagaccaaugccacccuuuaauacgguuccucguguuguggugacccccaacgauaaaauuaucuuuguugcuacuucauaacgguaauuuugcuacuguuauguuucuugauguaaauaucggauaugcagaugcucuuaggcgacccuucugaaaggguuguuuggcuccgugaaggggucacgacccacagguugaaaagcucuagaccuagcaucgccgcccacuuggaaguagcuggggccuugacagggcuuuggagacccccagaaagugugucuggaaagucagaggcacuccccggcccuuggcaccuuuugaaauugcuucucaccugcauauccagccucucuccccucucccacgagugcucaaucaggagcugcagcgcguccuugcaacccccauccggcucuguagccugaagccggcggaucuuggcgcgaauguucuccucgaugcgcgcguguauaagguuccgcgccuucacgcccugagcgcggagagagcguggcggugagcggaugcccgagcuugcguuccccuacuccgacuccgcaaaccgcccuuacccgguacaggccgcuaaagggcacgucaaugggaagagagaagagauugcgggucaucuccucgaaagccuccacgagcugcugcucguccuccccgccgcccgcuggacccggcucgcagcccagcaggaugcgcauggcgaugcggaacaugaggcgcuucaccucgggguagaccaggaggccgcgcucgccgcagcuuagccacugcuccagacaacugcugacuuccucagcgaucacgggcacguagcacuggagugccucgcggcugaaggccugcauaaucaccugagcaccccccaggagcagagaguguuacaauccucuacuuucccucagccccccccccuucgccuuuccgaguacccuuucaagaauuucaguccccccaggacuaacccacgugcuagcagaaaagcuaaaguggaucucagauagagaggguccugguccccaccacauaggacuagcccucgccccgcaucuauuugccugaaccaagccauaggaugaggucucccugccagccaaggaguugccagcucacccucaccuucuuucgcugcuugugcgaggaaucgugcagguuggagaggcagccagcgcccaggauggugcgcaccgacgcgggccagugcaccgacaccaaccggugcucucccagcaagaugcgccgcacauuauccgcgcccaucacccgcaccgugggccgcccaaacagaugcgucuuguagaugaagccguauuuccugcgcuucaucugcagaaacuuccuccgcugagagggagguggaggagagagacccgcaacccgcaugagggggcgccggggagcaucuggucuccgucuagccccucuuccaagccguggucgccucccucgcgaggacacuuaucccaccuucagcccaggcccagagcugaggcggacuccgggggaagcgucaggucccuucccgagcucccuuaccugaagcaccaucugcaauguuuccccaaagaaugggaagcccaugguaccggggggcaaggggagggcgcagcugcgaucgcggcugcucacacaguacaggucccagagcuugagcgccgccaggaagagcagcagcggcagcacgaaggugcagagcgcacuggccagcagcgccgggagccccauggcacgcuucagccucccgcgccaccugccgccgccgcccuagcuccgaaccccgccgcgcgcccucuuuauaaggccgcccagguuacugcccacguuaccuuggucagaca

SEQ ID NO: 9262 - RNA, 4377 nt, Mus musculus
aaucuuuucuuauaaaucuucuguauuuauuuuucauaagcuguuuguuaauuccaaccugugcauauauuucuguuggcuccugccugguucccacaucuucacacccugcugugaugaauuuuacauguucagucauagcuuaugaacuuauuuguugaaugaauggaugaaugaauaaacuaugugaguauacuuagccacaaguaaaagauggaagcaacccaagacauugggucugggaauaagcuagccucaaacagauggaugcgauuccgccuauagggcauguuuaugagaugagauguugguugguguuuacauagauugcaggguggggaaaacuggaaguuaguguuucaugggcacagacugucaguuggagaagaggaaagugccauacagaaagagagagcaugauaguggugcaacaggggauugcccgacauacuacgaaagccuacguuuaaggagaguugaaaggauaggcuuuauaugauguacauguaaccacaauuaaaaaaaaaaaccuaaaccuugguuucuggagaaagaugaagcugggcuuggaauccgacacagcaugugcuuucugcaugauuuguguaagcuguguauugaugucuguggcccagucuccucacugaaaagugagaauaaugagcguucccacucuacauacuacaugauguuguuauaauugcaauugugcagagauuuauagagcuauguauuuuauaagccauucgaaguuuagaagaacguuggugaaugauauuugauauuaucuuugauuaaaugagacauuaaaacacaacauacuaaaacaaaauauuuaccaacucaucacuacuacauaacagaaaacaacauuuugauaggaaaggaaauauaaaagaaugcuuuuaaagugaaaaacauuaaaaaaaaggcauguugucaacaaucacagacuaaguagucuccccuggugaggagaacuuaaaagcuaaacagcccauaugcugguucacagccacauguaacuucggucccaagagaauccagugccuucuucuggccucucuggaccccaggcaugcagguggugcccagacauaugugcaggcaaaacacccaggugcauacaauuuaaaaaacagaagucaaacaauaaugauuuuuuuuuuuuagaacucuguucaaagacaucaaaaagagagaaauguugacaaucuacugauacugguuccaaaauaaagaggaaauccacaaaagucggucuuggacuucagaauguuugcagaaucuggauguacuggccaagagacugaccaaugacuucaacaggcuuauggggcugagggaauaaaaguuggaauuuagggcgauaaaagaaguugucugaccucucccacuacuacaucuuugggcugagagucuuaaaggcuacaccuacaaguaaaagugaacucugaacuuucuggccaaacuuuaaacaguaccaggguaagaaauuggauuaagguaagccuggguuucuagugugcccuaaaaaccuggaauaaauauaugugaaccauuuccaauacccaaugucucauaggaauucuacaaauaauuuuacaaaauacaacgugaagugaauucccagguauagaguauguguacuaaucauaucugaaaugaacuaaaucagaaaagagaacaaauaauagaacagcccaguguaggcucuauagagcaguggcucucaaccuuccuaaugcugagaccuuuuauuaugguuccucauguucuggugacacccuaccauaaaauuauuuucauugcuacuucauaauuauaauuuugcuacuguucugaaucauaauguaaauguguucucagguuguuuuaggcuaccaaacccugugaauaggucauucaaugcucaagaggguuaugacccacagguugagaaccccugcucuagauccuggaauucugguuuauuuugccauugguagaaagcaaauucaggggcuugugcuugcuacacaagugcuaugccaaggaacuacaucucuauggccuauauauuggaaaucuugaacguauuucuuaagugccuaggcuugguaucugagggaaacuccugagacuuuuuguagugaucuagugucucggucacuuuuuauuccugggacaaaauagcugacugacuaagggaaaaaaaagauuuuagcucacaguuucaguccauggucuccugacuccacugccccagggcucauacauugugaggcggaaccucauggcaggaaagaugugguagaaaacuaaaaggucucuccucgugacgggcaugagggagagagggaaaggaggggagagagggaucaaaauaagaaauucucuucaaggguaaacuccaagcaacccacuuucuccagcuaggcuccaugaccaguuuucaugaccucccaaucauguuucaaauuaagagucugccaauggacugauucauagauuacucuugaaacucagacccagucacuucucaguagggccaccagccggggaccaggcuuugcuuucaauaaauaagucuuucagaggauacucucaaucuaaaucauaauguauaggaacuguaguaaaggacauggcauauuugaagaagagucaaauagugaaucuagaacuuaaaaauaauauauuugauaggcuucguaaaagauuauacaugguugaggagaaaaugagugaaaugaaagauaugcaaauggaaaagcucuagaaugauggauagagaaacugaaagacagaaaaccaugaagaaaaaaaauaauaaaccagagaaaauggugaguaaaucuaaugacacauguguguuuggaauucuagaaguuaaaaggagagaguauggagccuaagugaguuuuaagaggugaagaugaggggucgcuuugacggaugcacuuccggcgguggcgacuuggacgacugaaggaagaugggucaaagucagagugguggccaugguccuggggguggcaagaaggaugacaaggacaagaaaaaggaauaugaaccuccugucccaacuagaguggggaaaaagaagaagaaaacgaagggaccagcugcugccagcaaacuuccacugguaacaacucacacccagugccaccugaaauuacuaaagcuagagagaauaaaagacuaucuucucauggaggaggaauucauuagaaaucaggaacagaugaaaccauuagaagaaaagcaagaagaggaaagaucaaaaauggaugaucccagggggacccccaugucuguaggaaccuuggaagagaucauugaugauaaucaugccauuguguccacaucugugggcucagaacacuacagucagcauccugccauuuguagacaaggaucugcuggaaccaggcuguucaguccugcucaaccacaaggugcaugcugugauaggggugcuaauggaugacacggauccccugaucacggugaugaagguggaaaaggacccccaggaaaccuaugcagauauugggggacuggacaaccagauccaagaaauuaaggagucuguggagcuugcucuuacccauccuggcuauuacgaagagauggggauaaagcccccuaagggggucauucucuacgguccaccaggaacagguaaagcucuauuggccaaagcaguagcgaaccagacuucagccauucucuugcgagugguuggcucagagcuuauccagaaguauguaggugacgcggcccaaacuuguccgggagcucuuccggguugcugaggagcacacaccguccaucguguucauugaugagaucgacaccauugggaccaaaagauaugauucaaacucuggaggugagagagaaauucgacgaacaauguuggaacuguugaaccaguuggauggauuugauucaaggggagauguaaaaguuaucacggccacaaaccaaauagaaacuuuggauccagcacuuaucaggccaggccccauugacagaaagaucgaguucccccugccugaugagaccaagaagcauaucuuccagauucacaccagcaggaugacacuggcugaugauguaaccuuggaugacuugaucauggcaaaggaugaccucucuggggccgacaucaaggcaaucuguacagaagcuggcuugauggccuuacggggacgcagaaugaaaguaacaaaugaagacuacaaaaaaucuaaagagaauguucuuuauaaaaaacaagaaggcacccccaagggauucggucucuagugacccacaguugucuucagggaugggagcugcccccaggaacccauuuuccaguucagguuugccaguagaaagccu

SEQ ID NO: 9263 - RNA, 144546 nt, Mus musculus
cauaagccgcgccugugggccugcguggacuccgggagggaguguggauaucaguuuacacuuggcuuucaguaaauaauccuccagaggcccaccccccugcccugcaccacccccccaccgcggugggagaagcccucccccugcccgaggaagcccucccccagcugggagacauccuccucccagggcggagggcccagcgccagcaccgcgucuucucugcuuggcugcgacuugcuuucuccacgagccaugcuucgagugauuguggaaucugccacuaacaucccuaaaacaaaauuugggaagccggauccuaucguuucugucauuuuuaaggguaagacgacgacguuuucuucucuuucugaaacccuuuaauggaaggcuagacuuuugaaucuccuucaagucagcucuuggcaucuggugaagccaagccaacucuguuccucuggcggucccagguuuaccugggcaggucacugucguucacuacugagggaaucuaacuuuuccuagggcuuggagaaucaccgaauggccugacauuucuguaaacucucgggaaccucuauuugcuacucuucuggauuucaaguaugaaggucuuugucgguucaaaguuagugcgcauagaugugggugcguuuugaaacuuucucucccugugagaaaugaguagcggagggaacaauucauuaauugcuggaggcaccauuacacuauuaaccaguuccauacugcuuuuaccaucauuugggcuuugcguagggcaugaaggaacucucucuaguguucugaaucuccaggaguugggcuguuuggauauguucgguaacuuugggauugcccacccuaaaggagcucugaagcacaucugcagcuugggagucuggcucuacagcacuggauaaccuugggcaaaugacaucaucauuccucugugucucagcguuccucugcaaaacaagggggaagguuuagacuggcuggacuuuaauagaccccuuggaauuccaaacagauaucugugacacuagcugugauugcgguggaagggagccggggaggggaacgggcagcuguuaucauaggaugccccccuccacccuaguggggcagguggccauggcuuggguuuggcugcggucuuggcaaguugcaggcucccuuggugggggcacccugcugaacuggaacuuuugacaggcaggcauuuccuuacuacagcuuggcacauuuccugccaaccccaggaaucugacuccuccucccuugcaaauacuguguaauucaccccuuucuccacucuccuguccauuucugaaaaucuuuauuucuguucucaaaucuuuucuuccaagggugagcaagaaaaggaaaaaugggaaacgcaaagcugcuaaagggcuguucaguuagaaagagaaaaagggaggagagaagggagggagggagggaggagucgggagagggaagaugaaaagaagagaccuagaaaacaaaauucaaauucuuacuggacagugugguuuauaguucugacucuagauuauggagacacauauuagauuuauuugcaugugguaauuuuaaaaaucuaacuuaaagcagucuuacaauacugacacaacaugaagaauuugcaccuuucauuguuggcaugugaaaaagggugcuaagacugagaagucacaauuuagggcaaauuguacagauuaugaaauaaucugaaauugacaguguuaaaaaaaacuaauuuauuagccaggaagaauauucaauaauugaaacuuuuaagugacuuaacaauaugucgaugaaugaaaacgcuucgucgagagggagaaacuucagguaaauugguaaauguagucuaggcacacaaucacaguuuugguucccuuugguuguacaauugagugguaaagucauucauucauucauucauucauuuacuauuucauucaucggacacaagaaagaccauugaacucagggugggaauguuugaacuccaggcaagcacuucuuuuugguggggucuccuuuuuuuauggcccugggcaucagaccaagggcacacucuaccacugagccaucucugaccugcacacuggacacuagccagcauuaccuaaauaacggauaaccuuggauaucccagcucuaaccauucaggucucagcuuccuuagccauggcaaguagcaggacacuggcuuucuaguuucaaggugcuucaacuuucuaauaccagacuuugaucauuugugaggucugaaagccauggucuugacagguaugggacaggcagucauggccaugauuucuuuuccugccuuccuuuccuccccagcagucugaaaacccuggauacaucaauuccuuccagugcccaauuuugagagcuauguaaaauuaaguugaauuaaguccugauagaacuaaggaucucaugucguggcaucaauguucauaaaugaacaaggguggaaaagagcucagcccaccuccuggaaugacaggaagcauggccaacugaagggagaaaugggggugaugaugcucgcauggauacugugagguccugucuguccaucagcuuuccauuucugugacaaggauggagauaaucaccgagaacagagaacauggcuuuuggcccagggcuuuagagguucaguccacaagugagcagaucuauugcuuuucagccucucggggaggaaagguuaggacuaccaucugguaggaguguauggcagagcagucuuguacauggccaggaaaagagggaggggacaaaggcacaccccaaugacuuaacuccuccuacaaguccccagcucuuaaagguuccacugccuguucaugguaggcuggagaccaagucuuucacugcugggacuuugaguaccacaucucugacucccagcagagacccugcuagccugcaauuacacugcaucugggagcaaacguacuagucaccaacuaacugcauuggagcagaucucaggccuuuguauagccuucggcuggcuguggaguuguugcuccgggccucgggugaaccagaagggcugguugugcuucuuuuguggaaaugaaggugugcaggaguggauuaugaaggcagcagagcuuaugucuuuuccgucuuggguuccacgaaccaguucuaaauuuuaagccagccugcugagaacuacagguagcuaucugccucaagcuccuuguagacagcuagcgugugcagcugggcccaacagggauuaaauauacaagccucugagaccucucaacucccagacauaagcauuuagacauucuaacugugggauagcgagagggucgaugguuaaaaacacucgcugccaagccugguugucugaguucagucccuggaacccccauggggagagagaacaugcuucuguaacuuguccccuaaccaccccccaacacacucacauacaugcauacauacauacaugcaugcauacauacauacagagagacacaaacacaaacaauaaaagaaaacaauuaaauuuuguuuaauuuuuguuaauaucagaucuuaauucuuugaaugacggucaaauaaaguaaaccaaagcauaaaagggauuaaacaacugaaaaaugacaacucuuccugcuguguuugcagucuuccuagggaccacugauccaaucaauuuaauugaggcaggggcucauguagcccaggaugaucgucaaguccagagcuaucugaggaugaguuugaaccucugaucuuccucguucuccaguucuccuuauccugaaugcugggacuugccaucacgccugauguguuagucugaacaauuagguuugaaucucuuacauccucuugcuguaggcagacaaguugcuccagccuugugagcaugugcgcuucugaaggguuggugcuguggggauuuuuuaguuuguuuguuggccuguagcccuuuaaaggucauuuugcuagcuggauauuaccauauacuuuccuuuuccccucuguuucaucccuugcuuuuguaugaaaagagucuuuugaaaagguuaauagagagaaaccuuucuuguauacucauacgcuggcguguuuuauucauagcaguguuuuauucauaggaucaucccuuuccagggaaacauggcggccacaacagcagguuuccuauccuguccuugugauagggucacuuugcacccaagcuuccauucaaaaccaucuuagggaacauaguaagugugagugugagugugugugugugugugugugugugugugugaugaucagaucaaggcaauuuggcuuaauuaccaccucaagauuuuguauuuccuugugugagaaacauucaaaaucuugaggcauuuccuuccuuccuuccuuccuuccuuccuuccuuccuuccuuccuuuuucuuuuuguguauguaucuguuugugugugauguguguauguguguacaauguccacaccaguggugcaugaauggagucuaagaucagccuugaaugacacuucucaucuuccaccuuguuugaggcaggucucuuguuuguagauggcccacaaguuucugggggauucucuuaucucuucuguaagagaguuggaauuauagggucauacggugcccaacuuucuguaggcuuuggagauuugaacucaggcccuugcccuugcucagcaaguaccuuacccacugagccaaccccuacuguccagagguaaauucuaaaagaaucuuuuagauaagcuuuaagaagcugugagauuccauucggaguggugaaaucucucacaggguccauucauuguagacuauggagguaagcuguccauauagaaucuugaucuaccuaggguauguuguagagucuagacaguucuucacagguaaugauggucaugaaacuuggguacuucaguagaaccaugguauuguauugacaaauacuucagaaagcaaaacuguuuaaucuacugagucauucuccucacuuccgggagaaaagggcuuggagacuaacuguugaaggaugguggccccacccugccgaagccuggggacuguacauuucccaaaggcacauucuuuggcucucagucaucuacaaaaccacaguugcuuuuagaaauuaauuagcuuguccuguuuuuccuucccuccuccacaacauagcuuacccauaugcucucagucaggacacuggcacuucccuggcuucuuuucuggucacugguuucucucuguuccuaagaccaguccaaguggcauauuuaugccuucuccaacaacugauagauugauggauguugaauaugcuuuuucagcauuggccacugaaagagauggaaggagguuagagacaucuuggaauaacaaagccucugucuguuaauccugaaaggggccacggugauuggcccaucuuccguuguucaggaaggauuacacuuagaauucuuucaugugcccuguggguggaucuagguaaaggaacaacugcuccacacauuccugauacugaacugaacacaaccgguuuguagcuccuguuauccagauaaauugauguguuugaauucuucuauuugaaaagaacuacaugaagccgcugcccuuccugcugaagauucauaugugaaacguguacuggucuauaacacagauacuacccagaacacuguggcaugacaaccgucucccuacucacggcaagcuucgguggaacagcugcucuguugaacagggcuguacuuugagcacaguuuucguucaaaaaaaacagcugugggacaucugccacuuuaagccuuuaucaacugacuucuaauuggccauuacagaguaaaggcccugggcuuuagagccagccauaccugaggaauucuaauugccauuucuuguuuucuaauugcuuaugagcaaauaaaaucuccgguuucgguguucuaaguaauacucagugcugguuaguuucuuucaacuugacacaaacuagagucaccugggaagagggaaccucaguugaggaguuacucggaugagauuggccugcaggcaaggcugugggggcauuuucuugauuaaugauugauaugggagggccugguccacuguggguggugccaucucagggcagaugguccugaguuguaugaggaagcaagccaagcagggaugaugaacaaaucaguaauugcugucccuucauggucucugcuucaguucucaucuccagggucuagccuuggcuucucuuuaugaucauuugugaacagagcauguaagacaaaugcaguuuuuccucuccucagguugcuucuggucaugguguguuuuaucacagcaacagaaacacaaaauaggauggccucuccuaccuugcagggugacuuguggaucagguggaaaugcagaaggccuugcacauaggaauucuaaauuuccucuccuguuugauaaguugccagugucaggagccauggugaaaacaccuaacacggcuguucuccuaggccuccgacacuagaaugagaugcaugagaugcaagcuaguaccucguuggaagcgugggaaaaguugcaauuuaugaguaaaaggaggccacguuugguggcaugugccuguaaucccagaccugagaaacagaugcaagagaauugccacaaguucaaggccagccuggucugcauagcuaguuccagaucaggcauauauaggaagaccuugucucaaaaauugaaucaagcaagcaagcaagaaagcaagcaagcaagcaagcaagcaagcaaaaagaguaaacagaagaacagaaagcuuugagaggaaaguguuuauauuuaaguuggucuuaaaggauacaugaagacaucauuaggaggaaguaguggacauaguuuacacucgggucauccuaacaccugggaggcugagacaggaggaucacaaguuuaaggccugacugggcugcauagugagauccugugaaaggaaaaaguaagggagggaugggggggggggcggggaaggagggauggaggaagaaguuauuccagacuuugaaacaaccacaaaggggcuggagagauaacucagcaguuaagagcacugacugcucuuccagaggucaugaguucaacuccuagcaaccaugugguggcucacaaccaccuguaaugggaccugaugcccucuuuuggugugucugaagacagcuacaguguacucacauaucuaaauaaaucuuagaaaaaaauaauaaccacaaaggauaguggaguuguggguguauguggugagauuaacaaggguaguccgguuagggaguugugaugcaugguaaccuacuggaaaaccucucugagaauggcaucaacaggagucugggggauuaccuggguuuguugauugagucaauugcucuccagaacagaggcagcuccuucaggaccaccuuuagaagggaggagcuaaugaagccugacugagccaaauaagugagaaaaccacaccuagcaggcuaaugggacuucuugugcuucauugugaaauggaacuccagccauccccgugaccccucagaguguuuacccugugggugagcacaggcugggugggguggcucugaaagagacugucaugagggaggcaaucggagacaacagcuuagaaggugaaagugauauuugaaaacaaacauagcuggcuucccacaagucagauggggagcauuuccucagacaagcugagauguggcucucauccacuccucucauugcaucccugcccaaccuggaaagguaaggugccaccgccaagugucacucugcaaggagcagaagcucauucaagcuugugcaaggaaagcgugguuucuaaagccucagagagaucuuacagaauauagauuaugggcuccaaggggccagacuacugucaggcaagggccauuugcagcccuguguucucuuucccuccaguuacuucuucucacccucucucauucccccccccccacauuguccccaagacagaccucaagagagugaccccaguuggcauaguugugugagauugguucaucccaaugucugugauccaaaaguacagcagcccaggacacaaaccccagguauaccagauguaucuacugcagugugagaccugaaagcccagaacuugaaccacuuggcucaucuccuuucagcucaguaaauuuagacccguuuuuagacaaccacuugacccaaccuccuauauaaagugucccuucuuucuaugaucaacacaguauguagaaaaggauggucuuuggacuagggaggugaaguuuugccccugguuuuauuacuaggaggugaaaaaucuuuggguaacuauauaucuagcuuucauuucuucaucuauaaaagguugggaguaaggugcaccuccuaagguauuauaaggagaaaugguggugaaucuaaaguacuuucaagugaucacacccucccucucuucccaccuguggaggaugcacagaagccuggaggacauuucucaggggcagcucaggguuagacuaaguggaaugcccuuuagguauagcuaugacuguaccagaaucagcagagccuaugucugauuuauuggcgagagugugccagggcaucucuuagguacaagguuaaguucuuuguuucucauuguggugaaaggcauaacauuugucaucucaaccguuucaaguacacaguucuguuauuaaauauccacaguggugcucuuaccuuuaggcuacaguaaacacuggagcuguagacaguggugugcagcucuccuuuagaaggcuacccugagucuagucgaguuaaaaugaccagucagcuaggggcucacugagacugaaacaccuaccagagagcacgggugggacagaccuaggcccccuauacauauguaacagaugugcagcuuggucuucaugugggacuccuaacagcuggagcaggggcugucucugacuguugccugccuuuggagcccuuuccccuaacugccuuaucuaguagccucaauaggagaagaugcaccuagucuuacuacagcuuaauaugccaagguggguugauaucccugggaggccucccuuucuguaaagagagagagagagagggagggauggagggaggagagggaagauggaggcacugggaggagaggaaggaggacaagccucgaucaggauauaaaguaaauaaagaaauuaauuaaugaagaaaacaacagucaacuugcucaaaucagaauauuuuacuaauuuaaaaaaugucauuuagagggcuggagagauggcucagugcuuaagagcacuggcuguuuuuucagagguccugaguucaagucccagcacccacauagcagcucacaagcaccuauaauggaaucugaugcuuuccuucuggaaugcagacaugcaugcagacaaagcccugaaaucagucaaucagucaaucaaucaaucaaccccuccccccccuuuuuaaagccauccagcacucauuuucagguuuaucuagagacuuucuguccaauggagcuuccugugguguggaaauaguuaagauccacccugugugacaggaagccacuagccacaugugguuuccaaucaccaaaaugcagccacuaugaccaagggcuugaaauuuuacucuuaagugcaacuaguuuaaauguacauauccgcacguggucacugauggccuauagggauggcagcagagauugcagcagauggccccagcagcugagugaccaggucuuccacuugcuuaugguugcuagaaccugcagauccgguggccucaucugucaaauggaagguguaauugucacuaccccacacagcgcaugugcgagcauucgcacugaggcagugggagcaaagggcacugaguguugacugcugcugaaucuucagggggcuuggacuggaagcagccugaggaaucagcucacgccgcucucucgccccuuagugcucacgcagcacgcaccuccacugcugaauccucaggguucucguagggacgucuucuuucaccuucauguuccaugcagaggacuugggcagaggcagggcuggguuuaauugcauuccagauugucccugggcucugauggagcucaguucccaugaggagaauauacauaacuggaccaugacaccaagccgaaugaauacucuggcggccccucuggagggguugaguuguucaguaugcuggcaucauuuggaucaagucagaaagcagagagaaauuuaccaaggacaaaagaauguuuuuaagacagggagagaaggaacaaagccuagcccuccuggccgagcuuugucacaagguaaugcaagcauuuaugacaggcugugugacucagaggcacagaggugaaauagcuuagcagcgaaucaguuccacugauaaucuagaucaggcuauuuuauuagcaggaaauaaaggccuaaccuauuuuacacaaagcauuuuuuuuuuuaaaucucauauuuaacuggcagggugaggccccauucuguuuuaaccacagauuucugguuuuuuuuuuuuuuuuuaaccuacgccaucuuuuuucaucccaguaguccugcauagaaauugggaaaacaguucugccaucuuucuuuucacuaacaauguaggaaguuaugguucugcucauccuuccucccugccuggccccucccugucucugcgcccuuuugaugauuucugccugggccuuacaaauacaaguauucaguaacucugggugaaggcuguuaggucaggcaucuucuagcucuuuggagagucuggaucgagcuaggcugggauugugcccacaggcagccuaaaugcuaugcugcaagcaaagcagaguuugaugaaucaaauuuuuguuguuuuuuuaaagauuuauuuauuuauuuuuauuuuauuuuauguguauugguguguugauugcauguaugucugugugugggugucagaccuccuggaacuggagucauagacaguuguaaacugccaugugggugcugggaauugaaccugggucuuuaggaagaacagcuagugcucuuaaccacugagccaucucuccagccccuaaucaaauguuuaaguugucuucaugugcaggucacauugaggaugagaacuugacaguuuuuauggacuauguaacugcuuuauuuuuauuuauuaauuacauuuuaauuaauuaauuuuauucacugaaaauagaaaaaguguguguguguguugggggggggugugagacaggauuucuaggugugacucugucuauucuguagaccaggcuggccucauacucacagaaauccaccuuucucugacucuagagagcugggauuaaagguaugacccaccaccaccuccuggcuauaaagucuuucuuuaaggugugugucugcucguuaauguguaugcaggaagguaugcuugcauaagcauguggaggucaaaggagaacucugagcauccucucuugcucuccaccucauuccuuuaagauaggaucucucacugaagcuugaacuuuuaggcuaggcuagacuggaagccaccaagccuuuucaaucuucuaaccccaauugcuaggacuacagguacaagcaucuacaaccccaauugcuaggauuucagguacaagcaucuacaaccccaguugcuagaauuacaggcacaugcaucuacauccauuuucuuuuacaaggguucugaagaucccaacucaaguccccaugcuugcucaguaugugcucuuaccacugagccuucucuucagcccagaagugaaaucuuuuccagcuagagaagcugucuuaaguagaauggguuaaguaucuagguaagauucucauagcagguucaggcagaggugggguuuuaccaccacacucuccucuucugaggccaucauacaguuguuuccuaugcagagcugaguguuaucucagccaugucugucuguggccgacacuccccuauccacggcccuuugggcauucuuaucucuuccaaaggaguuuagugcagggcaggugggccaugcaacggacaggcauaagaaccggcaagguugugugagcucagacccccgagaaucucagagaucugagacuggcgggaguagggcuguucccuaccuaucucuguaccugcucugggacauaaccacgacaccccaccgugggcagucacuuucuuaaauaguacuuggaguccuucaccaugcaaauagagcaucacuaacaucucaaacucagccaacgggaaacaucuaccuaaaugcuaccacacuccucaagguuuguauagucccuggaauaaagggcauaaguuauuuccaccaagaaucgucugagagugucugucuuuauugagcuguaacacuuggggaagaguucucccaaagcauucaucucuggaucuuagaccacuuagcuggccagguucgugcugccuccgccuccgccuccgccuccgccuccgccuccgccuccgccuccgccuccgccuccgccuccgccuccgccuccgccuccgccuccgccuccgccuccgccuccgccuccgccuccgccuccgccucugccucuauugcagacaagagaccuaggacuuaggcugccugcacuaugcacacugcccaaacuucccugcuucucuucuaagagcugcaacacuuuaggaauucuggacccaagagagcuccauggaagcucaacuuccuccucuucagucugguuugguacagaggugucugauuuucuuuuuuuaauuuccuggaccuuuuuuuuuuguuguuguuguuauuauuguuguuuaacagugccucacuaugcagcucuggugguccuagaacuuacuaugcagaccaucuuggccucuaacacacagaggucacccugccuucaugucuuaagcuucuggaauaaaaagcaugaacaccuucggaaauucagcccuuggguuucuuacccuacuggguugagacuguggaugcuggugccuuuggucuggacacuucugacuccauagcauugucugagagucccagugcucucuuugcgaguggcaugccuuggagaagaagcccuuccccccucccccucccauacauuuacaugcucaaagucauuucaugagcguggucucaccuguuguucgcagccccuggagcugccuagggaacgguuacaucuguuuuguaggaaugugugagauggagagagagcaaagcuauguaggcaggaagaggcagagaaggaagagaacuugccuggggggggggggggcggucauaguccauggcugccuucucagcucagagcacaacucucuuugagcauggaaucucacacuuuaauuccauccucugauccuuucuaugcuccacugaccaagagcagcccacuuccaccucugacucccugcccuuccucagaucuguagccaacaaucagccagcuucuucaggagcuagaggccagagucaacugcaccguaacauggagggcugagaauguauuaaaacucuugacauugaugaugcuuuccuuaaagagauagaguagcugugggcugagagacugaggcucccgguaaauuucagucagucauuuuuccuccugggaauaacgggcucugauggucacaauuucuacuuugcuuugcuuucguuuucaaaauucucuucugggguugacuuccuuuugcuacaaugucuuggguaggggcuggcugauggaagcaguuacuacuucugauucacaggaacgucccuccgucuuaggcacaguuuuacucuuucacuggguccuugcugccucugugucugguugagccuuugaauccccauuugaaagaaggcucggagggccccuaagaaucauauccucaguugaaucugcugaggacagccuggauucacucucuagcaaacuaugucucagauauacaccagucagaugucagaguguuccaagagcuggaacagcuguauucaaagucuaccuuuguuucuuacugguggguggccuuggauaaacuguuuaacuuucuugugccuugaaaugaggguaaugggacuaggccaauucucucuucucucucuuucucucucucucucucucucucucuguguguguguguauguauguguguuuguagaauacuuauuuagcauucaguaggcccugccuaauuucugccuaaaggcauauauguaauccuacagugugggagguugaggcaggauggccucagggucaucucuggcuauauaucaaguuuguggccagccuggacaugagacucuaucucaaaaaacuaaaauuaaauuuaaaauuaaaauaaaaaaaagguaaccucuaggcaguucuuagcagagugucuggcagauuauaaaccuaaacaugaaagcuaguauucaugaguauuaggucccaggacuuccuaguggagacaucuggauagagucggaagaagcaggucauuaggcugggaaggcuugaaaaagccaccgguugcuugguuccucagcuuauaguggcaucuaagagcccaggcuggaaaaugaagcugacuuggggcaaagacucuccuacccuuuucucugcaggaagucuugggcaagucgauuaacuuugccugcuuccauuccugcaucuguaaaaugggcacccauuccucuauccauaaauugggcacacugguaccucaguaguuagguuaggcauggguauauuuaaaguacccacacaggguggaaagucacauauaaaaucagccuagcagccagugaagcuagagaccauucccaggguuggcuuuaaguaagagucuuuugugacucuuucagauuucugggccucauugcaaguuccuuggggaauauuauuuuauucaggagcucaaacucaauaggacaugucggaggccaguggggcccgggcugcagagggaggggcaggaacccggccugcuuuggccuagaguauuccuguguccauguuaucagcuaccucagaacacacaaagcagcuucucuuguagagugguuacuguuugacccaugcaugucucuuugaacucguuuggcaacaucucucugaagcacuggggcagcuagaguuuggaauuuaaaagucaaacaugccuccagagaguucuccuggguggcuugccaggauucccuuuaacuccuggggaccgaggaguguccuuuuuuuuuuuuuuuuuuuuaaccccuuacagacagcucuggcccugguccuuguagaauuaccccauucuuguggcugccaggcugacuggcaaucagguucgucacugugguguaccagcugcccuggguggccgcugacuucugggauggagcugugaaggaguuauuccaccagggcugucccuugcuucacuggguacuucccgucccuuggagcucugaggccugggaccgcccuggggaaggcaaagcaguguguucugguauaugaauaagaaacacuccaauggcugcugugugcuccgugcucagacucagcgcugcagacuucacauucaugcucucuuuugaccauuaaggcaacacugcacacucaagaagucucucaaaucauggagaagcuacuaaguagcaagcacucuguggggacacgugaauggcagucuuaauaaauuauagccaugaccuucagagagucauagucuuuuaagauugauuuuuuuauuauuugugugggagaagaagaggaggaaccccugagaacgggaauuauucauuggcugugcgcagucuaacauaggugaaggacaugaaauucaggucaucugcaagagcaguaagugcucuuagcucucucuccagcucuaaggagccacguucuuaccuuaguccuccaccucuggggacuggaccuguguuuuaacugcaagguuagaaugccaggucccacauuugcuugcccugugacgugugacaacuggcgaucaucacugcauuugccuuugagaacuguuaagaugaaaucagaccaauguugggaguaacggccaguucugaaaacuuaaucacuguuagccauguauaaaggcuuaaaagcucugggacaauuuuucgcaagguagggcaugaauuuauauuuagcuauucauuucucaggaggaaggggcaucaaccugagaaccaggugaugccuggcugugucgaccugacagaguuaacugucacagcgucuggcaagguaggaacagugaccagcaaaggaauuauucugugaagacaggcaggguugcaugugaguucucuggcacuaaggcuggcacacugcuuaagccuuucagagcugagccaggcaggcuccgcuaaucagaaaacaggaaauguccguaagaaugucuacagccguguguuccaaaguguucugcuuuugaguucguuguuuuguucugggaugaaagugcuuaguuccuuuccaaaggaaggaacugcuaucuuaauaacuguagagguggcagccuacugauguaggugauggggagacaagagagggcacuucccgucauuuaaucugauguccagagccugcaacucugaccuuugauaggaagaaagcagguaaaauauaccgaauagaauaaauauuugccuguggcuacugauaagaaaauauuuuucuucuuuuucuuucuuuuuuuuuuuuggacugauguguuuauguuugagaguaggauuuugguaaaauacaauguauuuaccuuuugauacaaaucagaaccuccgccuuggaagagaucagcugaguuucuccagaaggggaggagcuggcgcucauucuuuccuuuuuccugguuugcugggaaguuaggagagggccuggguuacauauaaggucuuugaaucagacuaugccuggcuagagggcgucuuccuagcucugugaucuuggauagaguucaugaaaggacacaauaaaagcccagcgaugccuggcucucacggagccugucucccaccccaaggugacgccuucagcaugugugucaugugagcagccuggaaucuacugaaguuccaggugaaugccuccaccugggcuguggucagccaccggccuucuguucugcuucacaggcauccuuuguucucagcaucugcccuggucacgugcucagcagcauacguucgauguuuugggguagcuugguuuuccuuggcagauuacuaacuucugaaaagucuuucaggcuggcuucuaacaccuuaguuccuucauuggcuuguaccagccagaugaagguuagcguggaauccaaggcuuugcaucaugucuagccauagccgucccacacaguuuuuaccuccuuucuuggcccuuugccuccaggcaacugugcugugacugaugcccacccccuagcuggccuugccacuucuucaagagagcaguccuucaauuccaccuugucaaucaaccuugacuuugccucuucuuccucugugaggucuuuuccaguacccaaacuugacaucaccuuucuuccccuccccccgaauuugcauguucuguauuccuccaauggcaacuaaaaucacccuuuucuaguuaaguaccucuugacacacccucacuagaccacuugaggaccaagagcucuuacaggcaagugaucauguaucucucucaguguucagcucucucacgugucaugccuggcacgugguaguuuuaaaaauauuuguuauguggaggauugaaggcauucauaaaguuugugaaagaucucccuuagaagaccauggcuaugagguggcuuagccugagccggccgguuacuucucccauuauuucucuuccccuaggagggaagcuuacaaaagaaagccagcuggaucaugugaugcccacuccaguggaaaaguuaaugcuuagcagagugagggucaugacucacaguguugcuaugcugaggucuuggaagaaugagguaguuagucguccgucucuccuccccccccccccccccccccguccucccccaagcagacuguguucugggagaagaagagauguggcaagcaguugaacaaaacccaccaccucccacauuccucagcagcagagcaguggucaggcauggcucaaaguguggcugccaaugugccccugccugcacugucaccggagccccuccacucauugacugggugauuuugacuacgucguuuaaccccauucaccuuggcuguaaaggggaggugacaauaguaauaauaaaaauuacacugcugacgagggaugagguggugcuuucaaugcauacagucgucagaggcaagcucuuauuuugguauccauuggaggauagggacagggaccugaaggaaagccaugggcacuggcugcacucaucuaucuucuccucuagguagauggacuguccaggcucagacacagagaaaaaagaccuuaggucucacaagaugguccaggagugcagggaacccccacguucuccacuggugcuagcagaacuccucucuggaugaggguguggaugaggcuuugagagggagcccagcuuagcugcuaagcugugguguugucuuaccaacuuuggagcaaagagggcuucagagucgaaaucucagguuuccaucaggccacgugugagcgauuugcccauguuguacccucaguguacacaucuguaaaauggcuaccccagacucucaaaggucaguccccuugaauucuuucagcagcaagauagagaugccaguuggaagccugugggagagagaggggaacugaacagcacgaccaugaugguggauucuuaucccuuguagaucucgagguggaggaaauguuuugagaacccaaaugguauucccuuuguaaaccugacucaggugucccccgcagcuggcagacaaagggguaaaugaguggcauaggaggcucugagaaacggcuuuuaggggaaucaaauggaugguacaagaucuuuagugacuucuaguugauugaaucucuugcuuuucuuuuuuuauuugcagaugagaaaaagaaaacaaagaaaguugauaaugaacucaacccugucuggaaugaggugauuuuaucgauacuguuucuucuuacaauuauagacgagcaugcacucauaucauucaacucaaaaguauuuucauggcuguguaauauucuacugaagggaaaucauguagcuucuuuacacugaccccuccccccauaaacacacacacacacaccacacccacacccacaccacacccacacacacacccacaccacacccacacacacacccacaccacacaccacacacacacacacacacacacacaccacacacacacacacacacacacacacacacacacacacacacauacacacacacacacacacacacaccacacacacacacacacacacacacacacacacacacacagagcacucucauaacacuguugacuuugcaucuauuuuuauaaguggcucagaguucaguguuuuuacagauagaccaaauguuucauucauucuuuuccgggugggauuuuccuagucugacuaauuuuuugaugaccagcuuccauuguuucuuucaacugcugggcuaaaccuccccggaccagagcaaugucuuuguuguucucccugagucauuggagggcgacuuuccuuucacccacccuaaauccuucccucugccagccucuuuuaauacgucuaaaucccagggccauaucucaucaucaaugaugggaagcuguggagccucuuaaagcuucugugggaaacccugcuguucugcaggcuguucugcagucugcucucuauaacucacaacacagccaauuggaccuuaagaccugugaagccccuugugcaaugcugugcacuccuagcaccuagcacgcagcuccaaggcuaaaacaaagcaaaaccacauuugcauccuucuaccccuucuggguuggacuaaccugacaugccucucaauucacuggaccucaaggguagagguguguugucaccugagggcacuacccaccuuacuccauuuuguucccaaugucccccucuuuaguuugcaaauguagagaucuagaaaacacucuaccugcuguuucguagcuguacccaaaccucagugaaaugccauugccaccgucuuugggauugguggguguauucucaugggaauugugagccaaacuucuauuccaaagcuacuuuaaggugguucaacagguugcuuacuuugacuaaucaauugaccaccugaucaauuaaaggccuccacggugcuuuguuaucucuguagcaucucuuacuagagagcaagucacugaauuaaagugagaaucugagacacaacaacagcaacuggauagcugcacuggccacaguaaagaggaaacccuccuuagaagauggguuucuaguuauucauuacuguucaacuguaaugcacaagaagagcacgguuuaaaaauaaccacggagggaaguauuuucucaacaguuugguaggcguuaguucauuuuucugacuaugagucagagguuuggugacccgucuauagccccaaggucuagaaaaugggaagccagaaguagcuuccacacucccuggaucucuaucuacuuuguuuucucaccauccaaacuauagaauuuaguaauucaaaggaguguuagugaagauuacugcccaguguguccucuauucucuuuaacagccuuuucacuuccuuuuaacuuuucugugaacagauuuuggaauuugacuugagggggauaccacuggacucuucauccucccuggugauuguugucaaagauuuugagacaauuggacaaaauaaguaaguugcuuccagagaguuuuuaucauuuuauauauauuaucuuaucauauuuguacuguugaauuacacauuauagcauuuuuauugaccuaucugugguacuuuuaauauucuagggcuucaguuccaugucucuaugcucuuacaucuucacgagccaugucagauguggcuauucaaucacagaacuuuucccccaggacuauacucaguguucaauacucagccgucacgagucugucuaucucauuccuucuuugccaacuguauuccuuaccucuagucauuuaucugaguuguagcuacauuaguauaacaaagauucuuugucugcuugugugugcuuugcuagagugugugugugucuauguguguguauguguguguguguguguguaugugugguguguguauguguguauguauguuuaugugugugugugugguguguguauguguauguguggugugugugaguaugugugugugugugguguguauguguguguguauauaugugauguguguauauaugugguauguguguauguguguguguaugugguguguguguguguguauauguggucuguauguguguauauauaugggugucuguguguguaugugguauguauguguguguguauauauguggucuguauguguguauauauaugggugugugugugugguguguauauguauguguguguguguauauauaugugauguguguauauauguguuauguguguauguuuguguguguguguguguaugugugugugguguaugccauaacucauggaaaggcauguuauuucucaccauaauuauaagguugucguuguuggguguacugcuacaguaauaacagauuugggagaaaaagagagucuaaugcucaaauccaugugaguuauaagaaacaccuuggcuuucaguguuagugcauguaaaguugcaagucuugccuucagcacacucggcacaaucagaaggcugcaaugggaggauuagggaguugagaguuagaccacgugcccugguuugcuuggcugccuccccacacagugcuugguuugcugucagugggggcuugguuuagacaguaaguucuauggucaacauaauuguugggaucuuuugcacacugcugucacagucagaaagucuugacaaacaucugcuccccagauagugcuuuauuggggagugcauguguguguagugugugugugugugugugugugguguauguguguaguguauaguauguguguauaguauguauguguaguaugucuguguaguguaugcauaugggugccuauguguguagucuguauauguguacuguguacuauguguaguauguguauguaugguguguauguguauguaucuggugcauaguguguuuauguguuguguguaguguguaauguguaaugucuauaugugaugcagucucagcgcaaagcauguagaggucagaggccaacacuagaaugaaugucuuccucaauuguuuuucaauaauaauaauaauaauaauaauaauaauaaugggcagugacucucacuaaaucuuggacuuucuggugagacagguccagcuggccaguaagccccaggauccccuuguaucuacucucagcuuuaggguuacacuguaccacaugccuuuuuauaugggcaccagugauccaaacucaugcuuguguaccaagcagcuuacgcacugaccuucucuccagccccagaauugugagccuuccaaauguauucucucacuuauucaugccccuuacgacugaaacaguuuuauuuaaauuauuuauuaaauuauauauucugaaauuuuauauucuacaagguucugacucuacucacucucuuaaacuaaaaacuaguguaauuguuuguuuguuuguuuguuuguuuuggagacagggucucagguaguccaaacuggccuuaaccuuguuguguggggcaagguguccuugaacuucccaagcggugggauuguagggguacaccaccacacccagcucaaaucuagccuuuuaagguuauguugcacaucuuaguuuugaaccauucuaugaagaguaaucuuccgccucaaccuccagaagagaguuuugguucccauaauucaauguucuggggaagugguuuguaaagcccacaguagccucugacugucacgagcaguauauucacccuucucuuccuuguguucuucucuccacaaaugagacauugucaguguucuagacaagcccccuccauuaggaauaguuugagggcuuacauguaucauaaaguuuucugguggcugcacuagcaaaaugagaacgaaacaagagaaguuaaucccaccguuuuaaucuagcauaucugagauggcaucacuucagcuugaaaucaaugugccccaaaucaccaggaucgugcacgaacagccuaggaaauccagucugcacucugugcagacuucuuacuccgaguguuguauguguguguuucugcacagaguggcugugcagacucucugaaucucaacauucuuuuuugcuagucagaacaaaggaaauaugauauguuccguuauaagcagacagaccuaccuacauuuaggaauucucauaucuugcuuaauacagguuuucauaaacaacuuuuuauugcagggucgggggggcaugcuauguuacuauaugaggucuaaggggcagcuuucaguagugugcucucuucuucuaccacguggguaccagggaucccacuuaggcaaucaggcuuagcagaaagcaccuuuauccgcugagccuucucuucauccucauuuuuuguuuuguugagacaggagcuuauguaguucaggcuaggcuccaacacccuaucaaaaaccauauuugacaugaaagguuaaccaaggcaggcagcgaaaagggauauggcauuggugauuggggucaugaggauaguagcccauagaggcccugcagacagcaauagggucaguacuacggacagaacaaaacauaauugucuggggcugagaagaaugcccagugagaaaugcccagugagaaacucagaacuuuuuuuuaaaauauuuuuuauuacguuauuuuccucaauuacauuuccaaugcuaucccagaagucccccauacccuccccccacuccccuacccaccuguacuggcuaguuuugugucaacuugacacagcuggaguuaucauagagaaagaagcuucaguugaggaaaugcccccaugagauccaacuguaaggcauuuucucaauuagugaucaagggggaaaggccccuugugggugggaccaucucugggcugguagucuuggguucuauaagagagcaggcugagcaagccaggggaggcaagccaguaaagaacaucccuccauggccucugcaucagcuccugcuuccugaccugcuugaguuccaguccuggcuucccuggugaugaacagcaguauggaaguguaagccgaauaaacccuuuccuccccaacuuguuucuuggucaugauguuugugcaggaauagaaacccugacuaagacaccacccauucccacuuuuuggcccuggcguuccccuguacuggggcauauaaaguuuguguguccaaugggccucucuuuccagugauggccaacuaggcuaauuuuugauacauaugcagcuagagucaagagcuccgggguacugguuaguucauaauguuguugcaccuacaggguugcagaucucuuuaguuccuuggauacuuucucuagcuccuccauugggggcccugugauccauccaauagcugacugugagcauccauuuauggguuucagaacucuuuaaacucuuaacuguaccuauguauagacagacagacagauauauagauauuuauaucuauauuuauauaucuuuaccucuauaucucuaucucuauaccuaugucuauguaucucuauaucuauguauguauguauguaucuauguauguauguaugaauguaucuaucuaucuaucuaucuaucuaucucugguggaugggacagagucccaaaggccacacuuuauuucuuuucucugucaauuuauaccuucuuagacaaaaguucuuuauaaaauuaccucauagauaggaugcuacacaaaaggggaguuacaaaaggauguugauaguaaguucaaaggaauguuuuauucuguaagcucacuauaaguucagagcaacaguuucacauggccuggcuucaucauagugaauauauggcugcauacuugaaucugaccuagaaugaaaguuuuuccuugauuucaaauuuuucccaagccuauuucucuucuuaguguaauuuaugaaagaaagcucaucguaugccuuauuaugcagccuuuacuuacuauccugugaggagggggcacguucuauucuuuuuuuuuaauuagguauuuuccucauuuacauuuccaaugcuaucccaaaaguuccccauauccacccccggcauauucuauucuugagucuaacuuuauuacaucuuucuggcaaagcaauuaaaaccauuaaccuuucuccuuaagaaacuuucuuccuaaaauuauuugaaucaaaccaggaauucuauaaagucauuaauucaucuagcauuaauucaugaaaauucuucuucauguugauuugcaggaguaggaauuugcucaguagggugggcugaugcccaagaaucauuaggcuaucuaauaguggcaugaaagcacuaucaguaaugagaagcaguccugggaugaagucucagaguguacccacugcagccaugcaaaaugguggaccaucucuaggaaacucgcuugccauagcauuuccuagauggcuucugucaacccccucuguaauagaaauugacugccaaguucuuauccuucugccuucaucucccaagugcuaggauuacaggcaugcaccaccagggccaguuuuaugccaugcuaggcguugaaccuggggcuuaaugcaugcuaggugucuuagucaggcuuucuauuccugcacaaacaucaugaccaagaagcaaguuggggaggaaaggguuuauucagcuuacacuuccauacagcuguucaucaccaaaggaagucaggacuggaacucaagcaggucagaaagcaggagcugaugcagaagccauggagggauauucuuuacuggcuugcuuccccugguuugcucagccugcucucuuuuagaaccaagacucccagcccagagauggccccacccacaaggggccuuucucccuugauuacuaauugagaaaaugcauuacaguuggaucucauggaggcauuuccucaacugaagcuccuuucucugugauaacuccagcugugucaaguugacacaaaacuagccaguacacuaggcaaacacucuacccccgaccuauaucuccagacugugggugauuuauguugcucuuguuucuggugcaaagaacagacaagaacauguucacuguaaagaccacaugagcagaaacuaggcaaaacaugaagcugguccuugucacucuuucaucucucuccccuucuuuuccccacugacuaagggacccaguguccuccuauuccaggccuucccugggauacccacucagccuguccauucaguuaggcagugcauuuucugccaguucuuuucuucagaaaaacucaccuggccuggggcuccauguccuucaagguccugcaucaggugcugucugcaaaccucagcuaaucggugguagaugggugcuaggagcuucugggcugucagaguuagggucacuauugcuguggugaaauacauuaaccaaaagaaacauggaggaaaggguguauuucacuuaacaguuucacacaacaggucaucuucaaaagcggugagggaaggaacucaggaaaagcaagaaccaggaggcaggaguugauacaggggcugcggagagguacuacuuacugacuugcuucucauggcuugcucagcugacuuucuuauagagcccaggaccacuagccuagggauggcuccacccacaaugggcugggcccuuucacaucaaucacuaauuaagaaaaugcccuacagccagauuugauacuuuuguuuuccaguuaagguuccauccuuuucaaugacuguagcuugugucaaguugacauaaaauucaccagcacaugucaccauuccagacacacuaaauuuuacucaccugaaaaaaaugaacaaaacagguuuuaggcucuuuggucccgucauggggguaaauguuuuuuaaugagaucagcuuucuacccugaagauuucucugcacaguuacuguccugaaaaucuggcuggagucaccuuagcuuggagcagaggguguaucucuguugucccuguacuuuacuaagagcauacugcagacagugcagaaucuuuggcucucuagacauuuccaccaauccaaaucuaucccagggaaguuaccuguacauuuuagggguaaaaaccaucugggaaucagcugucuguuuguacaaaguaucugcauguuugguuugucugcuagggauuuggccccagggaucugcuggcugcccaaggaggaauggcuuuucaagguggggcugagguuuuucuaccaguuucagaauguucucugugcugacuaaccuguugccauggagauuggcaguacaaacacaaguucccacuuggcuucugcuguuccauugcuuaggaccugccugucagcaaacagugccaggcagccugggcuggcuugugugaggugaccacacccacagggcucagccuugccugccuugccugcugugcauuaacucagcagcugcaaggcuauugcuccaggcugggagccugcugguugcuguaugcugccucccgugccccucauccaucaucugacuagccauucagauugaaugagggugggagaggagcagaaagccuccugcuuagagacacauguccauucugagaugucagaguggaagaauuuguccagacaaaagauaguucccucuauacacaagcaaugaccucacuuguuaaggacuuggaaagagccauccauggcuagcccaguacccacaaucaggcacccaauaagggccuguuuuucuugagagcaguuggguaaccugcucaggcucacaggucauuuaccuccagacuuaaagucuugacauauuuguuacucuggaagccucugacuuguuggaacaagacuguagguagaaugaugaauuuguucuuugcucaaauggaagcaguuuuccuccguaauucuaagaaacaacaacaaaacaaaacagaacaacagcacucucagugucagcauuccugccuuuccuggccuccucuuuuaagaaucuuuucuuuuuuuguauugcuagauaguaagagaccucuguucauacacugcaccggucaagguauguucaaagacaguuucacaucucauuuaaucuucacacugaccuuaggagaacagaggcgacuuggggcucagagacuugaggacccugguucuugucauccaauggaguucauagaaaacgaugccuggauuccugaaugggcaggaguaagagagauuucuaggucuucagaugugcaugugcguguacguuagaacaagaagcccaggaggagauggcaccaaucagggauucuacaccugcccccucugcaugggaugcucuuucccuuacauugcaaaugugacgucuugucauuggcccuuagcaccuuggaucccugaaccauagcacgggcaccaggccacucacuguaucacuacccuauucuaugaagcucuuaaugagcacaggaaugauguggggaagaagauauuaggccaggucuaagauaagggcucagcauauguguuauucccuaucgaugcuguguuuggcuuggcauuuugcccuaucuucaagucucuucuauaaguuauucauuuauuuccuccuugugcuagacuguaggcucuguaugcaucuuggucaaugcuguaccaucaacaguguaacaaugccuaggauguaugggcucucaauaaauguuuguugguguucuguucugcucuaagaucaagaauugacaaaugggaccucauaaaauuacaaagcuucuguaaggcaaaggacacugucaauaggacaaaauggcaaccaacagguugggaaaagaucuuuaccaauccuacaucugauagagggcaaauauucaaaauauacaaagaauucaagaaguuagacuucagagaaccaaauaacccuguuaaaagugggguacaaagauaaacaaagaauucucaaccaagaaauaucaaauggcugagaaauaccuaaagaaauguuuaaaguccuuagucauaagggaaaugcaaaucaaaacaccugagauuccaccucacaccagucagaauggcuaagaucaaaaacucaggugagagcagaugcuggcaaggauguggagaaagaggaacacuccuccacugcuggugggauugcaaacugguacaacuacucuggaaaucagucuggugguuccucagaaaauuggacauaguacuaccggaagaugcagcuauaccacuccugggcauguacccagaagaugcuccaacauguaauaaggacacauguuccucuuuguucauagcauccuuauuuauaauagucagaaacuagaaagaacccagaugucccucaacagaggaauggauacagaaaaugugguucauuuacacaauguaguccuacgcagcuauuaaaaacaaugaauucaugaaauucuuaggcaaauggauggaacuagaaaauaucauccugagugagguaaccuaaucacaaaagaacacacauuguauacacucacugauaaauggauauuagcccagaagcucggaauacccaauauacaauucacagaccaaaugaagcucaagaagaaggaagaccaaaguguggauacuuugguccuucuuagaagggggaacaaaauacccaugggaggaguuacagagacaaaguguggagcagagacugaaggaaagaccauccagagacugccccaccuggggcuccaucccaauauagucaccaaaccuagaccccauuguggaugccaacacgugcuuacugacaggagccugauauaguugucuccugagaggcucugccagugccuggcaaauacagagguggaugcucucagccaaccauuggacugaguacaagguccccaugaaggagauagagaaaggaccgaaggagcugaaggagcuugcagcccccuaggaggaauaacaauaugaaccaaccaguacccucagagcucccugggacuaaaccaccaaccaaagaguacacauggagagacccauggcuccaccugcauauguaucagaagagggccuuguuggacaucagugggaggagaggcccuuguuccugagaaggcuugauuccccaguguaggggaaugccaggacugggaagcaggaguaggugaguuggugaacaggggauaggggauuuugaaggggaaaugaggaaagaggauaacauuugaaauguaaaucaagaaaauaucuaauaaaaaauaaaaauaaauguuuguugaaggaaugaguuaacaaguguguuuaugauacuacuauaugggagacauuuaacauuuagucaccuugugacucucaugacaggccacuaauaguaauaggucacuugugaagaagucuguccaccucagcucuccagagcaguucucagacaacuugguuacagcuacaaaaggcucaggacaguucaaacaccagggacacagcagccucagaaagcuggugcucuuuugaagagauguagaagugaaggcuggacucacaggaaggcgagaggacagagguuuacugcugcuauucugaagacagagugaggcugguuagagauccagcucucugcuauuagggaguggccuuggccaaguugcuuacugucuuccagcaucagaauccucauccuuaaagugugcauaguugagugaaucugcuuaagugaagacauuauuacagggucuguuuacccucccacccgacacaauuaaaaacccucgcacaacacaggugacuguaauuuccagauagcagacauuccugacaccgugcugugguccugagagagggaggaaaucaugugagcuagcugcguagccuagcacagugcagagagagggucccaggcagagucuggcugucucccaaagucagagagaugcaggcugaguucuggggaugccaggaagcuguggagucaagagguggagauguacagaagacagggagaggagaagaagagugacugacccugauagaugugaaugguggacaggcuguggauggaguuccagucuguagauuaggaaagaugguggcgugugugugcagcggagacgagaaguugugaacagaagccaaaccggggugcuggagaaugaaaaugacgaugucugcgauacaaugacuguaauuaucucugcaagaaccuguguucccaauguucuuuucccauuugcauguguguacguguucaugcuaaccuacuaccacaucuuccaaccucaacacacacacagacacacacacagagacacacacacagagacacacacacagacacacacacagugaaguuagcaaaguuaacagaauguuggucucugggcaaggcucugauuugcuauauugugcauaagaaggagauaccagaaagucuagucacacaccaaaaaggagaguuacuaaguucuugcauaagaaaaugcaaaugggucagaugccugaucccagaguuugcugggauuucauuuugucauuuacugguuggguaacucuuaagaaguuccuucaucuuuacaaugggaacuacaguacuuccucagugaaggcuagcuggggcacaucugauauaauuagagaaacacuacugcaauuuccugaugaacaauacaaucucuguuuuugcgaguuuacagaaauccagggauuaggcuacagcuaucccacauguaacugcuuuuaaucuuuguaacagucagacagucauaucuucaauugacaaacgagagaaauaugacucaagagguuuggcaaaucacuggggucacccagcuccuuaaguggacuuggauggaguuaacuggggaucuucauuuacagaggccagacccucugagguucauuuuccuucuguguguaugugagugugugcacacacacugucgagcugagagucagggcaagagcauggcccaguaagcacaaguauguaaacaugcauguguaugcacacauauauaguauguaaacaugcauguguaugcacacauauauaguauguaagcaugcauguguaugcacacauauauaguauguaaacaugcauguguaugcacacauauauaguauguaagcaugcauguguaugcacacauauauaguauauaagcaugcauguguaugcacacauauauaguauguaagcaugcauguaugcacacacacauaguauguaagcaugcauguaugugugcacacacacaugauuuggggagauaugaaauagaaaaugaaaaugucaaaguucaguggugaaguauacaaacuuccugagcaaaagugcuuuucaguuggagaaaacaggaaaucugugguucagaaugaaaaaaaauucuuuucugggaaacagugugguccuacuugggagacauuuugguucauuguaugucagagaccuugccuuucagccuaugaccuguuaugucacauagcuuugagguucucuccugagauugacguaggugcuuguccucaguucucccccgagagugcuugaugagaggucagacagcugugggcuaugugguuugucuucugggagcacuuccaccagcugugugaaagccugaguagaugcaggggguacuacugggcaguggaauaccuccuuuugauuaaacaaacaaacagacaaacaagcuaacaaacagcccccucccgcaaacuaaaccuucauuuucagcagagcagcacaagaccaacacuguugcugaugaaaaucuuuuaauauuggagagguguuguaagcacccuaugucagaaacauagacaaacaugucuguguauuuccacagugauaggauuuauggaauaacaguaaagucauaagguauaguggcuucccugugccagauaauccuacuuuccuugacagcuaggacuaagacaaucacagguucuuuuuauucuaaccuuaauuacuaauauuaacucucagaucacauguuauacaucacacgauaaaggccuaauuuuguauguaagcaugaauguaugugcauauguguguagguaugaaugaguguauguauauauguaugcaugcuacauuacagaauggcuacaaaaaguuaaagaguugagguauuucaaagaacuccuauaggccaaaacugggaauuggagggaaaugcaaaggagcccugauggguaugagauaggcaucagguccagcugcagaagaggcugugagucugcuagcugcuggucauagagaugcuguugcaggaucuaauuggagcugcagcagugaagugaagagaagggcaagaccuggucuggucugauagaaagcugaguagauggauggagagcagguccagaugggugagcggauacaugggcagaugacaauuccaguaagcagcaucagcggugggaguggggcucaaugaaacugaagcccuggggacagauggaaguugucuguaugucugucugucccuagaccacaaagcagguagucaggugacaggucaccaucacaguguuagagguccauccauuuccaggugaggaaauccuuucuaggucuggcgugucugauacgcucuuggccuugguuuucuuauugugauuuuaguaugcccaucugccccuacagucucaacugaccugagaaauguauagcacaguacccauuguacucccaggaauaggucacuuuuuggucuguguugugaaggugaugucaaacagauggugccaaucacagguccccucagaugcagagucaucccgacuccucaaaauggagucaaaagcugccuggggauggaaucucuccaggcaagaugcagccuaaagaaacuacugguuuacaugauauggggguaacuuaaggcaguguacagcccaauccaauuaagagacugaacuacaggaccugaugaaggccgaugaaguuccuauaaguucugggguuuccacuguggucuugugaguaggucagcauggagcauggcccuggagaaagguguguggagagcuaaagaagaaaaacaugucauaauaauaacagcagccaggaugaccccguuccuccucagcuuuauaaacaauuuccagagacauuggacugucuucaguuauaacgccaauucacucacugaucccacaaacacucacuaaugcguaacgugugucagcaacagcuugaggcacuaaggacacuccacaccguuuauagagaucacagcaggguacaguucagugggaaggcacagggcccugcaaaacaaacaaagccaacgaaaaccacaagugcuccgacacacucgucugaauguggggcacuaauaaccagccaguaaauagauagagcggcagcagaggaaggucacaguagggguugugggguugguguggauaucccagcuggggcugagcacucaguagaacuuauucucaguaccuugaccaauugcgcauuucuguguuaacuguugaccacugcagagauaagcuucuggccaagguugagggcaaugcuaaucuaugggcauagcauaaauguucggagggcaacaauaguagaugccucucuaggccuggaaggucauagccuucuuuugacugauaauuuacuuugauauacaaaagcuuuuaaaaauuucauuagaucccauuuguugauuacuggacuuauuuccugagugauuaaagucuugucuaaaaaauccuuacccauauuuauuuauccuauaaguaugcuuccuagcuuuuuuucuagcaguuucauauuugcuuguuuuuaaagguuaauuuauuuauucauguguuuguguggacacuugcaugcacgucuaugcagaggccagaagagaguaucauugucuuucuauaucacucucugaccauuucuuugaggcagagucucuccccgaaccuugggcuuuuguuuucuugccuaagugagaagucagcaagcccuacuguuccacugucaugugggaucuggaauuugagcucugguccucaugauuguggagcaaaugcuauuaacuuuagagccuuuucuccaguuccuuguuuguucuuugggacacucuugcuguguagccugggcugauuucaaagucauuucaauuauucugucucaaauucugaagugcuaggauuauaagcauguucagcauuuucuuucuuuuuuuauuggauauuuucuuuauuuacauuucagaugcuauccccuuuccugcuuuccccccucccagaaacccccuuucccuucguccccuucccugcuucuaugaggguguuccuccacucacccacccacuucuaccucccugcccucaauuccccuauacuggggcaucuaucaagccuucaucaaggacuucuccucccauugaggccugacacggccauccucugcuacaugugcagcuggagccauguacuccuugguugauggcuuagucccugggagcucugggggguauaguugguugauauuguuguucuuccuauggggcugcaaaccccuucaacuccuucaguccuuucucuaacuccucuauuggggacccugcacucaguccaaugguugacugcgagcauccacuucuauacuugcaaagaaaucuuauguguuuauuuaugccugccugcucugaccaggucuuuugaaauuugggcugggcaugggucugguguaguaccuuccugugcuuuucuuagcuuucuuuuucuagaguaguaucugaaauaaagaucaauuuuuuaaaguaccugacauguuguucuuuuaaucucuaucucagcacuauuagauaaaauuugucagccccauuuauagauacagaaucagggaacuuggaggaguuaguuuguauauagacuguagugcaaacuugaguccaaauuacguuucugucuucauugucccauaaccuucuaagguucguguaugaauggaugaaggaauguguuuaugaaugauaaaacugaccugauucucauguugagaaaauuagacagccagagucugggaacuccacugaccuauugcaccaggcaagcauagauuagucccuugaggacugggaggucagaauuggccaggaagaaugagcaaaguauuaggauacagucguucauuccaaucuuaucuaucuaucuaucuaucuaucuaucuaucuaucuaucuaucuaucuaucuaucuacuuaaugugugagaguguguguguacaugccauaagugcacaugaggaaaucagaagacaacuugcaggaaucaacucucuucuucuacuauguggguaccagggaucacaaucagccauccuauuugaagucaggagccuuuacugcugagccgucucaccugccugacuacagucauuuuuaagacauaauauugaggccguggaguuuguggagaaugcagggaaggcuugcccgcaucagguuugggaacacuguggagcacugcugugccugcauucugguuuuuuuuuuguuuuuuuuuuuuaagcccauaaagccuuaaauggccaagaagaaagcuucagggccgucuuuaagaauccuggucuguaguaagaagggaaggccauaagaaaggcaucuagauauugaugcaguucuguugaccacaguuuauuuugggggaauaauuggguuucuauacacacuucucaacugugacccuauaugaucauauagaacgggcggguucucugcuuccugauccugcucugccaaccaccuucuccaggcaccuaugagaguuucugcuaugaccauggauaggagaaucaucucaaggcucuggagguuaaugguuaagaggacuugcuuuuguagaggaccuggguucagcucucagcauccacaugcugggucacggccaucuguaacuccaguuccagaggacuaagcucccacuuguggucagcauggucaauaagaaugcaugcagugcgcuaauauacauguaggcaaagcacuuauacacaugaaauaaaaauaaagggaaaggaaaagaaauaguucaacucuggucucugggaaucugcaugcaucugcugcugcugcugcugcugcugcugcugcugggagcuuugagaggugcauucugagggacaguugggaagagaaucagagaccagugaggauaggccccucuggugcaagugaaucagagaauuaagggaaugcccccaugaggggcuuucaccuugguaagggacucugguaccaugaccugcuauuacagcugugcccaggaagaaaccccugugucagcugucaauguguguugagcaagaguacccagagccaucaccacagguagacgagccagugccaguugaacuacaguagaagagagagauggggcucaagaccccacauaacucagccacaucaaacuuacagccaagggacagggaaggggcaguggauggaaauucuugagaggaacuaaccgggauagggaaauucuggcuaaaccaacauaacaggauucuugcugaaggcaguucagggugauccccagucacauggugggugggggcagagauaaagagucugaccaguuauuaagaugguuaaucagauauccaggguucagcaggguccuuugucagaucugaaccuaagacagaaguacauguucuaucucggagaaggcuccuaggagaaaaucuggcuuugcaaacagccuucgucugcggccuugcuucuccuggccgucagguuuguuuuaaggagcacgcuuggcucacuccuuauucucaggaccagggaggaacuugaugggcauaggcccagaggagggaacagugugggaaauccaugcaaagugcuacaggccuggcuaaaaugacaaacucgggcagccagagccagggccuucaaagaaugggauagcuuggucuucucagaucuuccacagggcauuugggaacuguugagguuuggaaaguuuuuuuuggccccagcccagcuguaggcuaugauuccucccagaggguggcagggcuggcugcuuacagucccuaaaagcagcaacagagaguguccaguugauguucaagccuccaacaggccuuuccucuguggaggggauuuccagcaauccccguggugaugucccgguuacacagagaagggaccuggugagcuguauaugggagcgccccugcuaaggcccucagccagcaggguccuuauucaccacagaggcauguggcugugaaugggggcccaggcugugggaaaaacauuuccauuccucuuuuuaaaaccaaguauauguuuccagauaaacacagugaugaagagguucuuaacugacacugcuuaacuaagauagcuagcuugacucucaacucccccaggccccagguauaacacccaguugccaggucauucccagggcuuagaaguagcucugugucaugcauagaggccugccucugaguuugaugucagucacagacugaaggcgcaguguccuagguucccuuuggugucuaaugcgucugaagcuuguuaguucucccaggagagcugcugggccaaggccugggcauuuauuucuuccaugguggcuuccuuuugggacuguagcccaucuguuagcgccuugggagcaguccaugggagacucuuguuuuucugugaaccacagggcgaagcgucccucuuacccacacaucuuaucaucuuggccuguuuacaguaucacauuaguaauagagaucccaggcugagggucaccuccuuuaaaggaaaucagcuuauagucggacugagcuguuccugucccucguguaggaggucaaguuaucauuccccauguucucaccguuuucuguaucuaggcaacgccccagaaaacaggccuggcuggcugaccugcgaggcgagacauaggacugcagcucuggcagugggcagugcuuccuucgggucagucaaaggucucagaagcuguaucuguguuuacaucuuucucaacacagccucacugucaaauaucuucgagauuagucuuuccaggauguucucaaaacacagucuuuacuccgcacgcacaugcagacacacgcaagcgcgcgcgcgcacgcacacacacacgcacacacacacaucaaauuuuccuuuaaaugcccucccccacagcaaaaccaccaggguuuuaugaugagaaagcaaaccuuagcaacgggacucaagcugcuuagaagggauugagguuagaguauauaauuggcuccuuuuacuccucgccauuccugcccugucuucuguuacugcacucuucuggggaacgaaucagcaaacugaaucagaacagguuacuagccauuccacugcauaaaaagaugagcaaaaggcucuguguguacucaagccuguucuuucugguuagccacaagccccacuguccccuacugcaccgggugacuucacuguauauuuuauucucuuacugucuucaucuuugccucuacacugugugugaaucaguugugaucugugacauuauaauuuugaaggcagaaacccugccuuucauuaugaugucuccaaaacaauucuaggaguuuuacacacacaccucaagaacugguaaaguaagaaaaaagaaauacuuaacauacaguaguuuccuaaauagaccuguaugggauauaucauauguauaagccuaaccugugaaguuauucaugucuguccauuuguuugccaacaauacaguggcucaaagaauugagggacuuaggcaaggagagagagagaaagagagagagacagagacagagacagagacaaagagagacagagagacagagacagagagagacaaagagagacagacagagagagagagagagagagagagagagcguacuagggcauaacacuugggcuacacaggaauuauucucaaccugggugauuuuguccccuaggacacuagguaaugugggagaugcauugaucuggucucagaugcugguucaaucccaugccaggccucuuuucaguuccgcauagccgagccacagcagcacccugccuguucucagauugauuuaccacugauaagaggcccuggucauucuggcucuagcuggcuuuaacaaaagcaaaucaguacauguucaaggguaugaugucagcaucuuacucguagaacuacaccacaaaucacagacugaaggauaacaugaguuuccuucccaucuuaccaggcaaacaccacauuuagacaaagccagaugguuuuuccuuaaaagaaaaggaagagaacacauuucauucguuguguguauugaggguaaggugugaaugccuauggaguguguguguguguguguguguguguguguguguguguguguguguauaguguaagugccugggagauguguguauauguguuuagugugagugccugugauauaugugugugagaguguaaguguguauguauaccugugugugugcaugugugugccugugacgcauguguaugaaugaauguauggugugaguacccgugacauguguauguaugugugugccugugauguguauaugugugugugagucugugugaaugaguguguggugugagaaccugugauguguguaugugugugugagugccuaugaugugugugugugugugugugugugugugugugagucugagugaaugaauguauggugagaguaccugugauguaugugugcacaugccacugugcacauguggaggacagaagacagccuaugggagucaguucucacuuuacaccucacuaaagcagggucucucuugcuguuguuccaucuccaucuaccacaggcuagcccacaagcuucuaucccuucuucccaccuccaggcagaagugcuugggauuacagguaugggcuacccuggcucuuaacccaggucccagggaucaaauucaggucacuaggcuugcuccccaagccucccagaugacuuuuacguguguuauuguuuauauuugucuucuuaaauuguuuaacuuguauuuuucauucaaaugaguguucaugcuuacagauggacauguguaggggcaucaggggucaaccucggggucacuccccaggagccagcuaccauguuuugaagauaaauuuucucucucacuggcacccgggcuaccugauugguuagguuggcuggacaguaacccccagggacucccuacucccgucuucaccuucccagcacuaggauuacaaaccugcaccccacuuguaaagcuuuuuacauggguacagugacugaacucaacuccacuuuacugacccccaagcccccauuucauuauucuuaaaaaucucaauugguccaccccauagcugauuacccuuuaaaaaccaugaaucauagcucuucugggccaucugugggggcugugggagaagggugaguugguagaucagcuguuuugucugguggagguggaauggggugucugucucugucuucaucauguuagaggaagcaaacccaaggaaggagaagaugaugcucaccguauaugaauuaucgccuuaauauccuacuguucauuaaaguacuguauaaaguuucuauccuuucucagcccugucuggugggccuaacugcuauaaggcucacucaucccucugaaggcaaaugccuuuucuguugcuggcugggggcugucuugugcuaugucagaagagaggagaacuugcauuaguccccaggugcugagagcugcguguacaaacagcuccguaucagacuguucacucuuccaagaauucauggacaaauagucuagauuacugggaaaacugucugaaacugcagugacauucuggucuugugcaauagaaucuacuauucccagagaggagagcagcuuaacacuaggagucacugagauaugagugacagguccacacuuacagccugguccuauuucugaggucugagaaccuggauauacaccuguaccuccaaauauggcguaccgacaccaacagcaagacuucagaaaugauguguucacucugaccucaaccagcacuuuuuuacugauggugcaaacgauugaagccaaagccuugaggauacuaggcaagggcugcccuccaaauccaccuucagaguuuuuaaagaauacauucuaagaugaaacagcauucuauaaaaugcauuuuccuguuuauuacuuaugccugugaguacacauugccuagaguuacaugaaaauaaucaaccagucucucuaccaugugcuauuuggggggaauuuuuuggagauaggaucuuacugugcagcccaggcuagccuuaaacacuugauuccuccuuucuucacuuccugggugcucagauuuuaaguguguacuaccauguguauguauguauguguauauauauauauauauauauauauauauauauauauccauacacacaauauauguauauauauguguguguguguguguguguguguguguguacacacauauauacucuucuaccaggcaugguggcacaugacaguaaugucuauacuuaggaugcaaaaauagaaggaauuaugaguuugugaccaauggagacuauauacugaguucaagugcauacuggguuacuuaguuacugugucuuagcuacuuuucuauugcuaugacaaaacaccacgaccaaggcaauguaauaaaaagacauuauuggguuuacagcugcaagagguuggauggugguagagcaaaggcaugaugguagaaacagcugagagcucacaucucaauccacaaacaagaggcugagagcagugcacacuaggacgggcaaguccuuugaaaccucaaagcucugccccagugacacaccuucaacaaggccacacccucuaacccuucccaaacaguuccaucaacuggaggccaaguuuuuaaacauauguauagggaccauucuuauucaaaccacacacccugucuccagcaugaagcagaaugagcagaacuaugaaucucuuuuggccuagagauguagcucaguggcugggugcuugucugguaccauguaaggcccggaguagcaucacaagcacaaaaaucaucucuucuaccacuuagggcuuggugcuugguuuccuauuuuaaagcuagugauuuucugcuuuauaaacacuacuccucauuaacaugucacugcaaacgucggcgagcuguaaucagacaucauucucccuacuucucuaucccaaccuugaggccugcacauuaaacuaaaagcacaccccaagcuuugugccucucugguccccaccuccacccacauuccaggucacuucauccgaguuuagacaauuuuuuguggauuacugcccucccccaauucaugcuaauauagacuaguuaccaguggaugugugcucuaaaaaaagaaaccuuuuuaaaacaugcuuuaauuaaaaauuucuauguuuauuggcaguaacuguagacuuauucauucuuuccaccauuccacaaagaccuuuuaugugccugccaugggauugaaacagugaccaaaacagaggcaacuggugugcccggggagagcguuugcuagagacagaccugcguuugcuccucuguucaucagucuugugccacagggagcaggaccaugagugaaagagaccugcagugauuccagggaccaggaagagagagcaaggaaugagcaagcacauccucauucgaaaccugcugcagagaggauggacuaacaagucagccccauagucaucuagaugccucaucuuaucuuaucuuauccaggaagguugacuuggggaaauauuauucagugggaaguuucuggguccccaucacagaagacugcuuuccuggcuuccugaaguuuuccuuacaucuuuuucuuucuaaauucugggggccagcuuucaguuguacccucauuuccucaugcaagauugucagaauuucaugggcauugcaguuggacccucagaugacuccuugucauggggaaguaacacguguuccggucacugugaaauacucuggcccgcauuaguuaugugauggucuugaugacaauguugcuggagauguuagggucaaagccugggcucuggcgacccuaacgagugagacucagccacucauccucagaaagccaaugaaaagggcacaugauaauaaaaggcagagaagaauugauucugugaggacacagcgggaagagaaacaaauagacguuagcugaccccacccuccaacuucaucuuuggggugcugauauaaggccuaauagggggcaacagguaugaagaacuaagcaguccugaucaagguguggucccauccauuagugaccuaucaucacuagucucuauacaagguagucugacaauuguaggaauuaugggaaguuucuuucugggggacaaguuccucuucugacugguacaauguuuuaacuuuuuucuucucuuuacacaagucucucagagaaauuccaauuuggggaccauuguuucaguagucugauagccaaagagaggagcaugugugucucuuuagaguaucuucaauuucugccagggcagauauaaggauaaacgaaugugagggaacugggaauucuaauggccuguggaugugugcucccucauaagcugcugcgcccuuucuuguuuucucugcagauuaauuggcacagcaacugucucccugaaggaccugauuggggaccagaacaggucuuugcccuacaaacagaccucccugcuaaaugaaaagggacaagacacuggggugagugcucuucuguggaaagacagaacaagauagugaaggaaaauacuggaaguuugguuucgugauaaaugcauccccuugucaaugauaugggccucauccucaauuuccaaucacagaacuggcaaauuugagauuugguuuuauuugacagaauuccauauggaaagcauaugguuauagcucaaugauauccacauggguguugacauuuagcuuuggauaucuagccuuuaaguugggugucuaacauaccagacaaagguguguauuaccuucuguguugcgaugguaauaucauugucguuaucaccacauugauugcugaauaucuucugauuccagucccucucuauaaguauauauugucugacauagaaucagaauucaaaggucccggcaguugggagguugagauaggaugauuucugagaguuucagcuucauccauuagugcauuccaggguagccaggaauauacaaugauacccuguguucaaaaaaaaaaauccaaacuaugaguuaaaaauugacucgaguaucuccgguuuauaugcugcgugccuacuaagaagucuucaaaugcugucgugcucaguccaugaccucuaaccccuucaucuucgagccaauucaucuuacuuguaaaucugggcaucaguguaagugugaacacaggggaggcucagaauccaaaggagaggaugccagugaggcugugcuggucucagagacuguaucauccagccacaagccaggguucugauuauaacaugugcauucaaaaugaucucugccaucugacuaccccaaacccacagaacagaaauggugccaugacaaggcaggaugucacggauuuuuuguuuuuuguuuuuguuuuggauugcugggguuuuuuguuguuguuuguuuguuuuuugguccauaugcacacacacacauauacaugcauguguauaacacagaagagcucucauagacuguucuaaagcagcugaacuuuuggggcuaagaugaacacggcuccuuguguccccucacccccucugagauuccuaagcaucauuaaguguacugaaacaacugggaccacuguguguaaaauagcaauaugcuagguuuuagaagcacaguuucucauguuacauuugaguccuguggugccagcacacagccuucacagugagccuugaucugugagugcauagacacugaugcugcucuugugacuuguuugcuugauaugaauauucauauuagggguauuaugagcuaauacuuucauaauguccuauccaguguccccaggccagucucaugcaccgaaugugcugauccacgaggaaacagucacugaugaacagacaagaaaaaacaggagcaacacagaugugugugucuagacaugcacacaugagagucauuagccacagcaaaaugaguaaaugaaggaagagggccaauuagauuuggacuucagauaaauaacgagcuacuuuuaguguagcugugaccuaaauauuagaauaccuuauucuauauuucaucuucuuuaauuuuuuuuuuuuuuacuuuuuauuuuauguguauggguguuuugcuugcauacuguagccacagaggccugaagaaagugucagaucacuggagacuggaguuucagagucguccugugaaugcuaaaaaaaucaaauccggguucucugaagaguaguuggugcuguuaaccauugagccaucucugcagcuccuguauuuuaucuucuaaccugauguguguggggucggggguggagaauacucauuugcaaaggacuuccuuaauuuuggaguuugucuuucccccacuuuggguauuaauaugccuuucauuuaugaaaugauugugauagccaaugagcauguguuuggugaaauaaaauuuaacaacucuucuucaagggauauagcucagcagcagaacacuagcauauuugggguccugguucccauccuuuguacuuuagggagaaggaagguuguuuuguuuguuuguuuuuuaauuuuucuaucaaacuuuuugacauuuucaagguuagugaaguguaaagacauaagcucuacuuuguugccauuuuuuguuugauuccuagauuuccugggaucaugauuaauguggggggggggaugacaauuauguuuaacuuuaugauuuguacguuugccuuuucuuuaaucagacucaguuuccccuuucauucucucuuacaauugugcuauuugcgacuaaccuuuugguuagucacagaauucuccccuguagagaacuaucaaaaugaaucucagucaugaguagaggugagcaacaagugagccauucauucuaaaugagcaucucugcuuguacuucuaugagcagaggccaucaccucugcaggacagaagcuagcuuccgguucacacuugcuuguuacagcuuuacucuagucugcgagguugcccuuggcaaccugcaauaaaguggcuucuuuccagcucugcccuggcucuccugggguaagauaggcaucguccaacauaccaucgcccuuccuaccucuguggucucacuucuaugcccagcccuuccaagacuccuacccaugaugaacuguucacacuaaaucuguaauauucucuuaccagcacuaacucgcuaugcaauggauucuuucuauucaggccaccauugaccuggugaucggcuauaccccaccuucagcuccacauccaaaugauccgagcgggaccagugugccaggcaugggagguaagcugacccuccugauggucccucucaccccaaggagaccguuccccaaggggagucuacuaagcacacaaagaaagucucuagagaaacucuauuugcaaaaugcuuuucuagcagaggggagggugaaacaguucucgugaugagcagucucgcagccagccagccaguacacacagacuguagaaccguuaucgucuugcuuuagcuuugugauuuccacugaauacgaugucucagguugugagguucaagagccuucauauuuuacagcucccaaagauaugauggcugggauguguccccaggcucuagucucauggccaauacccuugggcugagcucucuuuugcuuccucugagcccugaucccuuuucuuucccccaaccccucccacccacucaguacuguggucauauuuuucuacaagccacuugcccuccugggucauuugacaucagaugucauuccagacaggguuaaccuggggccucugggaugggcuucaagcauuucccugacaagcugcccuuucacaaaguugaauuugacuucccuuguuuuucugcaggguaacagugguacuaaaaaugaguuuugccccaaugaaacagagaaguuuccagaacaagcuguuuguuacgcuaaauaugguggagggagauuuuguuucuuuagguuggccauaggacccuacaauacuuugggccacaaauaugauuuccccauagcaagucucugcuuccuuggaaugagccacccuuucagggaagaaauauaacccuccccuaagauuccguuuaccagaggccauuucucacacauggcaugaugucaucugugucagccuggaguccuggcagcacuauagacuggagggucuaccaggcccaagaaucugccucccugacacucaauggcaggccugggcaaacgcuggcuagaucuaacacgcagauucccaccauccuaaucagcuugaagggcuggacagcuguggagaugauucagcacuuggguuccuugacuuuggguuuuaaagaccaucacuauuccauacuauacugcaucacuauucuauacugaauuacaucacuauacugucucacuauacuauacuauacuauacuauacuauacuauacuauacuauacuauacuauacuauacuauacuauaucauaccauaccauaccauaccauaccauaccauaccauaccauaccauacaauacugcaucacuauaccguacuauacugcaucacuauacuguacucuacugaaccacuguguaguacucuacugcaucacuguacuauacucuacugaaucacuguacugcacuguacugcaacucuaaacugaacugugcugaaucacuauacugcacugugcugcaucacuauaaggcacugugcugcaucacuauacugcauuuuacugcaucacuauacugcacuguacugcaucacuauacuguacuguacugcaucucuauacggcacagugcugcaucacucuagugcacugcacugcauuacucuacugcacuguacugcaucacuauacugcacugcacugcaucacuauacuacauugcacugcaucacuauacugcacugcacugcaucacuauacuauacuguacugcaucacuauauugcacugcacugcaucacuauacuauacuguacugcaucacuauacuacauugcacugcaucacuauacugccuugugcugcaucacucuacugcacugugcuguaucacuauacuacauuguacugcaucacucuacugcacuguacagcaucacuauacugcacuguacugcaucacuaugcugcacuguacugcauuacucuacugcacugugcuguaucacuauacagcacuauacugcaucacuauacugcacugugcugcaugauuauacugcacugugcuguaucccuauacuacauugcacugcaucacaauacugcacuguacugcaucaguauacugcacuguacugcaucaguauacugcacuuuacugcaucacuauacugcacuuuacugcaucaguauacugcacugugcugcaucaguauacugcacugugcugcaucacuacacugcacugugcugcaucacuauacugcacugugcugcaucacuauacugcacugugcugcaucacuauacugcacugugcugcaucacuauacugcacugugcugcaucacuauacugcacugugcugcaucacuauacugcacugugcugcaucacuauacuacauugcacuucaucauuauacugcacuguacugcaucacuguacugcacuguacagcaucacuauacugcacuguacugcaucacuaugcugcacuguacugcaucacuguacugcacuguacugcaucacuauacugcaaaggagcuggcugugucaggguaccauguaaauauaauaugacaagguaaaauuucuucauuuagaauaagaauaaguuucauuaaucuguaagcauuuguauuuuuuguuauguaaaguuauuauucaccagggcugagucagaggucacauucagaauguuaguuucauacucuuaaagucacuuuuuaaaagaaguacaaacaagagaaggaagaaaggaggggaagggggagagagacagagagacagagacaaagggagaacuaguuuuuauuaauuaggaaaaccaauuauuguuuuuuacuggugcaugcuuuaaugauauacacagaauauuggguccagaucauuaccccuuuaacuaauucuuaaagaauuaucauuuuguauaaaaguaaugaagguuucccuuaacuuauauagauauuuucaauuuuuaaaacuuuaguuuguuaucuauuuuuaauacaagaaauaacugcuuauuaaaaugcaagcaccauagaaaagaucucagaagacacaagaagagaaaagagaagagaaaaaaaaccucauucuccugagauacaucugccagcagcucauggcagugauaggugguguuaaaggugucacucgcacgguggcugcugcuggggagugugacaucuuagcaauauagcacaauagaaagauggucaaaggaugcucucugcaaguuaaaaaaaagccuaguccugaccaaagaaucaaacacuuaagaaacuucuuuuggaagaaugcuuuugaggagcccuuaggucaagauagcagaagauucagagcguggugcauuauauggucgacugagaguguguggugucaaagauguccccuuacagaccgccuuagaaacugguccuguaucagaaagaagcaaugagccagucugaagauuuggcagccuagaaaccuguuaccauggcaacuuguucacguucuggcagucagcucgacuggaguguacauuucuguuaccagaaugagcuauuuuuaaaagcucauaucuauuuuuaaagaaccaucuguucaauguguccuuugcucaacuaaagaaaggcaaaaacucauucauagacugacgcugguauuucaaauuuauccaugaauaacauuccauguauaacaaaagugcuuucgcuugaagguaaauuugaucuacuucagaaaagcgguuacugauacuuauacauguggcaugcagagaugaggaaggcagugcuuggucccaaggagcucacagucacuagaaagauaagauagacugaguaacagcagcccagcaaaugugaucaauucuucuccagaaaggagccaaaugauugcagguuuauccagccaccuuacauugacaggcuuaugagguaaugugucugacacuagcuuacagccugugcugucaaaggcauaugcuuccaggaugaauccuaagccuguguuucucuuuuuuguuaaguucuuuucuucaauacucuguguguguguguauaugucucuguguguguguguguguuuguguguauaaggugacauguuauacauuuuuugggcaccuaacugcuauuuauccaagaauuggaauggaaaaauaaugacuaucucacaguagcauacaguuauaugacuucuaauauuucagaagcccagaaacauaaucuacauguggugauguucacuguaagagcugcucugaagaggcaagaguuugccacaaguuuaagaugagccuuggcuccauagugagugccgggccagccaaaacuacauagcaaaacauugucucaauaaacaaacagauaauaacaauaauaaaacgucagguacaguaggacuguaaucccagcuuuuaaggagggaguaggaagaucauacacucaagaccagcuuugacuucauaaagaguuuagggccaggcugggauacauggggcuaugccuaaauaaauauaagagaaauucagaaauauuauaaacaucugcugcuauguuacccuuuugugcuuccaaauucccucuuuccauguucuguauuguauuucuuugguauaauucuuuuucaagauuuauuuauuuauguauuuuauguauaugaaugcucugucuucauguaugucuucaugccaaaagaggaaaucagaucccaucauagauguuugugagaccuuuauaugagauguuugugguugcugggaauugaacucagguccucuagaagagcucuuaacuacagaaccaucucuccagccccuguguauuauauuuuuaaacuuacucuaaagaauaauguuaccaaccuuuuguucugguuuuacagugaccuuuguuuuagagucauaagauugugccuuaaccaguacagacacuuaaccagacuuuaucauaagauuuaucauaagaguccagauuauuaucauaagcaaagaaagacaacaugguagcaauaggaaaaugguaaauauugaccaaaggguuggcagggaagagacuauuccagaaaagcuguuuuauuaggaacagaaaguuaagagggucguggaccagugaguguguaggcagaaaggauagaggugugagagacugacggagacagaaggccgagggaacugggccagcacucuuccucaguucaucccuagguggccggccuacacugggaaccccugucaggcucucccacccuagcagugugagggcagaugggugauggaagcaggcaggggauggccugcagauaugguaccguggccaucuuuuccuugagaagagcagggugccuggaaagagcagaguagucaucacccaucaggaagaguuaguuagggugccaaaggcuaguguaacuguagcauaaggugucugagcacugccagcuucucugugaugaguagggacuguuccugucaccaggauggcauaugguagcagucuucaaaaauacuacuguugaguuucugggaagaaggucauucauuuuaggaauugaaaggcuucauuugacugacuuugcugguguuagugacucuuuaugugacacuuacuuuacuagugaugcuucauuaacaccugggaaugguccccaucauaacaccagcagagucacuaccauuuaagaagggcacaggugaucaaagcuuucgaagauuugaccaaagaguacugucauguuaggaagcaagauggcauuagcacagggaacugugaagagagggagaggaagggagagggggagggggagggggaggggaagggggagccaggagcacucugagcugcagugagucagcagaucugauucugagcauugguccauucucaaauugucaguuucucugaucuucucauuccuugcaacaucaggggucuggauuaaauaauacauauggucucuaauuaggaaguucuauuuguuguuguuucaaggcaggguuccacucuagcccaggcuggcguggaauccacuguguuguccaaaccaguuuuaaauagcaagaggagauaagaucuauuuauuuaagugugauaguugguccgaaguugggagucaggagagaauauguauauuaguagaaugguugauuuguaguugaaaaccaaggcgaaauuugcaucuggacuuuguuaucucagugaaauaagcaggauuguuaauggagaaugaaguuuuccagguaagacuaauugcuggguguuggaggcugggacuguagcuuggcaguggaaugcuugcccggcucguacacugucccaggugggacagcaaugucucagcaauguaaaccauaggagguggaaagaugaacugaucugaccuugguggcuuauaguagccgucucgggucaggagccaagaaaaugaugucuuggaaauguuggagauagccuggaaaccccagaagucuacuuaaagcuugugauaccagucaagauggugugugcccuucucagcuguguugggcugccuaaguacagagggagaauguaauguauagaguugaacaagcauguggguaacaugcguggagaagaagagggguugaagcuaugcauggcaacuguaaugucagaccuccuaggcucugagaaccuaggagaguacugaagaaaugaaggggguaccaggcaggaagaugguguagguggugaggacuggggcugucuauguagaagaguugagcaaaccaggaagaaucaagagaugccuucucuagcggguugaguaauguccccugacaagucaugugugugugaaauuucaggacacaucauuuggaaacagaaugcgcaugugguuuguuaagaugagguugcccuggauuguggcaaacuuuaaaucccauggcugguguccuuaggagaugaaauuagggcacucaaauaugcagggaggucacaugacuacaaaaaguaauuggcgugauuggcaugguugcuaaggaccccuaggagccgcuguaugggaagaggcaggaggacucucucccagauacuacguguggacuauauaucugccaacaccugagauuucacuuucagagucugaggcugccagagaacauugcuugaagccacccaguuugcagaccuuuguuaggauagugcugggaagaccuacacccauugagucagcaguuccuagccuggcauuguccuuugucggcaugacagagucagucauuguuuauagcucugggucauauccaagccugguucucauuagugugccaugccagcauaggcacuagaguguugauggggagacagccugggcagaaggguguguucagccgggccuugguguucccuccuccuucauggaacacuuaguguuguucagcccugaaagaagagcuucagaaacaaagguggaauggacaaaugcugccauuuuucaccuucuagguucucuaagguuauauucuauagauagauagccaggagucugacguuuugaugugugugcaugugugcauguguguaugcauguauaugcugugugugcguauaugugacuguguauaugugugugugugcguguaugugugugcgugugcauguaugcaugugcuugcauggcuagaagucaaugccugaggacuuccucagcugcucucuaccuuacucuuugagaugggauucucacauugacucugaggcucacagagucagcuaggcugauuagccaaugagcuccagggauuugucugucuuugacucccuuggcacuagcauauuuuacuaagccaucuuccaaagcccuuuuuugucucuuaagaaaagaaaagcuaaaguuugucaauauguuucaaagauuuagugacuaaaagagaggggagaggugguaggcagaguugaguguuuuuuuguuuuuugguuuuuuugguuuuuuuuuuuuuuuuuuuuuuagaaagaaaaguuuucauguaggcaggaaggaggaaggugacagugacaaggaaccuccugggaaccuugagagugaaaggacauuuguggaaaagaaucgaaaagacagcagagaguuaggauauuauaauguuguguggggaaaacuuucucccuuuaaucuguagagugacugggaagugaaggaggggccagauggauguugaagucgcaaacagaaaguuaagaugaggaagaacauggccgccaugaugcucagcaagaaagaggcuaugagggcuaucuuggugagccuggcaauugugacuuaggaguuuagcaggugggaucccaacauggcuccugggucggucucuagacaagcagugagaagcagggcaugggggaugggaguuuaucugugcauuugguucuccauagcauuucuucuucuccuuagucucugaucucaggcuggcuccugaggggagcgcgcacucacuauagccaguccaggacacaauacuucucucacuauccuuaugaucucugguauucucuugucucugugaagacagaccaaagguccuaauacaccaugaaugcauuugccguaagaaacugugccuaugcaccaaguucccagucaaugccaccaaaucaccuuccuuaccuguuaccuugggaacagggcaaguccaggagaccagggugcuggauagacaguugcaggcuaaggaccaucacuaacugguuccccuucuguauuucagaagaagaggaagaagaucaaggagaugaagacaggguagauggcauagucagaggcccugggcccaaggggccaucugggacagugucagaagcucagcuggcucggaggaucaccaaagggaagagcagccgaaggaugcuguccaacaagccacaggauuuccaggugggaagggcucugcuguucugugcacaaacugccacgcccuggcccacaacccagccacugcugugacaucacggugaacaucguccuauggacaggggcgcaucuacggaaaaaggauauaagggcaugaacccagaaaggagaguuuucugucuauaaguacgaagggucuagugaaaguagacaagcuguuucagagggguguaaugggaacuuuuccuuuccucuggaagcaaauggggcugguuagcaaagaauaacagcaguucugguaccuguugcacuuugcuuagcucucagcaugagugcaucgcagggacacuuguagaccaggcaaugggccucagggcgggaaucuuagucuucccugcuucucccaggccagcucugaacucuuucucuugcucagugaucacagacggccccuuccggacugggaggucuuaguaccgguuuuagccauccuuaugagccagagagccgaggugacaccugaggaucccuuugcaucgcacacuggacgagcuuugguaacaacaccacuuugugcuugcagauccgugucagagugaucgagggccgucaguuaugcggcaacaacauaaggcccguggugaaaguucacaucuguggucagacgcaccgcacgagaaucaagagagggaacaauccguuuuuugacgaggugaguggguugagagugcacgguccugcucacccagucuguccuguuuguacaugucuccuccugccaauuucacccgguucacagaggagggaaacacggagcuaagaacuggaaaguacaguacaggccuccggugugaaugaagcacagagaagucagagccacacaggcgugaggccaccuaauuggcuuccacugaucuccaauugcccaugucuuccugacauuucucccguuuccucaugggucacuuuauccugguaauggaacuugugaugucaucuguauccauucuagcuccuucacauuacagaaugacuaaagguugacugugucccugugcaauccaggcuuuaagaggugugaacauuugcuugguuacaaaaauauuucauauuaaaggaaugccacaugaacaaacaaugcgucccaguucuguugacuucugugauaugcucaaaagugcuuaaugccuuuccagucaucucagaccccacaaaaccacaacuaggcaugaacagaaacaauguagaacucccucggaugcuagcugugcuauguucaggagacucagcucugagaugccucagccugcaccuuuccuagucucucuuuuucccuaaaguccugauucuggcucuguccuuuuuuuuuccugucuacauucauaagagaaaccaguuuguucucuucugcccccugucucuugucuuacucaagcgagguaaaggaccaaccccauuuucuucaaaccuauaccucuuagacugaagauagacaauagcauauagaugccuauagaugccagugacuggggcuucagaaugagacaugucgguuaaggcuuucaugauaugggcucuauguuaacuaagcuacucugaggaguagaacaagggucuccaucuuccuuagacuuuucauauucgucaucuuaaguauguaagugugguaccagagacugaaccuggagcaucauacuaggguaccugucaugcacuauacuagauguacccuuagcuaucguuccagaccccuccccccuuuacagggcaucuaugucuugauaguacauaaaagcacugucuacuguguguuguagauaauaugucagcaucuaucagacuauggggauagagauagauagauagauagauagauagauagauagauagauagauagauagaugauggauggauggauggauagauagauagauagauagauagauagauagauagauagggauggauggauggauggauggauggauggauagauagauagauagauagauagauagauagauaaauagauaaauagauagaugauagauuuuucggucaguuucacucugcaacccaggcuggccugagaucuugaguucuuuaccucaucaucuuaagugcugggauuacagguauguaacaguagguacuaugcacuagguguggaauauuuuauaaaaacgacuacucccuauagaaaacucaagaaaaauagaacuauucuagguaaaaauuaaacugaaaagaaaugacauccagaugcagcggugaucuguguguggaucuuagauuuugaaaaaaaaaauccaagaauuuuuguuuuuaaaucuauagaaaaaucuuaaaauugacuauuuacauguucauuuugggcaugugguagcagcauugugauuacacaaaaaggugcccuugcucuuaugaaacaugcacaaauacaccuugaaagaguaaauuaccaugauaucuaacuuuguuuugaaugauucuguuaaaaaacaagagagagagagagagagcaagcaaaaaaaucaagaaagacgagccuugcuuuagguuuuuugcauauuuuaagaugaccaucgucagaguagaaacuuauuuuucuuuccaguuuggaaaaacuguaauaaaucuauuuuccuuagaaggaaaacaagaccucaagguagugguggugcacaccuuuaauucuaguacuugggaggcagaagcagguagagaucucugugaguuugagguuaggcuggucuacagagugaguuguuccaggacagccagagcuucauagagagacucugucucaaaaaacaagcaagcaagcaagaaacaaaaaaacaaaacaaaacaaaacaagacaaccaacccagaaagaugaaacaaauaccccacuguaguaacaaaaaugaaaagugcuauucuauuuuauuuaagcuauuucuguuuauuuaaaauauuucuacauaugaaguuggagaaagugguuuuguuuuaaaaaaaaaacuauuuuuuuuuaaguuaaggucgucauuguagcccaggcuaaccaagaacucaccauguaacucaggcuggcuuccaaucauggcuguccuuguaccucagccucucacguucugggaaaggggugaugagauuuggcugagaaggaauuuaccacaacugaaugggcaauguuuuccuuaaaggcauuagacauaagugauagaacuaaggauguuagugaacugaguggacaucccagccgucagcaugcacuuuagucaaagugucaguguggaauaaucuagguccucacuuuaguuagccguaaauguccagugcuaagugaacacauuugcucgugucaguuauuuccuguguuuuccuuugccacugugcugcgauggguaagugcucacuccaccauaccugauucucaaaguguuuagcaguuuucuaggcaagccuucagcaccagcuccucugggccugagccacuggcuaauguccgauguguucuguguuguuuugacaguuauuuuucuacaaugugcacaucacacccucugagcucauggaugagaucaucaguauccggguaagggaccagggcaggaggacacugcucacugaccacugacaaagacuguccgcucacccuucuccuuuccuccagguuuauaauucccauucuuugagggcagauugucugaugggggaauuuaaggugagugacagcaguauacuucuuucaaugauauaaagaugagaacucucuuaauagggaaucugauucacagccaggccucagggcacgcauggcaguggcaucuuuaggguucuagguagaggguagacaccaugauuuuugcugaaggcuuuaugggucuugucuaccuuaaauguauaauacuaauagcauuccaaagcauggggccuuggugugucaaugaaggucuuugccagcuucugucuguggauggaagcaaagccaucucuauaaaggauguguuuggugcuggcaaaaagucccauaaccagcucuacuuaccaauggccccagaguucuguccgaaaagccacuuguaagucugaaaugagaacagaaagugacguuggauaagagaagcuauacuuuuucaaguaguucucacugugcggauucuugaugggcaccucagcaggccucagaggaugagcugccuucugaaggaagaagauccagucacuaacaugcuucuaacgugagcugagccaggcagaccucuggucagacccugccugucaccagagugaauucucuuaaccgcuuugauccuugguugcuucaugugcaggauagaaucagcauccaggaggcauguaaagacaucauggaaccauccaaucaaugauuagauuaguauucacguuaggacggacuggauaguuggacaagaccgggucaggugauuuccuguaaggugauuaauggucccaguuucucuggcacuaacaauguggaaacuaagaaagucuugggcaaauugggacaugcuagucacccugaucucacgguuucuuccaaccccgagucuagcucacucauucaguaacgaucuaucaagagucuucuguguggcauacaucaggcaagaugcugauacaaagugggugagggggaauuuagaucuuggaaguuuaaaaguaacagcauuggauaaauaucaugugucuuuuuuuuuuuucuuuaaagugacaagacugauuuuaaaaccuauuuaacuuguuuuccccagauugauguuggauuuguuuaugaugaaccugguaaguaauguccccucaucaacuugaagucucaguuccuucuaauucugaagaaacuccuagagcuuaaggaaaaucucagaagaaauuucuugaagagauuucuuuccagugguggggaucaggcuaagguccuuguagaugccucucccauagcggcaugccccccccaaaaaaaaauccaccacaggaauaaaaaaacuguuucugucacguggaggacgcuuaaugagaacaaauaguagcugauaacggauagggaugucuaauauuuuuacucuuaacaugcacaaaucggugaugucuuuguuucgugauggucucaugaucuuuuuaagagaucaaaaugaaaaacuauucuagagcucggagagucucucgugaguaacgccaggauaggaggagggcaggacuaaggugugugugcagagcauggacaggacguacugauuuguggacuugccuggggaauuggaugaaaucaggauccugccagcacaucuuuagaguggccuuguccuuaugcuccuuuauguuaggccacgcugucaugaggaaauggcuccuucucaaugacccagaagacaccagcucaggcgcaaaagguuacaugaaagucagcauguuuguccugggaaccggagacgaacccccugugagugccucacccucuaccuucuguucuuaaaaacguaacugagcagugggcugugaaauggagcucagauuccaaacuggcaccccuauuccugauuccucccacgccaagcugccccuugcugaucacagguuaucauuucggcucagauuccuucuuggugcuuccuaguauaugugagucuuucuuuuagggggcaagggcguugagucaggcagggucucauacagcucaaguuggccucagaucuaguuccguaguuaagguuggcuuugaacuucuaaucuucuugccuccaccugcugugugcugggaucacagugcccaggaguaaguauuuaauucaagacauaacauguauguuuuuaauaacuucauuguuucauuagaaaggcuugaguucaucuuccaugcaaagacucaauaccucaucacuuucuuccaccugacggguuagugauaguucaagaaaucagacagaaacaggaaugggccagagagaaaccagaacacaggagugcacauacauccucaaugcuggugcucaggagacuacaggaggauacgaaacacugaagcauugauauuguagagguuuugagauugaaagaaaaaaaucaaugacugagccuuuaaacgccgaacauuagauauaauggaagcaguccuggacauccauagcuuggcuucuuuuagaacugcuucuccuuugcaugugugauuuugaccaugugucccucuuagccugagaaacgagaccgugacaaugacagugaugacguggagagcaacuuguuacuuccggcaggcauugcccuccggugggugaccuucaugcugaagaucuaccgagccgaggacaucccccagaguauguacugccuuagucaugcaugggggcuuggguucagccaucuuugagaugguacaugaugaacucaugcuuugaauacuguuggaugcuccuucuauaagguuccccucugaaaggccuucauggacuuacuuccauucuucuggccccacugaaaguuucugagcagcuuggguggccauugcucaaccauguucuugucuuugauccauuuugcucugucccuucauccuuccauagucuguuuuauuuucuagagacugcuaaagggaggcgaacaguuagcacuucuaaccuuuuuaaaaaacauugcauuauguauguguaugugugugugugugggggggggggcacaugggccacaguacacaugaagucgaagaacaacuugucggaguccauucucuccucccaucauguugggucuuguaaaccagggcucagugaaaccacugcauuggacuacucuguggguagaaagaaagguuuauugggaccuaacggcagaagccgucucucaggggacagagagaagagagaaacagcagaaaagcagacagauuuuauaugcagucaguggggaugucuuugaguuuauauaagcuguagagaaugacccagaacuagauguccuugccauagguaagugauguuugaagguagccuguagugugauuuauuuugugugccuggccuuuuaagggauccccaaugucuacucaacuagucucaguacaauagggacaaacauagucauugcgucuuggacuucugggaacagaggaggacaugaaaagucaguagcugcugagagagauuucauagggggaguaggauuagaguaagcagaugaguaggguccaggugagagaguaggguuaaagacaguuggugcuagaagaaagaagauugagucgggcuaaggaaugaagaaaagagcagagugaaaaauaagagacuguugauccaggagaagcugagcugagcuagagaaaagaucuguuaagagacuguuaggagaacccacacaaaguagcaaaacagauaaaggcaagccacaggggacuaagggagguuccuauuaagcagaagcccaucuuuaggccucuguucacccaacaaaaacccuucuguuuaccuggccaaaguccuucuauuuaggacauugucacuagcacugacauuuugggguuccaauuuggaccuaacaguucucagggaucaagcucaggcuguaggucuuaguggcuuuaccacugagccaucucucuggcccuaccugaagaaaguguacaauuguguaauaaaaacaugcuuacaacuggacuauuaaauauagcugagcagguccaggaggauggcucaguagguaaaguaggcuugcaagcuugauaucacuucagauccccagaauccauagaaaagcugaaugugguggcuugugucugcaguccuagcaccccuaaagcuagaugggaugacaagacagggcacuacccccgaagcugggugggccaacuaaccagaaguacauagcauagugucaaacaagagacacccugccuuaaaaacaagauaaaaguuguagauaggcaccgagcauuauccucugacuucuguguacauguuguggcaugcgugugcccuugcacaccaaacguguauacacacauacauaugcaaaauuaaaaauuaaaaauauuuuuaagauguguugagcaaaguauagucucaacuguuugucccuacuguauuaugagacauguuugcugagagauuggacauuuaaacaaacgaguuacagagauuccaguuauaaggaccaaggugccagcucagcauccuuucugccucgccugcuggacucuggggaacaaggcucuuccccaagauucccagguggcugaccacucaugcuucaggauuugcuucuuuuccugggaaccuuucuguccuugcaaagacucuagaauguucccauuccacuuuucucucggagaugucuucagucgauuaaauucaccuucacauucuucuuccuacacuggcccauucaaugcauuucugaccucuuuggaguugguugaaacauagagacacuacauuuguaaugcaucaaugugugauagcuaugcuacuaauuacauuaacuuuguguuucucuaaauugucagcugggccuguaucauuuugaccugauauacauucuccaaauuggauguagaccugaauuugacaauugccucuuacccugaccaaauggaugucaggaaaacuauuucaucuuccacaaaugaucuguucuuaacacaauaauuuauuaguuuauuuuucaaggcucucuuaauuguuuuaaaacuucacaaggaaaaaaauccucucucugucuuucucucuuucucucucuuucucuccccuaugucccucucucacaagacaaagaacauuuuugcugcuaguucuuaccuccacagagaacaauucuuccuaaaucucuuuugaugcauugggagauuuuaaauuguguuggaggacuuuugugguuuuaagagaguagcuuugaugccuucugugugcucuguuccuuuccaguggaugaugccuucucacaaacagugaaggaaauauuugguggcaacgcagauaaaaaaaaucuuguggauccuuuuguagaagucuccuuugcugggaaaaagguucguauguaauguaaaugugugcgucucuuagaacagacauuuaaagugcaaugauguucuugauggugaauuccuagguaucuuugguaauuagccucuggucagugaaccacucugcagagacacugguuaucugaaucuggcuaugccaggcuucuccacagccuuauuuuggaguaaaaaguauaaaggacucaaauucaaauuagaagaaucugucuuuugaagauuggacuagugagaccaacacuggacugucauaguuauuucucagguucaaccauucccuuaaucaugggcaaaauccccagccagacauuaauccuuucuagccuccauucuguuggugggauaaaaacaucugaccaaaggcaccauaguggaggaaaagguuuauuucauuucacagguuacaguccaucacugaaggcagucacacagggauuuaagcaagaacucaaaucagaaagcacacaggaacacagcuuacuggcucagucucuggcuaguuucuaggcucacacuuagauagcauuuuuacacagcucaggaauacccgcuuagggaauggugcugccaacagugggcugggucauucuauaucaacuaacaaucaagacaauccuccacagacauucucgugugccauuuuucaucuagguaauuccucaaaggagaccagugcuucucauuuucuuugugcugcugugacccuuuaauacaguuccucauguuguagugaaccgagacucagcaucuucuuuauauuugagcuauuuaguuacuaaagcaggaauccauacccagcacacaagugaguggauaugauuccuaggaguguuguuguagacacaaugggagccccugacccugggauaagaugaagucugauuugaacuguagacuucgcucuacuccacagucagccuuggcuucugaguuucgauuucuuaaaccgugaaugcgagugcuaacgaucucauagggccuuugaauugguuaaugaguuuaagaagccaucugcuucauauccugggaauauagaaaugaacacauggacagcaauaguucucgaagagcuuagaauauacagacuggcuuaauuuguuuucuguugcuggaacaaaauaccuaagggugacuucauuuguagaguagaagccuauuugguucaugguuuugaggcuagaaaaucuaugaacacagcauaaauaucugcucagaaucugguaaggaucuucuacuucauuguaccauggcagcaggacccgugacaugagagguuaaaugugauaguucaaaucucucuacuaaugccaucaugagaucuccauucuuguggccucauagcuuucaauuucuucccccaaaagcccuacuuccaaacucuauauacauaggaauuucgauguuauguuuucaacuugugagcuuuggggagcaggcugaaauuaucacauacucaguaagugagaaaaugagagcggaacgauuuuagucagugcugagaacuacacagaaagcaaagugacagcaagcgauagaugcauguauauguauucaucugugugugaugaauaugggcauguuuguauguguaaauguguguauauauguaugugaagguauggauauguauguguaugugaaguuaucaacugggacgcuuuggaugaaguaacauuugagcagaaggcauggauguauaggcauccugaaggguccaaguaggcagaggagcagaggaagaggccaugaaggaagccuccuuucagggaagggaagccuguguggcuggggggagagcaagcaaggagggaagugagacaugaggucagcagggggugggcuagggagggcuuuagaaggaaagggcucugaacuucauccuguguggaccuggagggcucacaguagaguggugucagagucagaaggcaggaagggacuaggggagucauauggacguggagggcagaugcuugugagcaaguaugucaugagcuucaugaagaggucaggauuuacugacaggcuggguggggucuggggugggggaggguguuacacugacugacugucagccuaaacuggaaacgccaagacaggggcgauccggaagcuggucaauuacuaaccaugaggugcuugucaaauaguauacaguaacuguucaguaaacucaguuccuguuacagucaccuguuagaucugcagcaaguggagacagauuaaaaacaaccuuuaguagacaggagaagcagagaccaagguuaaacucaagcccauguccuauuuaaccuauuuauugucaggaaaaauaaagcccaggguuuagguguggauugcacaugcucgguguggacaaagcccugguucugucccuuugagacaaaggggaggagucgggagagaggaaggcagagaggaauaggcaggaagaaggaggggggggggcgaggaaagggaagggggaagaaaaggugggggaaggaggaggaaaaaagggacugaagaaugaguggaggaaggguuuacagguuacuaaguaaaaagcuaaaaaguagaccacuaaagucauaaucauacaugcgugcaugcacgcacgcaugcaugcacgcacgcgcaugcacacacacacacacacacacacacacacacaaaccuguuagcaguuagaacugugacgaccuacugguuuucuuuggugaucuuugcaggugugcacaaauauaauugagcggaaugcaaacccugaauggaaucaaguugucaaccuucagaucaagguuugacuuucuuuucuuucacaaaaacuaagacugggggggagaugaggggaagaacucuuggagggggagcugggagggggagccaccuuugggauguaaauaaauaaaauaauuacuuaauaaaaagaaaaauuaaaaaguaaugcaaaaaaccccuaagaaugcugacuccacuaguuagugaaaucauggagaaauaauuaccauuuucuguuucucuuugacaguuucccuccaugugugaaaaaauaaaacuaacaguauaugacuggugaguugcaagugugcuggauucagcauuagcaaguggaacaucugggugccaagggcaucgcauugaugaccuaacuaucaccuuuugguguauuugcaauucuucuacaagaaggcuaaacuuggaaguggguggcagaggguucuuuaaaaacaaaaacacuaaggcaauaacaauaauaauagaaaaggcuuuuccaaaaaguuuuagaaaucuuaguuuaguuguucauaaaccaaauaaaggagguggucaccugaaaauucucaaagauaagaaauuaggacucuuguuuccauuaggcuguccaaaauagaccagaaauagaguaagccaauuucuaggaagaaucauccaaaugucuaaaaacaacucuuuguuacuauuaaaaaugaaaauugagaaaguugcuuaccugaagugggaaaauucauuaauuuaggcaugguagcacacgacuguaauccuagcacuuacaaggcuugaagggaauugugaguucuaggcuauccuaggcuacauaauaauacuaaggcucaagaaaagagggaaaguagagggaggaaggaggaaggaggaagaaggaaagugaaggggguauuuauugaagaauucuuacuagacuaaucccucagaaccaacuagcuacuguaagaccauucauagaauguucuuguuggauggaguguucaacugacaacccucaucccucugaggaaggggcaugaacaggugucauccucaucuccaugguaacgcuguggggcagggacugaucacagcuucacuuuacaguaaggacuuugaggcucagaggggccugguagcuugcccauaaacacuuggugauuacagacccagcugggcucacauacuucauggaaaccccauauuucuccauuggucaaaugcauccgacuuucacguuagggcgacaugcuagguagaggagagacucuuguuuugugauuaccucacaacuaagagcugcagcugaggucugaggacaaaauguccccuucuuuaauguaaaaguuucaaggcauuggggauccccagguaaucuacagcaagagauuccagggccccagggacccuucggaguauggauuuagcccucguuuaauggcuuuaguauccacucuggccuauugacucuagagcuggaugucugcuggucgagccacuacagcaucaccuguggucucuaugaaugugggcauuccugcccuuugcugcccccuucaaggcauguguguagaugaggaugcacagagggccccaacuuccuggggggaguucuugggcccagaucuaagauugcauauccugaaggguauuuggaaaaugaagggaaggcuaaggauuugaaaccuaucugaagaggcagaaaacauucaaacuuguguuuaugacuuaauagcuguauauaauauuuuucuaacaaauuacuuggauugguuacuuccuauaagauauuaugcuaugaucuuuccccccaaacacugagccuuaggcuucagagagggcaagccacuagaugguuaaugaauaaaaggaaugaaacagaucaauguuuauaguacagucccaaccugaggccucucuaggacgccuacagaaagguacacauucauauuuguacuuguagugaauauaggcaaaaagaacuuucccacaauguagguaagauuuaaguuuuagucaagcagcugugcucugggaaacaacaucugucauacaguagguguucaauacacauuuuaauuuaauuaagagagacuuuuucucucuucgauagauccuuggauauagcccauuauacuuguuaggccauuuuaagcaccauaaaaauuacuguagauaugcuaagauauaucugacuauuuuacauaauauaguuacaguccacuaauaaauuuguaacuaauguaacauauuacuaguccguuccuuuuuaugacaaugauguuaacuguagccauuugaaaaucccuugacuuuucugcuaaucucagucucaugacuucagaaugcauggcuugacugaaucaggguuucuagaguggcuagagacucauuggcauuagacuggcaggcguagcuguuguguguauacuccuggccucuagcuaagcuuucaugaauugagcuugggcagaugaaggugggaagcucccacauaauccuuaagugcaggaaagucugaggccacuagacucgacaguuucugaggucuagaaucuucuaacucuccaguuaauauuauugaauuaaagcuauaacuucauaggcaggagauguaaccucuuguuuuacacagggaccggcuuacuaaaaaugauguaguugggaccacguaccuguaccucucuaaaauugcugccucugggggagaaguggaagguaagucaccugaggaccagagcuaagcaggacucaaugcuucuagaaaagacaaugucgauugcaacgcuccgguagugcaauggucagcgaguagaacuuacauagaacgcaugaaauguggcagucgcuuaggaacaggcucgaugccuuaaaagcaaauguaucugggacugaugaugcaggacugcgaccccagcugcagaggagacuaagacgggagaaucacaaauuggggccuaucugggcuacauagguaguuucccucuagccuaagcaacuuacaagaccccauaucaaaauaggaaugagaaacaaggcugguaaugccgucaaucauuagaguguguuaucuacagaauaaaaaguacuggguucaauuucuaauacacacacacacacacacacacacacacacacacacgcgcgcgcacagugagcccagugagccuggccaaugauguuuuggugauaaacagcacaauaacuaacgacagaaacaaauaagaaguuauacauuuucaucucucuugcucccauccaaaaccuuuuugccaggagcuguuuaugauagauuguauuauaauauaauacauuauauuauaauaauaauaaaaugaucauaagcauauuauuaccuguagcuugaguuuugcaagggccaguauauuaaacauauuggguaaagugaaguaauuuagaauaaaacuuuggagcauaaaugucugaagagggggaggagagauguacgggggaggagagauggcucagugauuaaagacacuuacugcuaugguauuucgaguagaccucaacauggcuuacaaccauccauaacuccuguuuuaggggcucugaugccuuuuuuaaggcuucugcaggcacuguauauaugugaccaacacauauacacacaugcagaccaaaacgcuaauacauguaaaauaagaaggaaauaguaucaaucccaaccaaugucacgaacccggaagauccagagauaggacaaagaagacaccagcuucauaucuuaaggugucaaaaagaaagacaauuauaaaucucggggagaacaaagaguuagacagaaacgcaugguucaaacauagcgucacaugggccauuacuuuaagccaacaguuggaagucagaaagagaucccaucugcacauucucugcugaagggaucauaagacugcggagcuucagcaaaggaaagagaaguauggccccuuucucugcagaaaacaaguauuaaagagguuacuauaucauaagaaugauuuguuuuguuuuuugaaacccacauccccagcucggaacagaaugcaaaugccagcacccuucugaaauguaaaacacaagcacagaaaauagagauuaagagcagacagaaggaaggugggagugcucagggccucuuuuugcugagugggcaguauggaugugcccacuguagguuaaagagaaccaguagaggguaaaaggugccauaucuguauagagaaugcguaaaagcaacccaacccacuuauaaaguggagagucacuagacaauaucuaacuguaacgguucaagaaauacugguaaacguguucuuacuuaauuguuacaggcaguuucagcccccuucucuugagaauuucugccauuacccguccuauggguagccucauuuaagggcacaaaacaaaaggaacagaccccuauccccucaaccucccacucccccaagcccccucccaccacacaugcacacaaagaaacaaccaugcucugcgucauguaauccagaguuaacuacaggugucugcuuauauugccucaaaccaaauuaacuugcauuuucugaccaugguuccagcuagggacauguaaaugauuuauuaaaagcaugcugugucaguaacuucaccugcuuccuguggcugugggaagccagcucuucucaaaugcugggcucuuucaagcaggcaaguuuggguuauucaccuggcuuugagccaguugacgguuaacugguaagacuagcacacauuaaacaggcuccguggaauuugggugugaacuggggauuccuugcugcugcucggcugcuuauccagcacagaacacgauuaacuuugcuguguguguuuuaaacucuucauguuucucuuguuuguguguguguguguguguguguguguguguguguguuuuuaaccaaucauauuuuuacuacauagauuucucauccucgggagcuggggcugcaucauauacagguuuaugcuuuguaauuuugcugucuucuauagcuuccuauccucugacaccuuacuaagaauauauauugauugccuuaaagccuucuccuugauguuucagugucucgaauaccguuuggugagaguuaguguuucaugaguaauguguguugguccugcauggcuacauuuaaagcacauucgauagccagcccuugugcccuguugcauauuuucaucuagagacacaucauccugugccgcuuuaccgcaaauaauuguuugugagauauaauacuuucuguuauugcauauguucaguggguagagaugcagggcacuacuaaaucuauaguuucgauaaugugugaaguaucucugucccacuuucgaugugaaucucuagguuagaagauaugaauacuuuccauuuuucacaccucucuaguaccggauagcuuaccaugcacuuugguuuguacaguccuugccguuuuuugcaaguuuccucaaugcugaccaucacaguucuaacgcagaugccauuguuccucuagaugagggcucugaguuggagaagcacaggcauuaagcaaccuucuaacaugaacauucuuucucugagauucucugauucaauccuuuauuccuacccaacaaccuacgcuacuccucugaauguuaaagacauaaaaucaaacuagugaaccaaaguuugaccuccauguaucacccaaggaugcuucuaccucugcuuucuggagcaaaaggcauccuucuuucacuugggagccauucagcuugaugagaaaacucuuguauccccuauuuccucuugauuggcuguuucuuugcauuguccucaguacccuuuauugagggguaaucuugucaaguccaaguaucaaagacagaguuuaucaaaugaucauuggggagagaaagcaaugaauggcaaucuguuuaacaauucagaauagugauacagucuuaccacuguaaggaacucauugacacaguuaaauuucuaguguauuuuuaauggcaccuauaauacuacuuaugguugaaugacaucuuuacagaugauauuaaauaaaucugauacaucauuuagaugacuucuuaaaacaacaauaucuuuuacuccagcuaugauaaauauuuaauaugucaguuauaaacuugcaaaaaaugugaacaacuuuaaaaaucuuaugauccuuuuuaaaguagcacucuuuuuguaaauauaaguuugucugaauuaucucaauuuuuuuguuuaauauuuuaaagcaauaguaaaauagaaauacggcaggucccacaguguucauaauuuucacuaaugcaacuaauucaccaacuagagggaaaacuucaucucaccuaacugacuaauaacuaauauuuauuuccauagcuugaacauuaagaccugaaaucuaauggugcuguuuaugucucagcaacuacaggagagacagaggugggguuugucccaacauucggaccuuguuauuugaaccuuuacggaagccccagagaguacacaggauuuccagaucccuaugaugagcucaacucaggaaagguugguuuaucaauuagggcugugauuaacgaccccugguuccugggauuccuucuuauaacaguaaucaguaucucaugccagaggcacuuacauucuccaccccuaacacagacauaccauucagcugauaaaguguuaaaggagagaagcccuacccuucuuaagccuuagaauuaaagaauaaaaaaaaggauccuggaaggccacgcauagcagugcacaccuuuaaucucagcacucaggaggcagaggcaggcagaucucugugagcuugaagccagccaggucuauacagugaguucucggucagccagagccacauaacaagauucugucuaagaaaaggaaaaggauccuggugaccgaguaaaacaaugggauaaguggcaucccacagccggucacucuucaacuuuacauuaaccgaaaacaucagcaaaguggacggccaaugcuggccuccuucuccaaugcaugguccaggaucugcagugauaacaugacuggagacccugagcugugcuggaacaucaucucacagaugggaaagucucuuuugacuacacuagaaguuaaauguauuuugguuauuuacacccccuccccuagugcucaaaaaauauuauaauagagagaaagcuguggguaggggacagugaagacagacaaggacuugggagccuucuauuucucucuaggagauucuauggacaaccacuguugaguggggugggaggaggaucuacucuugacuucuguauuuuagcauacccagagcaucuugaucuuuugccuccugaccauucugagacuugucugguuggcacaugugaguuucuuuauuaugagaagaagagaaagggauccaaguuaguaaauagacaaaaaugcaggauuguucccaugaacugagauggaggagacuuggagccccuucuccuucaccacccugcuucagaaacuccuuccagcuccagaauacagcuucaagggcuccagccuuagucaagcuaagagccuuuucuauccgagcaucucaugacaucauuuggaauccaucugaaaguaaaugacucuuccuuuagauauuaaagacuuguguguuaaaguaguguuagccugauuugauacacagagguucuccggcuguggucccugucuacgggaauaauuuuguguucuuggguuucagggagaagggguggccuacagaggcaggaucuucguggaacugaacacguuccuugaaaagaaaccaccagaaaagaagcuggagcccauuuccagugaugaccuucugguuguugagguaaaugucagugugaacauagccugggauggaagggauuggagggacuaagagucaucugugggagacucggagaaagaucugcuucauaguaagucccuccaacguucccuugauauagccaugacagcucuaugaagauaaugaggcuugcuucagccacuuagauguuaacugguauauuaacuuuugguacucugaccaaaauugaaggauagacaacuucagggccaaaggauucauuuuggcucacuauuucuguagguucauguccaugguuguacagucccauguaaacuggauagaacaggauuauggaaggcgugugcagcuaaggggcuaccuccauauggauagguaacagagagagggaacagaaaaagaugccaguaucuuacaguccuuugugaccugcuuccugcaccucuuacugucaccaacucuugacagugccaucaugauauaaauucagcaagggauaauccauuagugauauccaagaacucaugucucuggaaacacggagaaauucccauaggugugauuaaucuucucgauuuguuaauccagucaauauauauauucauaagaacagagugcccagacaguccccuuggauggagagguugagguugugaggaagagcccuucccuuagauggcuuauguaccagaguuacccuauucccacuuucacaggcggcugcuacaucuccgguuucauagcgauaaggacaugccugcuuccugcugacauuacaauggcucuaagucucuuuuuccuucaagacaggaagucuucuaaguucaccucucuguuuccaagacucucaggucaccauucuugagacacacacaucugaacuguuugggagagcaacugacucacagacacuccuccgcccagggccucuccuggcuuguucuagauugcccugggccaccaacucucucaggcugcuacauccuccauuccuggaacugaacauuuccgguguuguagagaaacuaagcagcaacuuuacaaagaugucagcucugaaucaagugaacaguaggagggcugacacgaaguggcugcucucagagacaugagcucagacagcucucugucucucagccuuccugucuguuuccaaccugccuucuuauggcuuggcccgguuagugccuugaacacauucuuaucucagcuuucaggcccagcucucacaagcucucagcugagccaggacaguuuucuuccuugaagucaacuaaugucuggcaguuauaaaaucugaccccuuuuaggaugaccaacaggaagaauagcuacucauuguagccgagacucuucucuccccgacgcuccauggccguguucacugacuuccacuaggaugauuaggucaggcuaguaccuaaagcaguacugguagacuuacccaucauacacgauugggguuugggacaucuagagcucagccuuuggguugcaccaauuucaauauagguugccuuucucuucaccccucacuuugucucuucugggaacaaggcauagggcacaacuguacacagggggaaaaaagcaaguuagcaaagaucauagccugggcaaaacugcugcccuggaaguuuauguuaccauauagaaugauucaauuuggguaauauaaauaguaaaagaacuauaguagacauuugcuuuuaaacccacccaugaagauuacccaaaagaaggaugugugaucugucuugaauguucauucacacgucugccucuagaaucuagaacugcuuacaguuuuucuaagacuuagccaaucucuuaaagcagguucacaggcuauuauaauaagccauuaagagauaacuguuaagaaauuucuaggggguggguaugggggaccuuugggauagcauugaaaauguaaaugaggaaaauaccuaauuaaaaaaaagaaaaaaaaagaaauuucuaguccucccuaaccccagauauauauguguauguauacauuuauguauguaugcauguauucuccaguaaaugccauagcacuguucuuggauuuagguuuugauuacuccugagguaucccugucucuugguguauaguauggcauggcugugcuaagcugagacuuuaaaucaaguauccucaaaggcgaguauauaaauacacuccccaugcuccaguacaccgacucaagcacagggcaugcucagcagagagagugagacucugugcuccauuaaucccaacacaggugcagcaacucugcauuaagaucagaaauuguccaccuaccucuaauuuucaguuacuuuguuauaauuccuggggauaucccaaaaugugaugaggcucuuguagucagagaaucgcuaugaucucaggaagacagaccuuguaaguuaguacggucugagcguuuuugucaccccagaagucauauguucaaaucuaaccuccagagugaaaggguuaggaauuagggcacuaccguggugauuagggugaggaaccugggaaggcuucuguggacaacugugugggcguugcaugagaacaucucaggguuucugauggaaucuuggcuuggaugucugugugcagggcagacuuaggcagaugcagucuucccgacucagugaguaccccgugcucuuucuuuguucucuguggacccugguguaauugauaaguaccauaucaaucacaguccuuccuucuggaaccuguauuagguucgggguguuuuguuuguuuguuuguuucuguugcugugacaaaauacuggacaaaggcaacuuuagaaaagagggguucauuuuggcuuacaguucaagaguacguuccaucaugguaaggaaggcguaguagcaggagcuugugguggcuggucgcaccaguuuccuggggagcuuaagccuggauauuuacucuuaaaagcuucccuagcuuaguccacugcuuuggcccuggaggagcuggggacacugaagccauuuaucgggagccuucugcugcugaguugugcgugcaaugaagccccccaauuacccaugauucaagaauacugggggaauuggaagcauaaaugugaauuuucuaaggacuuaaaagaaggaaguuauuuguauuagucauacuuuuauuauggcuuccucauaaagcaggacaaggugacugucaugaucaacuccuuuuuucuuuuagaucugcccagaaccccaccucaugcacggugaugggcucacauuuacggugguggugguggugguggugguggugguguggggaggugucucacagacucagggcccaaacuauguuuccuuuaaaaaaaaaaaaaaaccaacuucccuuuucuuaaaucaugcuuaguacuuuauaaaggagaaguuauguugcauauaaaauuaugacuaaaauggaaagugaagcugaggcugcagccagcgauuuagaaagaauucuucaagggcucagaggaguuucugacagaaccuucuuagagggcucugcucuaucugcuauaagaaaaucgccuuucaccaaaauggcgacuucacagccaugagcuaucuaggggacuguucccuucucuuucuaccucuacaagacuacaagaugauaaaaguucucacgacagccaggcaugacaaggcauauuuauaauaccagcaccuagagacugaaccaagaagguugugauuucaaagccagccaaggcauagugagagcucgucucacaacgaaacagaacaaaacauguucuuaaagcagaccccauaaaauaaaaauagaaucacuauagaaucuagcaguugcacuucugagugcagacucaaaggguuuggaagcaggaacgugcacacccaguguuguucaucauagccaaaagguggaagcugcguguguguccaucacuuggugacuggaugaacaaaugaaguguuuucauacaacaaaauagaacuggggaaagggggaaguauauguaccacaacguggaugauauagaagacauugugcuaagugaauuacacacagcacaggauaacuacauaccacacagucaaagaagcuagccuagucaaauccagaggcagaaagagaaugguagcugccaggggcuggagggagggagaaauggagaguuuuuauuugaacgucagcuuuguaaugugaaaagaguucuaggccugggugggugguuauugauuauagcacagugauauaaauuuacuugaucucuuguguaauggggaaagugcccucuauauagugacggagacauacauuuauguuuuguuaggaaaagagcauugguucaggggucagagggcuggagagacgacucagcauuuaggaucacuuacugcucuuucagaggguuugauuauuacuacacauaugaggacuuacaacugucuguaauuccaguuuuagggugcccaacgcuuuuaugaccccuguggcuccugcaaagacuugguucacauacauacaaggcacucaggcgcgcgcgcgcgcgcacacacacacacacacacacacacacacacacacacacaaagcaaacauguuuucaaaagaaaaagacaauuuaaauaaagccauaggaccugggaggaguuaagggggaugaacaguacacaaauacauuguauacauucucaacaaauaauagcacagugacaaauaaaccacgauggacgacuagaggauaacaagauguuugcuugguuuugauugaauugagggggaaagugucuuuugauacugagaggggacagaggacuucccauugcugcgguagguaagaugcaugggaaggcucucccuuuaacagacuuuuucucaaguacuucauuaagugauguaaaguagagacccccuccggagcccuggggaaugggaaugacugcuguaacagcucaaaaaagcaucagcaagaaaggaaaagcuugcaaauaauuaugucugguuaugcuuaauaaauaaagagaaugucgcuuuaguuuaguuuuguguuuuuggauguuuuaaaggccauugucuggauaucucuguaaauagguauccaaauuuuuuuugccucauacaagugagcuccacccacgauuugugauccauucaauugaauaaaggccaugguauagauugaaagagaaagaaaggaucagucaaguuacucaaggggagaaagagagacagagacagacagagagacagagagaaacugaggguggaagcgagaaagagagaaaauauaauucacucauuuuuuuaauugaaaauuaaaaucuuuauuguuauuuuugauuagaaaauuaauacuuaggugacucaaaauaucaaacauguauaagccaggaaauaaaguugccaucucucucugccuucuaugauaguauugcuguuauauuuuuccagaccaucuucaugugcaucaauauuaaaaaguauuuauugaaugaauucauuuuaaauauaucuguuuagagcaggggauauauugcucuaguagagugcuugccuagcacguugaaaggucugagauuaaucaccagcaaaguaaguaauaauaaaauaaaaccguccccuuuccuaugcuuacacugagacuuauuuaaguuguuaugaguucucgcccuauucaauagcaauguaacuuguuugaagcaugacuuguagacacauaguuuucccccucugucaaucauuuccauggugauaauccuacuacuuuagucucugcccaccuacaugagaaggagaguugacugauccaagaacauagcccuguggaauuuaguacagcacuaaucaacuagccuuagcacuucaucugcugggaauccacauacagauacaggcacaugaaguuguacugaaccuuaugucuauuccuacuuuucagaaguaccagcgaaggcggaaguauagccuguccgccguguuccauucagccaccauguugcaagauguuggugaggccauucaguuugaagucagcauugggaacuauggcaacaaguuugaugcaaccuguaaaccuuuggcaucaaccacucaauacagccgugcaguauuugacgguaagacuggugugaaguucucucuuauucaugcguacagagggcacaccccaggacaagaagcauauacuguauuuucgcuccgagggccauuauccucagcaucucauuagucaauuuaagaaagagcauuggauuuuagguacccauaauaguugcuaaaucuguggaacagugucccaggcuggacacaagagcucauaaaaucccaagaugaugaccccacuaaauaccacacucccuaaagcagcugcaccccaaccaacugcaaaucccccuuagauucggugguugacaaugguggcacucuggcucagacacuggaaaagccaggcugauucucaccagugcucacccaguccugucacccagcucucuuuuaaaagauuuuguuucucuuuuuaauuguauguuuguguauauggcccgguacacauaaacagcccaacaggacugcuauauuuuuaucuaaauuuuuuuguaugagcaaauuuaagacauaaaaugccccagaaaaugugaggcauuuagucuuaauuacagaaagccuccgagucaugccaaccccaugugggcagccgagguuugcgaagaacaggguguggggcgggacugcucuucuuucagcaaaagcaaucauuuaaaagcacaguuccacagagaaacagugagucuaaccuccagugcucugcauucuaccaugccauaugauguaaccaucaugggugcucagcugugugauccugaaccacaaauuguuccuaagaugguuguccucccugugcugguguuuuagaaagguucacaaaauaaaagaauaaagcaucuauucucuguugcuugccugauuaaaauugaugagucagaauagcgcccggguguggcucagcaguagagaacuguccuagcuuguaugaggcucuggguuuaaucuccagcuccccaaacagcaaacaaaccuuagccaagaccauuccccgggccuguggauuaauggguagcucuguucacacaucuauguaacaaauaugcuguccuuuucaagugucccuguucacugacuccugacacuccuuaccagggaacuacuauuacuacuuaccuugggcccacacgaagcccguggucacccugacuuccuacugggaggauauuagucaccgccuggaugcagugaacacucuccuagucauggcagaacggcuggugaguuaucuguccagcauuuccuuuucgcagacaguaagguaagcacgggguagguaauauacaagcuuggcaacuguagcacaagaucuuaaacacacaauggucaacaauagagcaauucaguaacaacugaggaaaugguccagaacuuguagaaguucaccgguacuggugcccacucuuuccccauggcuguccuaaccuuuacuaaggaacuaaggaguuaccucaguccaucccuuagagacaacucacuaggacauccacccuccagccuaaagggaggaaaacacaugagaaggugacaagagccccucauuagggaaaauuaggacgucauacccagauuucugcucacuuuccauucaccagaauuccaguccuacagccacacccaccacgaggaagucuagucuuacguuugugugagcacaugccaggagaaaggcuuucuuacugagaaagacgggaggauguagaaggcugggcagaggauuugcauauaaaggaugcuuuguuccaguagccgggugcaacuuguacaacuuugcucuuauuacagagauagucucugcuaugggaagaaccagggcugccagucucugcucuugcuucagacucggggaacuccucugaagccuggaggagguuggggugggggucccucugguuggggugggggucccuuugguagaccugcauaagagcaggcaugugauugaucgucuucuugacauugguaggcuacaacagugaggagaaaggugccacauuugggacauuucuacuuaauuuaagauacuaaguuacuucuauaaaaauccauucagcauuaauguuaauuuagagugugggggaaaaagguguuugaacauaaucaauccaucucauauguauggaaauaucacauuaaucucauuaauaugugauuaaaauacauuaauaaaauaauuucaguuuauauuaauaucauuuuuauaaaugauagaccaagauauauaagaaaauaucugaugaaaaacuccauaacaaaaaaauuauugcuuuuuuauauacaggcagcuuuauaucaaagauauauauauuucuaccacuuuucuuuuucaccaaaauggugcaugugaauguccuggcugaugcccucaagaauagcaacaaggcacgugccaggucuuuauuagguuccaaagucacagucuggcuucugucuguggugaggggcaugguugcauuggggaauuugaaaucauugaugacuacagaucugggcagaucguccugaaccucacaggcagcgagugaucaugaguguggggugaucagccccagauugaacaugcagcucaaacccaucacuugguuucaucgugcugacagccccagggagugccgcagaccaugacgaggcaaacauacuuacaaauaaaaggccuccaggugucgggggugggagcaccaauauagaaggauaauugaacuucaguguaauuucccauuucguaaaggugaaauggaggggaauagauagacaguucugugacuaagaacauuugcuucucuuccagaggaccuggguucucuuccuggaacucacauggcagcucaaaaucaccuauagcucccauuccaagggaucuguugcucuuuuuuuggcuuccaaaagcaccaggcauauguguggugcacagacauacauguuggcaaaacacucgugcauauagaauuaaaaaaugaaaaaaauuaaauuaaaauuuauagguuuuaauuuauaaaauuuaaaauuaauauuuguaaaaauaaaguugaaauugacaugaaauauuuuuuagauuuauuuauuuuauguuuaugaauacacugccacucucuucagacacaccagaagagggcauuggaucccauuacagacgguugugggccaccaugugguugcugggaauugauggacucaggaccucuggaagaguagucagugcucuuaacuaucgaggcaucucuccagcccaaaauacuauauuuuuuuuauuaguuuucauuuuccuuccucaagggaguugguggagaacuggccaaacuucuaauuauguuggggccauuccucggggggguuucuugcccugauucuccuuaucaucucccuccacugaccaaauugucugaguucaggccuagucgugacaaagagaguggcuuuccaugaccaggacuuuggcuaggccuagcgggcacucccuuccccucucuguuggcagaugcucaacucgagcacaucagcauguucugggcuuagcuuguacuuucucaacuccagcccugaaauaaccguuucucuaagaugcuguggucccuuuaauaggaagugacauuugaaaaacaagaucuagagugcucacgcugcugcuauauuguugcuuauaggccuugccaaccaagaaguucacggucacacucauuugcaugugcauauacauacauacauauaugcauauauuuauuucuauaucuguuaaaauguugaaggccagaacagugccuccaauuuuaaucuaccaccaaggacuuaccuugguaguaagauuaaaacucuugccuacagugagauuccagcuucugccauccuaacuguaaugguugauuuguucaaacuuaaacucccuacguccaccacugugaacaaguucacaaugauucauguuugaugcaguuggguugccuuugccuugaaacuaaggacagauaguuaaaaugcuguuuccaaagguuacguguggguuaguucaacuguccaucugaaauauaacugaguccauacuauuuacauauauauccuuuugaggguucccucaccuauuccugaugguuucuuccuguuuauuuuuggaguacauaaaauauuuacauaguuccaaaggucaaaauacaagacaaggcuuucucuauugcuuaaacuuaucaguguugauugcauuuugaauaaaaguaaauagcacgaggcuaugguaaguaucagugagugagaacaaagcccucuggcuuucuguaacgaaaucuuuuuaugucccuaccccucuacucacccucuacccugccuuggaaauaacacuuucuuggacauaauggcagaauuacacaauuaucucuccucuuucuugauucuucagcaaucaaacauagaggcuguaaaaucagggauccaggguaaaauuccugcaaaccaguuggcggagguguggcugaagcugauagaugaaguuauagaagacacgagguacaguaauccucuuccuaucugcacguccccagcaugcccugaauucuaagacuguaggugcuuuuccaaucuugucaaguauuucucuggaaaaaaaaaugcguuugagcauuguuuugggcuccuugaaagucccaccccagcccaggagaaguuucugaaucacccggaaaaccuccauucucugguuuggugccaagucuaaaguagcccaaguaggcccaggcuggacuaccggaagcuggcccagcagccugaggcaaagggugggaguggaagagagggaagagaaauagccugagcuaaccuuucugcagaaggacuccugacuuccacagggauauaggaacauggcuuccaccacucagaacaauguuccuaacucaugucuuuagaaauagcuugcugcugcugcuguuguuguuguuaaguguuucaagcacucugccauccuucagaaacaguuaacacuaaaaacaggaguaacagauaguuagaaugggcccuaagcaaggaugacgcgcaaauucauuauacacuaagaaauaaacaagaaacagcaacaauaacaacaacaacagcaacaacaacaacaacaacacacacacacacacacacacacacacacacaccacguuagacaaauccaggacacagacuuagccagaggacauuucauagcugugacuuaagaaguaacuuuuggcauuuagaaaucaaaagggaaagugacucauuccaaccucauuuuaaauguuggcuaauaaagccacgaacagggaaggucgaaaagaaaagagcauggacuacaccucucaagcucuggaagcagacauuuccccuucugggguaaggcccuuagucaucccguccucuugcgcccccuagugguuuauucaggucauugacaaacagcuaaaaucaagccccacuggcuuugugaccacucaaagcugagagacuuagggauucccuaaggagugaccucuaaauuacagauaagaaagaagggagaccgcagugacacugggaauuauuuacccacuuaauggccagcaucucacuuucaaagggcucaagugugacuucggagcucaacagcacucccgugaauuuuugccuuauguggccaccgcaggaucuuaaaccuuuauacacacggugccacagaaguuaaugaaaucaaacaaaaacauacagcgacagcuuucacauggaaaaugccugugauuugccaaagaaagcccaggcaugagaacacaugcuggcuucaaagaagcaagcuggcaucuuucuaaauguucugucgcaggaaauuccauguuugaggaaaaccaugcuaggauauccuucauauaaggagcuggguggcaugcaaauaauguaaauucuaaguggggacaaugagucgaauuuccugguacuggugacagucuugcccugugguuucaccuacuuccacagugagagagagagaggcacagcugacauguggcuaaucugagucacucacucagcugucccuguuuuucuuguggacucuuaacuuggcugaaaauuguccuauacaagugguccuucuuaucuucuggagcucucugagaaccgucugagaggaugacggugaugaagaugacgguacuggggauauuuaaacuuuggugcuuuaaaauuugugucuucuccgaugccaacagagacauccucaacuacaguuuaaagcaagcagccccuguagacucaggagauugcugucauuucaaucuacgugaaauggcgugcagacauacauuaaacaugugggcaaacacaaguggacuuaguuuugagaccuagaaugucauucuuagguuuguuucucuucucuccucuucuuauagauacaccuugccugucacagaaggaaaagccaacgucacgguucuggauacucagauccgaaaguugcgguccagguuucucucccagauacacgaggcagcucugaggaugagaucugaagccacggaugugaaauccaccuuguuggaaaucgaggaguggcuugauaaacugaugcagcuuacugaagagguagaccauuaaaauacacugucaucuguuuccagaaggauucugcagaugacaagaaggguggggcagguggugggugggucaucugguauaucugcgacugggauuggaucugaucaaugauaaaaaccaaggacuuacuaggaugaggaggcuacuggagagggugaaagucacccaaauuuugaguugcguuccugaggaaccugcaggaaaagcaucaugcucgcacugcgguuguagagcauuuuguaugauggaauaguagaacacaacacagagaauuaaaaugucacuguaguguggauugggaaaagccuggauuuaaauauuaaaccaugugugaccuugggcaagcucuucaacucacgucagcccauuuucccuaccaggaaaauggagaaaaacacaguacuuaggucauagaacuguugugggaauuuaaagaugaugucauaaggaaggacagaagagugugggguauacagucggugcuggauaaguguagaugggaugccccacaccuccauggcugaaagaacaagaguaaauggaugccuccuguccuugagugucuaggguagugucuuagcuccuucugugcugcuguaacagaauggcacaggcuggggaagcuauaaagaacagagguuucuuucuaaugguucuagaggcagggagagucgagauugagagaccuaaauuugacaaggacuugugugugugugugugugugugugugugugugugugugugugugugugugugugugugugugauaucacuggagaggaguagaggaugggggggccuauucucacacaauaugguaacuaacccacuccugcaauuauggggcacaaaucaagcuucagacaucuaaccuugaggagcacacuuaaauacacucaccguagcaguggauggcugcuuagagcuuucuggugaaagcuuucugaugaaagcuaccaauggcuuucuccaagugaugcuugagaggcagaggguauuuccuaaaauaccuuucagaucagcguggguuacaccucuucacuugcucccccgugccuucccuucugcucucccagccacccacagcccauuucuuagcuccauguaaucacaauauuacuguagacgagugucucccgacucugggacauggucuucaccacagccccuagugucuagccuagugcuauuucuccggucucuccacauguagacucauugaguuugcuuucuuucccaucugacccauugcccagccucagaacagcaugccugacaucaucaucuggaugauccguggagagaaaagacuggcuuaugcacgaaucccugcccaccaagucuuguacuccaccagcggugggaacgccucuggaaaauacugugggaaaacccaaaccauccuucugaagguaugccuucauucuguaaugggaaaggaggggguugcuuuguaacagucugccuguuguacagcuaagacguguaagaucaauaaccuguucucgucucuuccucuggggcuguaauuuuuauugugacaugagggugguuggccguucuauaucuagauaccguucuagaucucucugacaugaauaguagcaugacaccaucauuugcuuucugacgugaacuuucuacucuaaauguugcauauaagcaauacauuucuuccauugaugcuaguggguguuuagggaggaaggguggcauagccaguugugguuuaagguucucuagaaggaacagaucgacagaauaaauacacauuuaagaggguauuuauuaagguugguuuauaugauauggucuggguggcucaaccauggaugucucaaacagaaagggcaagaaguugggaauugauuagucugcgaggcuggauccugagaacucucaguuuggcacugauggcuugaaggauuccuacagagccacuggucuucaguuuccacuggaagcuggaagcugaguccuauuaguagggaaauaaugcagcagucgcagcaacaaaguugaugaacuugccagcaaaagugaaggcaagcaggcaaaaagagaagaccuuucuucugucuccuuuaucugggcugccaccagcagguacugcucacauuuaagacuucaaauaauacgaucaagaaaaugccucacgggaaugacuagcaucuugacuuuuuaguugguucagauccugucaaguugacagccauuaucagccaucacagagauucucuaauacaggcaaguuuugauaauugcuacuaggaccccauccuagaacagccccaccccccacccccaugaagaacuucccugggaaugucuugacaguggccuagggccacaucuaagaacucaacagcgcuccccuuagcaugcucuggcauccuauccugccuaccccaucaggagcuccuuggauuucacaaugaaaucauuuuuaaaaagggaaaaggcagagccaaggcaguguacucucuaaacagggagcugccugcugaccucuaauguguuaauguuguucauuaacaguguuaaauaguguaaauagaauggagugaccaucaucuuccaaauguucugcaggaugagucugacuuagcaccacaauucuaguugcuguuaauaguuuauuagcaaaggguccuuugucaguuuuagccaaagcaaauacaaacucagucugguggagggaaggguagagguucagcaugcuuugggcuuuagcguaugucacaguucguauggugucugucccaugucaccuaagauguuauuguucauccacaguauccacaagaaaaaaccaaugggcccaaagugccuguggagcugcgcgugaacaucuggcuggguuuaagugcuguggaaaagaaguucaauagcuucgcggaaggcaccuucaccgucuuugcugaaaugguaccuuuggugacagaccugucgucuucucuuuuauaccuaccuauagcuguuaacacuaccaccugaaaugcccucaaaagaaucuuggucuaacagauaggaaaaggaacaccuccccaccucccgcccccccaacuccccccacgccggccccccuucccgccugggguuaucaacagugggacacucuagagugucuauauuuaugugauaauucaaagagguggcuaaccaccagcuggugaccuugaaaauggaugauucuccagcuugugucacuagaaccaguaucagucauuuguauugguggcaacauaagacacacuaaacaagaugcacacacaugcaugugcacauauuucuuggugucuuuggggguacuucacaugugcacguccacgaauaccuucuuuuauccuguccuaguaugacuaucucaagauccuacccccaaagccacugaaggucaccaccuccacucuuagugaaacacuguugcccauguugaggccugugcuuggguuuuauuagugucaugcuggucuccgagcagaauggacaggaacaccuuguuccucucuccuguacccuugccgugcacauccuaguuucaugguuccuagugaugaccauuuaggaagagcucccuuccaggcucaagccagcacccgagacuguacugcugcgcucuugcuccaaugcaucaggcacauacucacauuccugccucccuuuguaggcaaaagcuuacuugugccuugggcaacucguuuucucaguagggucaacaucagauaaauaaauauacgaguuugagaccaaacagggacacccaccacucugggaagucucaccucuaucccaugguucagagcaugaagaucagacaaucguagguuuauaaauucuaaguuagaagggaguggccaggauggcuagacagcucaguggguacaggugcuuguagcugaggcuggucacccccuuaucaaucucccugggguccacauggucaaagaaaagaacccacuaccaaaaguugucagggcuugcacacacaaauaauuguaacaagcuuucuuaacuuagaaaugagcacucugcaaaccagaguuauccauugcuuuccagaaaguucuuguuccugccauaguccagaagagacucagagucugugaagccccguaaaagaaucaucuuucugauguauuccuuguauacugccuggggaguaacaccacuaauuaauuauuucaauggagaaaugugcccagaucuaagcaaugaacauacaagugcacacccaugaggacuguuguguaucauccgaugacauccuccuguugagugucauucaaaugauggaaacaacucacaagaugcaucacuguuugcacaacacacucacaaccaugugcacacaugaauucuagaauaaguguaagaaauguguugugcccaguuuacagaugagcacacagaaucuuaggaagaugggugacucaucugaaguugucuaaccacuggcaggccccaaauuaagguccauauuuuuagggucacauagguuugguuuuuguuuguuuguuugcuuguuuguuuguuuucugugaugaucugaccucaguccuagauagacuuggauuuuauggcuggcuuacuuucuagaucucugauagugauuccccaacugugucuguuuuuaacaguaugaaaaccaagcccuuguguuugggaaguggggcaccucuggacuggugggacgccauaaauucucugaugucacaggaaaaauaaaacucaagagagaauucuuuuuaccucccaaaggcugggagugggaaggagacugggugguugacccugaacgaaggugaguguuugaauuucugugucccuuguuuuguuuauguguguguguaugucuguacauauguauauguguacauguguguaugugugucuguacaugugugugucugugcuuguguguguauguuugugcagguucaugcaugcuauaacacacaugugugucuauacauauguguguaugucuguacaugaguguguguacagacacaugcuuaccauagcacacauguggacaucagaagacaucuuuuaagaguugguucucuccuuacaccuuguugagccaggguuuuuguuucugcuguuuuuguuccuauguccaggucagaugauacauggcuucugcgugauucuccugucucugccuuccagcucaccuuagggaugcugggauuacugcugugcaucaccacguccagcuuuuuaguggguucuugggcuccagcucagguuaucaggccugagugcuggcugaagguuucacccacugaacugcuuccccauccccuccgucagcauccuuaucaacaccauuuuacccacugaguaggacuaaguccagaaaaguuggaagauaucuucagucucaaaagacaagaauaagaggcaccucaggaacuguagggugccggucuguaaaccccagcugcccaagggcuaaaauaggaggaaugcucuuucaaagucugcccagagggcagacuaagccaagcucagccguuuagcaggaccuagucucaaaauacaaaguaaaaagcaguuggagagaugagugaguaccuaacgcagugguagacuacuugccucucaugaacaaggcuauggauucaguaccaguacaacucugucuacaccuacaucuagauauggcuauacagccauugcacaugugcucuguauuagaucuuaaaccccaaacaaauagcuaacuggggugccuauuuaacauaucaaaggggauucuggcugcuagguucucagcaucuaccuuuuacagagucauccuggcugccagagccuguucuuacccuaaacucuccagcccagggcugggcuucucuuucccccagguucucugguuccagccauuuuguccauguuggucuuuuuuuccccuugguugcuuggccacuugauccaaggcuucucccuuagcccucuccccuucucucucucuuccucuccucucucugcccucaacccucuccucucagagccugguucagucuggaucauucaggagccucuggcugugcccuuccccauaucuacaauaaaccuucuccucuaccauacuuagaagcaucauaucccgaucucauuuuuaaauuccucugcuacauauguuacuagaugagccauaggucccuucugccagagaaaaggacaaugacuccuuuuagcaaauagggacaacuuucccaagugccugaaggaauguuggcuuuugucuaaauugccagacuuuuaggaaaaggaaauuucuugggaccagacacgacuaggcagugugcugaauaguaucuaauucauccuuaacuacaguucucccagauaggcagcugggcagugguggcgcacgccuuuaauccaaguacuuggaggcagaggccagcagaucucugaguucaagaccagccuagucugcagaaugaguuccaggacagccaggacuauacagagaaacuaugacuugaaggaaaaaaauugauggauaucugcuuuggccacuauuuccuggaucauggcaagaagacacaggacuccugguucagaggcaaaggacuuuaacugcgcacaacuagaauaaauaacugaaugucagccuuuucucugguucacuaugcuccuccgucugagaggcaugaagcgggccagacgacauuugugccugcugugggcuuguguugaggagaggaagccuagauuucagaucccaguucuuuuauaaagggcauggcaccacacuggcccccuugcucuaggcaaagacacuaucucuauccuucaugaccauuccccagacagcauuguagagacacuagcucaccacaaaggccaucagugcucagugggcaagaugggcagagacacaauaaauucauggagaacuaccuccaaaccagauaauacggucuccacuuugcaaacaaggaaccugagaccuagagagacuaagcacuuguccaaaggcacagauuucugcacauaacagggcgugcaaaccaacgcucagccaugcuugcccagcuuaagaaacauuagggagugcauggcaaagacgugaauuaugugguguauggauuauaucucaaaaguugucauuaaaaagaaauguguacuggagauauuauaucucauugguuuacugccugccucacggguccgagguucuggguuucagucucagugcucuccaaaauagaacacagaguaauagaaagcuagacgcuucugcugaggucccagauuucuaaauauugccagcaggguuggggacaaagcucagcagguugacugcuugcugggaaugcauaaagccccacguuugagcucuagugcugaguaacccagcauccucugcuuauugagccuucauuaaccaucaguaagugaauaaaacuggugcuggcagcauuccucccagagcucccucuucuggcuaccuuguauggcacgcuuggggaccuguauugaugauagcuugguucuuagagucaccgcauggaccuuaaagugggaauaaaauaagcaagcuguucugccugacccagugccuacacguccuugcuucugguguaggacugcuugcuuuguuuggaguggugggaauugguaugugugugugugugguggggggaggggggguuggauuggacagaagaaaaagagcugagggcaggggaaagguagagagaauugugacuggaaaaacacaaggcugggaugccagagacagccgccaaagcguuuagucuccuuuggggugcaaaggagugauggaugauuucaauuuauacaaauggucggggccauuugcuuuuugauaccccuccaguguuugauuucagggagggaaggaaggaaaagaaaaagaacccucauuugagggucccuggcagaaaacuuaagacaagguugaagccucuacgcuccaacuguggguuuuugaagcaauucuaaauccaaguaaaagcuggcaaggcggaggagagucaguacagagggcuuaagggcccaggagggucuggagucugaaaugagccggcuuggcuguguacuuagaaaccaucaguuuaugucgugucgagcgaacaguccaugggcacacguuuccacacagccucaagccugccuccacuccauuuuuuuuuagaauagagaggccauaggaguauuuccuugcucuuugaacuaccagccaaggguuuuacugagaaaaugcugggaagucuguacggaaaggagaaguguggaagacacucucuaggucccuguaggaagcggcucacagcaugguuuuccuggcuccauccuaauuacgaggaaggagcaaccuugccaaugugcagaguccucuauaauuuaggucucacugccccaccccaccccccuuucuccaaaugaaugucaaaagcuuuuaguucaaagucgaauuuggaacgggaaaacuaaagggcucaaacaagaagggaacugguguccuuccaggcugcaggagucuccugacaguguaaaauagcuaggguugcugguccggguuccauuucgcuucgguaacaggagcccucucucgcccacagccuccugacugaggcugacgcaggucacaccgaguucacugaugaagucuaccagaaugagaaucgcuaccccggaggcgaguggaagcaggcagaggacaccuauacggaugcggugagccguuugcucucaacauagacccuccuguccagucgcugugcaucauggggcaugcuccaucugcucuuucgcuacagccccaguuccaaauaaccucccauuuacagcugaagcaacacaaaugcauggucacuacuuagguccaguaaaaacuaggucucugacuagacagugcuuugaguuguauaugauuuuuagguagaaauuuauuaucuaaguaguuuuaaaaaucaugacaaacgaaaugcucacuuuaaagaaaugcacaaacaaacauacacacacacacacacacacacacacacacacacacacuucuuaauggagcugaaggauggcucagcaauuaagaaugccugaugcucuuguuagggacuggaguucaguucccagcacccauacuggcucucacaacacccauaccacagcugcccgggauccaauauccuccugcagccuccgugagaaauucuuaugucuuaugcacaggcuuaccacgaauaaaaauuaaaauuuuaagcacauuuaaaaaaaaaacuuuaaaaauaaauccaaauagcuuuuaaggaagugagaaguaauuaucucuccccgcucacaguguacuccacaggauaaccgcgguugcuguucguguacauguguauugucuccgcuucuaagcagaagugugcugugcaaacaucuuacaagguguacuuucauacaauacuauauuugagcaccuguguguguacauguucaugugggugugcacagggccacacauacauguaugugcauguacauguagagacaaggucaaccuauagugucuuccuccaacacuccccacaucguuuuguuuguuuguuuguuuuuguuuuuguuuuugagauagcguuuucggugaggcugggccccauugacugagcugggcugucuggcuaacaggcucgugggaauccuuucaucuccuccuccucagugcuggguuacagauguguaauuucacuccuggcuuuuauacccaugcuggacuucugaaguaauuauuaacugagccaucuucccagcugcaggucauuuuuugauaacuguaaauacagagcuaugaacuugguuauaggccccgguuguuauuuauuuguuuaucucguagacauuuaggguuugguaguuuggggugaauuuuuguuuuguuuuguuuugauuuaucuuccguguuuauaaaagaugugacaguagugaauauccugaaacaaccauuuugacacaaucagugaaagcuuauauccagaaaaauauccuugcaacugugugucagcuucuaaaugcauaaagguguugugauaaucucgccagaucgcuuugcagguaaaugguacccucuugcagcagcagcacaaggggggcggggaacuuugcuuccagcccaucccacuacagcgacuuugcugauccauagacagugguaccugcuauuguuucccuucgcauucucuuaaucuaacaugacgcugggcaccucccauguguacagccaccuuuauguccuuuacagaugagcuuuguuaucauaacucuuuugaguuuuaauguaaacccaagucaacguuuaguagaaacuuugcucaaccucacaugaucagucucugguagcguuuucugaacuugaacacaugcauuuuaacacuugaucuggucucuuuugguuuguuuuguuuuuugguuaugcuuguuuguuuccugaauaagcucucauaaagaugaguggcaccauccaacaguauuaaaugaagccauaugaaauugcuaauauuugaucauuuuggcuuacaaaaccaagaauuucacaugguucaacuuaaaacuauucuuuaauaguaaaaaaaaaaaaaaaaagaagguacuggagacgugcuuuuaauguaggauuuguauguaaguaaaaaauagagguuuucuaaauaaaauugaucuccacgggguaucuauaaagauacacagauucuuuaguuaaguaucaggaaacuuuccucaccugugguucucauuccaucugucugugugucuguguaucugucugucucucagaauggagauaaggcggcaucacccagugagaugaccugcccuccagguugggagugggaggaugacgcauggauauaugacauaaaucgagcaguggaugagaaagguacguacaucugcuugccugagugugagucugcagaaaggccucgguuaaccagagcaaagguuccgugggaggaaggaccccggcuccaccuaggucaugugguguaauccgcaccuauucaaaugaguaucugacucaaacagauggacagaugcugggugaggagauguccggaguggaaaauggagguucuaggaccagccagcaggacuuuggggguacuuggaauuccugaauagaaauauaggagagaucuagagcuuggauuuucucuuuccuaacuacuccauaaucuacuugagaugaucaaccuuagaggucccagaacucagguaggagaauggcaaaaugucuugcaugucaucccaccggugaccaugugaucaacauugcuuuuagguacaguaaugcuuaccuuucucuauagacggucaggucaaaugaacuugccguuuggaacuaucaaaaggaaaaguaacauugauuuguuccucugagaugugauaauauguaagcagagugggguugauacauaacuguccaaauagauguugaauugcuugggaggcacauaccggauuaugcuauacauaacagcagucguugaguaauaacuacauaucagccacauagcugugugucuuuugccuuuaaaagguugucauguuggaacacaaguuuccaacuugagggaaacacuacugaagggcuaggguuguagcucgauggcagagugcauaccugguauccacagagcccuggguuugaauccuaaggagcagaaaaguugaguaccucuuagccaaauugcugggggcccagaaguuguuuuugguuugagaaauugagaaauuugauucagauuuuggaauauuuguggcauuauggcuccccaaaaauuucaguauggcauacuuuguauuuucagauuaggcaugcucaaccccgugacagucacuguggcagagaauauuugugagcagagagaggagcuauguucuuuccuagcaaguuauauuuugcugaucacacacgauguaucucuuuugggucacuauucucaaacucuguugcaggcugggaguaugggauuaccauuccuccugauaauaagcccaaauccuggguugcagcagaaaagauguaucacacucacaggcggcggagacugguccggaaacgcaagaaagaucugacacagacggcuucuaguaccgcaaggguaagaggggcgguaggagagagcuggaccgagugcucugccugccacacugugcagaguuccagcaacagggccguuucugcagagccguuuacaagucaaggaucugacccuggguucuggaaacguaccugcgaaugcuaggcaucccucacuuaggccuaugcugagcaacucuggggaugagagcaguaaccugugucccucaagcccucaaggagauguugaggcagccuagaggaugagacaucuaagggauaggaaaagacucggagauugugcuagcagaauaggacagagaugcuguuaccucagaaccuggaacaagaugcagaauucaaacucugggagggagacuuuaacuaaccaggaccaaaaagagccuggggaggaaggguuaauauuccagcuuacauguccugaucacagucuaccgugaaguaagucagggcaggaacucaaggcaggaaccuggaggcaggagcugguguggaggccauggaggagugcugcuugcuaacuugcucuuuguggcuugcucagccugcuuuccuauagcccggaacuaccugcccagaaucggcaccauccacagucagcugggcccucccacaucaaucauuaauuaagaaaacacccucgaggcuugcucauauaggccaacuggguaaagacauuauuuccuuugagguuccuuuccccccgaaugacucuagcuuauauguaguugacauaaaacuauccauauccuaauuuaauuagggcauuacaaggcuuuaaacugcguaguagauuaaguggacuaauaauaugaaaucgauaauaaacaauauguuuuauacaucauguagaacauggcacacagaugcaucaugcauaagcuguaaggucugagcguugcucauuccacagguggaguucauaggcaugaaguagacuugccuuaggucauaucuccaggaaguaacagguuagacugauucuaaacaggaacuuuuccuauugcucuaaaggcucaacucucauaggagcuaugaaauuacauuuuacacaguaaugagcuuccagagaacaaaaauagagcuacauauuuugguguccccccuaccauguuaccaggacaggguguggaagaaucaaugaaucuugaacauugcauuacuucauccugauugggugagacauuucuagacuugcuuuccuuucucuuuccacaugaguaccuacauggcucuggaagaacauggggccaccagguggaaaccccaguuccacccaugagccccgcagaggcuugaaucauauucucuaaccugcuuuauucucagucacacaaaauaugucaucgucacuauccagacuaucacaaaggaagauacaagaucaugugaaauguguacuuuauguuuauuugaaguggaaaaaaauuaaagagcauacacaaauagcaacccuacaugaagcucuuauuucuagauuaaucaauaguagucaguauuguuuuccauuuauuccaucuggucagcuuguaagacacuuacaaguugcaaugugagaaaauuuuggccacucaaaugucaaacacauggaggcaaaagccacaacuaucuuuuuguuaaguguuaccucaucuuugaggacaugaucucugucaugauacaggagcauagguguguuagaggaauagaauaaaacauugaaaacagagcaugugcauagaaaucauguuuaacuuacaaggacuguacucggugauucgcuaucacagaaacaauauacucugauuuagcacgucacugcuaaucacagcagguauuagcauuaacaggacauuuaaaucuuaagggguguuaccguuuuacccauauguaaaaugcagaugauaauucuuucaaaaaaacagugucacacucauguguucucacgaacaauccgagaaaaacccacccauucucacucaaaccugugucuggaugguugcuucagucgccuggugccucucuguauuccuacagucccucagcucugccaagucagagagccccucuugucugucuuugcuguaucccuggccucucauccaguacuugacagagaguggauuuuugugacuacguauuuguccauuggccaacuggucuacuuuaucaauaggagggagauuauuauucaucaucaaaugcuguacuucuauuguaggccauggaagaacuugaagaccgggagggcugggaauaugcuucguuaaucggcuggaaauuccacuggaaacagcgcaguucagacaccuuucgccgcaggcgcuggaggaggaaaauggccccuucugagacacacggugccgcugccaucuuuaaacucgaaggugcccuuguaaguaaccagaagcgaaagugugacuggugaugguguaaaggaagugugugacuuagguagaaagcacagccaagcccagagaggcuccuauaaccccagugccucacagcugcaaagauguugggggaaagauguacggccugaguggccagugacucccaucuuaggaagaaaccacuaccacaugagagguccucagaacaacagugaagacaccucucucucucucucucucucucucucucucucuuucucucaguauuuuucuaguaugucugccaggacccugguuucaggaagcaucuaguaguuuuguagacacagauggcuugguugauuacgaugaugauaugaugguggugguggugguggcgguggugguaauggugauggugaugaugacgccgacaaugacaacuuccuccuacuuuagggggcagacaccacagaggauggagaagagaagggcccggagaagcagaagcacagcgccaccacuguguuuggagcaaacacgcccauuguuuccuguaauuucgacaguaaguuuuaaguauggcugugaucucugcgucugccacuuuuaucucuagaaaaacucuucaaaucuucgaauguuauaauauaucuacacaggugaaggugacuuucuauuucuucacuucaugcagaggauucauaaaaugcauuuuaaaaaacuaccagauauuuaagcauucacaguucuuacauuaugcagucagucauaauacucuacuaucccucaaacuguguauauguauguguaucuguguaugcaugaauguauguucuguguacauacaugugauauugugugugucaguaugugcauuagcaagaagaguuugaacauuuuuaaaagucaaagaaagucuuagcagauaacugucccagacauaaaucucacauagcacugagaccuugcucagugacugcuugagauccaggcucauccgaaagucugugaugagcagcugugcacuaaacccaggaaggucacaaugggacuaauguuccucugaugcugguguugggauuauucuagcaguuauuuauuugguuucauuuucucuuuggaggcagaguuucuauguguaauccagacugccuugacuucuugccugcugggauuauaggugugcagcgccacacuuggaauauaguagguuagagcacacccccauuauacacacucgccugacucuuaccuguuuaaaauccauuuuaagaccccccccucgccaaucguacuuuuaaauugucaaacgugugugugugugagaugaaguuuaauuuauaaauuaggcacaauaacagauaaagcacaguaacuaaguauaaauauggaagguauuaaaaugcacugcaguaaaccagccagaaccacugcucuuauguuuugggucuuuauuaaauaaauaagaguuacuuaacacaagcacugcaauguuacuuacaucagucaguuggcuaacugagauaagaaacuacagagugacuaccaggcaggcagcuuauacagcacggauacacuggacaaaggcacaaucaacaucccaagcgaggcagcugggugcuuugagacgucacgcugcagggcuugcaauaugaaacuugugcaugauauaguuuuggacuauuucacuuaauguuugugaccugagauugauuaugggcaaaugaaauaggagaacaaagccauggauguaaggacuacugugaauguccuuuuauaagaaaccacuguguugggaacaugugugcuuucugcugcggggaaauggguugauugacccauguaucugcaacacgagucaccucuaaagagcugagaaaaauccuauuaacaguauccuguuucucaucaccuucccuucaggagucuacaucuaccaccugcgcugcuacauuuaucaagccaggaaccucauggcuuuggacaaagacagcuuuucaggugaagggaaaaucccuacuacccucuuacauggcaggcuagcuugggucgaucgagcaucaaguggguuuuguaucuuguuuuguuuucaauucuuacaauaaaacccuuuccauguagagacucuacugguaugcuugaagagaaccacacagucauuacuugaugaauucccaacugcuuuaagaacuguugcugggugcuagaggugcccagaauacacgaggcccuuaaacacuaaucaucacagguugagcaauaaagugcccugaagaacaacuucugaccucucuuugugugugcauggcuuccaagcuucccugguucuucuauggaaacagcucuuaaaacacuugucugauaauaucaugcacugugucaauucuuauucauaucccaagcacuccuuuuacacaguauuagugaauuauuuccuuuccuaauaauauuagaccagauuaucuagaucuggucuaaaaguuugaucaagauuauccuacucuguagaacaaaacuucaaaauguuuuuuuuuuaggacauuuucaaauaguauccaccaggggacacugucucacuauagauccaaucagaauucuuagaaaaaucuucacugauguuuguaucccaguuggauacaagauuuaucaguggggcaaaagaaaacuuuuaguccuguugcaagcuguaaauucugagaacaacuaaaccuuuccuaguuacugcuauauucuugaaacccagcaaauacaacaaauacaaauacaaauacaaauacaaauacaaauacaaaacuuucuguauagauaacaguagaaacaaaagcauaaaauaaacuuauauuugucaguuuaucaaaaacauagaaacaaaaauauaaaaauaaccgguauuuaccaaugaaauggauaauaggcucuguucuaggcaguucacauguucaugucaucccauuuucuacucaauaggaaaacagaaauuacuuuuguggcaaagagggaggaacggaggcuuagaaagguuaaaccuuuuucuuucaaggucacgggggcacagcaggccagaugugucugguugcgaagcuuguauucuagaugauguaugugaaagacugugugcccaaugaaccuugcugaggauaagugcacuccagagaagcaauccuuugcacaugucagggccuucgguuaggcacuucucaccaugauacuguccucuguggugccccgcuuucagaacuccuugucuucaaagggguggugaaaacauaugaccacuauguccagaugaaaagucuuugguugaaacgcacugucauaggagcucgacuucuccgagacucuacuguuaauaucuuuuucugugcauagauccauacgcccaugucuccuuccuccaucgaagcaaaaccacugagaucauccacuccacccugaaucccaccugggaccaaaccauuauauucgaugagguugaaaucuuuggggaaccccaaacaguucuacagaacccacccaacguuaccauagaacuuuuugacaaugaccaagugguagguaacaggacaguuuaugaugacuugggggcaugacagucgucugcagggcuauuugaccaggaguuucaguguggguuuccuucucuagggcaaagaugaauuuuuaggucgaagcauuugcucucccuuggugaaacugaacucagaaacggacaucacaccuaagcuucucuggcauccuguuaugaauggagacaaggccuguggggauguccucguaacagcagaguugauucugaggaacaagguaucgcuuuguucuugcucauggauuccacgagcugcuuagagcaccucagucauuccagguacucucugcuuuaaugaaagggaaguguugacagccugcguuuguuccacaggauggcuccaaccuucccauccuccccucucaaagagcaccaaacuuauacauggucccucaggggaucaggccugugguucagcucacugccauugagguauguauucucucugaguuuuacuugaccaagccaaagggugugucaaggaccauuaguguagggcaugcauugugcugcaugcuuucuugcugucucuaacuuccuauaaaaucggcucacacccucccccaauggaaauaaauagucauagaaaguagacaucuuaacaaagcaauaagaagcagaucucagggauuucuuucuuuuggggggaauucaccagagaaagagaagauaacccaagagaaagugccaugugaacaaggagaaggucugcaaaggaggcaggaggucgggggugggggugggggugggggaagcagcccacaguggcgaccagggagauaauuagggcagacccaggcugguggagauaaccucuuagcuagauagacgggguccugauaagggaagcauuguuagcgccucuguuuugcugugcguucgaaaacagacacagggagcuucaaacagcugcuaccaguuuggaaugcuugcaggucauuuaccaugcaagagguuuagacuugaucuuccagauugcccccacuccccacccccaguggaucacaugaguccuguuugcaggugagaucuagagaugcugacugacucggcagcacuuacagcaguucugacaaaagggaagggccaaaaccacuuucucugcauuuccacaggcaccugaagagaauaugcacugguauuuuagacgaaugugcaucgcuccaucuuaaagacuguacuguguucugugauugagauuggauuuuuccauauaugugugugcacguguguaugugugugugugcgugcaugugacucucuguguguaugugugugcucacauaugugugugagugcaucuguguguguguaauaugucagguuuacuucccuucucuuuaacuuguuuccccagauccuagcuuggggcuuaagaaauaugaaaaacuaccagauggcuucugucacaucacccagccuggugguggaaugcggaggagagagaguagaaucgguggugaucaaaagccuuaagaagacacccaacuucccaaguucuguucucuucaugaaagugguacaguaucuagacucugcacgagcccacgcaagugggaaaacccagccuuauaguaaaugugccggagacuucucccuccuuaggucaucuguaguuaguuacugaaagcuccaaauggccccucuaugagcagagcuuguuucuccagaaaguguuuggucucuguuauaggcucuuagugaaccccucaaggccagauuguuaacuagugcgaaugcacguggaccagaacuuuccacuaggaucuggaugucuaggaaggaacagcuguggaggacuuccgugugggugauguggcauggcccuaauagucugugucugaguccauacuauggaaccuucuuugauccuuugaaguuuauugucagaauugugaggugucagaugggacucacacaccuccaccuguuauaacuagagcuugugaaaaccacccaacuuguccauuuugaaagaaauucaauucuuaacuuucuugcuuaucccugguuguccuggaacucauucuguagaccaggcuggccuuaaauucagagaucugcuugccucugccuagugagugcuaggauuaacggcauguacccccaccacccagcaaaccuuaauucuuauaaauaaaaaaauucaucuuugcauugauauguaaaagauuacaauaaggacauauaaagauggaagacuagaauuuuccauuuccuuuccacagcucauuuuccuucauauccccaacacacuacucuugaacaucggggccacaugguuuaaccucucauuuugcaucugaggcaguugaggccuagagaggagaaauggcuucccuggccucagagcaaguguguacccuucugugcuugggaccauggucuaguuucaucugcaacuccagcccagugcuacaacuccuuccuucauguuugaggcaaugaagagguuaaguaauuuguacaggaggacccagcaagcgaguagccagagcuuggacuggggaccuuccacuccaugauucugcagauggacagucucauggacauguagaagcagaaucccuaguuagucaccacuaagaaacucugccaauccucacccacuccuucccccccacccccacccccauccuucccuucccacuucuaguuuagaaccuagguuuggccaacagacaugggagaaggcacugagggagcaccccacccucuauucuagugcaaggccagcaacagacauuaacccaaaccacagucaagcuuccaggccagcccauguucuccagucagugcagugucuucaaggcccccacauaccaggggcacugaaggcaaaaugagcaucccauuuuggcuguggacuucuagcaucaaaggaaucccaauuccacuuaagccauggcuaguagaggaccaaaguucugccugcuacaugaacuuucuuauugucuuugaagaaggaugcuuuucccacaucagcaacagggauggaggcacucagccuccagcaagugauuauugagcgcucauagaaugucaucaauuggucuaaauguuggggaggucaagggaccaaaacgaucuuguuccuugauauucccccucaggaagaagguugugggagggagaugggcucagugacaagaucucauuccacauuaugcuugccaagugcagccuaagcacuucaccuauggauuccacaacucugcuaugaaugauaaauugacccagcaaacaggguuagaaaaguucccuaaggccaugcucucugugacagcagagguaggauuugaucuuccagagccaggcugaaagaguacgcuauaagcucugagcugguuaccaagcaccucaguaccugaaauacccaaggaaggucccucuggguuagauuuaaugagcaaaaagaaucugggcuggucuccuggggggaacugacuggcaaagcuguuccuguuagaucuggaaacgaaaaaggacaucuguuuuucugaucccuaguucuugcccaaggaagaauuguacaugccuccgcuggugaucaaggucauugaucacaggcaguuugggcggaagccugugguuggccaaugcaccauugaccaccuggaccgcuuucggugugauccauaugcaggaaaggaggauauuguaccacaacuaaaagguacgucuauaggcacgucuauauguuacacuauuuagcuuuuuuuuuuaaaugccugaucugucugaaucuucacaagccauauucuagaugccacagaaaaaaauaaggucuuauuuacagaguacuagguaauuccuccaaggaacagcuaauagccaguggugcagccagccuggacucuugagguacuuugaggggcagaguccagugcugaagaguccacccucuggcaugccuuacuccugcauaaacaugggauaaccuuugaggcauugaugccuguuacaugaccuuuccuauuugccuuugaagaaggauccucaaaauucaggggaugcuguucccacaucagccacagggauggaggcacucagccuccagcaagugguuauugagcgcucauagaaugucauucacugaucuacauguuggggaggucaagggaccagaacagucuuguccucuaagaacaagagcccaacaagaaaaugaguguguguaggucauugcucuaaauacuuuggugugaagauucugucuggguucugaccuaggaccucuuggggucuucaauguaaaaaaaaaaugccccugugaccccaccccugccugcaucaggcuggaccuuggcacccgccuuuaacugagauaaaccaugugacuccagagccuguucccaagcaauugcuguuacuccaaaauccagaguuacauccaucugggaaaaugcauauaagaucagggcacaggccuccuaccuccgcaugccaugggagagcaagggcuggacacacaacagcuacuucagacugcugaagagagucaucccugcuuucuccuccccucucuccuucccucccuuccccuuccucucucuaaucaccuucucuaucuauccugucuuccuccacuccucuucuguguuucucuaucucauuucccaagaaaaugaggcucuuuuagacacagauucgcccaucuccaugcccauuccuacaugaucaacacgaucuuuuuaaugguguaagaguacauguguguauguguguguguguguauguguguguguguguguguguguguguguguguguguauguguguguguguugcucuguggcagauagagggccacuuacaggaaucaagguucuccuccuuccaccguguagguucauaggaucaaacucagaccauuaggcuuggcauccagcaccuuuaccuuaauugccaucucucuggucuucaacacaauucucuuccaagcacucguuaugcauaagaacugauuuaacuaccccaagccaagacacaugggccacauaauccccuauaaaaugucuagaaccauauccuacucugagaauguggcacgucguugguucauuuuccacauucaggugcggucccucauugaaaaguuucacccagguuaacgcuaucauccaucccguggcugcucgacuugaccaugggauagaacguucuccaguaugcuguuccaaguguccuagauuauaaagcucuuugucuugcagccucucugaugucugcaccuccaugccgggaagucguuauugaaauagaagacaccaaaccauuacuggcuucuaagguagguuguauuccagauguccaagcaauugguaaacuccagcagccauucaagaccauuaaaauauugcucaucaaaccaaugugcaaggacugaauagacacaagaucugaaucuuguauucauccacaguuaacagugaaauuguaucaaccagggcuucuaaaaagcuuuccacuuauaaccccguucaccugagaaauuuuuauacaaccucuggaguguaagguguacaaaucaaacaucacucauaauuaauuauaaagcauugcuagacauaauuuuaccauuugucuaaaacaaaaucaagauugcauucuaaugagauggacgagcuuguucauuuuuacauaaagauuuaaaucucagcuagauauguaauacugcaggacacagcaucauuaacauuuuucaggguuaauuaauaauuugauuuuacagccauugaugaugauuuggauaaauguguaauauuaauacaaaauggcagaaguauguuucaggcuacugcagagacugcuggaaacucuccuaaucccaagccaaaauucauuuaacauuuuuuuuuucuaaugaaacucaaaugagcaacucaaagagaaaucaaacauucuaacauaaugugacucaaauauauacuaacuugauacaugguaaggaauguugguggaaacuuucacaucuugauuuuuccauaguuaaaccauuguguuucuacaagagcagaaaacuugguaugugaaugcagucuguagcauacacuaggcccagaucugagcugagguguuucaggugguguucucugguguuguauggugugacuacaugcauaguucagagacacauggguuaugggcucaaaaccaaggccacaauggaguuguauggugcaguaugaguaaguauugccaagaacaccuuucuaggaguccuagcaaaucauuaauugcacuuuaaugaugcacuuggacucauuacacacuuuauuuuuaguuaauuuucacuuguugcacauuaagaaacauuucuguuugccauacguucuguaaccacacacacacacacacacacacacacacacacacacugugcuacacauucagguacccagcaccaaaugaggucauaaccuacaauuuuaaaagcuacugagaaccaaccaggggggagguccaaaugcuaucguguuagaaguuucuagagaaaaucgaaacauugcaucaaucagaacacgcaugucagaauuuugccuauacgaggcaggauugucaugauuugaaaugacccuauuugccaguauaaggaacauccuggguuuuauauucacuguggaagaaguucgugggaauccuaacucaggacccagucugaaaaccauccagccacuuccuuagaaaggaacaagaaaguuugaacccagaaaaaagaaaacaccaaauagcucacuguuucucuuggcauuuacaguaaacguucacagcauguuuuaauaugcaaacuggcuggaacacgcccaugauugcacuuuaauguguuauguccauaaaugguaccucuuuuuuuaaaacccacuucuuucccacugcauuaaacucacuaacaaucggaccauauuaaaugugggcuccacagccagcucccaauugcuguguguuugagucuacuguguggcaauucuacacggucacagaugacaauaucaaauuccccagcccauagugcaacacgacuauguucacuuauugaaaauaacuccaauuagucucaauaagacaguaguugccuaaggagaaguuauguauaauagacuuaaggguuuauuauuuuuuuucauggugauuuucacaacuacucugggaaaaggcaguguaagauccuacucgauaacaugccaaucaguccuuccugaaugucuucuguguacuccguacuacuggggaacaaggaaaauaaugucagugcuacucccuucucgacagugcuggagcuaggcuacucuagcaacacacgaugaaagguccguguguaucaacugugaaccgggaagagcagcaggucuagagaugauagugucaagucauucccacuacacuauaaaugaccauaaucagccugcucccaucauaccuuaguugagggacacugugucaacacgaaaaggugggaucuccucuaagcucucaagucccuuugucaagguagacauugcauauuucuauaaaguccagugagcaacguggaacuucgggagagccaaugacaagcuuacuaacguccuuuauuacauguagcaugcguacauguaauggacacauaugaccgcuaacuugauuuuagacuuuuuaccuggauaaaccgaaugggcccacacuaacugcuguugcugagggcuggaggccgagucuuuccacgagggcaucacgcucugugaugucugugggaacucgugacggaugagcuuagcacucuccgaagaagagcaggagaugagggcguggggcagauuggucaagugccaggcagacagcgcagaccuucuuucauggccgacucaacaguugccuuccaauuccagugcuuaagcagcaugucaacagcacucagcaaaauggcuucuccaaggacagugcauguauguauaugauacgaugcaugaggccgcaugggacuggggcagcuuggucuaagcacuugaauuccuccggguucuacuaguagauuuuggagugaaaggugauauuuagaugaauaaugucauuuuaagccaaagggaagacuggcccggggccauguagugcuuugaguugaauuuucaaguucauuuauuagauuggagaaaaaaagaaagucaacgaguugcuguccuuccuuuuccacagaggacgaugagcgaucaggcaugaaggaauccuucugggcuaacccugaaauuuaaagucagcaauuugucuuggauacucuuuaaacauggccuguucuugucccuaaaucaguucguuauaacugaaaguaagcgugaagaagcagacuaaauaucugaauucaaaacuauugagacugucaaaagauguuuuuuuuuuuuuaauuccucucuccaaaaucgcacuuaaacuaugaucgcuuaacccuaaucuugcuugggaauggagcuaacaaaacaaauugauacgucucuuuuucucucugccuccguuggcacuucugcugcaacaagggucagucuagauagaaauacugaggaccuuaagaagccggguggcacacaacacaggaggcacaaacgugcuguagggagagaucaggauuucagaaaggggaacuguguucucuaauuagcccagggggcuagcuuaucagugucccaagagaaaacucaagcuccugcaaacuccuggacagucccugguaccuggaggggcaaauccuccaugcaaacauucaaguggaaggauuuggccaacgagaaaccugacauccuuuuauuagaagagucauuuccuaccaguauuuaaguggcauucuuacauaggcaugggggaacacagaaaaggcacuaacaugauggccugcagcugugcacaccuugugacaagagaguucuugaaggggugcgaaggaggucauauuggggauaugauuuuggagcuaaauggaaugagagguuggggguaggaagaugaguagcuuucacucaccccuccugagcacccacugcguuagcugaucacaggcuagucuaaccccacuaaaagcacaagccauucaaguacuguuucgugaguuuucagagaagaaaucuaagauaugcucaaugauaagaugcuuucaacuagaauaauuaggcaaucuguuaaauguugauaguaaguaugcagaaaaauaauguuucuuacucucuuucucucuaaaccuaauguucaugggaucuuaaaccaaacauccacgugacuccuauauaugaugucuucugcuacugaccucauuugcccagcugucggaaaagguaacaauugcauauguguuuacaccucuaagauucauggggugaaggaugcuacucaggaguagagagcuugucucagcaugugcaagguucuugguucaauuuccaauacauguauuuucugcccauaauuggaauguaaccuuuuuucuaacuccaggaacauauugaugaucugcagaggacauuuaauucauuauaacuaugugugcaaugcacacacuuguaugcaugaauauaaauuuaaagacauauacaaagaugcacauguauaugagcauuuaguuauacgcguaaaucuacaaauauuuguccccauguacaaaugagaaacaaccuguuuuuguuuuuuuuuaaugauuucauuuguauggauguguauaugugagggugugcacacauaugugcggguacuugugguggccagaagagggcaucagauucccuggaguuggaguucaagugguugugugggugcugggaguugaccucugauggucugggagagcagccauugcucucaaugucugagccgucucuccagccugaaacagccuuucuuacuccuugcugcucuccguccugcagaacaugagggggguuacaagaggugaugcuuauuuuuaagagcaucacuaucuaaggcagauuagaaaaaccaagccaggcagugguggcgcaugccuuuaaucccagcacuugggaggcagaggcagggggauuucugaauucgaggccagccuggucuacagagugaguuccaggauaaccaggguuacacagagaaacccugucaugaaaaacaaaacaaaacaaaaacaaaaacaaaaaaacaaaaaaaaaaagagcaguaagugagucucauccagauauguccuuguuauaaaucaagguggagguugggugcagaaccucacaccuguaaucauagcccuuuggagacugaggcaggaggacaaucaguuugaggccagcuugaauuauauaucaagauccugugcagagagggagaaaagaaggaaggaaagagggaaggaagcaagcaaaaaaaggaggaaaggaaaggagagaaauagaaaaggagaaaaugugaggagcuacgcaggcacuggccuaugagugcuucauuuauuaucucuucugccaaaccaagaaccacucaucaaaaugaaguucauggcucuggcuauaacugaagcaauccgggggaguuaugugaacauaaugaauacacauuucagcccacauugacuggaucagaaucuaaggggugggugagagcagcuagcauacaugaaccacaagcucaucauaccuuuguuuccuacuuucaagguucccagaguucuuucucuuagugauccuaucugauuuccaaaucaacucuaugaggcagacggaggcaguugccacuagaugaagaaacugagggucagaguugcagaacaacuugcccaagacaguguggcuuauaacauaagggcuagaacuagaaccaguuuaccuaacucuuagagagaguuguaauguugcuaagagcuaaggaaaugagaucaaagaaagcauauguuagaaaugccauucuaauugauuuauggaugcaagcauuaaaaguaaagaaacgaaaagagacuaauagaucguauguaucaggucuaaggaaaacaucuaauauagaugugggcauugaagcaaacacauuucaucaagagcuggaaagauaguucagugggcgaagugcuugcucacaaucucagggacuugaguucuuucuccagaauucaugugaaaaugcugaguguuguggcacaugcuuguauucaggcacuggggaaguggagacagaaggaugacugcauuugugggccaacaagucuagcccaaauagugagcccugggagauaagagacccuguuucacagaggugaacagaauucauggggugucaccugagguugcucucuggucuccacauguacgccuacauacguguacuccucuacacacaggcaucuacauacacgcacacacacacacacacacacacacacacacacacccaugucacugguugacaucuccugcuucuaugcagaauuguggcugugcugcccaccgugcauguaaacagaggcagauaaucucagagcugucgguagccuucucucucugucucugucucucucucuuaucuguuccauagugacuuuucuguuaaaaaaaaaaucagaaauccacacugucaauaucauuuuuuuucauuugcauguggcuuuaggaggaagaaaucguugacugguggaguaaauuuuaugcuuccucuggagagcaugaaaaauguggacaguauauucagaaaggcuauuccaaacucaagguacuuggacuuauguucuuauggguggggaaaagccaguuucagcaugccuuaggcccuaggcuuacaaggccucguggugggugcugauggacaggggccaagcuugccucugcucuccuggagagcccucuugcaacaggcuuggcucugccaaguaucagggacugaggaaaguugcugaguuaugguugcgugacugccacuuuggggcuugggggcaucuggcagaaggcuaggaguggguuaauaccauacuaauuaggccaacaauuauccagauuggcucggggagacucagaagucacugugcccuuugcagaacaacaacaaaaagaugucaacacgcuucguuuugucuuccaaacagugaucaguuuugccaaauuaaaaguugauucuguuacauguaugccuagucacaucacaaccguggggcacacgagcgcaggaggaagcggcggaggcggccagggcuagcuaucuguauuauuuauucucuucauguucugaguuuuccaguucuucauuguucaguugcuaacucugucagcugcaaaccuacaggagucagagcgagguagaggagaaagaugaaguuaaaugagaaacaucuaguuauuaaaauuauuccucuaucaaagaaagaccuauacccuugcuuguugguggcguaauguauucguguagugugaggaaagcuagcauguuagaaaucacauggaaaaauaaugagacggggggugaagggacagguuuccauuacuucuuccucuucucccuuccaucuuucucucuuguccaacuuuucuuuuaaaaccaaggucuaauuuauaugccacaagcuggcccucccacaaggcuuugguguuguguacaucuguguaaagcugcccccacagcaaggggcagaccauuuucacacacaggaagcuccucugcgcuccugucaagccaacucuccacgagcugcaccccucuggugcacagcuggucugauaguuaccaugauaggcuggcuucgcuugcuccuguguuccagauaacuggacucagacaauauucauucuguauuuggcuccuuuggucccaaaggagucugcuuuugagacucgucauguuguuguggguaucacaaguuuguuuacucuugcugaaucauauuggaucagacuggguuggaguugggucaugccguguucauaccccaucucaccuccccuugccccuucuuuucucucuccucuccaugguuuguugacucauccucccaacacuggaccuucuugaaccacauggacaugcucauguuucuuuuugguaaauuccuagaaacaccacuucuggauccuaagauauguaacccccuaaaagaaguguggcauuuucccaaguggcaguucuaugcugcacccgugagggccccaggaguucuguccaauccuuuugguacucagcccuguuggcuggagacaccaccucuguuuuaaugagaaacugagaguccgcugaugguuuucagaucuaugacugugaacuggaggauguagccgacuuugaaggccugacagauuucucagauaccuucaagcuguacagaggcaaguccgaugagaaugaagauccaucugugguaggagaguuuaaagugaguaaagugugcguguguguccuuugaaaaaucuaucuucuuuuuuuuauuauugauuucggaugaaagacagcugaugucugcagcuggacauguccucugcccucugcaggaaggaaaaugcccccaggggagucaggauauugcuugggcuggccagacucaaauccuccugggucaaaucuucccaagaccucauuucuccuaccuucugcccuccugggguauuagcaagaucacuguggcagauucccagauggagaucuuagccaccuuucugcuccucccaagcagucucuccucaccguaaccaaauuugagccuccaucugaauggcuuaaacacaccucuuguauuucacagcucaggccucaacuccuuccaaagcugagcuggccuuucccaagcucugggucccuccugcauacagaagaaccacucccaagucccaaacacaccuuacaaguucucucuauggauguacggagccuugggcuaggcagcucuuccuuuccugggugcccuuccuuuccucucuguaguuugacaaagcccugcucaggcccuaagacagcucagaugucaucaggguuugucaagaguucccuggcugcuuugggcagcaugacucacccaugcucugggcucccacaggucuggguucaccuccugucagguuugauuguugcuucuccucccaagcacacuuggcaaggccagggcaucugacacuaccucuuccuaauccuuugccaauagcagacauggcuaauggaucaggggauuacacccaacacagggucucaaauccuccccaccccagccuccuacuaagaccacaauaggguacacagccaagcuaaucuaguaucuugugccauacucuguuucuugauuuuuggguguuccucacccaguauucaaugggugcuugcuucaugacauguuccugagugcagcuggccagaagaaaggcccaaacauccuaaucccaacuuucgauaccuuucccuguacuuaagcugguuucaaaacaaagugugcagucuuuuuagcugagaccugaagcagagcaucaauuugccugggaguggggcccaggcagguagggagacccagcagugaaaucaccucgggacuuauuccugucuccaaaauaaucucaacucuuuaccuuguuuugccaccacgucccccaacccugaccagccaccuccacuuccugcucagguuuauugcccccuuccuagaaugcccucuucugaaaugauggcuguagaaugcuggaguguucucuacuggaaucccacaagagccaaaacagguuaugucagagacaccuaacaucacccaacugugugagacggagggugcacaagaugggugcacauuucccaagcgcccucuacccauuggccaggguccuucggagucaucaguacacgucucucucuuucucucagggcuccuuccgaaucuaccccuugccggaugaccccagugugccagccccucccaggcaguuucgggaacugccugacagugucccacaggaaugcacuguuaggauuuacauuguucaaggcuuacagcuccagccucaggacaacaauggccugguaagaguuuggguguggggccuucucccauagcaggauaauuauagucaucagccaugguaauugucaccuucuuucuuucugggcgucuguuaucucacaaggagaaagauacucuaucaaaacaaugugaacagaaggauuguccccaugggguuuuacccaagagcuuuggcuggggcugugggggugguggugcuuagggcucucuaguucauccuucucguguuacugaugugacccaggacaagauuugcuccagucacaggaccagcaugugcagaguuaggucaucccuaccuccaccccaucccaccuuuucacccacacagaugcuuugaaggcacgcuggcccacugccacccaaaggagaaccuugcacugaacucgucugagguccucaggugccccagaggccaccuuugucaucacuugggaguauagaagcaagccaagucuauccccgaaauugacuucaguuugcacccgggaugauauaacaucuuaccugucuugucuccacagugugauccuuacauaaaaauaaccuugggcaagaaaguaauugaagaccgagaccacuacauucccaacacucucaacccaguguuuggcagguaacauacaguucaaaauauuccuucuacaugaaaugugcccugcucugguugagauccuaacgccaggaauauguacagauaccuuugucagagaaauggguagaagggcuggaagguccaugagggaagaaugucccccaagagccuugacaaagcauuguucucuucguggucacagccuugacuuguuucuggucuagaauauggguauuguuaacacauuuuuauucaugccacuugugaacaccugugugcauguggcagugaacaccugugugcauguggcagucagagacaaccugguucucuccuucuaccaugugggccccagggauucaucucagguccucaggguugaccucaguagccuuugcccgugugugagucauguuauauaagucuuaucagagcuguuucuaguuaccaacaugaucacuaaguaaagccaguguuauucagcugagagcaccuuucauauuuaguaacaacauuugcugagcagucagagugagcaaguccucucucuccugagccauuuuguagaagacaugucagaaaucucacagaacucugacgggaacagaaacugaggcccgaaaagaggugugcauaacaucuuucugauuacaggcuguggcugugaucccaagucauacgacaccagggucuguguggcuucagcaccacacucugcucugugcucugucugauucucuucuguguuagacucacuagccaagcaucacagcucccacaucacacagggccucacaucucugucaacaagccaucacacaagcgauugagacagaggagguauacauccaugacaugacucugaggcuuucccaagccugaggcaguacugcauagucacagcaaaacugcugucuguaggcaaauguucuuuguggaaaaauauuugaggaagggcuggggcaggggaggauucugugugcaaagggugggcaagcaggaggaccugaguuuggguccccaacccgucuagcuguaagauaaggcagagggcagaggauguggcucaguggguacaagacguggccacaugauuccgacaauccaaauuccagaugcagcggugcgcaucuauaaucccagcacuccuacagccagaugggaggcggagucagaagaaucaucuagaaacauucuggccagcuagccuggaguaugcaguacagaacagaaacaggagagagccuaccucaaaggggugggaggcaagaacugacuccccaaaauuguccucuggccuuaacccacaagcugucgcacacaccuguccucugccccauugcaaaaucaagaauuaaauauauuuguucuuaacuuuuuuuaaaaaaaaagguaguaaauaacaaagaaagaccuucugccucuacauacacuagugugcacauauguauaugugcacacacacauacacaugagcacaaaaggggaaaugguguuauucucucaaaauuuugcuaagugggagaacucuguuccuguuuugcccuccuccugacacacucauuuauuuuaugucuuauguuuauuccucucaguuuuucucugccucucugugugucugucucucucaugcaugcuuguacacacacacacacacacacacacacacacacacacaccuuggucauccaguuuuagguucaaacaagccaucucuauagacaggaacaugcauguacaaaggaccacccaguuggccccuagcauguuugcguacaugcacacacaugcauauacucagacaccugaauacgaacacccucugugcugcgcagcccuaggcccagugccgggcccagggaggggaaauaauccucuggcaaggcaaugugaucauuuucccuuccuuccgcugauccagccccaaggucuagacaggaaaaggcacgcagagcaggaaggagggcuccgugugagcgagaccgggaagcaggcagagccagcuuugaagggagaaaggcagcccuguuugaauggcuuguuucagaggugccaagcacaagcuuaauuaaguggcaggaaaagucuugcucagagccacgcucagaggaagugaugcugucaggcucagcgaggccaguggcugucuuaggggaucacagacuuccgccaguccaucagaguggcuccaggccgggaccucagucuugggaagugcuuugcuucucagcagagacacccugagacggggcuuggggaagaagugggauuuccugcguucuuggccauuguucaucuugacuucucuagaacacauucaacuccugaauacuguccucugaucucccccacugggcugugauacccauauucaucuacguaucauccacacaauaauaauaaacucuaaaagauuuuaaaaauaauaauugaugccucaggggagggaaaguauuccuuaauuaaccaaagcacccaagauaccaggagucaguuuguuuuguuuuuuuguuuuuccuugucaccagaucucaugguguauaccugguccuucuaaaaguuacauagaccaggcuggcaucaaauuuguggcaagccucuucugccucuagaguguagcauuuauaggagugcacuaccauguccagcugguuuucuuuuuguuguucuuacugggucucgagacagggucuuucuacauagcccgacuguccuggugcuuacucuguagaccagacuggccuucagcucacagaguuucaccugccucugccucccaacugcuacagaguaagucacaauacccagcuauuuuccuuuuuauuuaaaaaaaaauguguguagggaugcaguugcugcaugcaugucuguauacugugugcacaccuggugcccacauuggcucugaugcuuuguguguagcuaugacccaaguacccccuuucccugccucaagccucaggguaccugcugcaucuagggaggucucugagauugguacaggagacauccauguggcuuucuuccagagugccauuaaacgcucaucccugacucgcuggacaaaagccuguccucacaccagaggguaacaagaaaaggaggaagcccaggggaggagacaguuuuucugacagcaaaauaaacuaagcaccuggaaugagagggauauaggggaacaaugcaaauaccagagcuaagcccugccugucugccauugaugcgugcacuucaacaucccauggaccacacaguucuuccgacaacggcacggcugcuggaugauuucuuuguaucucugaagaauuuacauuuuaauguagauuccauagacaaguuaugaaaacugaaugaagucuguggcaggaccagaggccuggcaggcccccuccauggcacacuacacaaguucaugcaugccccugcguccuuccagagggaugagucaaguuguuuccuggggcaggagucucugaugagcagaguaagaaaugaagugggguacagaaaaauggcugucaggugccuguuugaucuuccuggagugaggagaaagguauuccaggugguauacaggugguaacacuaaaauuagcaauaugauguauuauuguuauaguacuguuuauuuauuuguuuuauauauguguguauacauguauauauauguauguguguauauauuacauacuacauauacuauauuuacuauauauaauauauauguguguguguguucuuuguuucaugcacauuagaagagggcaucagaucccauuacagaugguugugaguuaccaccugguugcugggaauugaacucaggaccucuggaagagcagccagugcucuuaacugcugagccaucucuccagucuguaauaugcauuguuaugaucauuucacagagaagaaaacagaaggacuaaauaaauggcauaacuaggguuugaacacagguauucacccaggcuuuucuccugagcaagcgugcauucccucgucgucuuauuacuagcgucuacuguuuauaaugucucccuacccacauagcuguccucaaucagucgucuucccccaacaucgccaacacuuggcaauucuuugucugagucuugguuucuggagcagcccagaaggccccugacugcucuguaugugcauuccuuuacuuagaauguacgaacugagcugcuacuugccucaagagaaagaccugaagaucucugucuaugacuacgauaccuucacccgagaugagaaggugggagagacaaccauugaccuggagaaccgcuuccuuucccgguucgggucucacugcggaaucccugagcaguacuguguguaaguugcuuccccacaaguggagguggucugcugcauggaugcucagaccugggaaggcuggagggcucugccuccaucagugugcuguggucuuuugguccauccagugucauuuuugacaggaucaucuagggacaaacaaggcaagcacacugccucaauuaccccauagucuguugaaauggcaguaccuggacaguccccucuccuguucuugaacuccugggguuagcggcuguuaugacaaggauucucuagccuuuaggaauagggauugauucaugacuaucaauuauccaccucccccaaggauucuaugaugccuagcauccccugaugcuaaccaguggcucucuaagccuucagugagacagcaugccacuucugguauuugaauuugccucuaugauugugauaaucccagauuccucauuuuuguugaggagggaacugcacacacacacaaaauagacaugaugaguugccugaagccaacauaauauguauguuuuauaacucugagauagguguccaggaggcaaaguagguacaggugucccuccccaguuagauggcugugcugagacacaugugcauuugugugguaccuugugcaccugugaugucguccacaguuccggaguaaauaccuggcgagaucagcugagaccaacgcaguugcuucaaaacguugcaagauucaaaggcuucccgccaccaguucuuucugaagacggaagcagaauccgauacggaggucgagacuaccauuuggaugaguuuggugagcacaaagcugugggguuguaagcacaauauaauaacccauuucugugcugcauuugggggaggaagaugagccaaggcagcgccuugaugauuuccugugagacuccaugucuguccuuaccaagacaaaaaccucaguaggguagagaauuuuguccauuggguggcccaguggacacguuuuuuuuagucugucuuauauuuuaccuguuauuuucagaucauagucaucugcacguuaacuauaaaguccuaauaauuagccauuuuuguguauuacguaauuaacgcaaaaguguuccaaugacagugaaagaaauucuguuccaaagagacuccaccauaauuggcugugauggugcacaucuuuagucccaacauucuggagacagagauaagcagaacucugaguuugaagccaggcuccaaaacaaacugaaacaaaacaugagagagagaaaaaggaggggaggggaggggagaggagaggagaggagaggcucauaucugagcccuugccugagaagccacagggaugcugaaggcagugcagaaaaccugcuuugcuacccaucuggcucaaguucaauccuggauuccugcugcuuuauuccugacacaucuauccuacacauacccaguuaaccacacugagacagcuguaggaauaugcaucaaaguauaugaacuauaggacguucauauggucucugggaaagagaagggauggggcucccaaagagacaugguaggucuggccuuccaagacgcacagggaaaucagaauaaagacaugugggaaucacagugguuccugaucuucaacuugauucuugacauugucagaaacaugguucucuccauuuggaaguugauaucaucaaucucaggguugguuugaugcuuaaugagcuguccguauaaacuugcaaaagcaaagaagaauaaaugggaaaagcaugaaggcaucauggucuggugguuaaaagugaccccaaaguuagcagauacgccccccccccaaucuguguuugucauggugacuguucaguugcuuccagauucagcaaccaggaacagcuguuuuguuuugcgaacaguuuugaggggucaggaauucuggaagggcucagcugagcaccacuccuuacaaucucucgccaggcugcagucaucugagagcccugugggcacaggccacaguaggucaugcacguagcuggaacuuguugccuccugucacuggagccaauggccaugguaccuacacaggcuugucacagaaagagcaacuucccucagagagacccaagagaaccaggcaggagcuucccucaaaaacaaaaacaaaaacaaacaaacaaacaaacaaacaaacaagcaaaccacacagccuccuuuaucuuuugcuccaguuacacucugucucgagaauaaaagggaaaagaugcaccuuuuccugggagagaggucugagaacgggguugggggcaaucauguuuuuaaaugcuacagugauacuugcugcuguaagagaugaaccuucaaaucucaggggcuugucccacuuuagaagcuuagggcaaugguccaucuaagcaagugcaucauggaauggacgcucuccuccuacaacccuguuauucuccagugcacucuucuaagcuuuuaucuuccuccacacccagaagagaaaggcucagaucggauccuaugcagaggaccaaguccagaggugacgcacaugucauucuaucagugucaucuucuuggucauguggucacaucugucuagucgaaagggaggcuaggaaagaaggugguugugagucugugcuacaaaaguaaauacagccuacgcucacccaauucuaguauguucuggucucugcuauuggcagacuacaaggugggugugagccucaguauggaagagcccacagucaggagcuauugguaucuauuuagucuuucaccaguccauaaaguacauauguacauacuggugaugccugcccauuuuuacgaagucugggaugacgugcugcaaguuaguuucugggagccaucuagcugcauuguucccaauuguuccuucucugucaaugccauuuugcauuccagaggccaacaaaauccugcaccagcaccuuggagcccccgaagagcgucuugcccuccauauucucaggacucaggggcuggucccugagcacguggagacaaggacuuugcacagcaccuuccagcccaauauuucccagguaaaagggaagaccacgcccacuccucaaauguggcaacagucgcugauggauuugccucuugaaacaaguucugaguacuuuuagauacacaagaaagagaaagaaacucaaacuagcuucacccaaaaggaaucuauuacaaagaugcucagggaaucuuggaaaaauacuggugaccugagacucagagcaaacuaaagccagggucuuccuuugucuuugucuuugucuuugucuuugucuuugucuuuugucuuucuuugucuuugucuuuguuucugucccuggcucuaguuaaucucucuugcuguuauuaccuuucuaugagucuuuugcagaggguuccugaguacucacuucugucuuguauacugggggauugguugucccacugugacccaauuugucuaccaauggagcagcccggagagcagcugagcuuguccuggcuuggggcagaggugccgugugcauguagagagccaagaaagcuugagcacagugggcaagcaauaggucaaagggcaugaugacaacucugagaaaauggggcccgguuuccagagaagcaaagcaagacauaacaaguggcaaaucaauccauguagaaucuugguccacguccaggcuguguccgcagaggucugggguaaggccaagaguguggauuuuaauacacaccucgaggggcucugauguaagcaguuaggcacucacacuuuaacaaauauuaacuuacuagaagcaaaugucaucaacaccugcuuuaagaccauagacauauuuacucagaaguggcuguggcucguagguaauucugucacagcuugcuuuuauccugugcugaauuucaguuucuucuuguucguaguccuucguuuuucuacucaaagccuauucauccuccuuucuuuccuccuacccaucagucuuagauggagucucaagacugacaaaguaaggaagauuucucccugagaagguaccagccugccuuugccucucugccugcagucuguggcuuaaucguaggagacgccuguaugcuuaguguccugcggugugccugauguauagucgaggccugagccuagagauuaguuggaaaagagucgggaucauaguaaaauauauucccuuucaaggguuccagguaauucauuuugaucgcaaugcauuuggaagccaauccagugguuuccuuggcaaacuucucaaagaccagucuauguuugucugaaggcagaguccauacaagauccaaaaauaaaguagagacuauaaauugauuugaaugguaggauaguguuuuggcuuuuuuuuuuuuucuuuuacuggcauucauaaugucuggaagaacauuccagugaagaggacaggcugaguccauacuauucaaagaucagagcagggccuccccaagauggcaggacaagugucagucuauacccugcucucucucucucucucucucucucucucucucucucucucucucgugugagcuccugcuggggugguggcauugccuauacagggaauccucacuuuuggaaaccagucauucuuuuugugucuccucacagaacuguguagauuuucuuuuauaaagcuaauugucguucuguuucucugauuuuuaauuuuuaaccacuugagguaagugggacaucugccaggauagagacuguacuggguacacaaugugacaacugauaaaaggggguaugacggggaaggaacugauuuuaaaugggaggauggggagagcgagacaggcagagagacagauggagagacagagacagagaguuugcacuagcaguuggguuaguuauaggaaugcccucacuggauuaauggaggcaauuuuagaccaugauaaaauggaugaaugcaguucuugggugaaagcggaaaguggguggccuuaaugacauuguagacaaucucaacccuggcuagcucuucauuuguggccauccaugugaaguaauaaagcagcaaagaggaacugauuuugcacucuauaguagagagcucuccuaguaugcgggaagcccuggagccuauguucaaugcugccaagaaaaaaggaaaacugugguuucucccaugugugacuccagucuucuuuccuuuguguaugguuuaggggaaacuucagauguggguggaugucuuccccaagaguuuaggaccaccaggccccccuuucaacaucacacccaggaaagccaagaagugaguaagccuaaaacccugcuucccuggagcggggacuccuccauccaggacucgaagacguauacuuucaaaaugugugguuuuuuuuuuuuuucagguacuaccugcgugugaucaucuggaauaccaaggacguuaucuuggaugagaagagcaucacuggggaggacaugagugacaucuacgucaaagggugaggauaggaggcagagauucccacaugggggaugaagcagacccccucuuuccccaguggccaucguuuggcgugcccacugauguguucuugguuaccagacauugcugcuuacaaugcucuguguagggggugccaggaaagcuaaaugccagcagggcagcagagaagagaaagcugucuguguuuaauauauuauuauaacucuguuauaagcaggguuucuuuuuucugagccuccucagucaucuaauuuccuauuucucuaugauauuacagacaagcaucaaaagcccaguaaagcucccagacuuuccuuccuauacauuuuuaucaacccuagccaaugcuugugaaaaguagguaacauggacagguuuuaaaaaauaaauaaauaaaucacacauccccuacccccccaccucugacaucuacugagugucauucaauucaauaugaaaacgauccagcuuaucauuuuacuugcauaauuugacuccaggugguuuguuuggauguuaguuucugcugcgcuguggucauagauucauagauccugagaaugguccuacacaguggcuaaaacgacauaaaacuacauagccagacuuugcagccagacucccuguguuagaauccuggcaccuucccugcuggcuagggaaagucagacaaucgcuguuagucaucugugcaguggagauaaugacacugcuacuuccuggagauagccagaagaguccaucacuccaggcaugugggccagcaccuggcagcuggugugcauuacucggguguuagaauuauugcuauuccucaugggccaaguucuuccuuaauauauagaagauaagauguguugaaauguaauguauucgucagugagaacaaagucucccucaugaucccuagugaacuucaaucaaaacguaguuacagacauaaugacuaucauuuaggcucacuguaagcuucaucaaguucuucauuguuauuugucauuucgggacuucauuaccauuccccaaggaaaacuaaucccagcuaauuauagcuaugcauauuuauuugacuauuaugagauuuuuuuuuccaaaucaagggaacaaacucaagcugaugggcugagagaaaacuaauacaagaagaaaacacaaccuaaaguaacaugcaaagcugcaauuacaaucugaauaccagggcugggagcccagcucagagguagaaagcuuaccuagccugagaaucugggguuugguuauucgcuuauuaguuucucuuuuagauagguuucauacagucugagcuggccucgaacuccuuauguagcugaggguggcuucaaaccucugauccuccugccuuuaccucccaaguauugggauuaaaagugcaggccaccaugauauucuggacaaguacuucacucacucaacuauauccucaaccccuaggaaucgggguuuguucuccagaacugcagagagggagagggaaagggagaggggggcaguucuccaugugacauccgaaaaggugacuugcuggaaaaauacagcgucuagcaugacacauguuaacguuacacaugaagugauacaugcucacacccaagcacaugcagcuaaagaugcuuuccuaguuaacauaucuuaaaaucaaaacaagagaagguucaaaaaaaaaaaaaaagcccaagagacagagagaucuugggucaaauaugguggugaguuuuuagggcugggucaagaaaaguuuaagagucgggcagugguggcacaugccuuuaauccuagcacuggcaggcggauaucugaguucgagaccagccuggucuacagagugaguuccaggacagccagggauacacagagaaacccugucucggaaacaaccagaaaggaaggaaggaaggaaggaaggaaggaaggaaggaaggaaggaaggaaggaagaaagaaggagggaagaggagaggaggggaggggaggggaggagaggagaggagaaagaaacauuguaagccugaguugagaaucggcuucccugagugacaaucuugaacucugucuucccaccgacuuaucacuggcagagaggacaggugggacccaagaguccaaaagcuucauuguggaacuaggaaucguuacuuuucaaaguucccaucugauccuagcagccugaccccuuugcccauugaaaaguaucaauucuuuuuuuuuuuuuuccuuuuguuuuguucuauuuugcaaucuuguuuucaagaccagguuucucugccuagguuucucugguuguccucgaacuuacuuuguagacccguguggccuccaacucagagauccaccugucugucucccaaaugcuguaauuaaaggugugcguaccaccgcgccuggcugaaaaugaauucugaguuuuaaaccagaggcaggcguaugugacugcagcuuccuuccgcacaccguucauuccaucaacagacaguugaucucauauccacuccgugccaggcacaagcaaaagacaagguucccaacgauaucaguuaagaugcuucggaugagaggaguguucucagcuaggcaucuggaaauaacagcuugccucucccuugcccgucucauuaaugagaucacggugacuuuugagaauaauaaaaaaggaagcugcaagauuacuugcugggugccucuuuuuguuugcuuaaguaaaauaugugaagggaaaugcuaacauuuugagcuaacuugcauucguugagccuaccagccccgaugacagaugcuaaugagucauaguugugaagcccacaaucauagccggcaagcugcagcuuacccaaaauagaagcuacguuguugaugauauuuuccagaaaauuucaccuuagcccugcuaacuacagucuaaaggguuuccugcuuugguuuuaaaggaauucuauuuuauuuggcucuaagcugaguuggaugcaaccgagugccucccuuccauaaaucacccccagcuuguggaucacuggacccugcccagagaaaaugcaucacuuuugcucuucccugccccacccccacccccuuaaucacugaaguuuugccccgcuagaucccuugucaaucacagcgaacugagucuguuugccucugcuuuacagcuggauuuccggcagcgaagaaaacaaacagaaaacagauguccacuacagguccuuggauggugaaggcaauuuuaacuggagauuuguuuucccauuugacuaccucccugcugagcagcucuguauagucgcuaaaaaaguaagccuugaaagaugugggcgggguguggacguuucaggucugcuagacucagaaagucagaggaggucagggcugcucgggaccugggaggucacugacucgagcucccucucgguacagacagggaaucugagacccacagagggguaaagccuugcccguggucacauagcuaugacagguauuuguuugcguauuuagggcuaugaggacugcagcuuccuuucugcuaggcucuugguggcaagacaagagacauuauagaacaaaggccuuuuuuuuuuucagccacuguacacauguguucuuuacggaaugaauagauggcuauucucugucuuaggccaaacacaggccaaauauuagaggugaagugucccuuuuugccucucuuguuaagccuuggcaucuguguucccucacucagaaacacuucuaggagaacugagggccccaguggauuuaauuagaaagacguuccguuacagaacuuagaccagaaaugugauuuauugguugccaggccuagcaaguccaagguuggcucauuuuaagaaugucuggaggccaugcagaagcaaugucuuuggaagcuagcuccacauucuccucccacugcucucuguccuccauggaccucccuucuaggcaggcucuucccuaggggaggaaacacgguagccaucacuccacacggucaccuauauuccuucagcacagauagaagaagagagccaggagggcauccaccagcauucuagaacugggccucagggucuccaccuccaccuaucuagagacuuguggcucucccugaaccaagcgcugcugcccaggaugccuuacucgggccaggcacuggcgcuagagauggagucugucuuugucuacaccaucccaccccagccccagcccugcccagacuguaccaacuggggaaggaaaaguucuccaagaaaagccuggggucugcaaucuagguagacaauccuaugaucccaauagaugucuuguucgauccugccuuuccuaccccaucagucuauuccauccacucacaccgucuccuuacacccuacaaaaugcacccaccccaagucccaauugcccucugauauccgaccuuucuguggcugcuguaguaagcacuuugccugugaaggguggaauggagucuaccggggugggguagggugggggguggggacuuuccagaggcucagaggcucuaauuaguguugaauugugcaucccuucagaggugaggcagagcaggacaggugaggaugucuggggucagauaggaccugagagaugguuacucuuccuguuuacccacaccuaagguuagaccucuccucacucccucaguggaacuuagagcaugaccccacacauaggacagccaggcaagacuagcugugugggcuuuccagagcccuaggaacuccaagaaagagaaccuuccaagaauaugaaaaaugagaaccaaccccauggucuuuagaauucccaaaucgcugguagaauuccuggucugaccaggccagaggcacuuagguauagcuggccauggagguauauucuuaacuaaugucugggccgaagcagggacuagaggugggaacuugguccuccgugucucuaccuucaaugugaaagaucagagggucuuagguggccacagguauguaaaaguucacgguauuuuuuuuuuaagcuaaaaauuucggaacauuuuagaaucuguaguaaagcaagaauagaaucugagccgcagauuaaacccacuguuuguagaaugaaagacugucaaucaaaccuugaagaacggggugggaauuugcuccauagggauaaagacccagcaaugacauugugggcuggccuaggacagguaguuuuaggggagucacaguggucuucaagggaaaaucuaagcucuccccaccccacagggguggcagccugaagucacacugauaggaauguggugagaaaccugguguuuggggacugccugggacauccuuuuugucacacaguaggccuugagacuuccugggaagccggauggccuuccaaaugcauggagaggaagcacagggugugaaggcagaggccucagucuuauugcuguaucuacggcuaaaaguaagggucugaccgugaucauaugaucuagucaugucucuucucacuuuaggagcauuucuggaguauugaucaaacagaauuucgagucccuccucggcugaucauucagauaugggacaaugacaaguuuucccuggacgacuacuuggguauugcuuaccuuucagucaccccucuaacacugcacauggaauuaaucgcugaaaccaauuauaauuuggaaacaguuuccuaacaccuguaaugggggaggcaggggaugugcccuugauuggguauccuccaagcuguguggucugcuugugaaugucaccccuuuucacggggcccuguucacucuuaaggccucauuaauaagcuagaaaggcaaguucuuggcuugcuuagcagguacagagccauggucucguuccucagaacuucaugcacagggaguggagcuaugugccuauuaccccagcaccugggaggugaagacaggaggcuaaggaauucaagguuauccuuggccauauagcgaauuagagggcaggcugggcacagagagaucaucacaucucugccugcauuuccaagcaaucuacuuucucucucuucuuggugcuuaggaacuauugucacuaacccucuccuugcucucaucacuuacuaagguccccuacuccucuuugucuccuccuuccucacacuguucuuuucccucagcccacccuccuccggcccugaggggcucaaugcagcaaccuacccaaccccuccccuucuuggcuugcucucuuccuuuccacgucuuaaauccaaucuuacccaggaagucuccuggcucuucugcagcccucugcacuucagcugaaggcaaagcucaccuuucacccaucaccaaacuaugcacggcuccuaaaccagggaaaauaagcuggccucuugaagcucuucacagaguccuauaugaaacuauucaggagcuggagacguaaugccucccuccaagccuccgcagaaagugcgucucuccagacacccugauccuggcugggauuucucauuuccugguggggauuuucuuuugaguuauguucuuuaaagguccugguuuuggggucacuccaggagagagcuguacuagcauggucccgaggagcaucccauguuucaagcaccuaauuguccuuccccaaaggcaaugaccuccauucaggguggcucagaaaucacaacuaguaccucucaaauacagagguccugaguucaguggaaauuuuuguguguagauguuuaaucgcuugggauuuauagcaggacuguuuaugcucaugucuuugagaaaggacgcauggaguccucugugagacacugaacaauggauggcuacuucuucugccaucucccauucuaucuggaaagaacuuaaacaucuagcaugaucccuuuugcuaacucacccaucaccuguucaaaaucacugucuguguccccuggacaagaacauccuguucaccucagaacaauggcucaaccacuugaagcuuaucuggaccucauguuguguucuuggccagguuuucuggaacuugacuuacaucguacgaucaucccagccaagacaucagagaaaugcaguuuggacaugauuccagaccucaaagccauggacccucuuaaagcuaagacugccucacucuuugaacagagguccaugaaaggaugguggccgugcuacgcagacaaagauggcacccgggugauggcuguaugaguauuuccuaguugggaaucauuucuguucauuauggguggauuuacccuuaauaagucgagacggugauaaagauagaagacaccgugggcaugugcuugaaguuggggacaggcauggauuggaaugguccaaauccaggaaccaagugguggcauuuguauuuccuuaagguuccuuuacaagaaagcuaccuuaggcugagcauuuacaguaagaaucagaaccccccccccccccagagugagcuuugcacaucuuaaagagaagaguuagguaagggugcuggaacaaaauccauauuugucaagcaucuuggagaauuuaagcuuuagaaagaagcagcaggacaggucaccauguuucugacauuaccucgcacagaacggauuguuacuagcuaauaguugugagccagguaacacguuaacucucacgugugugaucucguuucuacaguaccuuaccagucuacauuaauugcaucuuaguggaguuugguauauugcauauuaguaugguaauugcccauuaguguaguauacuauguacugaucaaauuucaccucccuuuccuacccuauccaccgcacacccuuucuaguauuggcugcacggggguugggggcggugcuuuuacauaugagaucauaugcuccugucuagcuaauucauuccuagaaguucuucaggaaacuguugaugaugaccugucaccauagaguuuaguuuucaccuucucauugaauucugccgacaggccuaugggguaggcuaaacccuuguuuuguggauucaaaucccuugcagggucaggcauccaguuucaccuagaguagaagcagaggcgcugccugggccccucuauauaaaugaaccccagugccaggauuucccaaguuacuagggacuuagagaccuuuucuagguccuaagaugucagcuaaaacuuagugaaggcuggguauaaaaguggaaauggugcuugguguauugacacacaccuuuaaucccugcccuuuggagacaaaggcaggcagaucucugugaauucgaggccagccuggucuacauggugaauuccaggccagaacuacauaauaagaccuugucuuaaaaaaaaaaaaguuuagaguguuagaccuuucuugaccuuagugucuucuucugcagagacaacagcaacuuucugaaguggcaugaccauucauuacacagguuauccacacagagcaccucccugugaggguguaccuugcaggggccugucagcagaggagcagccuccauuugcucacugaugcagcuaaggcaccuugaguuccuacuaagcacaagcucggcugcacacuguagggcugugggauaagcaagaagaaacaugguuccaucucucggagccuacagaaauguccgauguuguucuuagcagucaaguuacaaaggaagugagaaggaaggcagggagauugaugugggagcucgaggccacggggaugcugaagaaggagagccgaaggaggggaagcaauuuguccucccagcuuuccacauggagucgguuuaggaacacaugggaggggaaaugugaagaaaccucgggaggaaaauuggaggcaaucuaaggauuguuuuacaagaauaaaaaucguggcuuggggaauauuccuugggucgaaguaaaaauauuugugaaacgugaugucauguguuuaaaccuguucugcuuuacugaaggggaaaguggagaugacacuggaggugcucaacgagagggaggccgacgagaggccagccgggaaggggcggagugaacccaacaugaaccccaagcuugacccaccaaagugagaggccuucuuuguucuuucuccacguugucuacuccccaaacaccugcaguccgaaagcccccuuccgauugguuuaaugggcuggauuauuggcccucuaauuuuguucuucauggugggcugugggggaugggaggguaggggguuguggucuguuuuaacuacucuccuuccccauuaaaccaggcuuuggcguccuuggcaucuuagaaacugguguggggaccuaagcuauccacagccaacuacagaugcuaacaaaagaugcuaacauggcaaagacugggaagguguugggcacauuagaaaggggaggcugaaauuguuaaauuguaucuugucccaaauugauuauuucacuaucccugaauggcuacaugcugguugauaguccuucaugaguuaaggagagaaacuauucuuugcauugcagccgaccggaaaccuccuuccucugguucacgaacccuugcaagaccaugcgcuucaucguguggcgccgguucaagugggugaucaucggccugcuucugcugcucauccuguugcuguucguggcugugcuccuguacucucuuccgguacgaaaccugggccuuggcuucugcagcccuauggcucuacagccgauaggcagcaacccugucgugacccuuucgcuuuggaagaguuuaacacaguguccugugguggaaguuacauccuuggguuuuaacauauauauauauauggaggccagaggucagugacaugugucuuccucugucagacuccaccuuauuuugcggaugguggucucucacuaauggcucugcuaucucugcacuggagagcccaugcccugguauuauguggugcuggagaucugaacccagguccuugugcuuguacaaugagcaccuuacccacaaagccauccccccagacuucugcuuucacccuucuugucccaaaccaccucguacucagacgcuggcgauccccacagccucaacaaaccccaaagaguuauuacuuuugccucccugggcacuuuugaccacauuuuugauuucagaccuguaucucacaacacacacacagauaccuuaagaauccaaauugaaauuuuagcugugugcauagacucuguacuuuuuuuuuaaggauuuaauuuauuuuaugucugugaguacccuguagcugucuucagacauaucagaauaggacaucggaucccguuacaguugguugugagccaccaugugguugcugggauuugaacucaggaccucuggaagagcagucagugcucuuaaccgcugagccaucucuccagucccgguucugugcuuuuauuccccuauucagggaacucauggggcaucuaguuaaauacaaagaugagaagaaacaacccaagagaaggcagcaugcauacauacaggcacugugggcaggaaggucuuagagagcuaggaacgguugacugcaguagcccauugcuaaggacauuuucacugaggaaacaccuacgugcaguuuagucaccggagaagugaugggccaagcaggggaagcccugagcagcggcaaaguucaugacccuggaugcagcagcagcaugcaugccaaagacuuccccccacuccacccaccaaacucacuuccacuacccuauugacucuauacauucugaguuuggaggcauggucauacagccaucuauacacaugucuucuauuuucuccugugugacauuuucacaauugacaauucacaauuucuacuuuuauugacuauuuuuuuuaaaaaagauccauauaguuguuucuucaugacucagaucccacccauaugaagcgcugucucucauuugagaacaugaugucagccaaggauguuuaucaguguucagagacaccggagcucuaugggcgcccagaaggaauggccaggaauggcuuugacuguccaguggcucacaggacugcccagccgagcuaaauggcaccauggccaucugagaagccauauccauggacugacaccguuucuguuucccuuucagaacuauuuaucaaugaagauugugaggccgaaugcauagugaaagcagcgccuucaaucacgcaagcaaugaagaacuccugccucacacacugaugugugauuucaaguucaagacgaucucaggagacuucaccaaggcacauaaauuccuagaggggcugaaucccagaaagucagacaacaggcaacauuuuuuaucauguuaucuuuaaguauuaaaacauuuauuuucuaaacuuuaagccuauuuuccgaguauuucuaagguggcugguuccauuuauaaaucuucuuuugaaugugcucugcauucuaugacucguuugggcaguuagugaaaugaauuugaaaugucuuguaucuuaacgucauauauccuauuuguaaucaagaggaaagacuacauuaagaagauagggugcauaguuagagcaguucuuauuggugcccacaaccauuguugugguauuuuguauggacaaaugucaugagacucuuugcaacuugaguguaaauaaaauuaucucacuuguacacauggauguuuguccucuauucugaguaaguugggagggaggcagguucaguuucucugguccuaguaggcagaaugcuacagcauuccaguugaccacaagcccuuuacaaccauaagcccuuuaugagugugcugccaacaugaucccguggguccaguaauaaagcuaacacuuaugaauaguguuguaacaac

SEQ ID NO: 9264 - RNA, 2757 nt, Mus musculus
gggagugugggcgugguggaggcggagccaaggacagagucggaggaccaguucaaucugggccugcuugcuuuucucuguguguucggacccugcuguuauccauaggacaagcucugugacccucgccugggacugacuggucuauguucuuugggaaccaauuucucuuugugagguagagcacaaccuccuagucuuccgggcgggccacucauuuacccugucaaacucaggggcggagcaauggggaacgaagcuguagggagcugauaaacucccaguuugaaaaccgagauugugagccccagcagcgauuccagauugcugcccuacaggcagaugugucuuuauuggucuuuaucggucacaucagggucuugauuagcgucuugagaacuugaagcaaacaauugcuuauggcgugucguucuuagacuuagccuaggcauaccagaaguuuacagcgaaaaaaaucaguagcaaagcauccuaugaagguaauguauguaguacaaggguuaaaauccugaaugccucuuaauagauguguggccuugagaacauuucacuuccuugagccucaguuuccugaucuauaccaggaugcagauaaccaucugguaguguggcugcgagggcuagaguuuaacaaauguaguuaggcacuguuaaguaaaagacaacaaauccauuuguuacugaaucuaguggaugagaaaccauguaaggaauuucaguuuguuuuauuuguuuaaagcaggaagauggcaauccaagauacuggaauucucuauuuacacaguccucccgccugaaguaugaacggagaaacagauggagaaaggaauagucuuauuaaccacaagguggcacacuagaaggcggcaagcaggcuuuugcguuucaauguccaucuuucccuuuugcccuguuuuucagggcauguggguguuuuuugggguaugugggccccaaacagguggagccugggugaccccguguuccaaagagcagccuguucugguguccugguucugcacaucuuaccuucuuuauguagagccgugagguguucaguucaacacuuuuguguugauuaaaauuaaaaugucugguuauugcugaggucagcuuuucuggcaagcaucaacuccaggaaauugaccucucauaaccugagacaagggaggaaggggagggacuauguuuuuagcuaacuucaaugagcagguguucgacaaaagguaaauuucagugggcagcuaauucuggagagugcaguauggaauaugcagaaauggggguauuaugcauguuuuuauucccaagaagcaguuuuggcuuucuucuuauuuguguguuaaagugucauaugggagugauuaggggugggagaaaguuugucaacaugaagucaggaugugaauauucacugcccagacuauauaagaagcaaaauuggaaucaaguaggaggaucuuauaugcaugcacgaucuccaacacacacacacacacacacacacacacacacacacacacacacacacacacacacaccaggggcaggggaggguuccuuaaauaguagagcacagaggaaggguagggaaguucacugcaguucuacaucugcccuccagaaccuugguucuuguggaagcugcaaugaauaaggacuaguaagggagaggcauagccaggagguucacugggaggcuuggauuauuuguaaaagccaauguuggaucuagacgucaguguuugcucuuuauagacaggcacagucgugaagcuucaagcugcuagcuguuucgauagcaucucauggagaucucauuguccaggugauacugacaguucacucagggauauucuagggugaggauucaagacucgucuuuauucauguaaggagaaaaacgggaaugucuuuaucuuagcaggagagcucauuuucuccuuaggaaacagugucaaugguuuuuagacuuacuaauuggaaaccaggaggcuggugugaucuaaagaguucuagcuuccaaggggccuuucaugaguccacaggacccugccugcuaauagaccugcauggcuaauagaacauucugccaugacggaaaacuuccucuguucuguccaguauggcagcgcuggccacauuugacugaugucugcuugaacuguggcugcugugagugagaaacugagcucuaaguuguacuuaauuuugcuuuugaacagacagcuaguucuguuaguagaaaaacuguaaguauauuugaaaaacuuggguagaggagcucuugagaggguucaguuaguaaaggcucaggccaccaagucugacugacugaguuugacucucaggaucugcauaguagaaaagaguacugacuccuuaaguugucccuuaaaacacacacaugcacacacacacacacauacacacucacugaauaaaugugauuuaaaaggcauacacauauccuuuggguucuaaagacuacaacaucuaaauauagaucaaacacuucugaugaagacuuuguguucaaguugagaucuaauaugcuuuguauucuuacauauuaaaaaccauaauauucuggguugacuagcuaaaauaaaacauggaaaucugucuuaccuaguauguuuauuuuuaaaggaaaauccaaaauggugaaugugacucauguuacauuccuacagaacagcacugguaugcauauaauaaaggauauuauuuauu

SEQ ID NO: 9265 - RNA, 8704 nt, Mus musculus
agggggaaaaaaaaacagccaaaauaugccaaaaagcuucucacaacagcuccucaguagaagcaggggccacuugggaaagccagggccuggacgcuaauguuccaggcuacaucauaggucccuuuucgcucagugaggccaccaucaccacaccauggccacguaggccuccagccagggcaacaggaccuggaggccacccaagacugcagcuggcugccgcuggguccccgggccagcucuuggccccgauggauccucugggcuggagaguuuggcuccaccgagaccacccugagcggagcucggagcauaggcgacgugggacggcaaggcugacggaggggccccgcgugcguucaggagugagucagggagcguuaugcaagcucggccgccccccccccucccgcccccggcaccuccccgcggucuuucaccccgcgcgguuacgaaagcgcgacccccuccccccggagcuauaaaggaccgacggccgcucggcuccgucgcuccacgcgcgcgcgaacgcggcggccaggcuugcacgcggcuccugcuggugagccgccgcgcgcucccccggggaccugcagggcgggguggggcgggagggggcgacgggcggccucgguccuccggccccgcguuuacccugcgccugucccgcagggcagacuccggggugagauggagugggugugggcgcucgugcugcuggcggcucugggaggcggcagcgccgagcgcgacugcagggugagcagcuuccgagucaaggagaacuucgacaaggcucguguagguaucagcccggguuccccgauuccugcgggucagagguggagcccagacuccagucccuagcucucucaucucuuucucaguucucugggcucugguaugccaucgccaaaaaggaccccgagggucucuuuuugcaagacaacaucaucgcugaguuuucuguggacgagaagggucauaugagcgccacagccaagggacgaguccgucuucugaggucaguggccucuggugggcugugugcggcguuccaaagugccucccaccuugccuuuggcucccugggagcccaacccucacugggaugggaaaagaguaccuuggaugagguagaagcccuuuccuggcuuggcucaggauucucuuggcuuuugcagcaacugggaagugugugcagacauggugggcacuuucacagacacugaagauccugccaaguucaagaugaaguacugggguguagccuccuuucuccagcgaggaagugaguaguggggcauacauggccaaaucacugcguuucuguucagcggcaccguugggaagggcuucgagaggcagaacccucagcccugucugaauuuaggggaugugggauuagaagcgacuggauucucagccuaaaauaccuaauccaaguucggaagggccuuugggcuuaucggguaccauuucccugaucauccacugugacuuacuucacgcugucucacacauuaccacuccacucugucucuuggaguggaaucucugagacaguaggacaaucuggaacaucggcagagcuagagaccgauauccaagaggagggaacuaugugucugagcugggucacagcccaggccccucccgguggacucccagccaggcaguguucuggaagcaauagucuccuuuccuuaaauacucauaugcaaggcaggauuuugagaacucccaacaaaguucccuaaaguuugggauucuucucaggacacacaauugacauguucuuugacucccccagcccauuucacuuaaauuauagauccgaaagcuacuugauaacuaaggaauaauuuagggugggaagaaguauugugagaucucagaaagaaggaacuaaucucagcccuaaggcaauggcucuagaccugcguucugagacccuugggggucaaaugaccuuuucacgggagccagcucaagcugucuaaaaacacagacguuuacuuacauuaugauucauagcaguagcaaaaauuacaguuaugaaguagcaacaaaaauaauucuaugguuggugguuauugcaacaugaggagcuguauuaaaggauggcgggauuaggaagggugagaaucacucuccuagggugaagggggguguccgggauaaauuucuccuuauuuuaaccuuuucagaaagaccgugugcaggguaauaguuaaguaugccacguuaaaguuagacugacugagugcuggagauguagcucauuggcagaacaauugucgcacauucacgagguucuggaaucuaucuccaaacauaugggugcaggggcuugugcauacacacuugugugugugcgcgugugugcgcgcccggcuugugcaugcacacuuugugugugugugugugugugugugugugcacgcgcgugugcuccagagugcgugcucacgaacuccugugcacacacacacacacacguucauacccacacacccacaaccuaaguucaaauccuaacuaaacuauuacccgugggacccugaguuguuaccuaacuuuucugugccccaguuuccuccuugugcaaaguagacagaaucacaacaugcagaucgugggacugugaagauauaaugcaugggugugcagaaagcgccaggaagagugucugaggcauaaauucuguguuggauagcauuucuucuuaguaaagaaaucuuacucuuagguaaagaaaucauaguuuuauauucuggcucucgagugggagaacucagauaucuucagguacaaguuuacuacuauuuaaguuaagaaaugagugcaccaggggcacacacacagcuaacuguugggaccuggugacaccucuuagcccaaaugauguaaagaaacauuuccccugccuuuaccccuguuuucugagucuaccaacucacuugaggugucugccuuccacuguuuaauaugcuugucugggggccuccuucacaaacuccaaauucauuccuugugcuaauuuccuuccuugaccuugaccuuacauuaagcgugaauuuggacaggagguugcaggccacucagagaggucucucuccuugucacaauuuacaccuuaccagauggauacauuuguaauaaggcaggcugauuggaaauaacucaaggcaaguuaaauauaauaaacaucuauagcugaugcuggaguuccaagaaaauucuggccauccugaauccccauuguaguagauuagagagcuaaaggcauaguggccaugaccaugagcuugucagcuggguggaaugaggagcugacuccuuggcccuuuuuugacuuuuucuuucccccauaaauggccugggaaucgaccccagaccauguuaggcaagagcucuaauaccaugcucccuccuucagugcaagcagacugcucuggucugcugcccccuccuugagcaugcucuguacugaucucuuucucuucucauucuaugcacggagugagacaucucaaaaguaaaggucauugcuaucagccuguauuggucaaauauagacauaguugcagacuagguucucuaaaaucugauuuccucugcucucaacuuaaguuaaggaauaguuccuauuuaaaagauugucgaaagaacuagucaugguaacacaugaacgaguuuagcuuggugccuaauaagagcuucuuaaauauuggcuacgaucauuauuuuguuaugcccucccggaaaaacaugaacuaagacuucuuucuuccuugucucaaauaaauguugccacucucuuggccaaaggauccuuguuaauagaggaacaauuauuuaaugugaggcuugaacaucuacaucaguguuucuccaagucacugcccucuggccaacuuccauuagaucagcugcaguacuuuuucaaagugcagauuuauggguccgaaccccagacuuucugaaucagaaacucuugggaguagaacacuguuaucuccauuuucaauacauuccucuggugaguuccuucugcacugugaaguuugagaaccagcgggcuagauaauucaaaccaugggaggucucagacuucauuccuuuaccaagguuauugcuaugacuguuuggaaguggacuggaaucuguacccuggcugguuuaggucuuagguccuucugccugcgaaucauaggaagccccuccccuggaagacacagguuucgggagccaagggaaccuuuucgagggucacagcaagugagagcagugaauggcagaucuuuuaagaaagcuaaucaccaagacccucuguugaacauuugaaaccaggcauuucuaagcucuccaccuaucaguuccguucacuguagacacggccgcaguguaauguuauauucuggauuuuggaggggagucagggacugccagacauuauagucucugccucaggcacucucgccacaguccauugugugcaguuaggugaugucggggaagacuuggcaugucucuuucagaggaacccuacccagaggcaggagggcuaaguucauucuuucaagcugugcccuggcagaucuucucuugcaaauacuguuaggagggagugucuggugaaguuuguuaggacucuucaugauugaacuauucugccaaaaagaaccuggagacaaaccaaaccaauucaggccuucuuuuaaguuaaaagcaguagccaagugcacuacaaccagacauugaaaguuagcucuuaggucguauuuuauauuccagcaaccauuuggggauaaaaauuguuaagcugccggugugucaggcuaagugcguagacaaugagcugagauacuaguugaaacaugagugccuuuuugucuaagacaggcuccugggaugcccuuuaugccaccgugaucccaugacaccauccagagaugggaagacucugccccauacucaggagccuggggaggaggguggagccuggggaggaggguggagccugggaggaggguggagccugggaggaggguggagccugggaggaggguggagccuggggaggaggguggagccugaggaggaggaggguggagccugaggguggcccagcugcagccauguggcuccccucuauuccugguccgucuacugaggaacuucauggucacugccuagcagaugaauuguugggcagggacauuuucaagccagggcucugaaagccuggaagauaagggaguggcucauuccucuucuugugaggcagaggcugaggcagagggggcugcauauccucuccugagcagugauccugugggucugggcgcaggggcugagccagacccuaggcugguaucucaaguauccagagagagccacacacacuguugacuuacaguggggacaugaguggccucacgugaugucauguuuggacaucuggguugcucugucuuccuccaauaugaacccuuacauagguagaugguuccuugcuuuagaccugggugugagaaggaaaaaaaaauuuaaaaacaaacuguuuguucuuguccccuuugaccccaauuuaccuagugucuggagacacuggcagagguuaggugugcaagcucugguuagguguccagcucugcccagcgcccugguccuuugggaauuacuucucuuuucugugucucugucugcucaucuguaauauggaguaauaguguaugguuuugaaagauacaagaaauaccccgcgcgcgugcgugcgugcaugcgugcgugcgcgugcgcgugcgugcgugcgugcgugcgugcgugcgugcguguguguguguguguguguguguguguguguguguguguguguacaugcauccauuguaugcaugugagugugaagguguaugaaccugcccagagcagagcacuggguaucagaacacuugcugacagccucauuccuuugaagcagucuuucacugcaccggaagcuugcuguuucugcuaggcugacuugccaguaaccucccaggaucugccuguccccgccucccagagcuagguuuucaggcccacauagcagucuggcauuuuacaugggaauuugaauucagguccuuaugcuugcagaguaaacacaauuacccacugggcuauaucuccuuaacaacccugcccacuccaaauacaaauucuaaugaguauuugaagcuggauagugagcaucuuuugccccuaggcaucccagcugucaaccggaggaagugaauaggaugccuaagcgugaaucaggguagagccugaaaaacuauuaccaucugauuggcauccucuagcccacccaauaggaaaacaguggggcuaagagagacggggggugggguagauucuguggagcauugauaagucgugaccucaaguuguugguggcauaaguugagggcgauagacauuagacagagacacauguuauuggaggguguaguagugaagacaguaguacagcugcagggguccuuuagaaaagcauugugcuaucaguuaucaagaagcugacgacgagaaugaggugcccucuauaccaggacaagauuugugucuucugcuaccaaggaaacacugacaugaaggacaugccuucugugccaggacaccuuuccgggaagagagcaagauccuuucucgcuugcccaguuguccagaagcugucaggaaucucugcagccuccuuucacuaaggaaaggcugcgaguuccauggcagcagugguagcaaguuggucaggucucuggggccacugugucucucugacuuacagacgaugaccacuggaucaucgacacggacuacgacaccuucgcucugcaguacuccugccgccugcagaaucuggauggcaccugugcagacagcuacuccuuuguguuuucucgugaccccaauggccugagcccagagacacggaggcuggugaggcagcggcaggaggagcugugccuagagaggcaguacagauggauugaacacaauggugagcaagucuuccuggggaacuuggcagggcugggucaguaagagggugcaacaucgaucuuugcaaguggguugccugaggagccuccuuugggccaaggcuuggcccuucuugauuaaauuuuuccuagggcuuugccaucagccauacggagaagggcccaaagguucuuuuccccaaacccuagcacuuucaauaaccaaagcuguggggucacucucuucuccuuauauuuuacuccccacauuugcuuaugaugccacaacccugagaaacuauucugcaggaauuagaguuugguggagaagugucccuaguaaagaacuggcuggggcaugcagccauuuuauguaaaaccauaaacaaaggcaucaauauagcaggucuuuaaagacuggugccuugaaauguucuuuauucgucacaaaaccaaacaccacuuaauuagcucacggggucuccacuugaguuuccuaggggaagucuccaggauaaucgugggauacuuuaauaucuauuguccuuaacggauccuaacuugaaacucagaaacaugguggggaagugggcuaccuauuuugaauugaccugcacucauauguaugggcaauugagccucaaaauuccaaaaaggguccugcugggguguagaaaaagaacauuuuucuuaggcaucucagugauccaauauaccaacaacgugagcucagacguauauagauuugaaagugccaccagggguggacugggggagggagcugaaaguagggccagugaaggauugugucaccccgggcaccacagaagcuuucaccuaacucaccccaguuaacccuuggagacacuuuauagcuauacauacuccaccagugagaaaguuggaagcuaaggaaaguuaaauacauugccuucgaucuccaauagauggauaaguugaaugcaaacucagaugucugucaccauggaguuccuuguggggccuccuggugacccgggcaagacagggacaucauguaggcuaugaagcuauagcagugaagcggaggucagguagguguggcccucaugucucaaggcaggagggugggcuucaaaggcacuuggagaugcaaugggugggaaucaauugugggauaaauggauagugacucaugccgcagguccugugcccucagccaugcugcucccuggaggauuuagagagcuugagcaucaacugucagggaacuugugaaguaagccauaccgaugccuaugaguggccacuugcucuauggcugcccagguguucauuaaucuacgaaagcacugaacuaacgauccaucucucucauuauggucuuauuuucuguauuucagguuacugucaaagcaggcccuccagaaacaguuuguagcaacgucuaggaugugaaguuugaagauuucugauuagcuuucauccggucuucaucucuauuuaucuuagaaguuuaguuucccccaccuccccuaccuucucuagguggacauuaaaccaucguccaaaguacaugagagucacugacucuguucacacaacuguaugucuuacugaaggucccugaaagauguuugaggcuugggauuccaaacuugguuuauuaaacauauagucaccaucuuccuaug

SEQ ID NO: 9266 - RNA, 36850 nt, Mus musculus
agggggugauaaggcagaucugaggcugagcugcuggcugggcgaggaugcucgguggaggcguuacuaagguuacuagagagaggaccgcaggugacaggcgggguuuuucucuauagcaauauacauuuuccaaugaaggacgugggcugggcagugccacauuguacuacauauuggauucccuagaggaaaaaggagauggcccaaaggaaaaaugagggaccaaagcagggagccucugcuuccucuuccgggccuuuucuuccgccgucuuuguuuacccccgagccauucuggcugcagcacagagucggcgcgccggagaacggugucuuaucgaugugacacgccucugagccgggccggaagcgguucccagccgguacccguagggccaggcgugcagcgugcggugacaguggcgcgggcggcggcgcugcguggcucuggaggaccggcgcggaccugcagcggcucgcugaggccguggcucgucgcugcagcugucaggacucuugggggcgaacuugccagacagagaagagcggaagggaagggguguguaaggagggccgugggcguguuugaucucagagaggacuuugaaacugguucuuaguaguugagucucauuuuuauuuugacagauucgggaggcagcagaugcccuauucucgagauuuucuuaauuccagucaguugauagcaugauuugagugagagcuuuuuagugaagcuacuggguuaagauagcucaagggauggaugaagcugcccgagauaaaaagaaauguggcgucggagcagagaagaggugucuggaaugaggggucaagaugaucuacuaguuccagguucuacuaguuucaggucuuccuguacuagguaccguccccaaacuauguaagcuugagguuugggcuucuuuacauaaccucuauguuaaccuuuacauaaguggggaaguaggagacgcgucugugccagccagaccuuagauucugcaacugcuccaggcuccacacugcgguuuuccaccaucaauauaugaagcacgugaggauggauuagaggguaguagaauuugaacagccuugaugagaucugcuaaaaggugugacgucuagguguauaaggcaaugauagcugucggucaggaagaacuguggcuugcaaaccuaugucuccaaagcuuggcuguugccuucucuuuagcauuuggugggauaaggaagagagguauauacucacacgcccaaguuugaaaauggaguugcagagacucacagaauuuaaugauuugacauagcuaccuuauuuaacagaaugacaaacagaagguagucaagaacgcagacacuggcuauccuagcuguacuugccaacacagaugcuaaaguuaaugucucuuuaccuggacuggguccuuucagcaauaaagauugcaacccaccuuuaccccuauuaauguguguuacgaauucuguacacuuacugacacaaauaccaaagcugaaaaauauuaucacuugaccuggacuggcuccuuucagcugcaggaguugacuauugaugauauacaguaguaaaaucaucuguacccuugcucauguguguuccaaacucuguguaaugcuggagucagaugccuuuucaggcacaacugacagcugaagcuuuucagcaauuccaagacuauccaucggaaaauaauaagacugacuaagccuagggguaaggaaacuuagcuuaaggagaccucagcuaaaacucaugcuuaaaaauuaaggaaaaaaaauuuaaucaguugauaauguacuguuuacaaacacuaauucuggcaaguugugccuaauauucccaagagauuguugaaacuggggccuuaagaaucaaguagauuaguuuaacuacauuuucauuccuaaaaugcaaguacuuauuuuuaacuugaaaaaucauaagcuuuauaaaagugcuuaucacugugucuaugacaaaguaauaauauagucacccagugcuuaauaagagagacacuuaaauacauuucugcagcuccuucauuguucaaacagcagagaguaugcuucuacaaugguacagccaucaaacaccucuacuacagacagcccccaaacuaguaucuuucuagacuaugaacguauauagcauguuguugcaauuauuacuguagauaaguguaaugguauuugcacaguuaggcauagcuacaauguagaagguauaguugaaguacuaagcaauaauuuguauuuuccuccaguggucugucuguggcugaaacaucucuagggggugugggguguguggcacaaauaaaagugaugcacuguugucccuugcauggagucgcuuugcaauauccaggcuuagguuucacuggaaggccagugacuaauguccuuauucuucuuauuucaaagggauuaaaguguuagguggcugcguagaccagagaccaugaucugcccagcaugacuuguaaagcuuguggcuguuuaagaucacuuaacucucagucuuguguuuccugaguauuuggcagcucggguccgcacggcugaccucgcacuccuuugcagaugcaugggcauggaggcuaugacucugauuuuagugacgaugagcaaggcggaggcuccagcaaaaagaggaagaaguaagucuguugauccauaguucacacuguuucuagacggacaugaaguauaacuaaauccuggaaaggguuuggauugacuuugcauauggaaacaacugcuguagcaagugaggguuuauucauugcacuguaauaaauggauuucaguuuggagguaguuguggggaaaaugaaguuuuguugugaaggaguuuauugaaagggauagagggaaaaggaaagauuucucuauugcauguuuuuuuuuuuuguuuuguuuuguuuuuuguuguuugcuuuuucauuuguuaagacugugugucugcaaaugucacagcuuaaaggaggcuugguugcuguuugucuucccagugaggugcucguggaggaugaauuguaauucagaacaguuguaauguugacuugaaugagcaggucagaguuggcaagaccaagauccucuagcauacaaagccugggcuucacaaagaggacacauuuuuguuguuguugucauuuuuguuuccugagacaguuuuauuauuuaguucaggcuauccuggaauucccuauauagcccaggcuguccuaagacacagucuucuugguuuagcuuugaaagugcugggguuccagguaugaacugcauguccagcuggaggcuacaucuucacaaaauugcuguguuuagggccauuguccuuagcuuucagugcuuugaaaugucaugguauguaguaacaggagggcuugauucguaguagcaggacuuagagaaguugguuuauuaucccauagugagacugauguguuaucacuaacuaggaaugaacauuuuauaaaaucggcagucuuuaucaauaacagaagaauaguaauaauuauagcaauguauguuuuuuagauuucuuucuuucuuucuuucuuuuuuucuuccuuccuuccuuccuuccuuccuuccuuccuuccuuccuuucuuucuuucuuuuaaaagauuuacuuauguuguuuauaugaguacacuguaacugucuucagacacaccagaagagggcauuggauccuauuacagauuguugugagccacuauguaguugcuggaaauuggacucagaaccucuggaagagcaaucagugcccuuaaccacugagccaucucuccagcccuguguuguuuuuuuuuuuuuagauuuucauuaagaaacauugcuuucuggucugggggggggggguguaacuaaguuaguggaaugcuugccuaggauauaggacgcccagguucaguccccagugcuguguaaaacaaagaaaagugacacaugcccuuuagaggcagauuaaggagcaucaggaauucagguuuauccuugcuuguguagugauuuccgggcuaucuugggcuagugaggauccucccucaaaagaaaugauuuaugaauagaauuugagcagauuuaguuggguacuguggucuaggguucuauguauccauaucaguaaggcuguuugucuguggucaguguccucuauagucaaacuuuccuuuccauauuuuuuaccuguuaaaucuucauuaucucuccuuuagagguaaauaacuuagggugguaaaugaucaagucaggaacugagcuaggaaccugcugcuaagaacuagccauuuucucuuaucuuuuccauuuuauaaguaguaaauaaaaugaagaagcaaaauguuucauuaaagaucagagacccauuuuaaaguuaaguccuuauuucauguuaguuacuuuucuaguugugagccuguuacccgacaagaagaaacugaaagauuugcuuuuggucaagauuuaagaagggguacagugagaagggguuccuauggaggcaggggcaugaaguagcuggucacauugugucuacagucaggaggccgagagcagauauaaagugaggccggguuauaaaaugucaauccaucugcagugauccacuucuuccagcaaggcucugccuuccuaagacagcugaggcagaggucacuggcagaauaccugucgagcugucacaaacaugggaagaguuagacagcauccuucaagaaaaauuaacuuuuaacacuuuuuuuuuuuacuacaccaggacagucgaagaugaguugcugcuuacaaaaccguuucaaaaagaaaggcauggaaagguggcccauaaacaagucgccgcagacuugcucgacagguguggcgcuuuggugcuaugacggacagccuuugcguuaagcucuuuuauaaucucauaaccuguggguuucauuauguuaauaaaauaugggcauuugaauuuaccuaaacuucuuuuuuaaacagggaagaagcaagaaauagaagguuucaucucauagcuauggaugcuguauccuuuuuauaguccuauuuucauaacuaauagaauauuuugcuuguuauccauguuuucugacuuuuaaaaaucaaaaucuugucaaguuaaguagacuaguuuuauuuuuacagguuaguaguuauugauauagaaauuuacgauuugaauuuucagguguaauucucuuuugcuaauauauaggaaaaacuagagguaaaaauaaugaaauaaauacuaguuguggucuauuaauagacuuuaaaguccaggaacuuaaaaggguucccaccuguucuugucaggcuugcucacuucccuuuacuguucucgucuucuugaauaucauuuuaauucauccccuuccuaccuggcucuugacuacuuuaaauuuucugcaaaacuucuguuuuaaaauuaagugugucugagugccaucucuaugugugcuguugcucuguuccucggguaugacugaagacuugagcugugaguuagacugucaugcaccgcuacucgggauguuagagaacaggagaggccaggcaagaccugaguguucacucccaggucaggacugaagagaggaagcaccacacuagagucaucugaugcauuuucaccucauuccuuuccuuuaaguuacuguguucuagauuuuuuuuuuuuaaaaaucucucuuaccuccuaauccauuggaaacuuaccuuagcuuaauggucuuaucucccauaaacaucuauacauauguucucccuucucugacacucucauugaggguguuagugcaccuagcgagaauaaaaauauaggugauauguuucugucaugguagagagaucucauggcugagaugguagagaaccccaguauuuuugggaaguaggcauauguuuagcuauaggaguagucaccaucuuaaaaguuagugauuuugcuaggugugguacacaccuucaaucccagcauucagaaggcagaggcuggcagaugucugaauuugaggccagcauggucuacauagugagcuccaagcuagccaaggcuacauagugugacccugucuaaaaaacaaaaacaaccaaccaaccaaacccaaaaaccaaaauguuaguggcuaucuuaguuaagguuucauagugaagggacaacaugaccaaggcaaaucuuauaaaaggaaaacauuuaauugggguuggcuuacaguucuagagguucaguccauuaucaucuugguaggaaucauggcagcguccagagagccauggugcuggaggagcugagaguucuacaucugucgucucccacccccccucaccccccuccccgccaacaagguuucucuguguagcccuggcuguccuggaacucacucuguagaccaugcuggccuugaacucagaaaucugccugccucugccucccaaacacugggauuaaaggcgugcgccaccacugcccagcuaacuucuacaucuugauccuugggaagcagaaggggauugaucucccacaaacaaccaggaggagaaugucuuccagacuggguccagcuugagcauaggagaccucaaagcccaccuacauugugacacaccuuguccaacaaggcuacaucuccuccagcaaggcgcaccuccuaauagugccacucucuauggucaagcauucaaaccaugaauauaugggggccaccccuauucaguccaccacaguagucuuuuagaguuguaauuguuucagucugugucugaugguguuuuuaaguugcuagccucaccacaaugucugggguagaauaggcaaaaaaaaaaaaaaaaaaaaagaaaggaaaaggaaaaggaaaagggaaagaaaaagaaaaagaaaaaaaagcccggggaaugaauguaguucaguacacgggcagucccuggugugccuuuuaaccaccgacuuucacaggcuuguauuuguuacauaugaugcccaaagugggacucguuaguuuaaagaguagggaggaggaauagguuuuugucuacuccuucuccuggaagccaaacucucacugccauucguguuuuugcucaaggaaaaguuguguuaaccacagcccugccuguugccuaugacugccucauguuacaguagcagagcugagcaguaacggcagaaaccacuaggcugcgaagccuguaaaauuugucuucuagcuccuuacagaaaaaaauuagcauuuuuaacagcuugcccguuuagugguaguuggagaguucaaacccaggccuugagguguuugucuaccuccccacucaauuucauguucuuauuaauaaguacucuaauucuaauuauuaauaauuagcauacacugugauuaggggaauuacuaugccuauaaggguguggucagugagguugagacaguucaccuugcaugugcuugaguauggagagugcugccuugguuuuaaaagaaacaccagguguucauauaucuuguuauugugcaugaaaaauauacauaguuguguagauucucugaauauuaaaaagaaaagaaaaaucuuacugugguuuauuuauuucauuuucuuuucuauuugagacacucucuuacccuaaggcccaggcuggccaggaaaucuuguugcuccuccugccuccaccucuugaaugcuaguacgauaggugugagccacuacaccuccucucugacuucuucggcggugguggcggcuccuccuccucuuccuccuucuccuucuucuucagauuuauuuauuucuuucauguauaugaguacacacuauaacuguacagauauuuguaagccuucaucugguuguugagaauugaauuuaggaccucuguucacuccggucaacccugcucccuccggugggccccacucacucuggcccaaacauuuauagacuauguuugaacacuguggcagucuucagacacaccagaagagggagucagaucucauuauagguguuugugagccaccaugugauugcuaggauuugaacucaggaccuuuggaagagcagucagugcuuuuaccugcugagccaucucaccagccucucucuggcuucuuauguuguguuuuauuuuugaaaccuuaauguucauggcauuuaauuuuauaaacauauccuauuuuuauauacuuuauuauuaauuauuacauuguauaacaguagaagauaaauuuuaauuuuuuaucuuuaauuuagaagccgcaguuuauuuguaauauuauuauuagacugaauaaaagaauaaagcugugugcagucuagaagcagacuagaaagcucccucuuuccccuggugguuauauauuuuuaucccaagaauaauguauucaugaaaaagauuccaaacauuuuagguaauacaugcuugaaagauuuucagcagaaagugaaagucugcuguguaguugucguacaugauuuacacauuuaaaaaugauagacucauaccaugcuuucuuuuuauuuaauaguauguuacaguggaacaacuucugaacaguuacagaaguccuuaauguuuugcauuucaguaucaaaggcacaccaaguuuguaaacgacuauauuuuguacuaugguggcaaaagagaggacuuuaagcgguugggguaaguauugucaaguucacauggcacgguagggcaaguacaaaugauuuucuaggcccuguuguaacuuucuuggcgacaggagcauucucaugauugaaccaggugugaugcugguaagagcaguacacuugagcaaugcuuugugucuuguugaaugagaccauugaaacgacgacacacuuagacuauaguguccaggauugcuuuugcaaaauuaaagcaauguccaaaagacuccccaaauauaggcuauugccguugcccugguugcucccuaggcauugaagauaaguccuacugcugaggacaccagacacuugacauaggauucagaugaccugagaugucugaccuuaaagcuuccuuccuaagggcuaccuuuccugguacaauugaaaaaguagccaggaugggcuggugagauggcucaguggguaagagcacccgacugcucuuccgaagguccagaguucaaaucccagcaaccacaugguggcuuacaaccaucccguaacgauaucugaugcccucuucuggagugucugaauacagcuacaguguacuuacauauaauaaauaaauaaaucuuuaaaaaaaaaaaaaaaaaaaaaaaaaaaaaaagaaaaaguagccaggaauuugagagcaauggagaggguaucugagagggguuggaggaagaaaagauaggauagaagugauguaauaacauuuauaaucuaaaaaaguaaacauguuauuuaaaaaaaaaagcaagcaggaaacuucacauaaaaauuauuccugugucgaggcuguugucuugcauggauucuucucugauuuacuaucugaguagguagggcccuaacgaauuuaacuauuauuuaauuuaauaguuaaauuagcuaccccauuucuaucuuccccuguccacugagcccauacugcucaaauguuucuuccacuuccuagcugagcaucuuuauuuuccuccugccuuuauuggucuuuauuaguaacaugauguaaaaucgcauauuacugagagcucguuacuuggaucuacucugaaacuuguucucacucacauuuccucacucagagucugguugagcuucuguguccuuguuuuggcaacaaagcaccaucuguauaacugacccacuguaggguugaguggaucugcuucucuauggaacucacuccuuucuugcaaguuuuucuuaaguaccuucugaaaauauugaauauuuuuuauauaaaaauuuccaaauugaaguauacuuuuauuuauauuuuuauucaaguuuuuucaaaacuuucagcaauguuuagccuaaauuugacuaauuuuaauuuuauauuaaauuaaaauuuuuauauucuagggagaaugauaagacagaucuggauguuauacgagaaaaucauagauuccuuuggaaugaggaggaugaagcagauaugacuugguaauuuuacuugauuauuuauuuguuguguguguguguguguguguguguguguguguggagggcagaggacaacuuguaagagggguucuguucuuucaccaugagcuucucagggcugaaacgcaggucaucagaauugguggcaggagccuuuacuaauuagagugucuugccagucugagacuuggugauuuuagccaauagcgucuaauggaacaaguguuauagucuugucuuuuuuauucuauauguguguguguguguguguguguguguaggaacucuuagaggccagaggagggcaucagauuguccagaucuguaaguacaggagguugugagccacccagcaugggugcucagaucugaacuaaggucuuuugaaaaacaacacaugcucuuaacaacccugagccaucucuccagcuccaauauguauugucuuaaucaucauuuaucaagguguucagcucuuucauagacaguuucugaaggauagaaaccuacauuuaugacuccugauucugguuugcuuccuuggguaaucuuugguaauuuaauuaacuuguaauuguuugacccagucuucaaaaauaauuaugcuacuguuuguugucuuauaauaagcaauuguauguuccuuauaaaauguuuugaauaauuuggaaaaacaaaauacaugaaagugguuuucaaagucagacaucacugaggguaauaagugaagaguaauucuccaucucauucucugagagccgccauuaacaaacaggucaucucuagacagucgucacaucugucuauauuaggcaucucuuagcauuaauauuuauagcauauauguaucaccuauuugauauuucuuccaaguaacaaacuguuguuggauuucugaauauauaauacauacuuuuuaugaauuuagggagaagagacuugcaaagaaauacuaugauaaauuauucaaggaauacugcauagcugaucucaguagauacaaagaaaauaagguaugcccuaggaauauuuacagcuggcgcucuuguucaacuacagcaucaauuuuuauuaacuaccaugacccacauuacucuuuccuggcacugauuugaaucuguuaucuugcacuuugaguaucauuuugaccacuuacccucuguggucaugggguuuaaagggucuauaggauuuaugaaggacaagugcuuuguguuugugagaucaucuauaaaaggcuaaaauuacacaguuggcaacuagauuccauccgggcugucaucuugagccucuagugauuaaacacuuuagaaugaugucucauuucauagaucaugcuuuaaaucagcaguuuuuugauugauugccauuuauggaguggcagauacauuuuuuuuucuacauaaauauuucuauuuugguaaaauuaacuuucagucaaugcuaauuaguaguggcagauucccauuuccacauuacaucuuuaguuaauauuaaagcaauuuuuauuccuagcucaacuuccauuggaacuagagaagguaauccaagaauggaugaucuucaguuggaaauguuaaaaggacugaguggcuauuuguauucuacuaagaaaaaaaauccauuuauaaacaacuaucuaaaagaaauucuaaggauuucuuuuuauuuauuuauuuugauuucuuuaguuugugaguuguuuucuaguucuguacagacaguagcaauaauuaccuugcauauuccugauacaaaucuaugugguugggguagaccaaagacuucucaguuccuuacaaacuaguugugaaugcuauugcauagcacuugucuguaccagcgaauuaccauaguaacuagucuggagucagcacaaccaccuggauggaguugcuuguaauuacuagacaguaagccaagucugaaauaccuuucuaggcccauguggcaaaguagauugccagccauggauuuuuuuuuuuuuuaaugauacacuccaguauuuaucgaaauuggacugcacccucuauggcugcggucucgaugggugugaugguguauaccuguggucucaucacuugaggcaguagcaggauugugaagucaugacuagcugaggcugcagagcaaguuuugagggagauacugucucaaaaaaaauguagucuagcuaaggagaacagauaauucacaagaguguuuaaagucuccauuuuaaaaauacuacuagaauuagggagcuggaaagauggcucagugguuaggagugcuugcugaggagucauaaggaccugaggacgagaguuuggauuucagcacccauguaacaaggcaggcaaccacacauauguaaauacacacacacacacacacacacccuguaguaacagccuggauguagucagagauaggaggaucucuaggacuugcuagccucuauccuagcucccacucccagcaaaauugcaagccugagggucagggagagaacuuacuucaaagaauagguaaggguacguuagacaccucagacacucuucuggcucucuuaugugcaugcacucgugugacugucuuuuuuuuuucuuccacuuuuuaaaaucuauuuagaauauuaaacaugauagaaguagaagaaaaucucuuaugaaguucucuaugaaaggaaauugugacaaguuucugguuagacagaaacuguuccaucugcaagggagaauacacagcuuaacugaaugaacuggguaguguuccuucuguuucuauuuuguggaauaguuugaagaguauugguauuaggucuccuuugaaggucugauagaauucugcgcuaaacugucugguccugggcuuuuuuugguuaggagacuuuuaaagacugcuucuauuuguuuacagguuaugggacuguuuaggugguuuaucugauccugauuuaacucugguacuugguaucugucuagaaaguuguucauuucauccagauuuuccaguuuuauugaguuuaggcucuuguaguaggaucugaugauuuuuuaaauauccugggcuucugauguuauaucucccuuuucauuucugauuuuguuaauuugaauacugucucugugcccucugguuagucugacuaagggucaaucuaucuuuugauuuuucucaaagaacuagcucccaguuuuguugaucuuuggauaguucuguuuguuuccacuugguugauuucagcccugaguuugauuauuuccugccaucuacuccucuugggugaauuugcuucuuucuguucuagagcauucaggugugcuguuaagcuucuaguguaugcucucuccaguuucuuuuuggaggcacucaaguuaugaguuuuccucuuaccaguccuuucauugugucccauaaguuugaguauuuugugccuuuauuuucauuaaauucuaaagucuuuaauuucuuuauuucuuccuugaccaagugaucauugagcagugcauuguucagcuuccauguauaugugggcuuucuguugcuuuuauugcuauugaagaccagccuuagcccugguaucuucugcaccugagauucucucuucuaucucuuguauucuguuggugaugcuugcaucaaugucuccugaucucuuuccuagguuuucuaucuccaggguugucucccuuugugauuucuuuauuguuucuauuuccauuuuuagauccuggauguuuuuguucaauucuuucacauguuugguuguguuuuuuucuaauucuauaagggauuuuuguguuacaucuuuaagggcuucuaccuguuuaccuuuguucuccuguauuucuuuaagggaguuauuuauauccuacuuaaaguccucuaucaucaucaugagaugugauuuuaaaucagagucuugcuuuucuguuguguugggguauccagggcucgcuguggugggagaacuggauucugaaggugccaaguagccuugguuucuguugcuucuguucuuaugcuugccucuugccaucugguuaucucugguguuagcuggucuugcugucgcugacuguggcuugucccuccagcaagccuaggugucaauacuccugggagaccaguucuuuccuggaggaauuuagguauggagagcugugguacaggguuggcucugggguacauucagaaaccagaaggauccugucccggcuacuccaugguguccugauugauggcuaugggugggucucucuugggccagaaauuugaacagaaaugguggucuuaccuguaaucauaggugugucggcacuccugggagaccagcucucuccuggcaguauuuggguauggagcacuguggcacaggaucagcuccuggcacagacagaaacuggaaggauccugucccuggcugcuccucaguucuuguguccugagggcuccaggagggucccucugagcagaaguggugacuaucuuaagaagaguaauuuugauagauguuauguuuuguuagaacaugguaacugcaugugaaaagaagauaggugauaauaagaaacgaaacaugacuuggguuugaguguggaaaugagagaacaggaaguuuggaggggcuauguuuggaacauguaauagcucuguguucuagcauaccauguuugacauguuggaaaaaguuuagcuuacaucaugcuuccagaguuaggaugcguuuuucucuuagcuucauuuacacagauaguacuuuauucacuuuaauuaagcaggucuuaauuaauuaguuaaucagugccuacuguacauagcagagccuuaaggcacgucuagugacucuuccuuugcucuguguuccuguuccuuucuuugaaaacuuuucauguuugaggcuguauuugaguucuauugagccacuaggaaaggagaagugggauaagaaaaaaggaaaaacacugcuuuaaaugagccaaaagcuauuuuucuuuuacagaaagucccaguagaucuguguugcaggaagcaggauucaggaccaagcccugaguaacugcagccuggaucccaugagaagaacugggguugggaaaggauauaaggagacagagguuacaaagugggacaguguagucucuuacuccccauaagauuauaacuuuccucgugauggauagugcccuguaaagcuuuauuuauuuuuguuuuauguauaucaauguuugccugcacauguauguguacugcauggguguauugugccuguggggaccagaagaaggugucagaugcccccguacuggaggaauagaugguugugaugcacucuaugcauauuggcagucaaacccuggucuucugcagcagcacuaagcgcucuuuaacagcugagccauuucuccaguccugaaauacaaguccaauaaguaguuccuuaaauagaugaaugaaugaaagaaaaggcuuggaaaacucuugcuaguaauacaguugacuuugugcuucaguagacacugcaagacaaugugggauggcauguaaucucuagacacagauauacacuaaagcauaaaaugaaagggagucacuuuaaaauuuuuacuuccuuuuuuugauacuuauuuauucuacucccccccauagacauggggaauuuuauuuuuauuugcauuuuaacuagaauguuuugacauuuuuuugaauuuuuguaugaauuuaagauauaaauuugaaaaauuaagaaauggaugauuuaaaacuugaauauuaauaagaaauugaauguuuuaucugaauuauuuauauuuuuccccuuuaaaaaauguguauggcuguuuugccugcaugucuaucuguguaccacaugugugcagugccuguggaggaaggaagaugucagcuccucugagcuagaguuguagguaguugugagccaccacauaggggcugagacuuaagccuggucgucugcaguagcagccagugcucuuacauaccgagccaucucuccagccuucugaauucucucguaguacacugagucucaggguuaagauauugaaguaauacccuuggccauaaccacagccccuguucuuguuaauacuguauacuacgcauagauguuauaugcagauguuauccuguucuuguuaaucuguauacuacgcauagauguuauaugcagauguuauccuguucuuguuaaucuguauacuacgcauagauguuauaugcagauguuauccuguucuuguuaauacuguauacuaugcauagauguuauacgcagauguuauccuguucuuguuaauacuguauacuaugcauagauguuauacgcagauguuauccuguucuuguuaauacuguauacuacgcauagauguuauaugcagauguuauccuguucuuguuaaucuguauacuacgcauagauguuauauacagauguuauccuguucuuguuaauacuguauacuacgcauagauguuauaugcagauguuauccuguucuuguuaauacuguauacuacgcauagauguuauaugcagauguuauccuguucuuguuaauacuguauacuacgcauagauguuauaugcagauguuauccuguucuuguuaauacuguauacuacgcauagauguuauauacagauguuauccuguucuuguuaauacuguauacaacgcauagauguuauauacagauguuauccuguucuuguuaauacuguauacuacgcauagauguuauaugcagauguuauccuguucuuguuaauacuguauacugugcauagauguuauaugcagauguuauccugccucaacuccuguagauuuuagguauuuuaaaagucauuuuuaacagaaguugguaauugucaggagauauccuuaaguucuguaaaaagagaaaaagccaucacacugauaguuaaguuuauuuuucaggcugaaaacgucaccaaccuuggcuuuguguuuagauuuguacauauauuaauuuaaaauuugaauuuacauuuauuuuauauaaauguacuuuuuuuuuuuuuuuaaccaguuuggauuuagguggcgaauagaaaaagaaguaauuucaggaaaagguaacuuuuuaaaaauuuuuacuuucuaauugaucacaguuuacuuuguuauauagaauugaaaucaccaggugagaauuuuuucuuauaaaaauaaaguuugggaaaaauguauuucugauauauauguuguuagcaaagaucagaauuuaaugcuuucaugacuucuuuagaauuugguccuuagaauauuugaggauauguggacaauguuuuaagaauuaaagauuuaguaacaaggaacaagugcuugauuaucaauuauaacaaaauauugauaguacugcauuccaacaaaaaucauuauuuugaagauguuaaauaucauucgugaacccaauagaguugcacuccagcuccagggaucgggagcccucuucugaccgcucccggcaccgcgccugacgugcacggauaugaguggcagggguguuuucugugacugauaaaggcucuguagaggggagggaaaggggaugaauuuaaagcagcucucuuuugggucagugaggcgguugguggcuaaggacaggugccacaccagccuagcaacuucauuucaaucccucaagcuagaguuaaaggagagaacacacucaacagaauuguccucugaacucuacaugcaugcacgcgugugugcucaagcacacacacacaugccgugcacacacaauauuaaauauacuuuuuggguuuuguuuuucaagacaggguuuuuccguguagcccuggcuguccuggagcuugcucugugaaugaggcugggcaggaacuugauccuccuaccucugcuuccugaguguugagauuaaaggugggcaccacugccaccaccauccccagcucccuaucccccuacucucccacccccagcuaaguaaacauuuuaaaaaauaaggcaauucaaaaguuuucuuaaggucauguuuuauuuuguaucuuuaccuaaaauuaugagauaucugagaugucacuaguaaaaauaucuguauuaauuuugucaagugaaauuuuuaggagaguauauaaaacugcuuuuaaaaaaauggcaggcugccggccgugguggcgcacgccuuuaaucccagggaggcagaggcaggcggauuucugaguucgaggccagccuggucuacagagugaguuccaggacagccagagcuauaaagagaaacccugucucgaaaaaccaaaaaaaaaaaaaaaaaaaaaaauggcaggcauucucuaaguucuuaaaugaauauaggacuaguggggaagcagagaacaagcuguugcucuguuaaaacaguguugugcuugcuguuuaacagacauuacuaaacaugcuaaacaugcuuaauuaauuagcuuuucauuugggauaacuuguacaauaauucugugacuuccuuacauacuucauggcaugacauguauguauacacacaauagauagauagaugcauacauacauacauacaugcaugcagaaaguguguuuuaaguucaagucguccucugcuacaugauaagcuugagguuagucuggggcacauaugcuagauccuggugcagacgacugaguuacaaaucagccuuuggaugcugauguuagaguuucauuuuggcagucuuuugcauuuuaugaaaaagaauuuaugguuucuauuuguuacucuuggugcaaauuauugugguggaaauuguucuuuguauaaaucauuuuuauuuucucuuucucuuuuucugccaaaauaguuuugaguugugcuuauguccaaaucauuuuuuuguccuuagaaguuuuuagauagaauuuuauguaaaugauauauuugaaaacauuaauuuaacauuuagcuaaauacugaaaggacugacaucuaagagcaugucuuuugggaaaugaucucuuucaggguuuuaguuaguacacuuacuauuucacuuucuaaaguguaagauucucuaauauggacucacuaaaauucuacuuaaauaaacaguuuaccaacaggaauugugugccagcuuuuguuuuaagaguucagcucuuuagcuugguccgguggcacagucucauggucccagcuacccuggggauguuugcaauucaguccugaccuuuagaacaaguucuaggccagcuuaggcaauguggcaagcaagcaagaaauaauaauaguguuuuuguuuguuuguuuuaagacuuaaugguaaaacaaacacuuugcaugcacgagguccuggguucaguccccacuguagaaggaaaaaagcaucucucugauuucauauuucaauacaugcaugcuauaguuauuguggucaucauuuuucaugcugacuuuguauugaauuuauuauauuuauuuuauaauuuuuaaaggaaaauuuuagagguaauagguucuuguaggugacuccuaucauguacugugggugacaguccuuuucuuuugcaggccaguuuuuuuguggaaauaaauguuguaaugaaaaagaaggccugaggagcugggaagucaacuucgguuacacugagcacggugaaaagagaaacgcacuuguuaaauuaaguaagacguguucaguggauuucuuccaaauuuaccuugaauuuagaacugaaaaaaauguauguacuauuuaauuuuaaaagauuugguauauuuuccugaaaguauacuuuuucccuguaguuuccccaaaccucaaauaaaauuugaaucuaaagucuuuagcauuauggaagcgcuuugauaagacaauucuaaugucagauuucagcugguaacuuguagagucaucuguuacaagcuugaggauggcacuagauuaggagucuaagucagaguaucagaaaggcaguguagaccucacaucugauuguguagccguaauuaucagcaauaaauacauuuucuuucugacagugagugaagauuuuggaaaaauauccuuuuaaaaaaguuuuuacguaacuaacuuaauauuaauuuuacuuaauaaugaguuucacuaugucauuuucauguauguacacacacacacacacacacguacacauaugcuauuuacucucucuuguccccucauacacugauccccuuuuucuuccucauuaguccucaugugugugucugugugugucugugugugugugugugugugugugugugugacccaauaaguguaguuaggguuacuuacgaggugagggauuauuuacaggacccacuuaccaguugcucuacaccugaagaaaucuucaggaguacagagucucacgaaucucccccaacuccacaaugauggacuguucaugcauuuaauagucugaagguuuuauacaaguaaucacagcugcugagaauucaaggcuguaguaguuaugucaugcucagaggacagaguuaugugacgcacugugcuaccucugggucuucuuuuuucuuuuuuucuucugcuuucucacuguagauguucccugagccuuggaggcucuaauauaggugcccuaguaagagcugagccaguuauucucagcacuuggacuaguuaugagucucugcacuaauaacugcacucauaauugucucucacugcaaaaaaguugagccuagcaccauucuggguaauuaggagacuauuugacaaccacaccagacuauuuaggaaagcaguagcaauagcuuccauacuaggaccagccacaagcccgugaccagauuuggaguaagauuuccaguacuucauguggacuuccuccuguagagugagccuuaaauaccauccagaguaguugguuaccccauaacagucaugccacuaucacaccagugggcaggcacaucuugucugggagauggguugucuaacaugaaggauucguggcugagcaagaccauugaugacaacucucccagaacccccugcacaguaccuucuggcacugugaaagcuaaucucuagagaggaagcuuccagcuccauuuccuuugucucucacacaagcaaagcauaugguaucuucaauugcgcugucuccucuggcuucuaaugggcaacuaauggcccuagcaccagucaguguuguuuaaaaguauagagaugagcuagugacaugguucagugggugagguaccugcuaccaagcuugacaucuugaauuuauucccuggagcccacaauguggaaggagacaacagaccauguaaacuguccucagaccuccauacacucaucgcacucacuguggugcaugcacauccccucgccacaaaguaaauaccauguaauuaggaaacaguguagagggacuggagagauggcuuagaggucaggagcauuggcugcucuugcaaaugacccagguuugauuuccguagccacaugaugauucacagccaccuguaacuccaguuccaggggagccaguacccucuuggccuccacagugagccuguaugcacauguccaggcauguguguagacaaaacacucauacauauaacuuuuaaaaauaaagaaaaagauuagagauaaauguuacuuugaguguuguucucucugaguuucucaacauugcucauuuaagaccaggucucuugcugaaccuagagcucaccagcagacagcaguugccuauagccaugguuuacaguguuacccugcucuuuuuuaaaauuaguuuacaucuuucaguugcuugcuugcucccucccucgcucccucccucgcucucucccucccucgcucccucccucccucccucccucccuuccuucuucccuuccuucccuccuuucuuccuuccauuuaugaccaucagcuuuucuggcucuguaauaaaucuucagaguuucagucuccuccugauaguacagauugguuucugugagcuccuccugauaguacagauugguuucugugagcuccucuuagaagcaccugucuggaaaagucagccaguuuggaaugagacuagggaaaagaaguuuuuauaguggauucucuuucuguuuacuugaaaguuuuuaacacuucagaggagauggcuaaacccaaauaauaaucaucaucaucauuaucauuauuauauacauauuauuacaucauguuauauuaagagagaucuuugaugucagauacuaauuuugucuaugaaacacaauggauaaaacuuuuucuaacguaccuuuaaaacaacauuuucauauguaacagggcugacacauauauaaacucacaaagacagcauauauaagaccagcacaaguucaaaccagauagaaucccagcaccuacaugggaaaguggguacauuaagcaggaagaaguuugugauugguagcugcugggaaaaggaaaaaaauaaguuuucuuuaaugagugauacuuuuuuuuuucaaaagagagagaaaauaugaauugggguggauagggagggggaucuuggaggaacugagggaagggagagaguaugaucaaauauauuguaugaaaaaaaauucucaaacauuguaauauaauuuuagauauacuguuagauuauuuucuuuguauuauuuccuguguauaguaagggauagaaagaacaugggaaauuauaauuaaaauauauagaguugcaauauaauuacacggauucagaagcucagugguauauuuuuucucuuuuaggauuaugccaagaauguuccuuuaaauuaaauuuucaucacagguaauuuuuuucuuuuaaaauaucauuuuuaauguuuaguaacuuaggccauacucauuuuaucacacugagugucuaaaucucaauuuggaaaauggauuuguuuagaacauagagcaucauuguaugauccauggaauuggagauucacucugcccucaucaagccaagcaaguuuauauguaaaggucuguguggggcgauagaugccuguuguuaauuuggagccaacgacuagacacuguaauaguccuagaaaugauauuauaaagcuggcugcauaaacuggagcaugcgugcaugccugccugcgugagugugugcccacgcguuucuuaggcagcuaaaggaggacacugaguguugugcucucugucuuuucccccguuacucacuuaaaacaaggucucugguuaaaccuggagcuugccauuuuugacuagucugacugguaagccccagcaauguucuugucuuuggucuccaccuuccugucccuaagcacugagauuauuggcgaacauggucacagcugacauuuaugugguucuugggauucagauucaauuccccguguuugcauugcagacucucuuacccaggcaucuuuaagucaucuggagugugucugcuauguugaauuaggagugccacuggucugcaccaugccuuucaugugagaucauuggucuugguuuuauuuuauuauuugcuuguuuuuuguuuugcuauuuuguuucgauuuuuaggaagacugccuucaguucauaaugccucugaggcuagccucacauuugugauucuccugucucagccucuugagugcuggcugggguuauaggccaacacccggcuuauuaaguuuaggaauaagcaugucuacauuguguucuagcuacuacaaauaaacaguacauuuucaaaaccagcaggauuuuuuauguuacuagaauggccagcccaaaccuuaauuuccuuuuucuguuagugaugcugagagauugaagguauuuugugacuuucccuuuugagugacauuucagaauugaaaugacuuugauaaaagaacaaauaggauuaaugacuaugcccgcaugaaagcaucugcauggguaucuuaaccagaagucagcugagcaaauauuugagagcuguuuuuccagguuucuuuccuuaagcaauuaagaugaauuguuuucaccugcuguacugaccagcagcuguuguucuaaaucuggccuagaaaagguaaagccagagcacuaggaagguaaacuaggagcugucuaacguugacaucggaguucagaguacguacuuuuagcuccaucccuggauauguuuacuauggucucuguucugagaggagagcauccucucucucaugugaauuagauccauuauagcccuugcuucuccagugcucacuggauaugaguuacgugcuaggaaagggaguggacauaaaaagugcacuguuuguguagagaauuuacaaaauagcucuuugugucuguuuaggcuuuaucaucuuacagaauuaucuuaauuuauauaucgaccuaaaauauuugcauacucuagcauggcagugguggcacauaccuuuucucccagcacucuggagacagacacagguggaugaaccucugugaguccagccuggucuacagagugaguuucaguacaacuaagauuauauggggauaccguaucucaaaaaaauaaggaauaaaaaaaaauuacauacucuuucaagguuccuuaugauauacauucuauggacuuuaacuguuuucuuuaauucaaacauuuuuauggaaucuguugaaaaaauuaacuucaguauuauguuguuuaacaugaaggagaaaagaaaucaagucaacaaagaaaaagucuaaaaccacgccugagugugacgagucaccucguaagaaauccagaucgccaccuucagaggaagcuuccaaggggaaggaugaagguaagagaggacuaagagcugcucaucucgagugugagauacagacggccacggcacuggucagaauccaucuggggaugugcuuagaggucucuuuuagagcaacugaaagcgaaguggucaagaauucagauguaaauuuauagucgcuuguagccuguuaagaacagaacugguuuugguuccuuuuggggcauacccuauaguauuauauaacgcugcaagcaguguucggcuccuggcuguauccaagccauguuacuuggcuaagacacggacucuccugggcuuaccuucuccauguauguugggguagugugaacaccugccugcauauucauaacagucagaugagaauuugaaggcuuucucagacuguaaagcaguuuuucagucugucauucaaucuaaaaucuugauuauaguagcugccuuauaggauuaugagaaaaauugagaucguuuauuuagcaauuugacuaaugcccgccguguaauucauuauuaagaagguuucuucuaguugcuuuuucgcaccaggagguaaucagauacaacuuuuacucaauuuaacccaaugcuaauauaagaucuggacaggagagggcccccuugcucuagauaggaagauacuuggcucaggugcauucuuuugugcauuuuuuuuuuuccuucuugcauaucacaauggccaugcaguucaaguauauaguauaaaaugucacugaauuggaauggcugguuaguagacguauuauucuguuguuuauugagagcuggcauuugaagcugaaagccuuuuuaugucuaucuuauuuccuaacuccacaauaagucucaauaaguauggcaaucucaauuuaauucugaguuuuaaauuuaaaucugaguuuaaaauuuuguauuuauucuaauaugcuguaacaguaauaaggcauuugaaauuuugguuauguccauuauuaaauuaauaauauuguuaucuucuuaacgguaaucauaccauguaaucauggcuuauuauaaauuaaggaagagcucaucucuaccuagaccuuuuuaauuugaaauaaucuuuaauaaugacuaaacaucuagacaguuggcacuccugguucuaucccuagucaucccuugccccuuugugugagacuguguauucuauagcuucaucguuaccccauagaaagugcuaaguaagugaauggcuggguggacagcugagugccacauggcagaaugagaaaacuaagacaagucaauagcuuguguuugaagagugguuuugcuuucgcaagaaaggaagaacuaaauacuuggacaaaggcucucuaucuccucuccccauuucccucggagcagccucacccucacuuuucacuugagcucaguuggaaaggcccuucuuaacaacgucugucucacuucuccaacccagcuuagaucccuaggguacauccugaguacccuguacuuguuuagagaugcacaggacccuggaaaucauucauuuucugugagagaagggauuacguagcuguuuaacucacccccaauuccuaagaccauaggcauuuauuuaguagauauuagugaguggaaucagugaauucauucauuuuucuaauaguugaagaaacuccagaaaucaauccuaaacauaaucaaaaagauguuguagaauuuugcuuuucaaacuaugaugcucuguuguaagcagcucuaaauuggucugaaguuacugucugaagccccugugauuuguggguccucacacacagacaagugugcaagagccucugcccuguggcguguggugguucugacugcuucagcauuuccgggaagaggagcccacucaucccacagucgccuucccgucagauggugccagcagguuucccuggacaaacuacaccuucccacuuugggccuacuuauaucaauggguuugcagaguaaaccuaaccuuuccaccuacuuuuuaaauuuuuuuuuuuuaagauuuauuuauuuuauuuaucugaguacacugaugguugugagccaccaugaaguugcugggaauugaacucagaaccucugaaagaacagucagugcucuuaaccgcugagccaucuuugcagccuccacccacuuuuuaaaagcccauugaacaccuguacuucuuguauccccuuuggccucuaaaagacuaaaacuuaggcuucuccagccucucauccaguuuuguuggguggcuauuuugucaucugugcuuuuacuaccccccagaaaucucucucaugagggcucuguagagugguguguguguauauauauauauauacacacacacacacacauacacauauauaauauauaauuaauauauacuaauauauuaauacauauaauaauuaauauaauauauuaauuaauaaauauauaauuaauacucauaauauauuaauuaauuaauauauuaauacauauaauauauaauaaauauauaauauauaauauauaauaguguauguguauauguauguguauguguauguguauguguauauguauauguauauguauauguauauguauauguauauagcugggugguagcagcacaagccuuuaauccuagcaccugggagguacugaaaggcagaucucucugaguuugaggccagccugguuuacagagcaaguuccaggacagccagggcuacacaaagaaacccuucucucaaaaaacauauauauauacacacacacacacacauauauguguauauauauauauacacauacacacacacguguguauauguauauacauauauauguuauuuacuuauaaaauauauaacguuuaauuauauaaauauaauuuaacuaauauaauauaauuaaauauaauaaacauuguuuaaguauaucaauauauguaauauaaauaucuuaauauaaauauguauaaaauauaaaauacacuauauuauucuauaauauauauaccaauagauguucuguacuuuuugcuuuuugucucccucaauaacuauugcagagaugaaauuuuuauuuuuuugacaaaauaaugccuugugauuguggacaagguuggcugggaauguggcucagugggagagcacguguuugcaugcuauauggaaggaggaagcccuaacuccucgcuaccuccauuucuacuuguauaugaccuugaaaaaagucuggagaauagauuucuguacacugugcagugggagggcugagcaucucugcaaaguaaaggaaguguauuaguguugcuguuguuacugucaucauuauuugcagccuuugaagaguuguuuaagccauguaagacuguucauaggcuuucaguuuuuaaguucuauguuagcuaucagcugucccaggcucuaugaacaaauaagaugaucacugucuaaaaggaccuaauauuuuaauugaggaaauaaaacuaagagaccugaaaguaguaaaaggcuuuucccccuuuuucuuuuuuucuuucuuucuuucucccuuccucccucccucccucccucccucccucucuuucuuucuuucuuucuuucuuucuuucuuucuuucuuucuuucuuucuuucuuccuuccuuccuuccuuccuuccuuccuuucuuucuuucuuucuuucucuuucccucuuucuuucuuuccuuuguuuuuuuuuuuuguuuguuuguuuguucugagagcauacgaaaauuugugaagaauuuauagcuuuagcuacaacugucaauaccauccaaagaugaugcuugguaaaacaguguuuucuuuucaggacauucauccucaaagaagucagaagauucuagaaacaguaaguaccaagcauuuaucauuagaaauguauagauucaaagcacuugcaauuuggguuuuuuuuuauuuguauccugcugugaugugaauuauauuuauuauaccaugagaagaaccauaaaggacaaaaaguaaauauuuauugacuuuuuacaauuuuauuguaaacuauuuacuuuuuuacaauuaaaagucuuauuuuaauuauagaaagcaucagaagugauuuucaguaaacuugcugagugugcauuucaguuucacacuguacggugugcaggaagagaaggggguaagguuggacuggggaagggaaggcagguaggacuuaaagaaagcucaggagucugguggccugugcugccuuggacgggacacacagugcaguucucgugugguuccccugccagaagcccuugcucugaguggugcguucaccacuuccucccaaacacuuauuuuacuggaagauugcuacaaagucuuauuucccaugaaaugcuuccccgaguuuucacagugacuuacaaaaguacacagguuguuuuaaaauuagugacauaggaauacugggaaacaagguggaauugcaguauaaagguagaagcaagauguauuccuuuaccaaagcaugucacaugacugucgcuguucuccccacagccaaagcacaaugacuaaugcucuuuugaaauaauaaagagacuguagcgcuuauuuaauguuuucuggcagcuuugagagaaaucuccuguaggauuagaaaaggggcaugcuuuuuuuuuuuuuuucuaauaucugucugugguagaaauaaacuacuuuuggguuuuaaauuguaaagguuucuuuuuacuauuuuuaaauuauaucugugaguauaucuacucuagugcaggugccauugaagugcacacaugagccauggcugccuuggagcuugucuuagucaggguuuuacugcugugaacagacaccaugaccaaggcaagucuuauaaaaaaacaacauuuaauuggggcuggcuuacagguucagagguucaguccauuaucaucaaggugggaacauggcaguauccaggcaggcauggugcaggaggagcugagaguucuaugccuucauccaaaggcugcuaguggaagacugacuuccaggcaacuagggugaggaucuuauacccacacccacagugacacacccuuuccaaccaggucacgccuauuccaacaaggccacaccuucagauggugccacuaccugguccaaggacauacaaaccaucacauuggauauacaaaccaucacagagcugcaguuguagacuggcgagcugcugcauguggcugcuggaaaccagcguagguucucugaaagagcaguauucaccccuuaccacugagccaucucuccacugcuaugccucccccuccguuuugaaaagauuauuuuuuuuuaaauuguaauguacauauuuauuuugagacaaguucaagcuauucuugacuuugcaauccgugugucucacuguccaaauuucuagcauuacaggcaaaugccaucagggcuauuaaguagaugcccugagaaccagagagcucaaggaaauuauucaaggcuaaauaguuaauguuaaagauaggcuuagagacaaguuuauaauccccaacucagugcuguuuugcucuuacuaccaauaacuguucacuauuggugagucaaaugaaagccuauagucaaauuguuuauauuguaaugagauagauagauagauagauagauagauagauagauagauagauagauagagagagagagagagagagagauagguagauagauagauagaaggaaggauagauggauccaucuuaaaugauugguccaugucuugcuucuuuuguagaagggguauaaacaggccaggccagcuuuauugaauuauugucaaaagagaagauauauacaaaaagucugucucacacaaaggaaguccuugauaaccuguagcucuguugcaaugccagcaaaaagaaaaaugccagacauuaaacagucuguauuugcucucugaauugaucagaucaaaaguuaauaccugaccauuuauuaugguuauuagagacauucgccauucuucaguugaaugaguuuuuaguuaucauauaacauccacaaaauguaagcauuugggaaaaccugaagcauuaagcaccacacacuaaggagagcuuugaaggcugaagcagaucagacaccgagcagccgguaugguacaaguacugaaguugugccaugggaagaauguuggcgaacuaucgauguuuaguuuggagaaagguggaggauacgaggaggcgagcgugagggugaggacauaaaacuuggagguguuuggaggcuguuacucgaugggagaaguaucuuuggugauugguucauggagucuguagauaaaaagaaccugaaaacacauuuuguccucgauuuaagggaaacugucccuuggaauucucugacaaauggaagugaacugucucaggagacagauuggauguggcuuguuaucacaaguaccauggugacuggguucaucugcaggcagagcuggaugagcaggcccaagagaccaguagcacagcaggccgcggcucagcagauccaggcuggugcugccaagccugaagaccugauuugacccuugggacucacguguccaaugcgugaccugcacacacgcauuguagcauguucgcauuauaucacacacauaaaugugaagagaagaaaauaacuaauucuugcccauaaccacugcagacuugacagugaggcuguaagagggccguuguguauagaccacucuaccugucugucauuccguagugggacucuuucaccccuggcagaugguuguagugguaacuguuaguagugacucccguccucaggguaucaagaaguuuuacucauagaguggaaggaacucuacagaucauuuagucuauuccuauagauuugauucucugagguaauuugaccacuuuuccaauggauacucugucagagggauuuauuuuaagaugauuuaacuuuuuaaaaguaaaauuucauuaucugguauuagaaaauugaugugcugcugggcuggggcaauaguccauuugguacagugcuuccgugaaagcaagagauacugaauugaguucucagagcccacuuuaaaaacugggacaaggucagcucagugagugaaagcgcuugccaccaaacuugacagcuuaaucccugaacccacgugggagugggauagaacugauuuccauagcuucuugucuagccuccauacuguguccugcaugagcaccccugcaugagcaugcacauauauaaaaauaaguguaugauaaauguccagguauaguugcacacauuuucaaucuuagggcugggaaggcagagacaggcagaucucuggguuugugucaggcagccucaccuguuuaguaaguucagggccagugaaagaccccuucuguggacaguacccaaggaacaacacuagaaguugaccuuuguccuucauguauacacgcacacacuauacuuaugcauaccacacacagacagauagacucauacaaaggaaauuaguguagaaaagcugacuuguggaaaguauucuuaagagggaacagagugaacaccagagcuguuugcaguguaagauuuuacaaucaacugcuuguuuuuaaaggccauguagguucuguucucugacggcuggacaguaaugccauauagagaacuucauuaggcauaauuggguuuucuguucuuucuuaucucagcaaguggaagauuuuauucuuucuuguguuaucaguucaagacacugggaacuguguugauggcugucacagagcaggaaucuuccucuaagacuuuauaguuucaucaucauguguacauagcucauuagacagcacccucccccugcuauuuguuaaaguuggugccacaacagguucaguuaggaucaaaguucaggcauacacauugauucaaagaucagaguccagcagguaaaaggcuagaaccaccguggcaaaucaaugcggcuuuauuuuuguccugugcugaacugagggacguucuguacuggcaagccaaauccgaguuaagucagaacucuagugguaacucuccaaggcaauuagcucuuauuacgucauucuugaaguagcaucuuuucuuuuaauccuauggacguuguguaaguuaagguuuguaaagagcacacuguguuaggaugagcacaucaagauguucucuuacauuugaaagaguauuugucaaacauuuggaaaaauaaugcuuauuacuuuagaaaaacuuauucugagaagaggaggccuucucagacauuguuuggaagaauggaaacucucuaaccuuucuucuggaggaaaaccugacccuguaacuggguuagagcacaugugguggccaaugaugcugcuuuuggaauuugauauuuuauuuggaauagauaagcuccucagauaaacaugggcagaaaugcacacuguucaccaagaaaaacagcgugguggacugugugcccgcccacuguggagcucuugcuagcauguuuaagauccuggguuuaaucaccagacugcuccccacccacccucacccccaauaaaaauaaaaaugggaaauacagccuaaauccccaccaaucagaaauuaacgauugguuaaucaaauuccauauaacaguuuuuguuuuguuuuguuuuguuuuguuuguuuguuuaagguuuucacagggcuagauagauggcucuguggcuaaagcacauauuggccuuggagaggauccaaguucaguucuagcgccuucauugggagaucugacaccucagcccucugcaaacaccuguacauacauaugcaucauucaaaacaaagauaaauccuagaaagaaaucucauuauaaaagcuuugacauauuuauacguauugucaaggagaacugucucugcuaucucaaauccuuuauaguuacaguuaugcacaguauaaucuuaauuuaaauauauauauauauauaugaaugauaccuuuuuaaagaccaaccacacuuaaaaagugacuguauuaccuguggccugggguaacuuuuccuuaggacuuuaaacauuuccaaauugcuuuuauuuuagacaguggcaguauguauuaccuauaaaaucaguaaagauaauauauuccuauuuuuaaaauauaacaaaauagaccucacaugaauuaucuaaacucaacuaaaauuuauucaauauuggauaaaguaguaucaggcagacaaacuauuccaugauguaauuacauuaguaaguggcucaucuccagugaaaacccuuagccuacaggaacuaaucuugaguguagguccuaauacauauauguucuuuacaaaauucuucauuucuguuguauggccaaggaaauaauuaaaccagcugcuauuuuaguguaacauggggaaguuguucauuagauauuacuugcauucacuuuuugaugaggcucugguguuuuucauauuguuuaauuuuuuaaaauuuaugguaucuugaggaauaaguuaaauuuuguggaaucauagaaguugaagcuaaaauacugcuaaauucaugguuaauuuaauugcacugguaaacgauucagaaugcguuauguuaaaacaaugacgacauuuccuugucaaugagcaggaaacgcugaggaggaagacagugcuucagacucugagcucuggaaggguccgcugccagagacagaugagaagucccaguaagugcucauucgcaggugcuccauccuggccucagcuuagcaucuguggguacugccguucuugauagcaguugaugaaaauauuuaaugccauggauguugauuuagugccaaagucucccuauccugguaaggugcaaguuuauuaccagucauuguuuggggaugcaagcagccaguaugugcagcgucaguucacuuuaacaggcagcccucuguucuugccuggauucuuuccgagacggcugcucagucgcaucuuggacagccugucccaugguguuaggauucucguaacccauuccaaggagccccuugaagauuuacacagguguaaggaugccuugccagcagccaucucagccucccacccacaggugacccagugcacuuguucucugccgcccuugacuccagagccugagcugcuggcuacuugaggcuggcugcaaacacuaacguuauuuagcacuggguacuucucaccguauuucacagguuauacugaauguggcgucuccucaaagcucugcuuuagaugaaaccucuauaaacuauaaauagguagccacuguucccagacuaauaaagcacuguggccugaacagauguccucacauuccugggaguaagacgugguuuguuuuuuagacauaguuucuguuucaggcauuucuuaagcagguuguaauuugaaguagugaacagagaagguacaaagucaaccagaaaggcaaagagaagcaauggucuuucacaaaguacuucaaagaaaacugagggguuuuaagagaggugaaguauuccaguuuuaaucauucugagcauagauaggauuguuuagauacuaagaauuauuugaauuaugaaagccaacugguauaaagagugauagcuaauauacuagacgaaaauauuuuaauuaguuucauauaucacuuaauuuuuuacucuauugauuuuuuuaauuuaauuuucauugaguacucuugauuauaaucaauauuuguacuuuuuuuuaauagggaagaagaauuugaugauuauuuucaggauuuguuucugugaacugggagagagaaucuuauuccuuggugaggagauguacagagacacucggugaguguguccaugcuguugagucuggacagccacugggauagauccuucagcagcacgggacauuucagacauuuccuccuuuacuuucguggcugcucggcugcuuaucuaaaaccugguuuuggcucuagcucuacaguuuaugguauacuuguuucaagugucauuugaacauggagugauugucauugagcuguaaauaaauuauuuagugucuuauucuaaaaugucagagucuuuccuuucauuaaauaauuguuauuaacuuauucuggagugcucaccaggcuucuggugugcaugagcugcuaugcugagcacugcuuugaaggagcuauuuugaaagucauuuuacaauccuuucugaacgaucagaaagcagcaaaauuauugccaguguaccaguguuaaauauuguguaaaagucuccuuauugccucaagguguuguuucuuuauaguaguacuuauuuugaguaaaaagaaauacuugauuucugagggaaauuaucugaaacauccaacaucaaaguuggaguuucuauaauaguggaauuucuauagcuaagcauucuuacaaugaaauauguugaucauucaauggucaucagaaaauaagaguucugcaaaauuaaaugguaacugggaagaguacacaccauuuauaauagaauaauauguuuuggauugacaauacaguuuaugauacgaaguucauguaugaauuuagauaauuauauaaaaucccagcgaucuagcacaguggccaguaaugggagucauuuuaaggagucuuugcaagucuaagguaauguuagacaucaacucuauagcuacuucaugcuaugacuccguucagucagugauggucgccaggcccuuggucaggaggcugugggguucuacuuuuagauuacagagacucugaagccaagugcuuauuagagaccuucaucagacacgacaguugccucaauucaauugcuaaugacuaagggaggagaaguuacuugagcugauugauauuuugga

SEQ ID NO: 9267 - RNA, 15190 nt, Mus musculus
caaagucccuccauguaaaucacaguccugcugucuucuguguuggaacacaacaaugcugcuggcucuuuacccugcaugucugucuucuccacucgguaagucuagauaacuguaacggcagaaccgucuggguuuucguuucggccccccuuccagaagcccacacaucuccucagcagucacagagaaggacaaccacauugaaaagcuucccgccuacccucccgauugcagcuccuguacagcagcaggguaucgcuggucaguuacccaguuccagccuugagagcaaacugaaacgcuccaaugugugcccagucagaucugccagcuguacggcccaagagaaagcgcagugugugaaagcgcuugcugagcaagucugaugaccuaccugaguuugaucccugaaacucccuguggaagagaaucugcuccucagagucgggccucuggccucugcgcaugcgcaguggcauucucauccauguacucacaggcacaucagagagagagagauaaguaaaaugugaaacauuuuaaaauaaauauacuuaaacugaguggcccauuuaguaggauaguuaagaagcuuagauguaaucuaccaacauccccuauaauuaucauuuauccauauuuuauagaacauuaauaaacuugucuauaaucauaaaacuaguaaaaagccucuugagguauaaacccagguuugccuaauuguaaaacgugucaccacgaugucuauugcccuagaaagaggaauacugggaggagcaagagggguggcuuagacgccaaagagccccuggaagacaugguuaccaucucugucagacucuuaaagaacuaauuucugccauauuuccucauguugugcauuagacuuguauacauaagcuaagcaacuuuguaaauccuucaaagauaggggugacuuucggucaguucagcgguuuuuuguuuguuuguuguuuuguuuuuguauuaucuaccauagugagcugcauauaguagguguuuaauaaauagccucaauaaaauuuaacuuguuguauucauaagugugaagcuuaccagugugcuacuaggaacauuucaggcccuaagaguguguuuaugugucuggcagauuacagaguucugauuuuguuuguuuguuuguuuguuuuguuuuguuuuucgagacaggguuucucuguguagccccggcuguccuggaacucacuuuguagaccaggcugcccucgaacucagaaauucgccugccucugcuucccaagugcugggauuaaaggcaugcaccaccacugcccagcugaguuuugaauuucuaauuuaggauuuagucccugggcaguuccuggaauguuaccaguggcagauaccauccaagcagaucggaucuuucuuuguuucuuaaccaacuaaaugaccaugagcaaauuaucuagccuuccuaaaugcuuuucuaucugugaaacaaugucauaaucuuagaaucacagaggaagagacgacgaugcagaaaaagcacuuaguacaguagcuggcucagagucaguacccaguaagcaucaccuguuauauuucaaauacuaaaggacgcauccuaugcuacggguauuuuauuuauagcugucaaguauauauggcuacacaaggccaagggaaugaagaagacaggguccuagugucugaggcccaguuuugcuaagacugacuucuagauccuugguuagagaggaagcacccugggcgccuuugagcagcugccugugggucuaccuuguucucugggaugacuaugccaaaggauuuagauauuuugaaagcacugccguugccuuuccugcccuuugcucuugacucguggauaguccacaggcaggauucucugcgggaugagaacgaacuggaagguaggaggcugcuccauagacaugcaaacaggacuguugaagcagggggacuucagcuauuucauuucugcccucuacuagguagcaagcacuguuuuuggagcuuaggcuucagguagaaugagaugauaaaaaaaguggcagguaggaugcaauccugacccucaaggaugcgaaguuggcuaggacuaugcaaagauggcuagaucaacaacuaaccaccucuaaggcagguugaauuaugaccccugcuccuggugaaaccaaugggcgggcaaagccagaagagggagccaccacauguaaugggcuagguaugaaugaagauuccaaaguguagaaaagucaggagaagaguguuaccggugggacaagugaccugagcacagaaugacguagugccuaggugaugggggaugggaaaauuguuaaaggaacuacaaaugugggcaacauggagagcauugggguaggaggacaagggucauuuugaacuucaaaacauggcaucuuuaaaaggcuggaugucgcaggcaccaagccuacuaaaaugccuucacuauaaccaguaggguuggcauguuaugauacuagcaaagcugagugaacugagcugugauuugcuaguacaguguucuauagaugagcuuguaggaccaaugccaggcaaccauuuagaaucaguuugaggugaaguaacaaaaucugaggcagugccacagcuauaaggauacgaucacuacccuggcaauuuagauuaauuuuaauuguaaaauuugcugauuugcaacauaauuagaaaucuguagguccaaaaugcaucauaaaucuuuuucauuuccguggugcaagaaguucugaugcauugaaauucuguuuuaaacauugagaaguccuguucugguuggaaagguaauuuuuaaauuaauuugacaagaggugucaaagugagagaagugacgucauuugaauggcagagaaauauugaauuaucuagugcuucccucauauuuccagcagagcaaaucucaccugcauauucuugguugggugccagaguccagcuccagugggguucaggucccaaagagguguggaguuggcgaggaaagaagacucacacagucugagggugguucaggacagcugguuuauugaagaaagacaacaccuuuuuauacucuauguuugcacagcagcugaaucacagguaaugcugaaagcagacuuaaugauuccaagagauggaugaucuucucacagaugguuuuaaaccuguuuuagaccgauuuuucaacaucgagaaugagcgagguaaucaacuuuauuacaguauuuuucuuugaagcaaaagcaguaaguucagcaagcaucuaagucuuuauuguuuucuaagauucagcaaccccacccaagugccccuuuccuccuguaggcucccagcuuuuguagucaggaggucccagacauuugaguccugagaaacaagcccagaagaacacuuucauuccucaaggggcaguguuugcacccuggagcacacuaagcauugagcugguuccuacuugccuuccuaggugccuuagucuuacaguauggaccuguucuccucauucucuccccagagggaagcuccugguaucuuacucuucuuucauuaugcuguaccauccuccuucaguggaugcuccuguacauggcagagggggaaucaagccagucuaacuucuugacagacucugcuccucauagggauaccauucauccuguaagucacacgccuggggaaucaguuguggacacuauccuauacucagaaacugaacuugugcccucaacugcuaaggccucagacucugggucuugaugauuuuucucaauuguguguuuucaucuuugggaguagguguaagugccuaagaguuccuggagccaucuuucaggugauaaaucguuaacgucucugcucuuggugcugaggggcacaaugggaguucuuaugugggagucggcagaguuaaucauguugugugugguuccacggugcagagacuguucuccaaagaauuguuuagagagauugccauuguacacauuuaugcacucuaucuacuaaagcucauauaaaauuccccaaaagggaaaaaaaaaaaacauaaggagacucccauaacacacaguaaaaguccaagaugaagguaaaaggaugcuggagaauucugguucacaaucuuuuuuuuuuuuuaagauuuauuuauuauuauaucuaaguacauuguagcugucuucagaugcaccagaagaggguaucggauuuuuguuacagaugguugugagccaccaugugguugcugggauuugaacucaggaccuucggaagagcaguuggugcucuuaaccacugagccgucucuccagcccgugguucacaaucuugauaugcuggaacuuugucaagcaacaguagucaccauguggcccacaccaguugaagauaguuuauaaaaauguagaaaucucucaaaaagugugugugugcaugcaagguguggguguaugcaagugugcuuguguguguguguguguguguguguguguguguguguguguguguguguguagugaugggaacuggaugguuacagaaguaucucaaauaauugggcagaaagcacaaccagaucucuugggauguggggcagaaaacaacauggacuaggcagcugcucuccuccuccuccuccuucuccuccuccuccuccuccuccucuuccuccuccuccuccuuucucuuccuucucccucucucuccccucugagguggacacaaugaacugccaagaugcccauucaggaauacagggcuuuucgucaaggaguucaguagugagaagauggacucugaugguugguaucuuugcagauggcuuuggcuaagcaacagccucgccugagcccaugccagagcccaugcuuccuuccaggaacagcuuucuuccauaucugaggagaaaugacauaucuauaaaagugaguucucuugcuccaacuugggacaacugaaaagagacauuucaacuccagagcucgcgagcucuggagcugucagaggcuuuuguuagcaucauugugccccuccgccuaauccugcucccauucccuccuucccagaugucgacuuugagaauauucuccaacaaaugcuccagcaaccguuuuacacagucugguuaucagggcggccacccuggcaugccacaccucaucaugcgucugacacagucccucccucccugacuuucuuuccuuuguguccuccccucccucuaccccuccuccuucucccuuuucucugcucuuucccacacacuguguagcaucucacuucugcuucuuuucuauuucaaccgggauccugguacauacacgggccaugacaaccguucagagauggcuucggccccuugaucacuaucauggugguauaggcuccugguaccccacccagacucccauucccaguucacauacucacuccacaguaacugggaucagugaccagugacagcuuauguguaguguucucuagaggacgaucauugguggacugaaaccucuucuaaaguugcccaaaagugauacucuucacucuugggcuaguguggcauaauucacacucuugaguccccaugggacgaguccccacugggaugaggcugagaccaggcaucuaucuuuacccaacauccuuuccuauccuacguugcuccuuacuuccucagcaaaccucucugcuucuagaaaccccaauuuaucaccuugccaaucuggcgccuguguuaaaaguccuagccucugugguccuaguuccaaauauucaagggagauaacugacuuggagugcacccagacccaguuaucuguggccagaaggggcuagaguugaaacucaguuggaucuuaaaugauuuucucuuccuccccacucuuuucuuguccuguugaccaucacgcauauaagcuggagagugaaaaacugaaagauaacaccugaugacauaagguagacaggccuggaugacagucugaauucaagcagcucaucacccagcaucguguuucaggcuuuaaggaaaauuacuaacaccgcagacuguggaugcacagucucugcacccgagaacagugcucgguacaagguaagaacaccgaaauggcguugaguagaaguaguuauccuuuaaaagguauaguaugauccaaaaguggguaaugugcugggggugggggugggguggagccuaccagguagcuauuguguggagaguguucacacaggccauucugcuccugugcuccauuuaccuucugaugacuauggauguguaacaaaucaccccaaacagauccauuuaaaacaaccacuuuauuauucucauagaguccgggucacaaauuugggcagggauauuguggauggcuugcugcucuuuaauggcugccccuuaggugggaaggucugaugucugguaggaacuugaccacacggucuggagcuguaggcuuuacaggacuggugguugaugauggcuguuggcugcaacaccagcugggccuguugaccagagcaccaggaggugguugcucccgaggggauugguuuucaacaaagaagaauggccucugguuagaaagacuucuuaugcagauguucugggcucugcaggcaaguguuccaauuugcaaggcaagaaggaguucaugguuuuuaugacuuagcguggaagccaaacuaucacuuucaccaaauucaacguauuaacagcaagucaccaaccauucaggugaguucgaugcuaccucuuagugaauuuuggacaaggucucacaggcguggggguucaaggugcgguaggggauguauuuggaaaaaauaccaucugcuguucacggguuuucucauuuaucccucuucucagaaguagguuuuguuauccaucuuuacgaaugaagaagugggcucagguugguuaagaucuuuccuguuacaaagccugugcauggcagagcuagauuucaacuccgacuguacagugcaggcguccuccagcagcauaugaugauguugcuuauuagaacaaaggaaaaggcauuccaaggccagcgaaugaucaggaguuaagcuuuccucuuccuuaucacucugaagccaaaucuacuaucuuuucuagaugaguaaugaaauucugucuuugugcguggugacccaggguguugcuucuuuggagacugugugauuauuguggagaccccugaugcuccaggcaaccagacuuauccugggcagaggguacugcugucugccuaccuccauccagugggaacauagcaagcucaaaagcucuccauagaggcagcacacauaaccaguuugugcccgcaaugucuucccuacacacuuucuuuugccucuucccuuuaagucagacgaagagcauagcuuccccaaaguugcucugguuguucccaugauacucaaaaucuagaauuuucaggucauucuuuguacacauugcuuaaucuauagauguuuuuguauauuuagcccgcugccaaucuuuuucaagacuacagagggugagcauugcacccuccuccuguauuaguuacccacaaccacaccauauucugaacaaguagccaguaaguacucgauaggucagagggacccguggaguuuauuauaagagaaggagucacucguucccccuccacccccgcaaacucuuuuguuuuaugcugggaauugaacuccagguuuuacacaggccacauugaguacuuuuccgugaaacuauauccucagccuuugaaaagcaauguuugagagccuacauguacauaacaggcauugugcuagcuacuaaugacucaagugauccagaagcaggaaucuagaaaaucaaacaugagccucacaggcacuguguggcaggucagucacagcaaauccagugucuagaagcaaaauguccucugccagauagagaggccuccagggccagcauguugggaggcaagugcucuccauaauuuacaaucuaccagcugucaggagacucuagaguuagauauucagaaggucccagaucaggagcuuuucaauccuaaaucugaaauuucuucuauaaaauggcugagugguauuuaacccaggcuaucagauagaacaggguggucuuccuucucauuacagguuagccuuaucauaauaggcaaacucccucucauugaaggguguuacccuuucaccuuuaagugucccuaaacgucgugacuucugaguauucaaaacccacggauagaacccggauaaaggugcuuauaaauuaugggaaauuauuuucauuuguuaucuuuacucaauauucauacaauaaauccuugauccaaauauaauccuaguguauaaaacuauuuccucaacauacaaucaacaggaaucaaacagcucuuguaaauaauuaccuuugggauaugaaagaaaauguaaacauuuuauuuggcaguuguuucugaacacgugaauaaauaaauggaaaaguacauaugaauauuucuuuucggaguaacagaugccauuaaacgcuuauuuacacaucuucacugcaaagaacaguuacauaaggaaacuuuugucuuauaaaagguaacuucccacaccacuggaccggacaguuaaggauggugauacugguaguauuggcuuuagcagucucaguguugaaagguauucaucugcaagugugauaagaagagucaucaugcauugaguucauccaggucacgcacuguagaaaguuuccgauggcagccguggaguuuggugucucaugcgcuuaagucaacuaugacauguuuguaaaucugcguguuucccuuaaaacuggaagcaaagagaaaauuacgcuuauuaauggauacgugugugaaugaucugggugccugaacguuuaacuccugaaacuucacaaauuuggcuuucucugcaucccaguuauacacuugaguaaaggaguaaucgcuuccgagaauugcauauugguaauuauuuaucugaagagguuggaacaccauggauccucgagauggcauccucuggauguccuggaaggaggagccgccccacuucaugacuuuagagucgccaaugaaucuggucaagcagauguacacaucaccuuucacagagaagugcuucaccgcguauacguccuccauguuaggaaugucgguuugguuagugaauagcuguguugcuuugcuccacugguaaauaacagggcgcugagaacuacuggacaggauuaaaugagguguucugagggccaaugguggucuggcuauuucaagguauuccacaucaguaucccuguaccaggcauguaaggauuggugggaguagaauccguuuccauuccacuuguaaaugguaguaaacccagcuuuggaacugucagcgacaacgaaguaccaguugucuucaaucuugaauguuucgaugucauuggguuuucgaauuuugagaacuucaauaucuuggauuuuuaugaauuuguuugcaaaaccaucucgcuuauagauaugagagccaccaaacagcugggccacaaugacauagagcugagugucaauaacuaugggcuugcacaccacaguggacgugccugaggaaaaaaacaaaugagauguuagauguguagccacacucuguggaacauguaaacccaugguucucaaccuauggauuaugaaagggaggccaaaccaaccuuucacagggggucacuuaagaccaccagaaaauacagauauauaaauuaugauucauagcaaaagcaaaauugcaguuaugaaguagcaaagaaaauuuuaugucuggggggggugucauacaacaugaggaacuguauucaaggaucacagcauugggaaggcugagaaccacugauguaaaugcacaggcuggaguuggaaacuuccacagaaaucagccuagaaugagagauucccuggguuuaucaggcgggaccaaucuccaaggcuaaagcagcagugcccucagguucuggaccuuuauacccauggggccuuguuaugaacaaugacauugucauguuacauccaaccugcucuugacaauuaggauguacauaaaugaucagaacucuuuccucucacuccuugcagaaagucuuguuuuccuugacauacugauuuaauuucucccacuguaauuaacugccauuucugaacauaugcuuuaucaaaauauuacauuauuccaauaaccuuggaguuaaugcucuuaauggugucuguuagcuaagaguaugacauuuacgaauauaguguuaacuccuagaaggaguuuaacauuuggaaauccaaagaucuacagagcaaaucuaccccagacuuuuuugacuuuagcuuugagggaaggagucccacaagaaaucuuucuaccaauugaaaaaagaaauugagacuucugugugugucccccaccccauguacauguguguacaugugugugugugcacugcguucgugcaugugcauacagaugcaccugugugcacagauacauuugaguacauggagcucagagguaaaccucagaugucauuccuugagugcugccaucuugguuuuggaaguaaggucucugacucggauaucaaacuccuugauugggauaaguugacuggcucauagucacagagauccuugugucucugccucaucaaugccgggauuacagguggacguuaccacacccaguuuuuucauggguucuggggaucagacucagauuauaauacugaaauaacaaacacgucaccaucuaaacuaucucuccugccccuacuugcgacuucuuacagagcuaaaguuacuguauaacuuacagaggaugacaacaucuauggggucaguuuucuuuucuacacaguaaggguuagaguauauuagggaauccaucagauuucaucucagggucccauauugacugaccgagugaucgugacugcuuggugagcucguguugagaagaauuccuuggcuacauauguauucugcaagaaauaaugucacaggcaggcagugacaccgguccacgguggagagacuagugaccauaucacauuuuauuugugaucugcaugguuugaauaugugcguaucuccaaacuuguuuugaaauguaauccucaguggaacaacaauauggagaccugaggccucagggaagugauuaaaucaugacaauggaguccucauaaaagggcuugagagaguuccuuuaauguuuuaguccuugcuguugcccugugcauccauagaaaagaggcugucuuugaaguagaaagcaaguucucacaagauacggaaucuguugcacuucccaacucccggaucugugagaaauacauuucugauguuuauaaauaacccagccugaggcauuucauuacaguaccgggagcagacuaaacuaucaucuaaagcaagccuucugaaaauccgcaagcagaugacucguuccuuucaaguucuagucuacagugccauccagagcaagcugagcaugguaacauaugcaugugacccuaaugcugggacugaagcaggagcguuguggguucaaggccagccuugaugacacagcaagauccugaaacaguguugugugcacacauccaaagaccucacguuagacagcauuagaaccuggcugcuacacacuggagauuccaggaagaaagagaagcaucaccaugcuuggaaaacaaaaaacaaaaaaaaaacaaaacuauuaggauaccugauaaugggugggcuuaugaccacuggcaaaaucuaauuaauaauuauaaccuuauaauuguaucuugcuuggugcugucuucaaagugcagagucucacuauauaucccaagcuggucuuaaauucacaaucuuuuugcuucagccuccugaguucugagauuacaaagguguggcacccugcccagcuaaugguggcuuuuuaugaggacauugggcuguucuuaggagcagauuucaagauguuagaaaacggcugcuuucagaacuguuuugauugauauuuuacaacuuuaaaaaccguugaaaugggaacaagacuuaagagcucucccacgugggaacaaauggaaucuaugaacaaauuaagaaaaaaacguugaccacaggcuuacacacugcaggauuucucauaaucucugguauauuuauaauuaaucuccaagagagagagagauuuuuguuucaaggaaagcauuaacaucuuauuuaaaauguuaaaucaagaguuugagaguugacccaaaauaguuuucuuauuuaauucacuuacuuucaauucaagcagauguaguuauaaugauaacuauauuuuuguaccauguauucucauuuauguauuuguguccuuucuuagggcuagaaucggcaaacgacuuauuuccacuuuccuuuuauucuuuuaaaaaagcuuccacccucucccaugugugugugugugugugugugugugugugugugugugugugugauguuauuuguacauaaaugcauugaggaugcacucaucugugugugcauaugugaaggucagaggucaguguugggcauccuucucaaaugcuucuccacugauucgagacagggucucucacucaaccaggagcucacugaguuguccagacuggcuagcuagugagcucucaggcuccaccugucugagaaucuacagagagaugccugcuacuaugucuuuuuacaagggugcuagagauccaaacucaguuuuccauguuuaugcagugacuucuguacccagagagccaucucccuagccauacucccucugcuuugggaaaacacacagcacaguucauuguuuguuugaaauagggucuuauuauguagcugagcucagccuucugaucccaucugucuugcucagcuuuccaagagaugggaucucauaugaguaccaccaggcucggcuuauuuuaucuucuuauuuuagaguuaagaacaaugaggauacagugaaggugauggguuugucuagccaaauaguagcagaaccuagauuagaguuaaucacugagaucuagcacuuuacucugaagaaaaauaaucguccuucuagaguauauuuuauauacucaguacuaugccaaguuucuuuucuuuucuuuucuuuucuuuucuuuucuuuucuuuucuuuucuuugcuuugcuuugcuuugccuuuucuuuucuuucucucuuucucucuuucucucuuucuuucucucucucuuucuuucuuucuuuccuucuuuuuuuuuuguuuuuuuugagacaggauuucucuguguagcccuggcuguccuggaacucacucuguagaccaggcuggccuugaacucagaaauccgccugccucugccucccgagugcugggauuaaaggcgugugccaccaacgcccggcuucuuuucuauuuuuaauauuuauuuauuuuauguauaugagugcucuauccgcauguacaccugcaugccagaagaggacaccagaacuccguagagaugguugcaagucaccaugugguugcugggaauugaacucaagaccucugaaagagcaaccaguccucuuagccacugaggcaucucuccagucccucugcuaagugucuuaacuauaggaucacauuuccuuacugugaguuagauacuauucuuauuuacaagaagaggaauuaaagguuaguuaaaguuuagcaggcaaucucaagucacuuaguaaaaaguuugggguuaacacaacuaagaccagucagagcauuucuucauaaacuccucuguuucugcugcccuugggcaaagcaguuuaauguucuaguuaguauuguuagguuuuuuuuuuauauaccuguaauguugucauaauuccggaaggucuucucuacguggucccauuccaggaaaaugcauuuuccaguaaaaggcugagcaaugacuacauauucaucauucaaauaagaaaaagugucuauggacagcgacugauaagguaggucuugggacuuugcaaauucugcaaaaauaggaaaagaagaugaauaaauguaagcuaauacuacaccucgcacuucuuggcuagaucccaaauacccguacaucauauauuuauuucagagauauaauaaaaugacaauucugcaauuuuuuaagcauguagaguuuuaaagguucauaauauuucacacauuaaaucgcucagaugguucuuaacaaauuuuaaaaaaucaauuuuuauacgugcaaaaaagcaaccuuucaaauaauuuucugcuguaaaaugguuuucaauacauuaccuguaaugauacagucaaaauccuugggggagaggcuauugauuuuccguuucuuauauuccggugggccuucacaguagaugucuuccacaguugcauugguauggccgagccauuccaccagccacuucaacuuacagucacaauuaaaugcguucccucuuaggucccugaaacagaaaccucugcugcauuugcagugcauggguccugucgugacccacgcgugaccagcauuaaccugcacaugcuccguuaucugugucgaacuugacugccuauucagcuugggcucagaaggugaucacagagcaccccuaaagccacccagauccuaguaaccuauuuuugucuggauucaaugcugucuuagacuagaagaguagcuagagucaauggaaauagugcaugagccauauacauaaguugcauuuuuuuaaaaacaggggcacuaaggaaauguaaaaaugaacagguauuaauaauuuuaaaguuuuauuuauucuaauacauucaaaaugucauccucuagauguauaaucaauauaaacguuaugagauagccuacugauuaaucaauacucuguucucucucucacucuuucucucuguauuaucuuugagauucucugauuaguuuaugcuuacaucucaauugugaugcuaaauucgcaucagaaauauauuaucuguguuuagaguucauaaaguuuauagcucaaaaauagauuuauauuccuuaaguuguuccaaauguaauuauuuucuaauauaauaaaaugagaaaaaaacugca

SEQ ID NO: 9268 - RNA, 809 nt, Mus musculus
ccugcccugcuuuucuaugacaaucuugucauucauuccaaacuugcacucaggcaugccacucagguaacucuucaucaccacucggccugacacacgggcacucagcaccugccccuguggggacauaagcaggcccacacucuccagaacaucuaggaagaguucauuccggcgauacuugaugccuucucgccgccagccaaucugcccggucaccuggcuggugaucugggacuguucuuccuucaucugaugcugacucucgauacccugcugggugaugaaggucuucagugcaccugucucugaguucuguggguagccaaaguccagaaucucauccagcagcucguauacgagcacaaaauuguucuugauguucuccucgcugaucuugccaaaguaagcagccauuauaucacacaucuuguagaggaauucaaugaccauggcagcauugacauucugcuuggugacugcggccagccagauguuggaccacuuaacauagaagaagcuggugcaagcgauguuugugacagggcugcgcgccugcugccgugcaugaaugacauugacccgaaaggcauccacagcauuccucccgaugucaucucuguagacccgggagauaagcaccucccccuuaugauuauagaugaauaagccuccaaucaugguggcagcucagucucugugacccauugcucugagaacagaccuggagucagucaguagcccccacaaggccagccuggccacucucggaucccaagauguccgccugcccccuagcaucccuucuu

SEQ ID NO: 9269 - RNA, 882 nt, Mus musculus
ucuuaaauuuuucuuuacauuuuuauuuagugugcauauuuagagguguguggguaggcuuacaaaugcgacuugguacucauagagauuaacggacaauuugcaggacuuuucuucuccgugcguaaagcauugcagaaaaggaauugaaaccuaagcaaaacggccacgagaaaaacccuucagcacccacucuuauuagcggucuauuuguuuucugaaaaaaaaaaaauuuuuuuuuuuuuuuaaagauucauguacuccagggcuccagggugucuguaaaccaaggaucacugaccuuccaaaaguccuaauccugugccuggaccuccacugcgcgagaugacaagggagccuuucccugugggcaggcauuacaccaacuccgcuacaccuacagaccuuguucucuccuccguuccucucagucaguuuaucacucgcuauuuuauccuaaauacuuuuuccccccugaacuagcuauaaucuuaauuucucaucuuucuucuuacucacaaaccacuccucagaguuauuuggaaaggaaguuuacgaaaaaccgcgaacuacaacuggucaggguccagcgagcuuggccguuuuugacacccuaacaucgaccuucaccuaccgaaaggacagguauugggggcguucaaacaauccagugugugaagaggucuugcacccgccgaacaacucgggaccaucauuaaauaagaaaggggcgaucggggccacuacggucugcggcgccucugugaccacgggcgacauucaaggcuggagcuagcuacacccccuuugccuggguccagguaaaggcuuaacgcaucccuccuggggagaggcggaaagcaaagccaagcgcguccaaau

SEQ ID NO: 9270 - RNA, 40552 nt, Mus musculus
ugauuuauaagcauuuuuuauuguauccucacaugguaaaagaggcaaauaugucccaccgacacugcauuucggcaaucuacuuacaccuugguuuacaaacucuuacugcacuuccaaaacgucaucauugagauuagguuucaacaugcauuggggaagacauauucauucaacagcaaaucacuuuuaggcauagaauuuuagguauguauguauucuuagaguacaagaagccaaccauugucauguguguaaguacacagcaggcucagaaacugaacaaaaucccuaauauccgaugaagaaauaaagcaacagaugccaauuaacgcccacugcccuguaaaacggagcagaguccauauguguguggcauggagauuucaauaucugggaugaagucaucuuuuuuucuuuucuuucuauggggaauaacaaaaggacuauccaaacaaggucauuucugacuaaggaagggaugaagucaucucuaauuaaggauugaaguuaccgcuaaugguauguuuuaggcugggaugacgucaucugaggugauguaaucuccaggagcaagcaagaugagaccaucuaggauauccuaagugcgcgcucacuguagccucuaccauugaggugaaguaguucuuuuuauagggcuagaaauuaaaugacuguaaagcaauaaaaguaugguaauaagacuaaccauagccaugguguguacauacccuugcaaauucugugucuauauacaaguuugcuaaaacaaacaaaaaaaauuuucuucagagcaaacaacauaaagaaaaccacuggagaaaauucagcugaagaaacgugguucagaaugcuuguaacucuugcgaaauaucacaguucuguuccuacaacuguaucuggcggcuuuaaacuaguaguguaauucuacggagaauauaacagacaacuaaaaauuuuuaacaaauaagcuucucaaaaagaaaauuaacaaauuaagcaauuauggauauuuauuaaagaauaaaacaauuuguaaagcaauaaucaaaaaaaguauauuuuuucaaguauaaaugaagacauucacaaaacugaucauguacuaagucaaaaagaaagugaaucaucuaaaaguuaacaccauacaugugugguggagcaagccugcaaugccugcacuugauggguggaggcaggagggucgguaguucagggucauucuuggcaaaugugaagccagcccaggagacccugucacagaagcaauaaacaagcaagcaauacaaugcacugagcaucacacuaauaauguuuucugaaaauaacacaauguagguaaaugguaacaauaacuuuuaaaaguaauauaccugcaagauaaguaucuaagaaauccuugguuuaacaggaaaauuuaggaaacagauaaauaacugugaaaauauaacccacaaaguuuauggaaugucuaaaggaauagagaaaauaacaucuuuaaauauguaaauaaucaacacugaaaacucaguuauuuauauuaucuaacauaguuuaaagaaaauaauaaaaugaauacaugaaacaauggaauaugaucauagaaauaacaaaacuugaagcugauucugguguagauuauauaggcaaaacuacagcaagacuaaccaaaugaaaaaccaaaaugggcuggagagauggcucagagguucugagcacugacugcucuuccagagguccugaguucaauucccagcaaccacaugguggcucacagccaucuguaaugagaucugaugcccucuucuggugucuaaagacagcuacaguguaagaaagaaaagaaaacuuuaagcauacaaucucuucaaaagacuccagcugacauguuaaagggcagcauccuaagagauagauauauauuuacuaucccccuucugagaugaaagaaaauuuuauuuugcagcuguauuacauauaacuuaauccuuacaccaaugccuagacuuaugguuucuacaguuugcaggaaacuauagcuacuaggucauucauuucccaaagaucacauuaaaauaugaucccagaacugacuacagagcccauguuaacaaucacaaaauuauauuaguuccugugauacacuuuucugacaugcaaaucuucuauugacuccagagaguaacuauuaaacuaaacaagcugaguaugguauguacuaugauccuagcuaaguagacaaagacaaggagauauuaacaaaggacaaccugggcaaccuaaaacacucucucaaaacgaguuaaagaagucuaagaacagucaaguacuugucuagcagguacaaggcucuggguuccuuaacacuaaauauggaugccucccaagagcuguuaccccagaaaggaaaggaugacucuguucaagauuagccuggugguaguggugcacgcauuuacugucagcacuuggaaggcagaagcaaauagaucuugaaaaguccuaacccagccugaucuacagaaugaguucaaggacuacagagaaaccugucuugauccccccagucauaaaguagaacaauuucccacaggacaaucaguaagcagauaaauguuucaggggcuaaaaagacagcucagcagugcucuuccaaaggacuuguguuuguuucucagcaacaaugucaggaagcuaauaaccuacuauaacucuagcuccaggggaaucaaacaauacauguacacauaaaaauauuuuuuaaaggaaauaaauaaauaaauggguuguugaauauauccccucuccuagguaagguaaacucaggauuucuucuucacugucauauaaucuccugggcagggccuugauuguucucuuuguggcugguaugcucccuuaauuuguauccugaguuucuuaugcauaucgcucugguuguauccgcaucccuucuauaaauucuccauucaaccuccauucuuccuuaguacaauauaucacuccuaaauucuguuuuuucaucaauaucuuacauuuucuuugcgccuuccugcuaaaaucuuuauaugacauccuuacaaaagaacgaagucaguucagacaauauuguugaauccuaauauuaaauaaggcuuacuaauuuaaauaaauuacuaguuuccugaaaaaauaaugugaccagaucauauuauaauaaacauuuauuugguaagucaaauuauugacccaaaaaucaaaaacuuuacuucagcaacagaaaguacaguuucaaucaaucucccccuaucagacgccuacuccauaacugaaguccaaaucccaugaauuacauuacuaaagggggugggggagacacuaaacuuccacaggaagacugauaaacuuggcaaugguuaaguacauaauaacaaacucagaaguacuacccagucccaaaaacuaacugaaaaauuuaaauuuauaggaauuuuauacuaaguaaaauccacaaaauuuucaucaaguaugcaauacuaguuacauuauaaaaacugauauauuauaaaaguaaagugaacaauauggauuucaaagccaacaggcaaauuaccagaauggauguaaaccaaaguuuuuaaaagccauuuaguucuacauuaaaauaaacauucagcacuggaaucuucagaauuuucuaguauuuugaauaucccugucuucccuuuaauuggucuugaagccuucauuugaucuaagagagaaauaucagaacacauacauuuuuaaaugcauauuaaauccaaaguauauuguaaaauauuucuaauauaauguugagaugucacaaguccucucucuaaaauuuuauauaaagacacagagaauugugggauauucuuucccuuacccacagagcucacuuuaauaaugccuuauuucagcuccaaucaacagagaggaaacaauaugaagccuuauuuugcugauccaaaucuauguauacaaagguauaaacaaaaaaacuaaucuaauucuuuucucagagaugcuuuuuuaagagacaaucaugcagaguuugaacgcugguggcuggagagauggaucagugguuauaagcauuaguugcucuugcagagcucuagcacgcacauuugacaagcaaacaguucgaggacaugacaaauguuucuggccucugcaggaaccaagugcgcaccugcuacagacacacacacauacaggcaaaauacucagacauacauaauaaaaagcaacuuuuuuaaaguagacaccacgaaaaacuaaauuucagcuuagaaccagugcaaaccuguuuaugugccauguaucucacaaaauuccuuaccauuaauuuaacaaaauuugauuuuuuuucaaggugagcucuguaauucauauguauacuauccauacacacaccaagugcaugugccucugugugcucacaccugagaauaaguaaagaucaggaggaugucaggugccuucuccaucacucuucccuccuuccccgaccucucacagugaagguuacuggcauacgugcaaucaugaccagcguuucaugagugcuggguauguaaaucacuuccccagccuucugagcugccuuauuccugcugggccugguguuauuuaacuguuuucccaucuuuugagagcuauuuuaauuuuuuuucugcuuuguuuuucaagacaggguuucuuuguauagcccaugcuauuccagaauuagcucuauagaccaggcuggccuugaaaucaaagaaaacucccugccucucucugacucccuuaaugcuggggaaaggggcugugcuccaccaccaccaccaguugccaccaccugguuccgccauuucaauucuuguuucugucuauuguuucaugguaauuagaacuuccuucugcacuguuaaagugacagcuacuaugcuugguuaguccugaauucagaaauaacuucccagauggguguuuaagaccugccuucugaguagugggaagagcuuaguaaugccuucaauugaauuccccacauucucuaaaacacaaauaagcaaccaaacucaaacuagguaacaaaccuaaaauaaagaaacuagaaaucuaaagcuuaaacagauaaauucuaacacagauaaagauggcucagacauggaacuuuaagacagugaguaauuucagguuauagggcauuuugcaaggacaaaucacugagguccuccaggaagccacuaacacagaaaaacaaaagaugaguagugguuuaaguuaaauaaugaacacaauuguggauacuguuuuaaaacugcaguaaaaaaguaagacaacugcaaaaacaugaaugaacaaaauaauagaugaaauuacauucuuagugccaauauucugaccccaauugcucaguuuaacacaccauggagaagugcucaguuagaaugucucaacugaugcuuuuuuuuuuuuuuuuuugaacuaccaacuuuccuguaaacacugagauucccacuaucuguacacauauguacacacuggcugauccuccacuaucuacagagguaauaaaacaacuaauacacaacggggacugggggggggccaaaauucuccuuuaccacccccucccucauuggucuccuuccugauuuuuuuucccuuuuaaaagauuuauucauuuuuaaaauuauguacauguaugugucugcgcaugccauagaucccccuggaacuggaguugaggaggauugagagucaaaucgaagccacauucucagcaagagcagaacuccuaaccucugagccaccucagcagucucucaacuaaguuuuaagucuucaacaaaagacaaauaguaaaaaaauaauguucacuaaaugguggggacaauuacgccugaauaaacuauaccaaagcuucauuacacuacauucugaauagguuucagguuucuuuacaaaaacagggcaaacacucaccaaugagaucacuucgauccaacaguaauucuagaucuucgucacuaaugaccuucucucuggauccuuuuacuucccuauuuuaaaaaaaaaaaaaauccaaguauaugaaaauuuacaaagaacucuauauuacauuauaaauuaaguaauuuugcagacaaacgagauagcuuaaaggcuaauaggacugguugcucuuauaaaugaccugaguuccauucucacaucucaccaucuaacucagcucauaacuaucaauauuuaacuccagcucugggaaaucuaauacccccaucuggcuucugaaaguguaagccaugcauaugauacagaaauauaagcagcuaaaacaucaauauacauaaaauaaaaaauuagaaaguuuaaaaaauaaauaaauuuugggccaauaaauauagcucaguggguaaagaucccugccaccaagccugauaaccugagcucaaucccgagaaccuauaugguacaaaaaagaaccugggguuauacauuaugacaaucaaugaacuguauacuuaagauuuauguauuuuuguuugguugcgaucccuaggaggccugacuuuuguuuaaggaaagaaaguaguagauaggggaaagggacagacaugggagggggauggagaaacuucagucaggauacaauuaugagagacuuaagcuaacuccuacaaguugucaucugaucuccauacagguacaguagcagaagcacucacacacucacucucuuaaauuauuaaauguuacaauguuuuaauuuuaccuuucauaaucucuagauuuuaauaacuccauuaauuccuuugcaucuaagaaauucuuagauugacuuaacccagacugaccaccuuugaaaugaucugggaaagaaaagaacaaaacaaacaaaagaaaucaaauuuauuauagaauuucuuugaaaacuacaaaauauuacaaucugaaagaaaacuuaacauuuacugauuuguauguacggauccauuguaacauuucauuggccuuuaacuuuuaaaugaaaacuauuggaucuugcucgaaguauaaaauuauauggucauuuggcauaaauuugguauuuauugacagguaaacacaaagccccucuuaaaaaggggacuuuuuaauaaacaaugacucaaacaauuaguuuauucauaauaaacacaaucugguaacauuucaaauguccaucagcagaaauguuaaugaaaugaguaaagcaaaacuccucuaauauaaacagaugaaucucaaaauacauuaaaauuaggaaaaaaaaaaaaaccuagcuuaacaguuaaagaaaaagaauaauuuuugacaaaaaccaacagugucugucagagaaacaugaggaauaacuagaagggcuucauaaaaauuuccugggguuauacauuuaugacaaccaauaaacuauauacuuaagauuuauguauuuuuguuugguugcgaucccuaggaggccugacuuuuguuuaaggaaagaaaguaguagauaggggaaagggacagacaugggaggggggauggagaaacuuuagucaggauacaauuaugagacagucaggauacaauuaugagagaguuaaaauuaaaaacuuaaaagagaugcauaugucuguaagucuggauuuuuacauuccucaauauuuuguuaaauuaguaucuucaaauacugggaacaacuugagaauacauacucaugaauaaaauuuauauaaacuaaaacuauagucaauauuuaagcaaauaauuaugauuuuaucaaauuucuuauuuaucacugguaagaaaaaauuaugaaagacaaggucauuuuacucucaaauuuucuuuuuuuuuuuuuuuuuuuaagauuuuauuuauuuauuacauguaaguacacuguugcugucuucagacacuccagaagagggagucagauuucguuacggaugguugugagccaccaugugguugcugggauuugaacuccagaccuucggaagagcagucggugcucuuaaccacugagccaucucuccagccccaaauuuucaacuacaauuuaaauuuuccaccaagucaaaauaauaacgucucacauuuuucucucaaaaugagguaugagggccaaagaaaggcgaaaguucuaaauucagugccucgaucuaauucacaaaauaaugaugacuauaaaauuaaaaaauaaaaauaagccaggcaugauaaagaaguaugugcaggcuaaagaggauuauaaaacucaggaagugauuuuacccuuugggucugccucuccacccuggccagaucagaggguugcauacccuccuacacauuugccucccaagaggugcgaaguaaccggggacacaagugagaccaaauuaucccaaaguaaaagcaaauuuaaacaauaucuaccaauccagcccuacagaggauuuuagaaggaaaacuccaacacaaggagaguaccuacacaaaacaagaaaucaaucaucucacaacaaaaccaaaaggaaagaaucacacacacacaccuacaacaaacauaauaggaacuaacaaucaucugucuuuaaucucuaucaaucaacagacuuaugaauuccccaauaaagacauaagcuaaaaagacuggauaugcaagcaguauccagcauuuugcugcauacaagaaacacaccucaaugacaaagacagacacuaccucagaguaaaagguuagaaaaaaauuuuccaagcaauucgucccaagaaacaagcgggaguugccauccuaauauccaauaaaauagacugucaaccaaaaguuaucaaacaagauaggaaggauacuucauauuccaaggaaaaauccaucaagaaaaagucucaguucugaacaucuaugccccaaaugcauggguaccaacauucauaaaagaagcuuuacuaaagcucaaaacacacauugaaccucacacaauaauaguaggagacuuacucucacuaauagacaaucauggaaaaacaaaauaaaacagagacauagugaagcuaauagaaguucagauaucuauagaacauuucacccuaaaacaagagaauauaccuucuucuuggcaucuaauggaaccuucuccaaaauugaccauauaaucaaucagacacaaaacaagacucaaugacuauaagauuuaaacaaucccaugcauucuaucacaucaccacagaauaaggcuggacuucaauaacaacaaaaacaacaaaaagcccacguacucaggaaacugaacaacucuucgcucaaugauaacuuggucugggaagaaauaaagaaagaaaucaaagacuuuauagaauucagugaaaaugaagacacaacuuacccaaacuuagaggacacuaagaugucccucaacagaagaauccauacagaauccauacagaaaaugugguucauuuauacaauggaauacuauucagcuauuaaaaauuaguauaucaugaauuuugcaggcaaauggauggaacuagaaaauaucauccugagacagguaacccagacccaaaaggacaugcaugguauguacucacugauaaguggauauuaggcaaaaaguacugaauaccuaggauacaaccuacagaccauaagaaguuuaacaagcagaaaggcccaaaugaggauguuucgauucuacuuagaaaaggguagaaaauaaucaugggagcuagagggagggagggaccuggguggaagagaaagggaaaaaggggaacaagaucagguauggaggaaagggaguacaggagagaagcccagagggccaggagaaaggaaauaugcagccucuggggcaggaggguaggaauauccuguggacaguacuagaggccuggaggucucaggacucaaugggggugaccuuagccaaaauucccaacaaugaggagagggaacuugaagauuccaccucuaguacaaagacaagcccucaaguggagggacaggguuauuaacccacagucaaaauuucugaucuagaugucuuccugccuaaaagaaccgcagggauaaaaugaagaagagacugaaggaaaggcagucagcucaacuugucaucuaucucaacaggaggcauggguaccaaggucugacucuauuacugauguuaugauggauacagacaggagcuguccccugagaggcccuaccagcagcugacugagauagaugcagauaccuauacccaaccauuggacuaaagucagggaucccuaugguugaauuaggggaaggauuaaagaagcuggagaggaaggcaacugcauagaaagaccagcagucucaacuaacccagaccucuagaucucaacuaucccagagacuaaaccaccaaccaggcagcauacaugggcuagaccaaggccccagcagcauacaugggcuagaccaaggcccccagcacaaauaugucaaaggacugccuggucuggcuucagugagagaagauauaccuaacccuugagacacuuaaggucccagggaauggggaggccugguguaguggggagagcguucucagagcaagggugaggaggaaugggaugaagaacuguaggaacaaggaggggggacaauaguuggaauauaaauaaauaauaaaaagaaauaaauaaaaggaaaaaaaguguguuuacacaguauuuuaaagaucauguuccucucauuucuguagacuuagagaaacaauuucaacuuuucaacuuuucuucagguagccaaugaaccaucuaaccaaguaaaauuuuauguuaaaugaguaaaaugaaaucuggguaaacaggucaugaaacuccccauucauuuuuguccuucaaaaaucuauucaacaguguaagaauuugauaauacuaugauauuccauuagcauuuaguaucuagaauauguagagcacucaaguuuuaaaacuuuugauaaguauuguuauaaggacuagaggugauggcucaugcuuguaaucccaacacuuggggcgggggaagagggagagaaggagagaggagaggggaggggagaggagaggggaggagaggaaggggagaggagagggggcagggagagaaagcaagagagcgagcaagcuagagaaaugguucugagguuaaaagcacugauugcucuuggaaaggucuugaagaguucaauucccagcaaccacaugguggcucacaaccaucuguaaugggaucugaugcucucuucuggaguguuugaaggcagagacagugcacucauauacauuaaauagacagacagauagcagucagagcugugcacagagaaucuaucuucaaaaaaaaaccaaaaugaaugaaugaaugacuguaaagauggauggauagaugaacaacacuggaaauuuucgccauauaacauggauaacugaagcacaaaauuaccucguaauaaucauuacagagcuauagagauggcucagauuuggaucauuggaugcuuuuacagggaacuugagucaauucccagcagccacaaagaggcuugcauauggaagagacauacaugcaagcaacacacucauaaauaauaaaauaaacauacuaguuaaagcaauuuaaaaauuacuuacuuuuauggauuaucaacuucuccaacuuucuuuuagcagcugcucuuuccacaauuuucuggucaauaguauuugcuguuacaagacgauacacaacaacuggcuuugucugaccaauucuaugacaucuaucuugagccuggagaucagacugaggauucuuaaaguugaaaagaaauguacaguuaauagaauuguuaaaccugaaaaaaaauuggugaaaaauaaaaucauauacauuaucuggggagaaacuuuuuuaaugguuuagauucauuuuaacuuccaguauggcuguaaaaauuacaacucacgucguaacaauuaugaaguuuucuacuuaacugcucccacaggggccacugagauggcucagcggguaaagguaucaugccuuaguaaaccugaccacuuguguucaauacccaggauccacacaguagaaagaaccaacuccugcauacuguccugacuucuaugucacucacauacacaaauacacccacuaaauuaauaaaaguaacaaaauuauuuaaauacucugaaaaugucuugcuuuuaucuacagaaaacuugauaaauuccuaccugcaaacaggcacuuuucaaaacaaauaaaagacguuuucagaacagaaauauagucagcauauugcugcauuucuuacccaaucacugucauaaaugaucacuguaucugcugcagucaaguuuaugccuaaaccaccagcucguguacucacuaagaaaagaaaaacaucuggauccguguugaaacuguauaucuaaaugcaaaagaaacagacauaaaaauuuuuuuaaagacacuaacuauaaacauggagggcauuauuuuuaaauaucacuguuaaagucuuuucccacagaucuagaaaacaauuaauuagcuaauaaaaccucugcuuagccgggugcuggugacgcacgccuuuaaucccagcacacgggaggcagaggcaggcagauuucugaguucaaggccagccuggucuacaaagugaguuccaggacagccagggcuauacagagaaacccugucucgaaaaaacaaacaaacaaaaaaacaaaaaacaaaccaaaacaacaagaacaacaaaaaaccucuacuuacauaaauauugcuuuucaaacauuuacauuaugcaagauauuuuuauuuuguuaaagguauguaucauaaccaguaucaaaaaacagacaaaacuacguuaacagacagcucaaucaguaaagcaccugccauacgagcacucacuagacagccuaauuaaugaguucuagguucagagaaauacccugucucuaagacaugguagaaaaagaagacgacauugaaugucuuccuuaccuugguacaugcacauauacacauccauacaacaaacacauacaaagacaaccaacagacaaauacacacacacaaaccagaaacaauauuaaaaaaugagguggguugcuuaacuaggaagaagcacauacuuuccuggcaggugguaauuuugaucucaguacauguauuuaacaaauuuugcacaugcuugucaaaaacaauaauacauauuuuauuugcuacacaguaacucuuaugcaaaagucaaugacaauauauaaucuaaacacauccagagaacaguuauguaugguggaucacacuuguaauccuaacacuggaggucaagaaaacaagaguauuccaagugcuacccagggcaauauaacguaaaugugccugacaaaaccaaaacacuacccauaaaaauagcugugucucuaagacugacaaccugagcucaauccucggagcccacgugauggaaagagaguaacucaucaagcuguccuuugacuuccauguaaguuguagaccaugcuuaucuucauacacauaaaaacauacaaaugaggaaaugcugaaauaaaauuggguauaguguggugaguaugagugcuuauuguccucacagugucugggauucaguuccuacagauugcauauccucuucuagucugccuaggugucagguauucauucaugugguacaaaauacauacagguaacaaucaugcacauaauauaaacauaaauauaaacauugucaagugauacaauggccuacugcuacaucacaagugugauaaaaagaaacaaugagauguuaacuggcagguucuggguggaauaauagccaacuaggaaacuaauugccacaugcuuacaauuuucaugaugaaaagaugaaaacuaggauaaaaagcagaauacaaccccuauugugccauuauucucacagcagugguuaaguaggauacuauuauacaaagacugcaacagaagguugccugugcauacauagguauggaacucaaaacuaaagucuguuaguacucaaaaugcuuauccuuaaucaaucuuacuacaaaguuuuuggucauauuauuucaaagaugaagacagaaaucacaaaaaagaaauucaugugaggucuuacauuuuuuucucuuuccgaauaagacauggacccaucaagucugcuaaagaugaaguuucuaagauggcaauaauccaucaagauguccaacaugcuugucauuugugaaaacaccagaaccuagaauuuuaacacaucuauguuaauaacuauacugauucauaagaaacuaaagaccuaaaauucuagucagaaguaccuugugaccucuuuuuuuaaguucgggcagcauucgauccaaaauuaagaacuucccagaauuuguuaccaacucuucaucaaucuuaaauguagacaagaaaaaggaaagaaaaaaaauguuaauauaauuuccaaucaugugccauuuuaauagcucaauuuuuuuucuuucugguuuuuaaucugagagauccucccgccucuauuucccaauaggagugcugguauaaaaggcauguguuaccacacccaaccuuaacaguucaacuuucaaugacaaguuauaaauuacaaauuauuuauauuuuuaaauugauauaauuaacuuuucaagaaaaagccaaaaauuaaguucaaauauaacuaugaacuuaaccacaaaacaugauucacauuuccuacaacucucuuaaaaguuuuguauagagaggugugguagcacaugucugaaaucuaagcacugaggaggcagaggcagaaggaucugaaugaaguccaaggccagcuucacuuauauaaaaugguuguggccagucugugcaaaaacaauuaaaaucggaggcugaagcgauggcucacugguugagaagucuugcuguucuugcagagcaggcaaguuuaugucccaaaaaacccuuggcagcucacaggccauaauauuccaguugcugagauaagaccccuuucuuuugaccuaaacaagcaugaugcacauacauaaugcauauacauacaugcaggcaaacacucacacauaaaauaaaaauaacccaaagugguaauggcacacacuuuuaauucuagcacuugggagucagaggcaggcgggcagaauguuagaggccagccugauccagagccaguucaaggacagccaguacuacagagaaaaccugucuuguaaacaaaacaacaacaaaaaaaaaaaaaacaaaaauucuauuuuagccagagauauggugugguacacaucuuuaauuccaacacucaggaucaaaggccauccuggugacaaagugauuuccaaggcagcucuccccacccccaccuccaaccccaaauuaaaacagcaaacuaaacuagaaaaguuuugcaugagaaaacaguucauacauguauguguguguuaagguuuguuguguacaacuuaguaaaauauacacaaaaauuacuaucagaacucuuaauaaaaauuaaagaaaacacaugaacuuguaaacaauauaaagauuaaggcuaaagaaacauuuaguaaacacuuuuaccuugaugaucugauauuugaucacuggaauccacauaaacauggaagagaacuauacaaagcuguccuaacuuuccacaugcacacuguuccauauguauacacaugcacacaaguacacacuacuaguaauaaauaauaaggaguauuuuggagcuagagagauagcuuaguauucagugacuugcuacucuuguagagggccagcauucaguuccuagcaucugccaggcucuucagaaccacuuggaaauuccaguuccagagauucuggucucuucuggccuuuuaaggcacugcacucacauaugcacaaauacacacacagauacauaugaauacacauauaacuaaaaaugaaacguaagccaggaguggaccauguuucgaaucccagcaauuaggggcaaagacaaguaaaucucugugacuuuuaggccagccugcuauacagagugaguuccaggauacauagggagaccccaccucaaaagagcaaaaaauuaaguaaaugaaugaaauggcuuaguguuuaaucuauuuuuaaaaagauuuugccucaauauuuaaaaaaguaacuaaaagccaggcaguugugccacaugccuuuaaucccagcacucaggaggcagagacaggaggauuucugaguucgaggccagucuggucuacagagugaguuccaggacagccagggcuacacagagaaacccugucucaaaaacaaaaacaaaaaaaaaaacaaacaaacaaaaaaaaaagccacagaaaacaaaacaaauuacuagcuaaucuuuuaccuuaaauucuugugugacagggucaauaggauauucaaucauauaugggugauuacagcacuuucgaaguagcaucauuauauuccgcagcuucagauuaacuucagauucuauagggauauuaccuuccacaacaguccuacaaaaggacaguaaguacauuaaguaugacaaauguaaaaaacacaauuuaaauaucuaaauguaccuuuaaacucuuaccucucucuguuuacuucuggcuguauuugacuuauuaguuuuucuaauucacuagggaacugaucuaguucgcuguaauuuauugacuuucuacuucgucguuuuggucuuccaguaggacuuagcucaacuguuuccuucuaagagaauacauaaaaagccauuuguuuaaaaacagcagaagccaggcaguggaggugaaugccuaagaagcagaggcaagcaaaucugaguucaaggccagccuaguuuauagugugaguucaaggccagccaggcauacacagagaaacccuguuuugaaaaaucaaaacaaacaaaaaaacucuaaauguguauaugaaugaaguauacuucuacacacacauaacaaagcaaucccaucaacucuuuuaauacaguagauauuauuggaaauuuucaaauauucaugaauccuccuagugacuguuacaucuccauuaaggaaacaggguuggagaggguuggucuuguugauaagucuuuagaacagugacuuuaaaaauucuguggcuguaaaaauggacuucuaaaggugguagggcgggugagauauaggauaacaaauguggucaaaguacaugaaacacuuaagugaaaaugucuuaugaagcccauuaccauaugugaugauuaugucugacuuguugucuguagcauaaaggaucaugaacccaggcuguugaacauauagauauguaaauuuuaaacacgcauuuauuuccaaagaccacaaaacaacugauauacagaugaccaguaaguuuagcagaaccauaaguaacagaaaguaccuucugcuuuuggggucuuacuuacucacaaaguucugagaaugggugaggagacaaaacacuaaaaauuagucauaaaauguuaugccauggccgaacggugguggugcacgccuuuaaucccagcacuugggaggcagagguagggggauuucugaguucgaggccagccuggucuacaaagugaguuccaggacagccagggcuauacagagaaacacugucccgaaaaaccacaaaaaaaaaaaaaaaaaaaaaaaaaaaaaaaaguuaugucaucucauuaacaguuacuucaaauucacaauuaccucacaggauccaaacauguuugcaauugugcgguucacaauagcuguauagaagaucucuuguuuauugcaaaguggugcauaaacaacuacuucucgcuuaggggggacuucaagagcaacaucagacuucagucuucucaguaggaaaggcguuaaaaucuaagauuuaaacaugaacaaauaaauaugaacauuaguuaucuuuuucucuccuuagggacacucuaaacacgccuuccccuuuguuccuauugaguuuaaaaagacuaauguaucgccuugagauguucucauaccagaccagcacuugauaauuuuaaaacaaaaacauauauacccaaagaugccauuacuacuuuaaacaaauagcuacacuaggugggcugcacaugccuuuacuuuuaguauuccaguggcagaggcagggagaucugaguuagaagccaaccuggucuacaaagaaaccuugucucaggaaagguaagaaagagaaagaagauauuuacaauauauagaccaguaaguuacucagagcacacaugaagaaccacuaagauacuagaacaaguaauucauaugaaaacuaccacaguuauacuugauaguguauuugacaaacugagccaccaagacugcauguucuuaauccuauacacaugccuacagaugaagugugcuuuugaguauccaguguucauaauucuuaucaaaugcugguuucauguuucaggauaguaacugacuaugagcgccauguguucuugucaacagcuccuuccuuauggcccuguaaauaaagcugaauauuuuaacaagaaaaaaagaaaaaaaagaaaaagaaaaaaaacuacaacagauccagagacauuugaguaucgcaauucuuuggugugcuaaugagauuaaggcuggguuuaucaacuuuucuucaauucugauacugaaagauuucuaaucuucaaaaucuguauaugcagauucaacuaguuucauuuuuaaguuuuuggucccauguaauuuuuauaaauauauaauuucuuucugaagcacaauugccugucuguguuuucaaagcuggggaaauggcucaguggcagugugcuugucugggacacauucccaaaauauaggugaaggauugucuaaaaauuuagacaaaaggcaauggaaacucaacaagauaauuuuuaaccuagaauuuucuucuaaggaaaaacuacauauuuuaaauuuauuuaugacacaagaaaaaugcuauaaaaccaaauauaaguauagugggacagagcaacaguauacuaaagcauaauugaaauccaaugugccugccucgcacuaaccccaggacuccaggcaaaucugaguuuauauaguuuauauaguuuauauaguuuauauaguuuauauaguuuauauaguuuauauaguuuauauaguuuauauaguuuauauaguuuauauagugaggccuaccauggcuacauagugaaaccccaucuaaaaaauaaguaaagaaaauguaugcacuaaagaacgacaaggaaaaacguuaaucuuuuuaaugaaaaauuauugacuucgcagaauacauauaaaagcaugcuuacaaagugacaggugacugugaggacaaacaauaccaguacacugguaaggacgacgacuuggagaaggaggauuauuacuuuucaagucucuucuacagaguuuaagucucuagaauuccuaauauauuaaguauaaauugagcagaauaaggagauuugguaccuggugcagcauauguaaaacauucuguucucucucuuuagcuauaauaucuucagcaguuucagaaagacuagugauaucaaaccaagacucaaagcuggaaaagaaaauuaauuacaaauuaaucuaucacaugaauccaauuauacuaacaugguacauauuuacaauuucauauauauauauauacauauacuacauacauacauacauacauacacacauacacacauacauaaauacauauuuggggggguagauaaacagguucucauucaggccagcuugacucaaauucacuguaacuccaagucugaccaugaauuccugucuuccugaccuucuccauccccaagugcugauauuacaggauaugccauuauacacagcauaaauuccauauuaauuuguguauuaugaaacaggaacauuguuccaaaaauucaaaaggcaauuuuauuuuuaaauaaaauuaagacuucauccaaauaaaaaggaagcaauuguguugaaaucuaaaaugguugggaagcagaggcaggcggauuucugaguuugaggccagcuuggucuacagagugaguuccaggacagccagggcuacacagagaaacccugucucgaaaaaaaaacaaaaaaacaaacaaacaaaucuaaaaugggacauuuuuuucuaaaaaagucaaaucauauacaagucaaauacaaaugaugcuauacuuuuuccucauuuguuuuugcccugcuaagacuagaacccagggcuucaaggaugcuaagcagaagcucuuuuucacugggcuacaucucuaguccaaagcacauacuuaguauacaucuuuuuccauccugaagauacuguuuuccgaaaauguuuugaaaauauaauuuuaaguuuaaauuguaauaccaacaauaaaaguuuuagguugacacugagacucuuacgauauuucucuggugcuaacuaguuauuuuuuuucuaaacuucuaugcagguuuccuucuaugagcuaaaggacauguaugcugccuggcuauucugugaaauggaauuauccacauuaaaguaucuuagaaagcaaaaaucaauguccuauaaucucaugaguauuuaaaaguucacguuuuacuuugacugcuuuucuuucuuuuuuuucuuuguuguuuauguacccuuauuuauuuggggaaggagugcauacaugugccaugacacaggaagggaggaagaaaagcaaacugcagacaccacugccuccuuccacuggaauucaggacugaauucaggccuucagauuuggcggucuacacgugcugugccaucuuuccagccccuuacaggauuauuuuuguuuucuuuuaaucaaucugaaaagucauuaucuucucucauauauauucugucaaaaguagaacacauaauauauagcacaaaaaaaaaaaucgcuaaaaaugucauuuaaguucagcuaccaaacagaaaggaaucaguuucagcuuagaacacagauuuuuuugagguuuuaagaagacauaaaaccuaccuuuucaagucaucaaauacaucuggcaacaaaaaguuuagcaaugaccaaaguucugauaaauuguuuugcaagggaguaccagucaaaagaaguuuguuaucagcauugaaccguuuuaacucccugauuagccggcacuucauauucuuaauccuguguccuucaucuacuauuaaguauuuccaauagcaaugcuagaaaaugaauugaggaaagaaauuguaagaaucaaucucauaauuuucuccuagaaauauuucuuauaccuauaaaaguucuugugaggaacaucuauugaauuucauuaaaugucauuuuacuaucuacuaggacuauuccuuucucccgguaucauaaagauaauaaacuuuaaaacccagcggguauuguauccuuaaacuauagcuuacuggaaauccccauuaucauguguuaauauuuucauucauucuaaagucaacaucaucuuagcuuuuuaacugccacgugccauuagaguccugaaaaaacgguaucaaaauaauaauaguaauaaugaaggauaaaaagaaagaaaucuuccauuaguuauauguacuccaaacuuauuacuuuuuuacuuuuucuuuauuuauuuuguuuagacagaguaucucuacauauuccuagcuggccugcaacucagauccaccugccuuugccuccuguuuggcuaggauuaagggcaugaagcaccaagacuagcuugcuccaaauuuuuaaaacauucuuggaauuuucauuuugagacucacauauaagauugacauuauuuuaaucucauaauuuuccucaauuuccuucacugacuuuaggugcucccuaucuucagaagccauauuuaacaauuaauauuuucaaaaagcaccccacauuuauauuuguaaaguccuaaaaacuguucucucacuuguucuuucuuuuauauugaucaagcaaguuaaaauaauccaucuagauuauuguguaacaauacagaaauauacaugauuucuagaaucaguaauaucaaacugucacgccaagauaucuuggacaguacgauuagccgauuagcuaaaaauauaucuaaaagaaaaaaauagguagcuagagauaguuuaaugguuaagaggacuuugcucugucugacaaaggaucuggguuagguuccaagcacagacaugcaggcucugucaccgaaacucagggcauuucaugcucucuugugaccucaggacaccaggcauauaccaggcacagauacauaugcagacaaaacacccauacaugucaaauaaaaaacuuuauacauuuccuuuuucuaaaauuaauaucagauuagauaaaauacaugaaaugagguacacuuuaaaauuauauaguaaauuccuaacggaaugaaaaauguuuaacaacuacaaaggagauuacuuuucuggaaacauagaaagccaaauaaucugaaaaaucucccacuauaaaacaucuauuuaaaaguacaacacaaaaugcaagacggccuuuguaaaugaaugagugaaaaacaagagaaaaaccaaggugaaugagaugaaaccucauuuaaugcuuguaagcauuaaaacuuuugcccauuacccacuaaaacuaaaauucuggcaaugauucaauggcucgguggaaaaacaaauaucuucaaaacuagcaaaggaaacugauaaggaagcuuuacuggcaauauaagcaggguaaagugggaauaaaacauaagucuucauguuacauauuuaaauaagaaacaaguuacaggcuaaagggauggcucagcgcuuaagagcacugacagcucuuccagagguucuaaguucaauucccagcaaccacacggugguucacagccaucuguaaugggaucugaugcccucuucuggcacguccgaagacagaguauucauauacauaaaauaaauguuuaaaaaaaaaaagaggaaauaaguuacgaaacagaauguagccugaguuguguuuaaauuauaccuguucucucucucaauagcaguuauuuaccacaaaagaacucucauguagaauuacaaauacuccauauuacuucuugaggcagucucaccauguaaugcugucuaguuuuguggaccaggcuggccucaaacucagaaaucugucuacuccugccugcuaauucugggguuaaagaugugccaccaugcccauauuauuuucuucuacaaauaugcuugcuguaaagaaaacucuguguucucucucucccucuguguguguguaugugcgcgcguguguguguguuuugaagaaagggucuagacuauucccaaaccacaccaauccugccucugccuucugagaaguguuauuacaugcacaacauacaugccuuuauuaaacuauaaagcuggguaguaaagauggcucagcaguuaagagcacuggcuauucuuccagguccugaauucaauucccagcaaccacaugguggcucacaaccauggguucugauaccuucuuaugguguaucuaaagauucaguguacccacaaauaaacaaaggaaggaaaugaaucuuaaaaaaaacaaaauauauauauauauauaaacaaaaguauggcuauugccaauuacauucaacaauaccacacauacaaauagcagauuugauaaacacuaccuguguguuuugaugucauguugaagccaucauguaugcuacuuuccguguuacauguaagaaaaaguuaaaaggucugggcagugguggcacauucaggacagucagggcuauguacaaaccccgccuuaaaaagacaaagaaaaagccacauggugguggcucgagccuuuaaucgcagcacucaggagacagagauuugaacucaggcagaucccugaauucaaggccagccuagucuauaaaagcggaguuccaggacaagaaggacuguacagagaaauccugucuugaaaaaccaaaaagacaaagcaaaaggguaaagaugaacuuaauuaagaaugaacauuacaugaucagagaagaaaaugcaaagaacuauacacaauucacauggugaggaagaaaggcagcuaauggcauaguaaaacauggacauuaaugaauaagcaacuaaaacaaugaagacaaaggacagaguaccauccacaguucuaaaaacacaaaaaugguuuuuuuucugcaaaucuauucauauuugaauaaaacuaaaccaauaaauaaauuccaacuacagaucucaaauuuacggcauaguuaaugugcaaccauuucuaauaccuuuaauauggccacagauaaaaugccaauaauucuucuaacagacaucaaccuuaaucacaaucuuucuauggacaagucuccaguuucuaaaggaaaugcaaagggcaucuacuacuuuacccacaauaaaacaaauguuauuggaugguaauacuaugaauuaugaauuaaaaaucugacuaaugaucaggguuaggguuagguaccuguaaagcauucuggucucgcauagcgaucucgaaugaugugaccaccacaggaugaaucugcagugucccuugucuuuuguggauauucuuuacuaauuuccgacgguccucccggguuccaugauacagcagaguaggaaucuacaaggguacauugauucaaagcaaacuauaaaggauuuggaaaauacagaacacgucacuuucuuaaagaacauuuuaguucuauuuuucuaugacuaagguaacauaagaagucaugacuaacauaaggaaaaaaaaugaaaaaaaaaaaguauuccuaaauccacagaaacaaaacaaagagguuuaagaagcagauggguaaacuacuucaggaauauauucucaugaggcgaaaacauagguaaaauagcauguguaugcaguacuuguuuaaguugaaaacaaaaacuuacaaacaaguccagacaguaauuuuuuuauaacucagaacuuguuauucgauaagcuggcacauacaagaauuauuauagagguaauaauauguauuggggaaaauauguaacaauacacaugggaggaggacuggaaagauggcucagcuguuaagagcaguagcacuuauucuucuuccagaggacccaaguucaaaucccagcacccacaaggcagcugacaacuaucuauaaauccaagaucuaacacacucacacagacauacaugcaggcaaaacaccaauguacauaaaauagauaaauuaaauaagaaugaggaaggaccugcuuccagucccaauucucacauuaugguucacugucuauaacucugguuucaggggauuugauggccuauuacuggcaccaggcauucaugggguacacauuuaaaaaguauuuuaaaaauaagaagaauaaacaugggauaagcagucaacuggaugaggaagcagacuagaauauccaaggucagacugugcuaaaccuaucuggggacagcugggcuauauacugagugaaauugugcuucaaaaacaagcagaaaaauaaagaugaccaaaacuuuuuuaaauguagaucugacucagaugaaauaauuuauaaaaucccaaaaacaauuuaaggaaaaucucaguaaaacauaucagacuaccaaucccaauucuauauauaaaucaaagaaugguccuauucaaauugguaagucaaaucaaaugcaauguauauaaaaaucauuucagcuacugugaguggucuauauuucauauaauaaauauauguaauauauuaauguaaaaaauauaucuuacuucuggaguaaaucuuuuaaauucagccauccaguuaggaaguguagacaaagggccacaaacaagaaaagguccagguacuccccucugaaucaucaaugcaauuguagcaaugcacugaacagucuuucccaaacccauuucaucugcuaaaaugccauuaauuccauuuucccaaagcaucuguacaaaagaauacauuauacauaaauguuaauacaaacauuuucuggauuaaaggcuucauuuuuaaaagcauaaucaaaacuaugaaucuaacauaauaaaauaaacucuuaaguuauaagaaguccuuuuuaucuagaacauagaaaguguugaaggucucacacucauuuuaaaauuuaacauuuccacuuuaaaacacucagaaaauacacacaaggaacuggugagaugacucagcaguuaggaauacucuucucuuccaaaggaucccaguuaagaucccaaccccuacacuggguacccugccacaaaggauccaaugcacucaaggcucaugcagacaagaacugcacaacauccaaguacaaggugcacaugcaccacccaacacacacaaauaauaaauguuaaaaaaugcaaauauuucuuucacacucaaauggaacaauuugaguaguaguguaucaugcuacuuaguuauuagagaaaagaauccauaagcaauaucaaaaauuuuaaacuucagaucaggugugccaccacauacuuuugaucucagcauucaggaagcagaaguguaaguagugaaaccugggucaaccaaagcuacaaagugaaacuacgucucuaaaaacaaaacaaaagcagguaacacaagggcugggaaaauggcucagugcauaaaucuaaggaacugacuuuggaaacccaaaccacacauaaaaacuagacacagcggugcauguacaccuguaauccuggcacuccuacaaagacaggagaagcuccacaagcuccugagccagcuagcagagcacuuuuguucauguauauacaccuacaaugacaauucgagacagguugcauagggaaugcaugccaucacuugaagaaauggauacaacagagccuggaguucaaguucuuuccuggcucaccauuuccaaaccagccucaguuaugaaacuugcuuguuucaaacaaaaacaaaaauaccuuaaagacaaaaaagucuuaaaaacaaaaaaguguaccaagugcucagcagauaaagcccuaggacacaugcuaggcuacacuguauucaauccccaggauccucaagguggaaccaacuccaaaguuacgcugacacccucaaaccauacaccaugguggcacaugagucaacacgugucaacagcccccccacacacacacaccaaauaaagaugauggugauaauuauaaaauuuggaauggcaugauagcuuagcagauaaaaguguuuaguaugagagccugcuaaauucaauuguaaaauagucacauaaagguggauagaacagacuccacaaaaaucaucuucugcuauauaaacaugugcuauggcccauacccuaacccccacauagacacagaaguagcagaauuaagaaagaagaugagaagacaacucauuacccuaagccauuccaugccuucuacuugguaccaccucauuacuccuccugugaaaugcuuugguuguugaaaggguacaggcuguccguuacauuuccgaacugggucaaaaaagaauuuagaauucugccuaacaguuugagacaaucuaucuuuaaucauacuauuugaauccuuauuuuucugaauaucuucuacacaaagacucguaguggaagagcuuucauccuguaaugagaaauauuuaauuaaaaucuugauaguaaaugcuacuauguucacuauuuaucuaucagaaaaugcaacaggcugguggcauagcucaguagguaaaagcacuugcuguacaagcuuggagacuugaauuagaaugggagaaccacugauucuaaaguuguccuagcuuccacauguacacugaggcgcgcgcacacaugcaucauucaugaaacuuauuuuucaaaaagaaaauguaacaaaaucuacaauacuguaguuacuagucuagaaaauaaaaucuguaugcauggucacaucuccaagaccuuccuuucccauauaaaugugaaaucauuaaaaaagaaaaaaaaaaaguuagcggagcuggagagauaaguuuagcucuucuguuagggaucuugcagaagaauagaauucccuugccagcaccuccucuacucuagcucugggagaucccuuuuauggccuuuucacguacucaaauguguauguuuauuguagacaaauaaauuuuuaaaaaaaucuuuaaaaaaacaaugccaauguauaucuuuuuauuuuuucagauuuauuuauuuuuauuauacguaaguacacuguagcugucuucagacacgccagaaaagggcguaggaucucauuacggaugguugugagccaccaugugguugcugggauuugaacuucggaccuucggaagagcaguugggugcucuuaccaacugagccaucucaccagccccguauaucuauuucugaagcucaauaacaacuuaaucaauuacagauuuuaccaguuagaaaagcauucuucuuuguaacuacccgcuaugcaucuguaugcuaaucaggacucaaacucauaguccuccagguucacccuagguaacuggucacuguuaaaaauguuagaaggagcaagauggcucaacauuugcuagcaaccuugaugaugaaugaucugacuuguucaauccuggggacccacaugauaaaaaaauaauuucugcaaguuaucaugacaccugcaugccauacaucccauaacuaaauuaauguaaaacaagcaaaaaugccaaaagaaccagcaagauggcauagcagauaaaggacccugucgucaauuuauucuucugagcuucaaaacauauggcauacauaugcauucauaaacacaagagacaccaacaguaauaaaauguaucuuaccucauuauccuuauguuuuuuagcuacggacaaaauuuccuauaagauugaaaaaguaaaaauuaauaauguauaagacuaccacuucugccaugcucuagugaugcaugccuuuaaucccagcacuaaagagacaacaggaggauuucugugaguucgaaccaacccuggucuacaaagcaaguuccaagauagccaagacuguuaaacaaagaaacuguguugaaagaauaaaacaaaacaaaacgaggacuacuaccuccauggccccaccaguaugauccagguaaauuauucucauccuuaauuaaagaugucuuuuuauagugaaugaacaaaugcaugacuggcuaagauaggcccuagguuuaguagccagcacugugaggaaaaaaaggggguugagggcuguugugaagaagcaagaacgcaugagcugggaguaguaugacuuuaaucccagaagagacacgcugaucucugugaguucaaggccagcuugauuacacaguaaguucaaagcuagccaaagcuaaacaaguaagaguccgcagaaagaaagaaagaaagaaagaaagaaagaaagaaagaaagaaagaaagaaagaaaggaaggaaggaaggaaggaaggaaggaaggaaggaaggaaggaaggaaggaagggagaaagaaggagggagggaagaagagagagagagauuaguauacaacccuaaguacaagaauucagauuccuguauacauauaauaaucagggcaucucauguaugucuuuaacuacagcuccaaggaaccucaggcccucuucagaucuuuaugcacaaaggugugugcuucuauaaaccacagacuuauggauuccuccaacaauggcuggugccauucuucugcaugagcacuucuuagcaucuuugcuguaaccccacacaaaguagucuacgcggcuccaacacuguuccuauaaaccagaacucuacuuucucuacuaagaauguuguaauuguauuaaaauccacuugauauguaauaaucauaugaugaaggaugaugcaacuacaaacuacuguaaacccagcacucaagaggcaaaggcagccaaguuaaucccaaguuaaccaagucagccuggugccggccauggugacgcacgccuuuaaucucagcacucgggaggcagaggcaggcggauuucugaguuaagaggccagccuggucuacaaagugaguuccaggacagccagggcuacacagagaaacccugucucgaaaaaccaaaaaaaaaaaaaaaagucagccugauguauacaccaggacucuguauuaauaacaacaaaaccagcaaaaccagguuagagaaauggcucagugguuaacagcacugguugcucuucuagaguaccgaaguucaauuccuaacacucacaugguagguaacucauaaucuuucuauaauucugguuccuggggaugugauguucucuucuggauuaaggacacuauacauguaaguuagcaaaccauaaaaauaaaauaauuuuuuucauaaaaaaguaucuuacuuaagauaggcucuaucuagccuggaacaauguugaccagguuggccuggaaacuacugauccaccugccucugccucccaauugcugaaacuaacuuucucuguagaccagagucggcuuguacucauagaaaucugucugccugugccaccaaaaagaugggauuaaaggcaugcaccacugccacccagcaaguaaauacauuuuaaagguuaaaaccaacaguagauuuagccaacaucaaauauauguagucuucuaauauuauuaccucuuuugacaugaccucugaaauauuauaagauucaucuucucuuccucuuuucuuuuucaugacuauaaaacaaaaccaguuaacuuuuuaauagcagcuaaaaacagaagugcaaacauacauccuucaagcuggaacaaaguuaguuuaccugguuucucuccauucccaucaacuaaacuuuuacccuacaaaacaaagauuuagaauauuaauaaaaaauguauuaauuuuaaauauuugcccuacauguccaucuaggcauccugugcacaccuggugccaauaacagaagagggcaucagauuccccuagaacuggagacaguuuaaaaccaugaauaugagucagguaguugcggcacacgccuuuaacccagcaaauaagaaacagaggcagguacauccuggucuacagagugagugucaagacagccaggaaaaaaaaacagaaaagaaccaucauguggguacuaggaauggaacccagggucucuggaagaacaucuagugcccuuaauugcugagcuaucucucaaaacccuagaauguuauguuuacuaaggauccuuauguuguuacacuuuuucuuuguauguuuugagaguaacaguacuucauguccuugcagacaaaguucaguuccuagaagccacacugggcaagucacaacugcuuuaggggauccaaugcccuauucuauauacuccaugaucgcccaaacauagguaagcgaucacaaaaaacagacagauacacacacagacacacguuauaaaaauaacaauauaaacacuuccugauguggcagugccacauacauaaucccaacauucaggaggcaaaggcaggcagaucucugugaauuggaaaccaguaauauagccuucuauucaucaugcuuacacaaaaaauaccccgaaacucagugagucucaaaaacaaauagacgggcuggugagauggcucaguggguaagaguauccaacugcucuuccaaagguccggaguucaaaucccagcaaccauaugguggcucacaaccauccguaacaagaucugacacccucuucuggugugucugaagacagcuacaguguacuuacauauaauaaauaaauaaaucuuuaaaaaaaaaaacaaauagacaugaacauagaaggaggaaauguuaugaagaagggauucaauggaaguggguaaauaggauaaugggauaaauacaaccaaaacacuaacaauaacuaaaaaaaaaaaagguuagggagaugccuggacaguuuuaagugugaaaacuagcuuggaucaagaacccauguaaaugcugaguaagcagguguccccacugaauucuagugcucccugaagaaagcagguuagcuaguuagucagaacauacagguaagcuauagguucaacugagacucugccucaugaacauggaagaauaaccuaggaagccucccaacagacaucccugggacuuuauacauguucacaugugaacauccauaagccuucagacacacacaaacacacauaaaaaugaaaggauaauuuaaaagaaaaguaauuuuuuuuuuaauuuuaaggagcaagaacaauggcuaaguguucugguuccguucccagaaguuccagguucaagucccagcacccaccuagaaucucacaaacauuuguaacuccaacuguaaggaauccaaugcccucuucuggccucuccagguaccaggcacacaugugaaugcacacacacacacacacacacacacacacacacacacgcgcgcacacauacacacacguguauauguguauacacacacagaggcacucacucauagucauaaaaaauucaucuuugagaaagauacauuacccauuaagaaaacuuauaaauaguugaaaauuaaagcaaacaaacaccaaacagauggacaagcugaauauauauaacacccgcuucugacucccagagguauuccacacacauaguguacuuacacacauccaggcaaaacaaaaaacauacacauaaguuauuacuuuuuaaaagacaauggaagaauaaaucugaaauuuaaguagaugaugaaauaauaaguaacaauuuucucaagaggacugaauguauuuaacacauucaagaccaagccacagcacaaaaggagaaaauccuggcuuacuauauuaccucuguaaguuuuaaugaccguuuuuuuuucuccaacuucucuuucuucuucuguuccuguaagauaaauuuauuccuuaggacaugugacaaaaaauauacauuacaauuauaucaaaauguauuuaaaauaaaaaauuauuuaacaauuaaaaacaagaacuucuacuucuaggcuuuauaggauuauaguaaacagauuuauccucuucucuucacacagaacuaaauacagauccaauauauuagacaauaguuuucaaaaggacagugagcucugagaagaaaaccuucugaaugcuuagcucacagccugaguucaaucucagaacaaacagaaaccaagucuuugagaugagacaaaaugcaaaucugaaaacugauaacaucuccaacaucaaguaccagagagaacugugaugcacagagaaagcuggucuuccagacuucaggcuaaguccuucuaaguccuugggcaaagccauaagccaaccaacagaaagaauaaguagguaaggcaaucugccaagaaagaaagagagagagagagagagagagagagagagagagagagagagagagaaagaaagaaagaaagaagaaagaagaaagaaagaaagagagagagagagagaaagaaggaaagagaaagaaagagaaagaaagagaaagaaagagagaaagaaagaaagaaagaaagaaagaaagaaagaaagaaagaaagaaagaaagaaaggaaggaaggaaggaaggaaggaaggaaaagaaaaaaaagagaagagaagagaagagaaguuuauucccuaggcuaaaaauuaaguccuacaaagcagugcauggaagacaaaguuauuccuaaacuaaaugcuguaccacauuuaccuuauaauuaaucuuaauaaaauuuaauuuuauuguguguaugugaacacaucuaugacacucugauuacauggggcugaagaucaaacgaagguugccagguuuugagaucaaacaccuuuaccugcucagccaucucccugguaucuugcuagcaagacacacacacacacacacacacacacacacacacacacacacacacacacacacacacacaagauggcuaaaacagaaguugucuuuuaacucauccagcuaaacacuuauuuuguguuuauuauuuuaccacaagauuugaacaagguuucuaauguaguagucuuaguugaucacugugauagacagguacacucuggaaaauggccuaaaagguaaugagguucaaguagguagcuaacuuucuuuaaauauugcauuaaaucuugugagaaacaaaagcuagaggccaaugaaacuugaaaagucacaggagagaacuaaaauacuaaagaaaaagaaucauuguauuaguuuuuauuugcuuauuuggggagguacaugauauguaucuagucagacagcucucaggggcaauauuauuccaccacaugagugucacagaucaaauucaggucuucaggauuagugacuuugcccacugagccaacucaauggccagaaaaaaauucuucagaagcaauaccuuguuuuuuuuaacuuaagagcaggaugagcuggcacauaccuuuaaucauauauauauauauauauauauauauauauauauauauauauauguauauauacacacacacacacacacacaccccauauuuaugccuauagauggcugcaagccaucaugugugcuggguaccaaacccagguccucugcaagaauaguaagugcucuuaacuacugagccaucucuccaguccugcaaguaaaaaauuaucuuucaaaacuuagaagauuuucaaacaugaaaaagauauucaguuaugcuauaaaaucaccaagagaaaauucaaauaaaucuguaauauuagaaaacaucagcacauaauagcacuggagaaauggaugaagauggacaggauaaaaaacuugauaggaaucuucauacaauugugguagccuucccagguauauuuguauccuaaaauagaaacugcauguguaggguucuguguauucagaguacucaguauuugccuaguaucugagaugacccuaacacuggauuaaaccccuaguacugcuaaagaaagacaauagagggauggagaggagagaaagcaauugcacaugaugguguauguauaaccacagcacuuaggaaucaguaacagaaggauccauaaauggacgcucucaugccucuuuggggcuucauuacacagguaugaaugauuaaagcacugcccacaauguaaucaacuaacaccuuugaaguugccgcacaccucuaauccuguuucagcuucucaguggcuaacccccaguucuaggcccagccacgugucaauaugucagcauucaaaaggauaccacugcggagaucccagggcuuuaggaguuucaugauagaaaaacaaaaugaaaccaaagaucuauguauaaaauacuauaguacaguaaucaauagugagaguuugcugaugucacaagaguacauuuuuggaauggaaacauacauuauuucaauugugauggugauuacaccagucuauacacugacugguuaaaacaagucuggagacauggcucagcuaucaagagcucuagcuggucuuccaggacccagguucaauucccagcacccaaaugguagcccacaagcaucuguaacucauccaaggggacccaauaccuucuucuggcaugcccaugguauauacacauacaaauaugcagacaaaaaaucauuaacaaaaaauaaauuuuuaaaacucaaagaauaaaauugaaauaucuacauuuaacuguacuaaucuauaccucaaaaagcuguuuccaaaaugcuucuaaccuauuuucuaguuaaucauacauacauaccuccaauugcuguuguuccauuuuagucaacaaaaauuuugaguagauauugcuuuuuucaagcaaaugcugaagucugcgguaccgaauuucaguggacucucugucccaagacuuuugagccuauccaaagaaaaauauuccauacuaaauuaaagagauacaaauauucaaagucaugcuacacagcaagucaggcagcagccuaacuacacgaguaaguuccaggacagccagggcuacacagagaaacccugucuaaaaaaaaacaaaacaaaacaaacaaacaaaaaaaaaaaccccaaagacaaaacccaaagaacgcaaaccacuaaaacaagggugagguagaauaggaggggaggaauuaacaacuaaguauaaugacauguaugaaaaauaccauaugaaaucccuuuuaggcuaaucaaacuaaacaaaacucucacuggccagggacuacaucuuuuuauaacuuuaaaauugcuguuaccuaggcacagugccuaggccuuuaaucccaguacucaggagacagaugaaagaaucaagaguucaauagucauuguuauauaggggaauuccaagccaaucuggguuacauaagaugcuaucucaaaacaaaacaaaacaaaacaaaaccucagaaaaaaaaaacaaaaccugugaucuauguugcccucugccacuuggagauucagccuucaagaaugucaucaccaaauucagccccucaaacuuggaucagaacagugacaccaaaauaagccucuuucuuauuugucugucuguaugcaggcaacauguauggacauuugcaggccugcauacccauuugugacgagcaaaagaaaacuuugaaguuaauucucucuuaccuuuacauggguccuggggauccaguucagguugccagucuuguauacccaacaauuuacuagcugagcgaucugaucaguauaaagcucuuuucaaaguucuauaugcauauuguacugcucauggcuuauuaucccuugccagcauuuuguguuccccagagcuuugccuucaugcuuuagcuuucuuuuaagagcugaagcucaccucaaacugacuauguuaacagaagaugaccuugaauugauucuccugcaucuaucucccagacacagggauuacacaugggccaccacccccagcaagacauugcuuucaugucacauacacuuuugaacuacaaaccucuacuuuuuauauuacuuuuauauuuacucauugaguaauuuaacuuuacguguguagacguuuuaucuacauguaucaugucugugaaccacuugugugccugguauccagaggcccgugggcauuggaugcccuggaacuggaguuacagaggauugugagccacgaugugggugcuggaaauuaaagcugugucuuugagaagacugaaggugcgcauggaugcuagagaugucagauccucuggagcuguaauuagaaaauuugugagccaccugacauggguucuggacucaaacucagaaccuuugcaagagcaauuaacacuuaaucauuaacccaccuccucagcucuacaauuuuuaaaauguaauuaacuaucuacuucauaaaguagaugagaacucaauaaauaaaacacuggaaauaaaaccugaccuuuucuaucuucuguuuugagaucuuucugugacuugucugaaauuugcuacauagacuaggcuggccucuaacucacaccugccuucugccccacacaaaccccaagugcugagauuaaaggcaugcaugcaccaccaccauaucuagcaugauuuuaagauuuuagggguagggaaaauuauuuuauguguuugacuguuuugccuguguguauauguguguauuaccacacauguuccugcuaccuauggaguucugaugaagaugucgggucaucuaggaacuggaguuauagaugguuguaauccaccaugugaguacugagaaccaaucuuguauagcaugccucuauagcccagugacuguuuuugauaaaggguuuuguuauacagccuacgguagucuaaaacuugcagcaauucuccagucuguuuccccaaguguuguccuuaauuuaaaggugugaaguacaaccaccacuguuuuguuuuguuuuuuuaugacaggcuaucauauagcuaaggcuccccgcaaacuuccuauguagauacacagcugagggugacccauguagggaugacuugaacaucugauccucaagcugccacaucccaagugcugggauuauaggcacggggccuagugugacccuacucuuaauaaaccaucauuaagauuuaacaaugguagauccaauaguuugaggcuaacuagaacuauguacuaugcccccaucccuauucagagggaagaaaaguuacaaaacaacuagugugauaacaucaaauucuguccauccuccaugugcaccacgaacacaaauaaauacugaagaacacugacauacaaaauacauaccgugaacuauaugacugaucacuuguuucaggauggauuauuuccuaaacuaaguggguuucuauuuaugguuagauaguucaaaguaaguugaacugaauguauucugugagaagaucauacaucuacuaaguccacuuucagcauuaccugugauucagcuaccauauaugcaaacauagaguauaaaaggugcaaagccuucaauaaaccugcgaucuugccugauuugucuuuagauagugucagucuccuucccuugcugacucuacaccucuuugggaccugaacccugcugaagcuggacucuggcacauuuacuuuaugaccaacuggcucagcugguaaagcacaacugcucuugcagagguaccagguuuguuucccagcgguccugcuaugucagacggcucacaaccugcuuagucuagcuccaaacucaccugcagcuacuccaaacucaaauggacaucucacacucacacacacacuucagaaaaggagaccuacugugaguuccagcccagcaugggcuacaaaauugaagauuaaaaaucccaaagaguguucauacucuauugacagaaugaaauaaaugcaaggaaaaaaaaaaacuaagauggaguuaagaacuucccaugauuauaucaccuuuucuugcauaugcaacaacuaagcagcagggugguggcacuucauaguacuaaucaagaacuaaacuugccaaauguuaaaagcugcuuucacuacguuuuaaaagauucuguuuuuuaaagaaauguacaaauacuguaacuuaccaugaaaacauacaccucaauuuuagcuaaagaaccuuacuuguagaaaacuaaaacaaauugauuacuuaggcagcaaacaguaauaaauugcuaagaaauccuuaggagaagggaaugauaugcacacuccaguaaucccagccagcacugggaagcuaggcagggggacccuaggauaugaaggccagcauaauacugucucaaaaacaaacccaacagaaaaauagaggggaagggaauuaucaguagacccggcuuacagcccaaccguugauuaaugucaacgucuaccaccucugucuacuaauacauacauuaugacucggggcauuaaagauuaauaauguuggccauuaggcauacagugagagaacauauuuuaaaagccaauaaagauggcaaaagcaagcaaacacuuaccagugacucuugacugaaucuuaguagucaaaaaagcaaucugaaacguccacucaaagauaaguugcaaccuaccccgcccagaccacacuucagaaaccuaucuaucauucaaagcccacgccaagauuuccacuuuacaaguacggagaagccaaguggccagggcugcuuggaaguucaaggagaagcaagugggggaggcaggcggggaggcaggccggggguggggguggggagccggggagaaccgccggccguggacuuuacauuaccucuucuaacaucuuccgcucuuucucaagucccgcagccucgagcuguuccuccuccuccagcauggcuggaguaaucaccgcaggcuccguuuguucggccaucucuggagccaaggacccuaagggagcacggcgggggcuuucagaacgggauucaaguuacaacccccgaguuccaacuucgggaagccacggccuucccccucccuggccgucugcaucgccggccaaagccacggacagcgucuggguggcaaagccggucggccgggacccagcucgugaggagaccuguaagggagacgugggggaacgcuuccgugccaccaagcagaccaggucgccgccggcggcuccucacgccuuuuccccuccucagcccggaccccggcgagcucccuccccggggugcagccuucacgccgccggcucaccgcugcugcucgcgggcggcuccgcaggcacggcuggacaccggccggggacccagucgccucaaacgccgcgagcuaaauccucacaccccgccggcucgcucgccccgcggcgcaagaaauucgcgcgcuucucuuucgcgggaaaacccgguggucucg

SEQ ID NO: 9271 - RNA, 6043 nt, Mus musculus
cauaccagugggggauauagagacugaaguggccaccuccuguagccagauaggacauccgguggagaaaaggggacauccacccacccacaaaaccuucaacccaaaacuuguccugcuuacaagaugcacagggauaaagauggaacagaggcugagggaacagucaaccagugacugccccaaccugagacccaucccaugugaaagagccaacccugacacuauuaaagauacucugcuaugcuugcagauaggagccuagcauaacugucucuugagaggcuucauccagcagcugauggaaacagaugcagagaccacagucaaacaucagccggagcuuaggguuucuugugaaauggugaggggauagaauugauggagcuagaggggucaaggacaccacaauaaaaccuacagagucuacuaaccugagcccauggcggggguggggggggcucccagagacugaaccaccaacccaagagcaugcgguggcuggaccuaggcucccuacacauuuggggcagaugugcagcuuguucuucauguggauccucuaacaaauggaguggaggcugucucugacucaguugccugccacuggcucuccuuccccuaacuggacuaccucguggggcuucaguggaagaggaugcgguuaggccuucagagacuggaugugccaagguaggguagcacccaagagggacuuccccuugucugagaagaaggggagggagugauggggguugggauuuguaaggguggagcuuggaggugagaagggacagggcugggguggggagguguugagggucuggauguaaaguaaauuuaaaaaaaaaacaacaacuauuuucaauaaaagaaaaaaguuuaaaaaaauguugaccauaaaguagaggaaauagccuagacagugagcacuagucagggagcacccccugaaaacagagcaccgccauacucagaaggcuuugcagaaacagacacagacagugaugggaagaaaccagagaugagggaaauuuccagaacugaaagaugagaauuucugacugggagggaaacaaaugcucccacgcaauacacaaaucacaaaacggguggaucacaggggacagaaacuagcuugugccaaaacacaucaccauaaacuucuaguacauacaagacuagaaaacaaaacaaaagaccaagacuuuuacauccuuucuggaaacagggugggugggagcaacagaugacacagaaacacuuaggaacaagagcggugacguggauacccuaagagaugcaagagccucgcugcaucuucccucugagcgccuguuuucagcgaguugcugaagggugcuccacccaguugaggcugggaaccuagaaagaggaagagauguuuagugcgagagucaacaugggcuagaggccagcggacagagaaugacaaagagcagucagcugaaacuaaacaggacaaaagccucacaagggagacuucaaaaaugaacaggcaagaaaggaagacggcaaaaguaaaagagaacaaaaaccaaagcugcaauggagggaaggauaagacaccugugacacugcugacagucagaauucaacuaaauuuggguuuaacuugguuuaugagggggggaacaacccaguuaccaaguagaacagccaacucagcaaguggagauccaggcguuacugcaggguaaaggaugcacagggaaggaaaccuaagaggaaggaacacuuacucagaugcugacguaggcaggggacgcugcugccuaccccagaucuguccaucacugccgggggagaggcuggagguggaggggugaaagauuuggcugucacgauaggaaagcagcagcuaucucagcggacacuaaccaggcgcacaugccagacgacacuguacaaagguuaaaggcagccgucuuggacaggaugaacugaagauggagcugggguagaaaggggacugcaggucacugucccuuuguacacucgagucuaaguuauauucucagguugcucugacaugaaauacugauuuuuuuuuaaaggaaaaauaucccaaucaucucucaaaugaaagccuccuggagccucugaguuaagggaugccaaggucggcucugcccuaaaacagucacuagauuccugugccuccggugcacagacauuguugcucugagcaggagacugucuguaagacaggcagagguggccgcugccaaucugacuacugaguuuguugguuauuuuuguuguggugcuuuuaaauauguaaaauguuccccauuguucauuagcuuucuucuaccagagccucaacaguaaaaguguuagaaacgcacuucugggagcacugcacuucugggagcaccgcccuucgcacagacacauugcaucaaaauacaugauuuucugagucaaccuauggugaucccaucauuucaguuaauuuuccgccuuuuuucuucguucaaauccagauguauuugcuucucauuucuagaauaauuuucugaacuguucagaucuaagcucuugauauucugugaugauacugacucucagagagacagacuuugcaugcuuguagccugguagaaaaauuacauacauaguuggaagucaggcuaauaagcagguuaucacauuucauauaauccuuuuaauucugauuaauuuuugcuaguagauuaguacuuuccgauuaacuuuaaacgaaagauauuucuaagucucauuuaguauuucucucagcaaaaaaaaauauaugcuuguuaagauucaggagauacagaaauaucaaaaagaaaaauaaaauuuuuguaaacaaucuauuuuaauauuucauccuuuuggucuucuuucuguacguauuuuuugucaagguaauuauuuucgaaccaauaggucuugacugcucacuuugauuaacugguccucauaacaauagcguccuuuaggcucacaacucuuugucauaaucucucuugaauauagcuauaugugagguuauuucccucugcuacuccagcagacaacucgucagcacaugcccuccagggaacauuuaugcacauacucuagauagcuuucuuggacaguuuuuguaggaucagaauaauaacaaucuucacgccuuacauaauuauaaacaaaccaccauucagcaaaguuuaacuuacacuuuugccaacuuaagaauguccugucccgagaaaauacccaaggagcuaaagggaucugcaacccuauagguggaacaacauuaugaacuaaccaguacccuggagcucuugacuccagcugcauauguaucaaaagauggccuagucggccaucacuggaaagagaggcccauuggacacgcaaacuuuguaugccccaguacaggggaacgccagggccaaaaaguaggaguggguggguaggggaguuggggggggaggguaugggggacuuuugggagagcauuggaaauguaaaugaggaaaauaccuaauaaaaauauuaaaaaagaaaaaaaagaacguccugucccuucagugguacugaucauuaaaaagaaagaagaaaaagaacagcagaaauguuuccuuuuuguggaaaacagcgccucacuguagcaacugacuggguuugcaagugauggggacauucacguccuucccauagucuuuauccacugggacuuccucuaccuccgcuaugaaacagcuguggagcucuagcaggccucaauacccagcaaucaggacgguauccaaagcauuaauugguagguuuugauuuaacaacugauuuuagccucuugaaaaaagaaaugggucuggugcagguugcaugccgcauagcgcaagaggcaccacuuacaucauaggccacccagagacccugaugcuaacccacacaauaacugugcacagcagcucuguugcgugcuugggagucaugggaaguacuuccagaguauuccuggggagaagccgcaguauuugcuuggauaccuugaaaauuuggauguuaauaggacgacucauaagaaaugccaaucauuucauuuugacguacaaaauugucuauugaaaauggucccacccauaaauauagauaaauguauuguaaaacagagcaaaguauuguaggugucuucagaacuagccaagcugccacuucccucucaaguugcuuagcuacagaaggagcgcccaugccugcucuccugugucagccuuggugcauuuuuacaaaccuggcugaaugaguaaggguaagucaaauaaaccagggaugggggaagcuggggaugagaagauuuuuuuucagucaguauaacacacggaaagcacuacaguuaugggaggcauguugaucccugagcucacugauaagcacuaggggaaccaggaauguuacacacacaggaggcuuguccuuuccaagggggugggguggggugcauaaccuguuuuccacccagaaggguaggaguagacguggcuaauagccuggugacuuuugcacuaucuguguggucaagaugacacuggaucauccaccaggcccuuauuauaagcuugucaaucuauagaacccauccuuauggaaggugucaugaguacuuugugaacaguuuugauauagucauucaugucuuaagcuuuauuaugcacaagggacuggauuauuuaucacuaggagauuuuucaccaaauugugcuguaguuaaauaucccuaaaauaaacuacucaggaucagacuccuaaaguuugaaccaauaccagcuacagaauugugcugaacugaacgaccuuucuugucucccacagauguuacucagaugugguggguucagagagccuuauuuccacuaaaggugaaaacaaaauacacuacaguccaacaagguuaaaaaucaaucagagagcagcccgcaucaugacucaacagaaaaaaaucgugacucagcagauaagaaucgugacucagcagaaaagaaucaggauucagcaggucagagugucugcugagcagaccugaugaccuggguuugauuuucaaaaccaacaugaaaaaccuugauagcguaugugcaucugugaugucagcauuccuaugcaagaggggaggcagagacaagagagugccuaccagcucaggaaccagcuggacuggaguauucaguacagugaagacuucaagaggauccuguaucagcaagguggaaggagaguaucaacuccaggaguugucccucuaaccucuacaaauguacucuagcauauuauguaugcacacacuuaaaaaaaaagucaggaaaaucccaacagguauaucaaagaauggccugugagugguggcuuuugacuaagggaagaacauucguaacccuaagaauaucugagaaucauuuucucuauucgaaaagagaaccuugguugauuacagggcaugccaugaucauggauaaacuggacuggcuuguccugaaugcugauacuuuuuucacagaaaauguuauaaucugacacccaugaacaccauggaaccacaaaccugcccauaagaguuuccauccuaaaugauuucacauggcaggaacacaaauacauuccaacagauagcggcagacuaucugcaccaaaguggacaaacacuguuacugaaugccgagaguucauuuccucugcuucuggcaccauaauuugaaauuuccuuugaggaaacaugucuaccucccucucaaccaacuucuucagaugucaaaaauucuucccuaguucuuggacaaagggaaaggauagaaaugagggaauuagaucaacagaaccaggcuggagagauugcuccgcgguuaagagcauugauggcucuuccagagguccuaaguucaauuuccagcaaccacaagguaguucacaaucaucuguaaugaguucugaugcccucuucuggugugucugaagacagcuacauguaguuauauauaauaaauaaaacuuuuuuuuaaaagga

SEQ ID NO: 9272 - RNA, 23752 nt, Mus musculus
ggcgggagagaagagugucccucacagguagccugugcguggggcugcucuggagcucaggguuggcucccuugugggccagagcuuuggguagcagcuucguccaaccacugggacgucaaagggauaccacaacucgcgugauccgaguaaguacagggaacacgccauuugcuaagaugggggcugccuaaaaccucuggguugaggccauuuccugucaaccaaggcuugccaagcacaccaguuccugcuucuggugucuacuugggaaaggacgguagccauuuuccccguucuuccccccgcaguaggauccccgcggcuggugaguagacggggggcggugaggcgggacgcagggaggcgccguaugacgaggucagccguggacucagcgccauggccuacucucgggaggcugaggcgggggcccuuccggccgccguucccuuccgcucgccucaggugcagcgcggaucccuccgccgcagcgugcgcugccggcagcgcggcgcucggcuuuccggcaguacccggauggagggguaauggccgccaucugggacucgcaggcaauggggaccacggcagguauucccugugugcggagccgccaagaccaguuaggaugucgggacgcacagagagacggcaaggggccaagggcgaaaucguggggugcuaggguuccccccaaauggucuugggggggauccgccucuugcgcuaggaagcucauguuaaauagucccguccauucagcgcuuccggccaacuugccgcaaaguuuucuagagaaguccuugguuucuaacccggggcucuugcuagcucuuagggcuggucauugucgucucggcuugggcugguuguaaguuugucccuaagaacucccccacggucucagagccuaggacuugggcgcgcgcgcacggcgcggcgacaguguacauccgcgcgcccgaggggcagcggaacuccggggaaaggggcggaucgggcgcggcguuuugggggcgaugcgggggcguuuggcgcgcgaagccaucgcucgucggguuccgcgcccgguggagacgggcugggcagcccucaguccgcaccccucgagcuguagguucgcgggcccgccucgacggcaucccuacuaugggcccagucuauggcuauuggggguucuuccuugcagagacuccccgcucucuuggcgcacgcacugcgcgcccucagaguugggcaagaaagugguccucuuguagacugcccccaccaccaccacacccaguggcauauggauuucuuugucacgggcuuuuuuuuuuuuuuuccccacuuguaggguccaucuugaaucuguucuuaacaugguguccucuuuguuaaguggguaguaucuugaguuagauggcuuugguaacucaaaaguauugggucugaaugcauagaugaugugauuuaacucuuaucuagaccaauggaacagaugcaacuucaaaguuuagaaaacaaaaguuaagggucaguuuucgcuucagguuuaaauuuggguuauuuuaguuuuuguaaauuauuuuuuucaaaagucuugaaaauggggaaaggggucaguuuuugaggaauucaugagaauguugaacugucugugauuaucucagggauguaauguaaaaacaacucacagcgugguuaauuugaaagucugguuuucuuaaggcacauuuuacuaauaauaauugaauugcuuuuuuucccagcaaaacaggucugauuugagugugcucuaaaguuuguauggucagaaugaauagagagacuugcugaaauucccuaacauuuuuaaaguuauagcugcagaucuguuaauuauccuucaacaaagcuguauuuuucuuuagaaagucaaaaggggcaauucguacuagcacuugagggguguuggcuuucuauggcguagguaagcauaguagaccuuacucuuuucuguuuuuuuuuccaaauuaugauuaccaauucaaacauuauaugucagaugucugaacagauaaaaggauagcaacuccagcgacugugucuuugugagcucauagcaaauaaacuuaaauacuggaggguuuuaucauaaccaccuucacauuuuaugauauuuuuucuggaaguaguauagugugguuccaaaagcugcuguauuuugaaauauuuuaaaugagaaacuuucuaucuaaauauaguuugagugaaaaaacccacaaaaccuuacaaugcccuuuuaauguacuuuuauugcaaguguuggggcuuacucucauugaagcauugugugugcccuguagagaacacuuaaucugaccagucuaacuacuuuucugguuuuccuuuaaguucaagauuuuaaucuugcauuucuucaggugcucuauuuaaaaggguuuugucaauuagagaaaaggguucuuagaaaauuugaaauguuuaucuguugucugcccucauguauagucuauuaauucuauaggcuucacaucauaggcaguucucaugggauguugauaccagccuugagcauuacuguugucaguaggcuuuuguagugggcagauaagugguucagaaucaggugcaauacuaauucugcuuuugcaauuuggauagggcaaaacgaguuuuccuuuuauuguauuaaaugaugcuauuguauuagauucuuggagaugugacuuuuguauuacaugaguuauaucacuggguaucaauuguaugcuuaugccccaaguacagaggaacuuaaaaacuaauauuccuuacuuaaauaugaacuguaaaugaccaggauaaaagcauuuuguuuuugcugucaaaauucuuaaaucuucauuuucauuuccagauaccaucucuugaucacuguaccugauuguggguggcauuguccaggcauuaaguugugugccuuuguuccugggagaaagguagggauuggagcacuugaguagauagauuuauuacguaguaaguucgcgucuuaauauuggauuaaauagacugaaugguuaccuaucucuuaauuuucaaaguuacuuuagaguuuuauuuauuggccaaaauaaaaggaauuucuccggaaguuuuuauuuuaauguaaguaaaaaacuaauuuuggguuucauauuuguugaauguuuuaucagagcucaaagaugauuuuaauaugucaugcuaaaucuagagauagcauuaagggcuucuggauaaugaucaauaaagacaaauaugguagaaacagguuucaaagcucuauaaauggcuagagucugugccuuaauuuggcaagugcuagucagugcaccuaaagaaaaacaauauauuugauuuacauuaugauuaaugcuuaucuacuugaaguuagaaaaggaacuggagaaucucuagagaauuaagacugguagccgggcgugguggcgcacgccuuuagucccagcacucgggaggcagaggcaggcggauuucugaguucgaggccaaccuggucuacaaagugagcuccaggacagccagggcuauacagagaaaccuugucuugaaaaaacaaaaaaacaacaacaacaaaaaaagaauuaagacuggagaaguguccuggagaaguaucugaaugucuugauguggacaaaaagaguggcaaaaauccaacagauccaugguaauauacggagagcuauuaaaauggauuggaaaauauugugugcccuuauucaaaaacacgguuuaaucuacucucaacacaaauaugucugucacuuguuuguguuacuuaggucuuggaaucuuuaaaaugggugccaugauauuuuauacugcucauuucuaaaugcauuaagcauauacuaaaauacuuggcagucauaaccguguucuuccaugaacuuuaccaauagauuacguucuuuucagggucucuuuuuucacaaaggcauaaauuuuuauuuauuuagaaauuaaugucugaugacuauauugaauagaacaaaguucaagccgggcggugguggugcacgccuuuaaucccagcacuugggaggcagaggcaggcggauuucugaguuugaggccagccuggucuacaaagugaguuccaggacacccagggcuacacagagaaauccugucucgaaaaaucaaaaaaccuaaaacaaaaaccaaaaaaaaaaaaaaaaaaccaaaaaaaaaccaaaguucagaacuggguuaucauugauguuccuuccuugaguaacuccuuuuuauaaaacauguuugauaucuugcuagauuugcauaguacuuuguuccuucauaaaauaaugaugaauacagagaauuuucaaaaccguauuugauauguuccugcguagaaagaaucaugacuagugaaaguaaauaagaaauuauagcacaauuacuaaacuaacuuagaugauuacauuuugcagaauugaugcuaagauuaguauugccauaugaguguuaggaaaauagacuauauuugaguuugaaagcuuaggcuucacaggggucucauuucaagacguaauaauagguaaaaauaaguguuagcucuauagacauuuauuaaugcuguuuuguugauuuuacacauaaaguauaccuaaaugguaugcaguuaucuagugugguaaaggccuuuauugugucuacuuugaaaacuuaaaacaaacaaacaaaaggucauugagcuagggcuauaucucuguaguaguguguuugccuagucucuaaagucaaauuccggguccccaauaaacaaauagucauaauuaacuuagaaugauagucuguuuccuaaauauuacugauuuuucuuacuuuacccuuuuugagaaaucccuuaguaacagacaaauacuauacuugucuuagagauacagccaguucaaaagugauauugauauuaaaaaauaaguguuauuuuguuuagguaacaaaauagauacacaagguaagaaaugaaauuuaaguaaauauuugcucacuuacaucucuuggagagcaugcugggacaugucuuuaaucccauacuuaggaggcagagucagaaggcucugagcuccaggccagccugguuuauauaguguguuccagguagccagggccacacgguaagccucugucuccaacaaaagaaaaggaaaagaaaaaagaaauucaucuggagcugaguacuaagaaagacauaaaaguuaauuuaugaccuguuuauuagauguugguguugcuuaagaucaugucuuuuuugccaaauuaucugacuuucaaauuuaagauuaacaguuuaagauuguuaaccaggguuugcagacuacucuuguaaaugaagauaguaaauaucuuaggcuuuguagucauauggcuucuguuaacugcuaucaagcugucauuggaauaugaaagguagucauagacaauauguagaagagcaaguaugucuugggcuuguguuuccagugaaauuuuaugaaacuggcuauuagccaaauuuggccuguagguaaaccuaaugagacauuuuguuccacaagcacucacagauuuguuuaccugcuaguaucagugccauccccuguaguuacuguagaggaauucucuguucuuuucuaaguaugacucaguuuauucuauacuccaucccucugaucuaccaaagucauuguuaccauauuuuuccucuauccucaacuuuaaaauuuucuaccaggaucauuuucauagauauuuguuuauacuauaguuuugcuuauuaaaaacaaaacaaaaacccagugucuucgguucuacccauagaucuuuugugguauauucccucagaguugucugcauagcagcuuuguuucugugccuuguucccauauuuuuuccuaaaccuauaugauucugccuucccuauuaacuccuccuaaauugugcuagccacuguuccuguugauugugacauuaaaaccaguguuuuaucucacuuaaugaaauugaucagucccguuuuauuuaccuuuuuguagaauaccacauuuucauuuagcuucaauaucaauggauuuuucuuuucuaccucaccaacuguucuugaggcuuugggcuuugaacuuuucuguuuauuuaugcuuugguaauuuaauuauguccucaauacuuaaauacaaacagcuauauccugaugacaacuuaaauuuuaucauguagcuagaccuuuguggagaacucauuauauaauuucacuugaaugucagagauaccuugaauugugcauauauauaacugacuuuuugauacacuugccugcuauuucuacagcucuuaaaaaauucacuaaauguuugacauacauuuuauuuauauuagaauacuuauggcuuauaguagaucauauuuguaguuauuggaguuggaaguuuuagcugcuuuugguacaucucuauaucagagaagauaggccaauaaauuuuauagguacuuucuucaaaaucaauucagaaccugaccaugccuucuagacucugugaggucauuauguuguacaggaugauuauaauagccuuuaaauugguucuuuaaugauuuccauuuuucucccaaaucuucuacuuuuuauauaauagcccagauggucucuuuuaaaaguaguuuaguggcuggggaauguagguuaauggcaguauaguugccuaucauguccaaggcacuugcaaggaaaauucagcucaugucccaucucuacugaaguaguuuccugucucauuuagaauaaaaccaaaaugcuuagcaucuucaggcccuauuucugucuccauguuagaucuuugauucuagucuacauuucuucucuuuucaugcuuucugaucuaguaauacugauagaugaaauauguuaggcauacugaacacucaggauuuugggacuuaauauuucuuuacuuagaaugcuagcucucucaacuucuccuuucuuucuuuuuguuuaauuuauuguuuauaggcaguguuguacuguguauuuguggcuggcuaaaaacucaaguuguagagaccaggcuggcuucacacucacagagauccaccugucucugcuucuugggcccagguaucacaccugcaucccagcucccccuuugacuuaagacucgcuucuuucuuuuggcaguacugaggacugaacucugagccuuauugagcaugcuaaacaaauaaauaucacugacccauaccccauaagaacauuugaagugagaguuuccugauauuauauuuaaaauuacaacacucugguuuuuccuuuuccccauuguuuuaucugcucuugcucccuuugaccagaauaacaguguccuuuauugucugaacaguagaauauuagcucuacaggggagggauuuuucucuucucuuuuccccuauugugcuccugagacuuagagcaaaagacuggcacugauuuggugcuaacugcaggcccagcacuguggguugagcagcaaagagcauuauagauacaguccuuauuuaguucaugccauaguauagacuuagaggauaaauuagcagaguuaaauagugcuaguacauaaaaguuuaauaaaggcauaaaauagaguuauuuguuuauuuuugaggagagggugauuuauagaagaggaaagccuugcuaaguaggugaugccaaguuaagaaagaaagaauuaaggagcuggagacugguggcuugcuaagauguuuacagaugacaagugugguagaaaugaaagugaagagggaaggcaagguaaggugcuguucccuuuuuuaauacuuacaauuacagauuuguuuuuuuaauaguccuuaacuauguuuagguguguacauaucugcauguggguaugcacacuugagugcaggugcccauucugggccagaagugucaggaacccuguagguggauuuagaggugguugugagucacuugauacauguucugggaaccaaacucaugucucaggaagagcagcaaaugcucuuaacuacugagccauuucuccagccucagguauuauuuuuuuuugucaggcccuugcaaaaagauuaaaauguaagugcugggguguuauagacuggauaaucuuaauucuccaauguaauggcauuagaaggucaagccuugggaauugauuaaauuaugaagauagauucuccaugaaugaaauuaguguccuuauuaaagagacccuagggaguuucuuugcuguuucucugccauuuguaaacuaggaagauaauagugaugcuauuucuuugcuguuucucugccauuuguaaacuaggaagauaauagugaugcuagugacuuuaucauggccuucccagacucuggaacuaugagaaguagauuucaacuguuuacaugcugcucaguguauaauaugcuauuauagaauccuauuagaucagccuaaauggacuuaagguucaaguuaaggaacuuugugacuuauauugauagauuauuaacucuugcugagagaaugcauuuuacuuuauuguacuuuuuuaaaaaauacuauuuuaugugcauuguguuuugccuacauauguaucuugugcuuguguacuuguguccaguggccauaguggacagaagaggauaucagaucuccugggacuaaaauuacagaugguugugaccugccauaucagugcugggaauugaugccugguccucuggaagagcaacuauugcuccuauccacugagccaucucuccauccuuagagaauguguuuagaagaaugugguagacaagcgggaagcauggaugccacuuaggaaacuguuacuucaaguaagagcugauagugguuggacuaaggugaugacauugaauagcaagaggagaguggggauacgaguuauauuuugaagauagaguagauuaagauuacuuguggaucauauguuggugguggugcccucuccucccuacacuuucugccagacaugguggugcacaccuuaaaaucucagcacuggggaggcagagacagauggcucuaugaguuugaggccagccugauauauguagugaguucuaggacagccaggcuauguggagagacacugucucagacagagagacaaacaagcaagcaaacaaacaaaaaaucaguauucuauguaaauuuaaaaauuuuuguccacucaugaccccuuuugcccaagaauuuuuauguaacuguggguaacaagguuuauaaaauaggcauacagauuaaauauuuacugauagugagucauaaacauuuguuuuaaaacaauugucugcuauacauauaguuuuauaauuuagcaaaggcuaaaacaaauuuacauacuacuaugguagaugugucuguuuguuuuuauauaaacaauuacaauuuggcugaaaauuuauacugcagggugcaucugauuuuuuuuuuuaugguugauuaguauuuugauuuuauaauagucagugccaagaacagcacuuuguguaaauacauaauagcagaauuacacuuacggcuacuucagaaauuauuagaaauucuguccuaauaucaacucaggauucacuucaauaauuuuuaaaauaauaacaauaacaacaacaccacuuuauauuauuauuacuauuacuauucugugcauauauguguauguagaggucagaggacaauuugaugguuaucaguucuuuccuuccaccuucuacuuguguucuagggguugaacucuagguuugugcagcaguggccuuuaccugcuaaugaaacucaaguuagcgauucaaauagauucugaaaucaaguauucuacccaauacagucuaaagauaauaccaauuagacacugaggaaugguaagagaaauacuaaaagcuuuugucuucuaauuaaaucauuauauuucuguaaguagaaagcuuuguauguacaguggaaacugcaguucauaaugcaagacuguuaaaucggaacugggauguuucgggcagcuuugguuggcauugugagucuugaggauauacuaguacaagcgugcauguuguguguucagaacugagacugguaggucaggccauguaacaaaggugaauguuaauggagacaccuuagauccauuacacucuagauuuuuaaauuagugauugguuguugugcauucagaaacuucuuacuguuuuaccugcauguauguauguguacucuauagaugcaugugugauccuaguaaaggacagacccuggaacuagaguugcagauguuugugagcugccauuugggugcugggaauugaaccuugcucuucuagaagagcaauuggugcuauuaacugcuaagccaucucccuggucccuaagaaauuauuuuaaacuaggagguauggcucagugccuauaaucccaggacuuggaagguagagccaagggugugccaguuuuaggcaguuuggggaugcaaaggaauacaaagggaaauugggcaucaacccccuugccuaaacuauuucagugacuucucugugugauuuaacuuuauucuugcauuccuguuggucaguguugagagcuuuguuguucuagccuucucacccagauuuccuuuuguuguugggguuguuguugugggugggugggugggugguugguugguugauuuuugcuuuuuuccuuuuugagacagaucuugcucuguacccuaggcugacuucuaauucaacaguugucuugucucaacuuccaaugugcuaggauaacaggcauguucagccauaccuagcuugucugcuuugcucuagugucagagaaguuacuucauuugcuguccaggccuuuuacuuuuuugaauguuuauuuuguuauacuuugauuguuuuauuauuuuaacauggucucacuauguagcuuaggcuggucucaaacuugucacccuucugcuucugccuuacagauaauuaggauuagaugaacaugccauuguuuccaguauuuguuuacucuauuuuccuacuuucagagagucuuuuucuguuguucuuucguaccuuuuguuauagcuuauuuaccuagaaaaucaguuuuaaaauuggaguguauuaauauauaugucuguauuaggaguuauuuucuuucuuucuauuuggucugaauucugagcuaauuuuagacauuaccucagauguccaguaaucaguccuugaauuguuugauaauaauuagaaagcugaugggaaguucugucagaguugauagauggguuaauaaacacagcauuugauccccgcucuggagagcucucuaugggcuuggucuguccccagauucuggcucgugcuucuuaaguugacuggaaaaagcagaauuuauaaauaaaaccgcaauuuauuguaaaaugguaguuuuuaaacuauaguaaaaacaaaccauaaaaauauuagaagaagacacuuaaaacaugaggagaggagaagauacaaguccacagagguuuucuuaaacagccacugucuauaccagucuuguagguugauggcaugguucaggaaccaauagcagaucaugguuucaggaacacuguuuuaguuuaggaacacuacuagaggggauaaaggauauggaugaggggagguuugugucuguuugugaaugguuagugaaaugcucuuaauuuugcuaugauacucucuuucuaauguggccuguuucacuuuagacuuucuguuuuaacccugcagagaauacaucuuuagauuucuacuguggugggaaaagagcaguuucuuaugugacagacuagguaggaaucagaucuaagacucaaguagcuuucuccagauuucacuuugcuuuagcuuuccugcugcuuccugcugcaauuccugaguauuuugauaauuccguguaagauggaucaguucuuaacuuuacccacugucggccugaggccagggacuaagcacuguggucauuuagugccugauuacuuuccagcaucugauguuuucuuuuuauaguaucugcaaugagaaguuguuaauuuuucaugaauuucuuauguauuugauauuguaucuguuccuuuaauaauuuuuguuuggcuaacuauacuaguaaugcuguuaauauuuacuuacauguuguagauuuuaucauagucucuugaucuuuguacauuuuuuucucauaugagaguuuuauaauagacuuaggauaaacuuuugggcuucuccuuuccuuugaaaacuauaaaugucuguuucauguuccauauaucauagcacuuacagcuagcuaauacuguauguguugaguuuuauauuuucuuccuacugguaauuuuaccuagcuuuuggaaaaacugauuuuaaaaauucaagucuuuuuuuuuuuuaaccucaaaauuauuuuuuuucucaucuacuuugucucucuuauaauauuagcuguuuuuucuuuacuguaauugccaacuacagaacuauuccauuuugaacagugauagucugaaaaugaugaauagaaaaguccagaaauaaccaauucuuauguuucuaauagugugcuacucugagugguguguugaagucuauuauuucuuuacaccccgagaugugaauuauuucuuagccugcccauaguguuuuaugcuacuuaaccugcuagucauuuggaaaguauauugguuaucaacuugguguucagagaucauauuacccaguguacaguauaguagcucagugcuaugccagugucuguaucauuuaccuugcuuugggaguauuguaucuuuaggcuucauaccagaagaacugugaauauaauucagcaagguagccaggcgguggugacgcacgccuuuaaucccagcacuugggaggcagaggcaggcagauuucugaguuccaggccagccuggucuacagaguuaguuccaggacagccagggcuauacagagaaacccugucucaaaaaacaaaacaaaacaaaacaaacaaacaaacaaaaaaaucagcaagguaauaaacagaaacuacauacuuuuuuauuauaacagaguauucuauuuuauuauuaugaaucuuuuacuauuaaacucuuauuaguuaaacuucaucauagauguaguaagaaaauaacuauauacaggauuuaggaacuucagguuucaggcaucuacuggggugucccccagguaagguuaggggguaugggguuggggauauuguguuaacuugauuuuuaaaagaaaaaaauagcaguaauaacucauuauauagucacuucuggauaaaagaaagaaaaagaauuuucucugaauaaaguguuuacuuccuucuucacacccauccaucacuuuauccaguuauuucugcuucuuaaaguuuauugucuuacugucuguuccauacacacacacacacacacacacacacacaccuguuauuugaggcaugaccccacuguauaucuauggccagccuagaacucacuguaugcuccagacuggccucaaacucaaagaaaucugucugccucccaaacccugggauuaaagguccauguucggcccuugcuuuuauuuuauaaugacaucaguaguuaagaugagauaaaacaagauuuucucuguuuauuuaaguagaggaggugaaauuuggaggguuuuuugguuuuuugggguuuuuugguuuuuuuuuuuuuucugauauugacauaacuucagaaaaauacaguacuggauagagggaacuagccauuagugcagaaagguucauuugguuuuaguaaugauuguccuuuuacgucuccugacaguugauacuagcaaguccucauucuuccuggcuucuggacucagcugagaauucuggauucuuucuuucucauaugucaaccugagcccucuggccucgagagagcuccaaccugaucuuucguucaagcuuccaucucucccacgguagguuuaguggggaaagggagcacaugauugccauuuccuuacuuuggauguaaaagauaaucauuaaauauuuguugaugagugucuccuauuggacuucucuuucaaaauggugguugguaucugaaugugauacuuaagccuguaguucaagcuccucauuggcagaagugggaaaauugcuugaguccagaaauuuaaggcuagcuuggucaacacaggcaauguagcuaaacccagugucacaugccuuuuacuuuuuaaaugaugguuguuagucagcauuugcuuuuuucuuuuugguuuuuuugagacaggguuucucuguguagcccuggcuguccuggaacucacuuuguagaccaggcuggccucgaacucagaaauccgccugccucugccucccaagugcugggauuaaaggugugcaccaccaccgccuggcuuuuuuuuuuuuuccuuuuucacuaggccauuuccuaucaaauauuuuguaauacauuuuggaauuugguuuuagaucuuuaauuuuuuucucuauuauuuuuguuacuucauuggucaguugguagaaggaagaaagccuauauaguuuuauuugcuauuguguaggaaacuuauuuuacugcuuuuacaaaggugucuuauuucagugacuuaggacauugguaaacuuaugaaugaguagaaccauaauuuaaauagcacauuuaaaaccaguucuuuuuguugguggagauggaaauugaacuauaauacaaacuaacuuaauagguggggggggggucaaauuauaauaaaauuccuguccuuauguuaccugagguaucuauaacauaguuucuuucuuuuuucauuaaccaaagguagcagcucuaguguaaguuauucucuggugguauugcuuacacacaaauagugggcaugccaggcguugguggcucacaacuuuaaagacccagcacuugggaggcagaggcagcuggauuucugaguucaaggccagccuggucuacaaagugaguuccaggacagccagggcuauacagagaaacccugucuccaaauaccaaaaaaauaaauaaacaaauagugggcaugcuucaagaucagguagauuuuucagauaaaguuggaauuugagagcaaauuacaagcccucaacuaccuaaaauauaugcgcucuuccuauacuauauugacauucagacaguuaucaccuuuaaguaaaagcuaaacauuuuuauaacuagucauugaauuaucuuuuaaguugcaucuggauaaagaagaacauucaaguagacacucuuauaaccuggcuucccaacaauucuaguuacuuucaguagcuuuucuucuuuuuaggauccccauccccuuuauaugaccuuuauugagcucucucccacccccuuuugguaauacuaaaguuuuaaacauuccauucuagguucaugucuuagucaggguuucuauuccugcacaaacaucaugaccaagaagcaaguuggggaggaaaaggguuuauucagcuuacacuuccacacugcuguugauuaccaaaggaagucaggacuggaacucaagcaggucaggaagcaggagcugaugcagaggccauggagggauguuacuuacuggcuugcuuccccuggcuugcucaacuugcuuucuuauagaacccaagacuaccagcccagagauggcaccacccacaaggggaccuccccccuugaucacuaauugagaaaaugucuuacagcuggaccuuguggaggcauuuccucaacugaagcuccuuucucugugauaacuccagcugugucaaguugacacaaaacuagccaguauagcucacuauuucaaaaguuuaugauucaguaacuuaguuugcacuucauaaauaggcuuaucagaucaaauagugacuuugaugacaauuuucuuguuaauaccaucauugacaaccuugcuuugaaauuuuauuaaugcaacaaaauaauugauugacagcuuuauguuuugaguuuuuaguauauuguaauuuucuaauggucauuucaacuuaaaucccuuuuaguauaugaggagagauaaauacacaguuagcucuguuacucauagaacacguugucuuucuguucagaaagaagcacaagaaaauacauacaggcaauacauuacagagaaaaauuaaugccuguaauucuuuaauaauauuuccaauguauguuucuaacuuuguuggagauaaggaauuuuuagaacugcagaaguaugcauuaggauaaaggcaaaucuauaucuagguauauuucagaaauauuuauuguauaaaugugagaugggaguagauagaguuccuguagcugccuuugguuuucuguugguuuguuuucgcuuuuaaaaggaacuauuauuuagcuuuuauuuaucauuuauuuuuuaauaaguguauuacaagagacaaaacacaagaacaaagucaucuagucaugagcagcucagcuugaugcacccuagauauuguuucccuggucagagccuguaacagccucuguauaguagcaaaagaguugagguaaaguuccaccagcaguaggaaugugaaauguuccguagccauuggaagggggaaucuagguauuuaugaugguguuccuagaaagaagucuauaauacaacuguaaaaaaagucaaauugugaaagucuugugguaauacuuuauacaagaacaaauaaaaucuuauauauuuauguugcuuuugcauuuauuuuguacauuccuaccauuugguaacaaugcucugauuuucuucuagggaagcauccagucgucacuaauaucaguucaugcuugaugguguuuuaugcuggcucccaugagugaccuguucagguauggcccuucauaaaacugugucuuacuguaggaaaucacacuuaagaaaauuugggucgagacuguccugcuuuaggagggugauauguucuuucauuaagucuguaucuugaaggauguuaacuuguaacuugaacagucauuuggcaucucauggugccuaaccuaagugaaagaaagauaccagaagcuaaagugaugcuacuguucauguuguuagaugaagccuccuuuaaaccugaguguucuuaacagaucaugucuuugugucuuuagaauauguguuugauuagcauuucugcuuuguugauucagaaugaacuuaaaaauauaaaauuuacuuuuaauucuguguuaaaaauuucaauucuuuguuuaauuuuaggugaauugauuugaggaaaauccugguuauuuugaaguuguugcagcucaguauuauuuuguguuuaaaucacaaauaacuucacaaguuuucagaacaaaagaaacuggauuuuuuuuuuaauuaaaaaaaugccauuugaacagacacagcuauuuugugaugaaaaaccaacuauuuugaaaaaacuugauacaagaaaugagauagcagauacuaucagaucaguaucuacaucaaaaauuucagaaacuaguuuucaguauguacuaaaagaugugaacaucuguuuacccaagauaaauauuccaaaugaaaucuuaaugaaacaugaaguugaaaaauacagacuauuauuucagaguaaaccacagacugcaaggaagucuaucaguguaaaaacaguaagcugugcugaggaguguguacugcuuuguaaaucugagcgagcugaagaugagacuguaaauaugucugcaaaaauacucaacuuuaguuguucaaaaugccaagacaguacucaguauaguccaaaugauuugcagaaacacuuugaaauguggcaucauggugaguuaccuucauuuccuugugaaauguguaguuuuucagcaagugacuuccagauauuuaaacaacaccgaaaaacccauaggaacacuuuuguaaaaugugauauuugcaacagugagcguucauauacuuuauuggacuugacaaaacacuucacaucuaaacauuguguuaaugguaauuuucagugcgaagaguguagauucuuuacccaggaugucggcacauuuguucagcacauucauagacauaaagaagugcacuauaaauguggaaaaugccaucaccuguguuuuaccaagggagagcugcagaagcaccuucguguccacucugguacucuucccuucacuugucacuacuguagcuauggugccauucauaaagaccaacuuaucagacauguuauaaccuugcauaaagaacacuuauaugcgaaagaaaaacuggaaagagaccaauaugauaaaagaguggcaaagacuacaacaacaggacuuaaacuaauacuuaaaagauauaaaauagguccaacaaagacauuuuggaaacguaagacaauuaccaguggaaaugaugaaaguauaggaaaaaaugcucaagcguuuaauauagugagcaaaacacagacuaaaucugaagaccagagucaagagcaaguaaauggagaaaagggugaaaaacagcacugugagaauggugauaagcccgucgaaucagagucagaaaaggcaacggugcuauccaccgggcaauauaauaaagccgacgagggagcaaguacuacuucuucaagugucuugagugcuguacaaggaccuacgguguuacuggugagaaauaauaagauaacaauuccugcuaacuacagugcuaaguuuaugggcuucaagaugguagaugggagacagcauaucguaauaaaauuguugccugccaauaaacagauuuuaccuucaccagucuuacaaucaaacacagaaaagaauaguacagcuaauuugucaccccaggcuguggccaacacuggguuugcaacuggauuaacaaccaaagugaaugacacagauuuugugaaagcagcuccaccugcauguucauccccugugcuugccaggaaaguaauuucugaaaaggaagcagcuuucauaucugaaaagaauaauacgcuucagaugguagacgacaguaaaaguuuaucuucauugccaacaacaucaacuacaucagugcgugugacuacaaaaguugaagcaagagauaauguugacuugugggaaaaugauagcccucagagucauccagaugcaucagauaccuccaucaguaguccagauaaagucagccuuacuccuaagcccaaugcauacaguucuggagauaugcauaacuauugcauuaauuaugucaacucugaguuaccugcugaauccuccaacucuuuugaguucucuaaccaaggaucauuaccuuuucauaauuauucaaagguaaauaauaaacgccguagguuuucaagagcaacacugugugaaaaccuucagaaggaaucuccaaauaaaacaguuacucagcaaucaacuagugauagcgauacagcuucaccacuacugagaaaagagagcucuaacucagauaaccuguuugcguccaucaacccuuuaaauggaacuuuaaaaauaaaaacugaaauugaagaaccauacaauuuagaagaaacacaaaacuuuaaugaacagagccuguucacuaaugaaaaccaaaauuuauugaaugugacugaagaaccuaaauggaaugacauacccagugccggcuccccuaugaugccucgaauuacaucuguuuucucucuccagagugagcaggcuucagaauuuuugacaccugaaguaaaucaguugcuucaagauacauuaaaaccaaaaucugauauaaaggaagauucuaauaacauuccaaguaaaaaccuuccauucgauugugaccaaacacuuaaaaagucugaagaaguagugauaaaaucuucaaaagacuuccaaaugcaagacgacaucccaguuccuucugccaguguagguguuaaugugccugcaaaugaucugaauucaaaauguaauggacaagaaaaacaaggauugucaguauuacaagaugugagagauucagaggugaccacuaaaauuccaaauaucaucacauuacuuaagacucaaucagaugcaauaauaacacaacaacuuguaaaagacaaacuccgaaccacaacacaaaauucagguccuguauauguucagaauccauuucuaaccucagagcagaaaaauccuguuuuuguucaaacuccaaaagguuuuauuauaccacugcauguugcuaacaagccuggauugcacguuuuuucuggaagaccaguuccuuugguuaauacucggagugugccugcuacucuccuuguaaacaagaaaccuggaaugcuuuuggcaacuaauaaugggaaaccugaaaguguucccacggugaagacugagaauguucauaguuacggaacugugacuaaggaaccuugcaaaacaccuuuucugaaggcagaacacaauaacaguugucuuacaccuggacuuuguuccagcauuggaaauugugugaacaugaaaacuugcucagagaauacauugccauugaaagguucuuacauuauuaaaacaucaguaaauucuucagugaaagcuguuccuaacauucuaccugagcagcagggcccuaagaugaauaucuuggauacaguaaagcaacagaaugaaaauuuaccaaaagcaucucucuacacccucaugccugacgguaaacaagcuguauuuuuuaagugugugaugccaaauaacacuaaacugcuuaagccuaaguuaguccaaaguaguaccuaccaacauauucagccaaagagaccugcaggagcaccacagaaaauacucguaaagauuuuuaauccuguuuuaaguaugagugcuuuuaauaaucuuucagcuagcaacucugcauccucauuccagaaagagauuguaccaucuaaaccaacuguacauggagagcagaaagagccagaaacuucuagaaaugccuuaccagucuuagugcaugguuugaugccagcaaaugaaacuguucauucuucuacuacagcaugcccaggaucuucugaggaaccaguauauaucagugagcguucagaaacaagaguuuuaagagguaaagcaaauugugcagucgagagaaauuucaauaaaagaaagacuuguaaaaauaaguuugcaaaaauuaaaacucggauagaucaagauucugaaacugcuuuuguaucuagaaacagaagcuguaaacgaaaguacauugauaauuaccaagaaccuccaaggaaaaagucaacauugaauagaaaagguaaagaaagggcuagugcugaagauguccaggaagcauuuggauuuagcagaccuaggcuuccaaaggauucuaguagaacuuugagacuuuucccuuuuaguuccaaacagcuugugaaauguccuaggagaaaccaaccaguuguggucuugaaccauccugaugcagauaccccagaaguagaacguguaaugaaaacuaucgcaaaguuuaaugggcauguacugaagguuucauugucacaaacaacuauuaaugcuuuacugaagccaguuucuaacacuucugaaacaacuuacaaugacuuuuccaagagacaaaaaaugcuuaaaccuguuaauucugugaaagaaagauuugugcuaaaacuaacacucaaaaaaacaagcaaaaauaauuaccagauuguaaaaacuaccuccgaagaugucuugaaaucucaguuuaacugcugguucugugguagaguuuuugacaaucaagaugugugggcuggccauggacagagacauuuaguggaagcuacucgggauuggaauauguuagaauaauauacugugauuaccaaggaaaagauaucucagaaggaaaaaaauggguugguauaauucaggcauuuucuacauugguauaguuuugaacauuucuaagaguugguuauauuucuguggaagaacaaaagcuuuaugugugguacuuggaaauaccacaguuaacguauguuuugaaagaaaguaauuagcacagaccuugauuuaguuguguaaagaugcauaugugggacagaaggguaaggaaauuuuugacaaaagaguuuucccauuugaauuuagagacugaguagaagauaaugguggacagcccuuucuucucccaccagccuuaccgaccugacaagaguuucucuggaggugaagaaccuucucacaaaugguucccugcuacauauaaagauggacugagcuuagauaaaguuacuuucuguuauaguucauuugaaagguauuaauuuucuuugaagcuacaucuugcuggacuguaguuaaacuugaaauaaugcuugaagaguuuagggcaagucaaugcuguuguuguugcucugcccugugucagauuggaaugccaguuaauugucuuuuccuguggcugucuuccgucacugcgguaacuggggcaaucuccagaggagaaacaaacuuuuuucuaaaauucacuugaacgucaacauuuucuugaauuugguccuauuuuccagugauccccuugcacagaacuaugcuuaucugauuggaaguguccauaaccaaaugacuuuuuuaucucccuugguuggcauccccucaaaacgaacagaaagaacauagaagcacuucaaagggaaugcuuuucuugaaaauuaaaacuauuuuuacagagauaauauuuugaagcaagguuaacaaagcagauuauauuuuugcuuguguuuaauuacuguucuuaccuaaacauguccacauuaggauagaccauuuucaggaugaccaacaacccaaaauaguguuaauaguugguauuugaaaacagagaagcaagcauuaacgauggacucaguagcaguucauuaaacuugaaaaauuccuaagagacaugcccaacaauuucaaaauggauuauuuucauaacaaugcauuuaccauauacauuugcaucaauuuuuuugucuuauuggauaaugaaguuauauuagaagaugauacucuauguaauuuuuuguuuuguuauuacuauacauguuaaugacauuuucauugauuagaucaauuucagggcuuuuuuguauauaacaaaaauguacauauuuuuguauugauuauguaaauuugcacaagaaguuuaugacacaaaaaguauuuucuuuuuaguucucugcaugcauuaauaaaagugggugauuuaaaaauaagaaaaaaggacuguacccauguuauuuuauugguuuuuauugguuuuuauuucugaccuuuuuuguuuguuuuuuguuuugguuggggacauacuuuuuuuuucagggauuaaacacuauuauuagcaagugccuaaaaaugaugugaaccguuuacacaugccaacuguaacaguagguccuaaaugggcccauuccccuaauaguuuugauuuaaacaaagccauaaauagaugcuucaagcuauauugcuaugcacauuauacuuguacuguuuuugugcaguuuaucuacuuucuuaguggaauauuuuuuguauaaaaccuguuauaauuguguuucuugaauugagucugaguggaauugauugaaaaugcacaguauauauugauaauguacaugauguuuaaagaacgguaagcauuaauuuccuuguucauuguuaaugaagguuuucuucaauuaaacuuaagcuuguguuuacaugag

SEQ ID NO: 9273 - RNA, 1156 nt, Mus musculus
ucagucagagauguuaaaaugcagcgggcuguuguuagagagauggaugcugauuugucaacagagucuccacucugcugggagacaggaggaggggcuucugaugacugacagccagguuuuuguuuguuuguuuuguuuuguuuguuuguuuuuagccauuauagggaucacagaauauucuuccauucccuuuagaucagaguaaaaucuugucuacggcggcauauuuggggguagggcauuuuucuuugcacggcuucuuauuuuaaaguuucuuaggaucuucuuguugcugugaacacauucaggacauagcaaauuaucuuccacuccugguucugggauaauacaggccgguaacaggaagagaaaauucauccuuuggggagugucuggaacccaggucuguccagcaagaaauugcaggcgaacccaaccuuucuuaucugcagggagcugccugccauggacaacacaccaucuggauccaguggcuuguggcagaaaggccuccacauuagacggaagaggacaucgauucuuagacauugacugagcugcucucauggcaauccuugcccaggcugcaaauguggacuccuuaggugaaguuagaauuuccaggacaccacucuccuccuuucuccuuuggcacccgcuuggaggcccgauuccucugaagacuaucuuggauuucuugggacccugcuucauucuggccucccgagauguauugggaauauaacauucuuguuuagaauaggagugucuccgaagucucaaauagaccucaacuuucuugccauccguacucaaguuaugauaccgacaccacucccgaagaguguuccgggacacgucccuaauaggaggcaggcugggcggaggacaggugcuugguaugguucugguuggguguuugauuccagcaugccucaccagagaacgggcuggugguguguggucuaagguugaagaagaaacauuugauugcguaggguagucuguaauuggcuccuccuccuccuuaaaggggaccagcguuaaaaucacacuuucuucauccaaguucuccucagauugguucucguugaaagucuccaggccgaaguaugacauuuucaggcaggcuugggagaagacaaaggcgagu

SEQ ID NO: 9274 - RNA, 934 nt, Mus musculus
ugaccuaagacuuuauuugccaggggucuugcuuugagacacggucucauuauguugcccaggcuggccuggcauuugcaauccugccucucagcccaccgaacuguugcuauuaccaggugugcaccaucguggucggcugaugguguaguagucuaaagcgaugaaacagugcgggcuuugagaauuguggaaaucuaauuggcucugagauggaaggugccuacuacccguaaucuuacuccuauccaggagacccaccaagucauucuuaggggcaguuacccccguucccacgccagagcgcccucccuucaaagacccagacuugauacacaucaguggaauccuugaggucaagugaugauuuuguuuuaccuacagaaauacuuacauuuaaauauuuagaaggaaugcacucucaaauucuaagggugaggaagaggccaccuagcuuguauugguaaguagccauuuccguuuuuuucauuuccuauuuccuccuugcucuuucuccucucuuucaaauaaaucaaguaauuaauagugugauguuuaaacaaaacaaggcucccugugcaaggugguuuaauuaucccagaaggcaccuggaaauccuuucucaucaaaauguucugaguccuuuccugaacuacggaucugggcguauauuucccaacauauucuuaagcuguuguuugaaaguuugaaauucauuuucuacuagcacauuuuuuuuucucagcucucuuaagacuuucaacuaugaucagucuugcuaguaagagauccccuaggcuuuuuauuugacuuaaaacccuuuucuuuuuuuuuuuuuuuuaaauuggggcuuaugaauaccggcgaagcauuucgauaacuuaaaacuuaaaauuauccacuucaccuuugcaaaccucggggcucaaugccu

SEQ ID NO: 9275 - RNA, 5365 nt, Mus musculus
ugaauauuucaaaagauauauauuuuaccuuauuguagguuuguaaaguuaguuuguaauauucaggugcacuuuuaauguuaaacuuuguguucagagcuccauuauacugcauauuucuuggagguggcugucagucuucauaccacagugaucccuuaauauuugauuuuucucuugauuugccacuaugcuguauggcacuuucaguguagauagucuaguuuggagacguccucauaagugugugauggagauuggucuacuugcaugcuuaauuucugcuaaucagagguuugcauggcccaaacaacaguugaccauuuuuaugguaugggaaaguauaguucauaacugccugucacaaaagcuguuuuuucucauauuuuccaguaaggcaaaugaugacauuauucaaauuacauaacauuauuugaauuaaugguaggaaauaauauauuuauaauaaauccuugcuuuuuagugagagaacauugacaucacacaguagauaagcuacaguacugugaaaucacaaaacacuaaacaguucuaggugagauagaguugggaugguauuuuauuauuagcauucuuauuucugaaagagcagaaucagcaggcacgaucuaauauaguguguuauuuuacuuuguucccuagcuugucaaaugacugaauuguauuguauugagcuauacacuuucauucugcuccccaaauaccaugaaggacaaggucucucuuucaggaaaaaauauuuauauuuguguauaauacuuuuuaauauaaguuuguuguuauucugaaguuuagauguugcuugauaaaacuuugcuacagcagaucaugaauaugagcaaggcuuuguguaauaaauaguaggguccuuaugugaaguuacgacuguucaguccuggugagcaagcucagagguguggaguguguauuagcuuuauuucguacaguuuuacuuuacagcagugaagugcuuuagaauucugguuaucuuauagaagucauuaccucaacccauuggcauuucuguuccccaguguuuuaccuuagcuguaauuugagcuguaugggaucagauagcaaaauguuauguggcacaaggagguguuugguucccaguuuucuggagagaacucuuaagucagacccauagccuaacuaccuucugucauuaggcaacuuugagcagcuagugugcucucugccuaccccagauaagcacauguugccagaccugguucuaagccuuucugauccuuuuacauuuuauugccccaugauggugaaguuuagauuuauuugguuauuuuuauaaaacaaauugucaggucagugucagaaccugaaauuauuuugagcugucaaagcauguguauguaugacaaguaguguuacauuaacaacuauuacauccuaauagcuuuccuuuugaagcagacuucugaaucuguaauccuuuauuuaaccaaaugcuugagguuguuuucacaucuccauucuuguauuuauucagguugcugucacuggugguagaauaugacuauaggaugcauggccacuugauauucuguuagcagauugaaaguuacagguuaaauuuuggccuucagaaagauggaagaucguuuuucucguucccuuuccauuagaauuaaauuuucauuaauaugcuggucaguccaguauuauucagaccuugauggcuuuagccaaauaauccauuuaggagacuauugaacuauauaaauuuuuugguugguugguuuuuguuuuuuacuacuaaaaaaauacauauguauacacacauauauguauguauacauauacauacauacuugugguauaaggcauacagaccuccauacucuuuauuuuggaauaauucuguucuugagacuugauuuauaaacacaaugacgggagauagaggaaaugaucuccauaccaucuuguucacucuagucuuuacacucagcuuuuaaagaagcaaacguuagcccugggauaguaacacuguggcuguguuuuguguugcaaaggauuuuggagcaggggauggaaccuagguuggauaggugugaacuuuagagaaaaggauaaagaucaacuggccccaguguauuaaauaaacuaagagugggcucaagacacuguaugaaaacuugaucaugugcauuugacaggaaaauauuuacauuuuuuugaaaaugagaauuaaaucuaauguuuauuuggcagacaguaagcaagaguuaauuuuacaauuauuugggagguaauuuuaagauuuccaguucauuuagagcuguaucuauaaaaaagcaugaaaagcaagcacuuuuaguaaaccauagauuuauuggauguagcaaauauuccuaauauuuauccuuuauuguuugaaugugaaaaugaacucuuuacuccuugaacugucauugaacaggcucaggauauuuucaacacuggaaaugacccuacacacauaccaaauaaauaaucuaaagcagugagacauuugaagauucauaccucuuaaccuuagauuugucuugaaaaccaguuugugcaccuauaaccaguauuagugcagucuugggcuccuuguucugcauaauugcacccuuucucagguauguccugaaaacaagauuuuaaaucucuguggagauuagauucucaguggauagugugaagggggguuggggggggugggaguaguuggacacaggauacugacacaguagagcagggauuuuuaacauucaguagccaaauagaguuucagucuagaauauuuuuacccccacagaauaaacaaaaugguuccuauuugauaaacaaccagcgcuacacuccugagucugucugacuuuccugcauaauggaaggguauauauauauauauauauauauauauauauauagcaaaccucacuguuguugggaaagcacucccccaaacuuuuaaaguucuagaaaagggauaagucagcacuuuucuguuaaaacacuaaagucuuaauuuaccuucagagucuuagguacuguaaguuuuaggaugauuauuuuaaaaaccauaacuacaugauauggggucaaaucacauuuauauaaauccuuauuuuaacaaaggacaauagcauuuuguaucuuucuaguacuucuaaguaauugccucacuuuccccaguucaguuuagcacuucuggcuuaggaauuugagaaucugagaggaagcagaggaauucccuaaacacauuaucagaccauuuugauauguaaaucacuaaggaauggguagagacucucucccuuuuaagucuucagggaaugagcaguauuuagaaucuuuggcugaaauucaagccuuuuuacuguguaaauuuuuaauacuaauucacugacaugcuuuuuacaucagaggacugauacggaucuuaauggguuuaaguuguggaaggguauauuucuaaaacuaaggggggguguugauuaacuagguuaguauuaccagcauuagugaguuuaagaaaucuuaguauguaauagcgaaguguuugauuaaaagucuaauccuauauugauagucaaaauuaguacauucugaucuaggaaagauagucauuggauauugauaugcugugcugucaggaaaacaaaaaaacaaaaaacagaagaaaccuuuauccgacucccaugugugcguguucugaugggauguauacuuaacgguggcuuguugcugcuuuggggggaaaugcauaaacuacauggagcguucacguauaauucucuaugaccuccacuuuaaacugucagacauugguauuuuaucaguccacacuguuaaauaaagcuaauguucuuggaaaaucaacuuguacacacuguugaaaaacccucagggacaguuuucacacucuucucacucaauucagguacuuugaugcuauucuuaaaccuaacagugacuuguauuuuucuguuuugcuuuuauuucaacgugcugguagcacaucuuugaugaaugucaacuuaaaaacucaguucagguauccagguauaacucagccaaacagauuuuaaagcugcauaacuuuccagcacacggugccucacacucuuauaguggcauucuauagauucaguuauaacuacugagcagauaauauggggguuccuguuaacaguguauuuuuuuaaacaugcauacauguauagccaccacacacacacauaaacuauauauuuuuaaaugccacuaauagccagcacaaagaaaauaaguaacauuccuagcugcuucuguaaacugugacagaugcaguuccuccuugauguggcucuuguuucuucaucauaacuacuacuaaauucaagcacugguccuugggugucugaccucuacauucuauuuaugcaaugucuucagagaaucugugcacuggccacugugauggaaccauugggccacaagugcuuugaguuuaucaguagugaaucugccaaaguugguauuuuuaacauugaguauguaagaugucaaaagugagcagaggucugggucugcagacagcagaaaguuuuaucucaguguauuuuacagccucuaagaccucagugacaagucccuuccgauggugacuugucuuuuaaccacuuguuuuccacagugcuaccugugguuagcaaacugugugcaucauccucugccuuacuguuugaugucuuacauccaaaagaaacgcuaaaacccauagccuuugaagacauggaaaauggcauuuuucagauuucuagaaguucaguguccugcaacaaaacaggaacccccuuaacucuauggaccucauuucaauauacuguuuacaguuugacggaauuguauaauuuaauauuucucuuguacuguagugaauauuuauuuacagauuuuuuuguacugugugauuugaacuuuuuguuccugcuauaaucauuuguuuauguaguagagcacuuaugaucacacguuaaguuuuuggguuugauugcacuacauuaaauuuuuaauucaguucugauuuugacuggacuaaaauaagcugucuuaauguaugugaugaguacuuaaauuuuaauccaugugguuccccuuccuuuuuuuuuuuucuuuuuuugcauuguaugucagaagcacuacuucuucugugcauguguaagacuuaaugguuccauuguauuauuugaccaugacauuuuggagaaacauucccagcuguaauguuguguaugguaguucucacuggaugcuagacuuuaaaaaccacuauucuucuaauaaauuuuguugugaaaaccuguuu

SEQ ID NO: 9276 - RNA, 10515 nt, Mus musculus
aggagucucuucugucuguauuuugccuaagaugauuuaaacuaaagggcagcucccugaagaacaauuucauuuucaccucagaagaaggaagguaagguagaaagcauuuuagccucucuggcucauccuguucucuuuucuccugcgauggugaccuuaucacccagaguuccagcuccguggggcucaggguauaugacccuucucagcucaagucuguccugaccagaggucugucugugccuucuuaaauguaaacuggaugauuuccuacagucugcuucagaguuccacgggaguucuuagagugagugcuugcucaguuuguguucuaaccaaguuaguguucaguuccagcacucauugguguaacuuccaggaacuauuuuaaauuuaugucacccagccuaaaaucucguccuuugcauccuuugaauugccuuuugucuaaugaacaccagauguaguauguuugaucuucugauaucugcuugggaugacugaaugacaagcaaaaguuagcuuggcggggaggccuugagaauuaguugguugggaugugaaguuugggaggccaucacacugcugggagggguuggcccuugcacucugguccugcgcuaccauggcucgaaccuccuuuuuaccaugugccgauacgcaaagcauaaagaguaaaccugaauuuuuuuguaguuguauuuauuauaauguaauaaucagacugguuaaaauucagaaagaaaaaaaaacaaacugaagaaagcaggggauugaguauauaugccucaaaacuacugccuauuuaagauauguucugaaaacagccugcuaugaggcgugugccacuacugcccagcuuuuuuuaaagauaguccuuggcucuuauaggaagcaccauuaacccagugaaaaaaaguuuauuaaaacuauguauguauaaaauacauauaaaauuguguauauuauagguuuuuuuuaaagauaaauaguuaaauuucuugcagcuuuuucuggccuccuuauuacuuuacccuucucccuguguuuacuucccucccuuaagagccacccuuugcaucugcccgcucuguuacccccucucuguuccucccagccccccuaaccugucagccgacucaccauauccugaaaaagaucuagugaagaagugggaagcauucuuucgaguuaccaccuaacaaauguauaccuuguauaccuugauagaggacugggcauacauuuuuauguuuuguuuaaagaaauaagccaaauugaauacucuaaccauagucugcuuugucuaaagccuucuuucgccuccgcaaacuuaacucuuucugcuccuaacauuagcucccauauacuuacuacuggucuuaugcagucaagaaaaacauauuuuggccgggcgugguggugcacgccuuuaaucccagcacuggggagacagaggcagguggauuucugaguuugaggccagccugguuccaggacagccagggcuacucagagaaacccugccucaaaaaaaaaaaaaaaaaaaaaaaaaaaaaaaaaaaaaaggaaggaaggaaggaaggaaggaaaaacauuuuggccaucagugauacugauuugccugcguagcagucuuugggugguuauauacuaacugcuggagaaaguaccugagucuauuacucccagauucuagauucuuacacuugacauuuagcuuccugcuucauuuugaucuguucuuuagugaaaaauaaccugaauguugacuggccaccauuuauauuagccucaggaauguaaguauugcaguauugacuaaauaggagaguucagcuaugccuaaccucugaucuggaaaaacaccauugaguaaaucauuaaagauaagguugugaagcaaccuguugcuuuuaaacugugccuuuuacaguuuuuaugaauauuaucuuauccucuaccacacccugcugaauuaggcauuaagcuaaagguggaaagacugugugaucaagguuacauagaccauuucucacuaaggagauaaacccaggaccaauuccaagagcugcaaagucaggcucuccucuucuuuuauagccucuguccaguuuaccaaucccuaugaucuuaugugcuuugguggugguguucugcuugcuaaauaauucaucucccuauuacagauaggccuccuauugagcaggcauaagguuauuucgacguaccaugaagucagaccgaggacugcaaagucugcgauauauuucuuguaaagauccuauuuagucaggugucaauaaucuauaugacacagacuaauuacggaucuaaaaugucaugcuuuuucagagucagagugaggaaauucucuacaagacagaaucucugcucuguucaauuagcaguugccuagggguaaccaaaguuagugcaagcgcuguauuugggcuccguuaaagaugcagggaaacuugaguacugcuaagcaaagguagaucuuuagccaauuuaaaucagacugacaccauuuuuuaaagccaaacaugaaaaaugcaacaauauaauuaaguaccaggaaguugagguuaacucuaaacauuaaauagcugaaugguaagaaauuaaaaucaucuaaauuagauuucucuuuaaaaccuuugggggggugguaaguaguaauuuggagucacagccaaaaguagcuuuauggcuguaguuguaaaguuagcuauuuaaugauagcugggcaaagguuaguguuaaugugcagucucucagccccaaggucacuacuuacugccagguuucugccuauggauccaaauugccuacaaaacaggucacauucggagcuuugaaacaucuacuaagaacacaucauuugccaucuccagcagcuacugucuuccaucuucuguguccugauggggguaaauacugauucucagagaaauaaaggccaaguggagagagagacgcguguuaagugaugguaugauucuguaaagaauuacacaccaaaauauuuucagaaauucaggggcugacaggauggucaguguaucuaaguguuugccaccaagccugacggccugagcuuaaucccggagacccacaugcucacaaaaucugaccucugacuucucccuguaugcuguggcacaugugcacaugagauauauauacaugauauaaacguaauuaaaagucuaagccgggcagugguggugcacgccuuuaaucccagcacuugggaggcagaggcagguggauuucugaguucgaggccagccuggucuacagagugaguuccaggauagccaggacuauacagagaaacccugucucaaaaaacaaaacaaacaaacaaccccccccaaaaaaguuaagcugccugugagggcacacaccuguaaucuuaacacugggacaacggaagcuggagaaggaguagagcucaagguuagucucagcuagacagaaaguuucaggucgcacugagaagcaagcaagaaccuugacugcuuuugccaagcacaucagaggcagaggcagaggcagccuugccaguugaggcauugacugagccagcuggagcagugccacaaagcucacccugguggugugggugagggagagcuggugagcugaccaacacggcugccacccaggcccagauucagggcuuugaguuggcccacccuaggaacuacuggagcaugugaaggggucagccuugcagauccaaagcugcaggaucuccaugacacagucaacaggguacccgagaggagccauagugaggauagaguauccauagaauagcagaagacagaggucuugaaccagaccaaugacucacugcagugagcauuugcaaguaaagauguguggacagaaggguuuaccguaggauauacuaugacucacugcagcuucugcaaugaggugguuguuguuguuuuuuucuugggaaaggggagguugcaaggauagaugguagauacaaagagacagggagaugagugggacugggguugcauggugugaaauucacaaagaauaaaaaguuucuuuuuaaaaaggcagacagaagccaaaacuauuugaacccugcuuuugugcagacucucagcauacugccauucagucccagugugcaggugcagcuaagguucugagggacuguacugucagaguagggguccagucagaugucuccuuugcagcucccauguccuuuacuguaacucugccaccagugggagguggaaaggcaggugacacaggcugucugugguaaaccuuucuauaaagacauguccuggccaugaggucagagucaaagauggaagaguaagccagaagacguaucaauacauguucaacacacaugaagcuaccgucuguguucugucguguuucacaugccaucaaauaauagucuccuaaagguccauaagccagaggggcugagaagagugugugugugagauguugucucagaaucugggcucuuuuccaugucgguaaaaguugugcauccaaaagcccaaagccaccgugagaccccuggccauccccgcaggccauguuugugcccugucuugaaccuaguguuggccucucccucccucuuagcuucccaguguggauuuagcuuucaugcagagcagcuggugagacugaaauguuuccuggugauauucucggauauucucggggagcucgguggugggcuacuguggggaugcuucugccuugcaugggucaaagcugauagccccuccacugugaaauuucuuucucuuuguguccuguucuggagcacuguugguggcucuccagccaauuguucuuucugagaaauugucuuaaaagccauugaguucucaaaguacuuuuaagcugaugucuguaaugucuggagcguaguaugucugaauguuugccguguucuaaacuaaagcuagugguuauuuuagcaccacugccuaggccuaaacugaagggcagguugagcagcccuuauccaaaauacucgggagaagacaugguuugaauuuuggcuuucuucagauuuugggaugucugcauauauuuaaugauuuaacgaugcaggagugaggcccaggucuaaugucagaguucacuuacaguccaggcccacugcguccauacggccuaagaggagucuuacacggagucuucaguagucuugcacuuaacacuggcaugguguguaauuucccacuugugccaccaugaaaggguuaacauuuuggagcguuacagauuuuuggauaaggauugcucuguguugaccauacagaguuaauaauguggcgaaauguuauuuucaauguuucuuuuaagauaacuaguucugaaauuauauauauauauuuuaaaguuuuauuuauuauuauacauaaguacauuguagcugucuucagaugcaccagaagagggcaucagaucucauuagggaugguugugagccaccaugugguugcugggauuuuaacucaggaccuucggaagagcagucggugcucuuaaccauugagccaucucuccagccccuauuucugaaaauuuuaaguguagaaaguaugaaguaggguuuggaauguggcucagugguagcauaccuuccuagcaccauaaacauaaaaacauaugagagauacuaaguuuuugagacuaugaugggccggcuuugcaaucuaauuacauguucuuuguugaacuaaagcagacagcagacuugaaaguaaauaacaguuuccaccagaaugcccuccuuuacaauauaaauagcaucugauacuguucauacuauacagacgguucuuuggaaaugcacacacuaauuucuuccuuuuucuguuuucgccuagagaggagucagcagaggcacccguagcugauccuaaccgucaaucaaagucuccacuggagaaguuuauggucaaguugugcaaucaucaucagaagcaauucauccgcguccugagugaccuguacaccgagucccagccagguucugaggcccugcagccucuggauuccaccgugauggacgucuccgcuugcgauucgggcugugcccagcugagcggcagagagaaugaaaaggaugauugucucgaggagaguucuccugccucuguaaaguuguucuuagacucauccgguucuccuagcucccugaaugugacugaagaaaccaugaaggaaccaccuccugagacagacucuguagaugggagagacagugccgcgagcucgagcgcuguccagaaagguuccucugaaccuccagacgcucagcauaaccccacagguucugcagacaguuccaccaugggaugccucgguacacuggacgcuuucucuucuaacucuccccacagugcuaaaagcuuagaggggcaaaccacuggccaggagcaagacacagacaugaaacccugugaggaugcugaagacagugccccagcgccaguccaaagucuggcugcaguggaagagguggcugagaauacugaagagggugguagcuguauugugucucaaagaaacucauucaaagcuuuaucagaagagacgugggacucaggguuuaugggaaacucaucuaguacugcagacaaagagaaugcuuuacagucuagcucaaaaucauccuuccaccaggauuuagagacagaugagcaagaugcaaggccaaagcaagagaaccaucuucauucauuagguagaaacaagguagguuuccagacauaucccagagacaagggccauuuugaucauuccagaggugguugguuagcucccagccccacgccaacuguacacagagcauccaauggucacucacaaaccaagaugaugucagccuccaucaagacugcucggaaaaguaagagggcaucaggguugaggauaaacgauuaugacaaccagugugauguuguuuauaucagccaaccaauaacagaaugccacuuugagaaucaaagauccauacugucuucucggaaaacagcccgaaagaguacccggggauauuucuucaauggugacugcugugagcugccaacuguucgcacacuggccagaaauuuaugcucccaagacaaaggaagcugcucacaaguagcaucagaggcagugaugacucccaagcagacucuuacaguucccaccucaaagcacacaguaggugugcagcuucccacaguaggugcacaacuuccuacaacagauguacagccucccacagcagguacacaacuuccuacagcagaugugcagucccccacaguaggugcacaacuuccuacagcagaugugcagucccccacaguaggugcacaacuuccuacagcagaugugcagccucccacaguagauguacaacuuccuacagcagaugugcagccucccacaggagguguacaacuuccuacagcagaugugcagccucccacaguaggugcacaacuuccuagaguagauguccagcuuuccucaguagguacacaacuuccuacagcagaugugcagccucccacaguaggugcacaacuuccugcagcggauguacaacuucccacaguggaugugcagauuuccacaguugauacgcagcuuuccacaguaggugagcagccucuagaagauaucugugacgauccuaggaaagagagaaccucccuugagggaggggacgaagacacauccucagcgaaaaagcaucaggaggcagagguuugccucagcuugagggaacaggauccuaguagcuccccuaggccgggagagaccacaaccucuagcccagcaugccuccugccuacucuccucccuaaugacaauaugucugaggugccagaaggcagcauuguggucucaccucccacagaaaguguacugucuuuccaggagcaagaccagccaccagccucucagcuagguccagaggaaaugcaggcacaggagugccacuugguuccgacagcuggaagcacccccuuuaccucccgagaggacagugaagaccuccucuguagaccucagucuucuccuaaaacauccaucagagaggagagcucuccaugcucggaagaugaagguuccacuguggcuuuagaucccccccugggccuagaacugucugaacaugaccaaagcaccagcacugaggcggagaccagagacauccccggggagacacuguugcuagaugacucccugccccuccuggagagcagcauugucacugaugagaacccaagcgagauggaagaaggugaggccacaaguggaacaggacaccuggaggcgcaugacaaugauacaaaauacucagcagaaaaugaucccagugagccaaacuccgacucaccugaagagaauguggauaagaagaaaaaggcuagaaaguuccccgaggccucugauaggugccuaagaagucagcuuggagauccuuccucuucugacagguacccaggaagccaggguuuggauucauccgcugcuugcucugaaaucaagguuucuaaaaauccugcuguaaagcauucuaaaagagaaggggacucugguagggugacauccgagggaccagugauugacagcauccauccagacaaucuggaagacccugaagacucugguguuagugagcauuccucugaugaagagaccaagcaggagacugaaggaguuggugucauuacaaggcagacuguuaaaaauaugcuggcaaaggaaauuaaaagggaagagggagggacuuacccaaacagugacccagccacuguuggccagccauugccuggggacaaucuggaaacccaugucugguccaagauagaugagagagaugcccaugugcccucagaaagcauuccuugcaagagggauccagagcagguaaaagagaacccgggacaccuugccauacaggacacagaggcugccgcuaugagugagguagacccugaggauacccaccauaaagaugaugcuggccucgcuccauguagcucaucugggauaucagccagucauagugacggugcugaugggccaccaaaaucaguaacaaggccuaagagacugccuucuucuaccuacaaccugagacaugcucauuguucgaaugccuuggacacugcaaaaaugacuucagaaaagcaaggcacacagguaaacccagcagccaaggaaggcggagcuuccgagagugcagagcccuuagaugaggaagaugaggacucggugguggaggagcagcccaaguucauaggauggugugcagaggaggagaaccaggagcugaucgccagcuucaacgcccacuaccugcggguccagaagggcuggauccaguuggagaaggaagcucagccaacggcaagagcaaggagcaagucugacaagcugaaggagauuuggaagagcaagaagcgggcacggaaguguagggggucguuggaggugcaaaaguuuucucccguucagaugcuguuuaugaccaacuuuaagcugucuaacaucuguaagugguucuuagagacaacagaaacucgaucucuggucauugugaagaaacucaauacucgucuuccaggagacaucccccuuguuaaacacccucuucagaaguuuccuccuuccaccauguacccuaguucacuacaggcagaacgcuugaaaaaacauuuaaagaaauucccuggagccauuccugcuaggaauaauuggaagacacagaagcuaugggcuaaacuacgagagaauccugaccugauagagucagaggauggcagugacaucagcuuuggcccuagcagugaagacagcguggaggaagucagggaaggcagacauagccauccucccaccaacuugccuacuccagccagcacccggauccuuagaaaguauuccaauauucgaggaaagcucagagcacagcgccuggacagcucacuguguggggcuucugaaaugaagcagggccgcaagagcgugugcauuaacccgcucauguccccaaagcucgcccuccaggugggugcagauggguuucccgucaaccccaagagggcugaaagaagcaaggggagaagagggaagcagaugccggaaacuuugcuuaaaguggaaggucagaacaagcgcaagagagcagaaggcucugguacucaagaugguaaggacaaggggccggcaacaaaagucagcagaggccuuucugccaagaagcuagcugcaaaggacagagccaaccaacucuccaagaagaugaccuugaaagcgaauaaagugagagucuguagaaaggguccuggaaggagcugccugucauccaggaaagaaaaagagaaugccaacagaagaccuggccauccugcggcagccuccgaagcgcugacaaagccuucaaaacaaaggggcgcaagagaagccucuucaaagccccca

SEQ ID NO: 9277 - RNA, 3139 nt, Mus musculus
ugacaaaaaucaaucaauuagaacucuauuccacgugaacauaaaguagagggaagcaaacauauuagggacaaauugggcgugggggcuggacuggagagauggcuccgugguuaaggucaccuucugcuccugcagaggacuccccagaaucuacauggcaccucacaaccaucugcaacuccaguuccaaggagucugauguccuuuuuuggucuccucaggcaccaggcauacauguggggugcaaacaagcaaacauacaugcaggcaaaauacccagacacauaaaauaaauaaaaguaaagaucugugggacggagcugcuggugugagcauguauuuucagcagcuacagaaugaguucuagguugggcgacuuagggagcccacaucucaaaagcaaacgaagagggcugaagacguaguucagugguaugggcuugcuugggcuuuuggaaggcccuacguucaguccuaagugugguaaccugagauaaaaaccugcaguguuugggaaaucguacuagauggucuugaggauggguuagacaaccaaagaggaaagacacugaauguaacaacacaguaacaaacucaucaaaaacaaaacacagaagcaggcuguaaaacuaugggcagagcaucggugagccaggagguggcuucaagaggauguuuuuuuugugggugugggguuccagauggaggggacaaaaaaaugugaagagauaauggugaaaaaccuuucaaauuugagaacuacagucgaggugugcagagccuggugagagucccccacccccaucccugccccccgggcacuccugguucauacucagcaucuggguagugacugagcacacuguggcacaccggacuugguggcuccgcucucuucuuccccuccucuaguugcuugucucuugcuuaauaggccaguguuguccugaucacacagggugacucuguuggaagacacuucaucuuaggcagagugagccagccauugcucuagucuguacugugugucucaggcgcuucugccuuuugggagucugagcaugucuggggguuuagagacuuaaggucacauagggcagugaugacacacaccuuuaauuccagcacucacgagacagagagagguggaucucuggcuucuagggcagccaagacaggcagagaaaccaugucucaaaaaaaaaaaagcuaaguuuugcugguaccagccucucaggauuccuagccggugugugguccaacagagccagcuccagcgucauucacagcucagccugcgacucuucugacacaggaggucagcuaguuucuucucuccacugggccacuaacuguacuuucuuuaaccuuuuguuuguuuguuuuguuuuuagauauuuguguuaacuuugugaguguugggcugagagcaaugccuggcaauggugccgugacucagugacccagugagccaucuugccaguccaagaguuaguacguuuuagauuuccuuccaucgcuuaccucgguuucuggaccuauucuggacuuucucuucugauaggccucaucgaugcuaauggagagaaagcaggcaggucucagcucccuugucagggccaggaggcuccuuucagugguucccuagaguguucaagcacaugucucuuuaggguuucuauugcugugaagagaaaccaagaccacagcaauguuauaaaggaaaaauuuaguuggggccaccuugcgguuccagagguuuagucuguuaucgccauggugggaaacuugguagcauggagucagacauggcgcuggagaaggaacuggaaguucuacauuuugaccugaaggcagcagaaggagacugugucucccauugggcguagcuugagcauaugagacuucaaagccggucuccacagugacacacuuccuccaaugaggccacgcccacuccaaccaagucacaucuccuuauagagccacuuccuuccggccaagcacacaaacacaugagucuauugggggggggggcauucuuauucaaaccaccacagugcucaaacgccucaccucagcacaccagaccuuggcucguaggccacagucuuuggaaacccacaauguagaccuauggucccaggaaucagcauacguagugggcacucccaaaugacuuuucaaauagcacgugcgugaugguaguuacaucacacuguauggaauaaacucuccaaagggcagaaaguaaguggauguggacguuguccuguuaccaccugggucccuucccugaaagcaaacacguuccagaggcagugcaugucugagcacuuacauauccagacgugcguuucagcaugagaacaggccgggugacauaggcaacuguacagaaccagaggauggcugggcccggggccucugggaugugacucaucucuuccagauccuugugaugucagcaaaaccaacuugccaggauuuagagccgccuugaagagaaaccucugggcaugucugugaagauguucccagagcgguuuggcugaggagggaagauuuaccgugaguacgggcagcgucagcgccacgggcuguggucccggacugaguaaagaagagagagagagagagagagagagagagagagagagagugcagagccccagcuuuuagcucuuggcuucucgaucgaucacugacauuacaggaucaguucccuauguuccugccaccgagccuggccugugacgguccauucccuuuaaccucgagccaauacaagcccuucuuuucucuucccuuuggacacagucucacuagguggcccuggcugaccuggaauuugcuguggaguccaggcuugaacucacagaucggccuaccuuugauuccggagcaucugauuaaaaacacaccaccaugccuacuucugggcuuaaguugcccuugucagguauuucuacacagcgagaagaagaaucacacaccacugugcgucucgggcugucccucugcuggugucuugucccggcugcuguguuugcugaggggucgggucacacucugcagcuguccaaccaaugucuccuuguccugugagaccuucugaagugcuuugcccuguagg

SEQ ID NO: 9278 - RNA, 2163 nt, Mus musculus
guuuacaaaucaacccaagccggcagcguuccggcucccgcggcucuaaggcgcgcgguaccucugcccgguggucccggcuuccgcauccccaggcucggcccccuccuggcccggcuugggccuccgccgcgcucccgccccagccgcggcucgccgagcccgcggccaaccgagcugccagcgacgcccgcacagccgcgggggcccgggcggggggccaugccuugccggagagaggaggaggaggaagccggcgacgaggcagagggggaggaggacgacgacagcuuccuccugcugcagcagucggugacucugggcggcucgaccgacguggaucggcucaucguccagaucggcgagacgcugcagcuggacacggcgcacgaucgcccggccucgccgugugccgccccgggucccccacccgcgccuccgcggguccuggcggcgcugucggcggacaagaccgggaccccagcgaggcggcugcugcggccgacggggucagcagagaccggggacccugcgccuccgggggccgugcgcugcgugcugggggagcgcgggcgugugcggggccgaucggcgcccuacugcguugcggagaucgccccgggugccagcgcgcuucccgggccggggcggcgaggguggcuccccggcuccguggcuucucaccgaauccagcagcggcgguggacagcaggcggagcgcgcgcggccgacgacgacccgcaccggcuccugcagcagcucgugcucuccggaaaccucaucaaggaggcggugcgcagacuccagcgagcggucgccgcgguugcggccacgagccccgcgagcgcuccgggguccggggguggccgaagcggaccggacucagucacucugcagcccucgggcgccuggcucugacaggggaucccuggaggaggaagaggacgccgcuacgcugauccaacagugucuugcccgggacugugcggagcaggagcugucguccaucccucgggcuacagccucaaaguuaccggccgcgagaggcuguuagagaaaacggacucuacugaguagcaccagcagccgaggaccugggaucuaccgguugaacuguggcagcuacuuaauccacuuggaccugacuuagcccuuaucgugugcuuggauuguuuauagauguggcucgcaggggcgggaaucgggagggcuucuaacaauacuugaaaaaccaauaguagauaugaucucguuauuuucggguacagaagcuuucugaauauggugcuacaauugcagagcagagcgguucuagggugaagaacauaaguuggcagauuuauguugguggguugacaacgcuugcuuuccccugcuuaauuugugauuaugaagguuggggaccugguuggugaauucuugaagguggggagagaugaguuuaaauggggacaugcaauugauucgaccuugccaacuugaacucaaggucagguugguagaguggaguguugugggauucuugggagcgcucaccccagugucuuuuucuggagccaagcacagaccggagugucccuuugccaccgcguggagucucccgaggacacggccgacauggccauccuuguaggaagaguuauuugcgguuucugugcuuugcuuuuccagaacuacuucugcuaggccacucuuuggccauagcuccagcuuucucagaaauggucauaagcaaccuccugaucucccugcggccauuguguuugugguguguguguguguguguguguguguguguguguaggggggaaagcagugggcacacuuuucugcucuuuugacccucugcagaguuggagggcgccucuccugcuaaaccugucaguucuuggugagugacugaaacuuuuuuaaaaugugacucccagaggagaaaaugcuggcuuuuccucuugugaaccccgaggggcaccucaggugccaucccaaacuuuaagguagcuaaacuuuuuuuuuuuuaugauucaauggcucggucauccuccagauguggcuguugauguacacuucgcaacggagugucugaaauuguggugguccugauuuauaggauucauaauuaaaaugucugcugaauaaauuugguuuuuguuuugaaaaaau

SEQ ID NO: 9279 - RNA, 14398 nt, Mus musculus
aauuauaggcaguucuggugacugguuuauuccuauaaacacuuguuucuacaguacaguucagauaauaaauagaggcacacagcuauaauuuccaccacagucugcuguugagagagauuggaggaugggaccuggggcugggacuagggcuggggcugggacuagggcugggacugggacuaggcuaacuggagaccuuaugaucauuuuggcaggaagaucugucccaggccugagggccaagacucuugcuuccagagucaaaaggagaagcccaugcuagacaguucucacgcuuggauggacccaagucugugaacacccaggggacagugagccugauccaaugguacgcugggaaggagcucucagugcaggccuuuccugggauuccaggccauuccacagaaagccuggauaggucugcccuucacccuggagugagucaggagugcaggucauaaguuacuuuuacacugguuucuuacuuggcuauucuauaaagggauccugucugaugucuaaggggggagagaggcaccgacggggauugggcugucugcuguaacucagguaaggaagacgcagcuaaagcugagggagaagaaaaccacacucuuacaccgaggagggauaagaagacacagaggccagucuggagccaggccuccaauugcagugaaugaguggguaacccccagaagagcucuggccuggacuucacagagcugcuguggucuaggucaccccugucuuuuuccugaugucuccaaugguagcacacgggacugguucugagucuaggcccagauuaucugcgguaaguaagggugggcagaaugaagagagucuguaugguuugacagcaggcggagagaaggccacagcacuggguaacccaaggucuuggggauaacaaggaagaaagggcaggcccuguucuugagcacaucggggccagggaaggacauaacugccgcagggccuuggggccaaaccccuccacacuuuucugcgacugaacuccuggucggcaggggacggagcaccucccaggcuguggcaucaaggucauucucaucucauauccguuucauuuguucaccugcacgcauacaagggaagccacugcucuacggauccuuuccagcugcgcccaaagcuccgucaggcagugagguuccuggcugacuuggaggcgcucugagcccgcugaaccacggcggaacacuucucacgccgcaguagcuuguuguucucgaacagaccuucguugcgggguauuccaugagaaccaucugggaaagucagcaggccugugaggaggacagagggagggagagggcauuaauguuuccgcucagcuugaugugucaaggcugaaggagaagaacaaguuauggcuaugggcacugcagguugcuggagagagccccgggagaauuaggauaaaggggaaggauuccauccauguuacauuuaccuaaauuaccauucuacugagcugaaacuuaccaaaaccgucuacucugccauuuuuaaauucccccucaaaggucauguugucauaucgaaugaagacuccgacgccauugaacuugcccugggaaaacucccccucauaccugcagagacaccaagauguaaguuagccuuuagugcauagguuagcugugcgggguaacggaggccagcagcugucaaugugucuguuagucaggguacagagggaagcucaucucagaacucuucuagugccaccuggaccacuccucaguagcagagaagggucugaggcuauguaaugugaggucuuaguuccaggaaaggaauucucuguauaacaaaagccauguuuuauuuguaucagaguugucuaggaacucacuauguagaccaggcuggcgucaacucacagaggucugccugccuuuuccuccugagugcugggauuaaagggcgugcaccaccaugcccagacaaggaaagcgaauuuaagugaacagagguagaguagacagucacucaccuucuuggcauuuccaauuucauaacuauuuuuuuuuuguuuuguuuuguuuuuuuguuuuuugagacaggguuucucuguguagcccuggcucuccuggaacucacucuguagaccaggcuggccuggaaacucagaaauccaccugccucugccucccaagugcugugauuaaaggcgugcgccaccacugcccagcuauaacuaauuuuuuaaaagauuuauuuauuuauuuuauauauaugaguacacuguagcuguacagaugguugugagcuaucauguaauugcuaggaauugaauuuaggaccucugcuugcucccgucaaucucgcuuacucuggcccaaagauuauuuauuauuauaaaugaguacacuguagcugucuucagacacaccagaagaggacgucagaucucauuacagaugguugugagccaccaugugguugcugggauuugaacucagggcuuuugggagagcaauuagugccaucucuccagcccagcuauaacgauuuaauuugauauacuuguuuuauuuagggacagagucuugcuauguaguccagguuggccucuaauucaggauucucuugccuuugucuccccagugcugggauuacagacauucgucaccaugccuggcucucacaucuauuuuaaaauaauaaaggcaggcaagauggcuuagaccaaagaaaccugucucaacacuuaauaacugaguuaaauccuggagacccucaugguggaagaggagaacugacuccucccaccaucauaagcauguggugcacccuccacaaauaaagaacacauaggaauaaauaaaaauuuaaaaagcaaacuaauuaauaaaagaacuguucauucuuuuccuguuuucuuuagggcuugcgcaagcucgggguugaacugacaaccaccagugcccauaucuguauuagagucuugccaguucaaagauggagaaaggaaugacuuaauacuugccuugagccaucugagaaggucaggacuccaaagccauuaaaaagcccauucucgaagugacccagguaggugccaccgucugcaaacaccaauugaccaaagccaugucuccggccugagcgaagagaaggacagauaccagguuggaauggggaagcuucaaggucccuccucacuggcuuagcaucccacgcuuuuccacaaccucacccaccaaaagcugcccuuugccccugugaguauggaaaggcccaucuccuugugggcaguuucguggauugcuaggacugaacacugggagacucuaagacugcacaccaaagaguugacuuggcucuucugggcacauucacauuuaagacaacagacuguuaaagcacuguacauccaggaguagagacugcauucauuucuaguuccuucauuaagccccgacauaaaggaaagguucuauguggagccgaguccugcaguggggacugagugacacuugauggcugccccagagcugcuucucacccucuuuccacucgccgcgguacuccuccccgcuggaguagguaaaggaaccuuuggucagggucaugguggcagcuuacagaagaagaggaugacagcucuaagaaacagagagagaaagcagugucacggaauggcuaguggacuagaggcggugcuccggcaagugcacacuuaccucaaguggacuccuaccucaggucacuuaaaacgcccuccucgccaccaccuucgccucugcuauggcacccucaccccuacuucuuuaauaguuuucagccaguuccuguuuccugugaugaagaggaaagcucaaucuaccaauauuuacuugacacguacugugugcucaguggauguauaaacaggguccccucaaugaaguuaucauauggucaguaggcucagcaggugaagcaccacacgcuauaccagagacaagguaauucugcaucagcucagauggcagaaauuaguaaguacacaggugagcagcccgcagcacaaccauggugcaugucggcagccucggcagagucaggcggcucaugcauucgacgucauccucagcuaaacgcaaaggccucaaaauaaauaaauaggaaaaauaauagaacaaaagcaagcagcaaaaagagggaaacaacaacaucaacaacaaccaaaacacaagauauccaggggaaaaacgcagagcugguccacccagauaagacggcuuguuuagaggcgauagauacucuacaccgagaccuugagauguuaacgaacggcacagaugugaugcaagcuccuucauguuauagaugaagaaacacaagcucggaagaagccuuuggguaagaaguuuugguggugcuggcaagguggcucagugguuaagggcacuuguugcucuugcagaagacccagguuucauucccagcuucacaucauguuucacgaccaucuaaacuccaguuccaagggauccaaaaccuccuucugacuuccguagguagugguccacacacauacccacaggcaaguacuccauacagguaaacuuuaaaaaaaaacuuaaaaaauuacucauaacaaaaauuuuguugguggcugagcaagggacaagaauauaacccucccugaccaugcugguucuccuuccucagguugagccucugguuuaggucagacuuauugauggugcucucugaaaacuuggcagacuauagcagcuaaguuagggaaaggaggagucgguggugucugggguugggggcggggcacugaacaaggauuguuauuggaugaaagcagcggucaagaaaaaugaccgugacaacaggagggguuggagcagccgagucccaucagagaagcuuucgaggaagagcuagccuccuaccaagagacagaauugccuuaguuugggucagcuguaugcauuacguaguuaauggaauguuaucaaaggugaugauacagauauuuaaacgcagagauuugaggagcacccggcuagccucucugcuacacugggaccuguucuguuuccagugcaggagucuagacuaaucuuccagaugagaagagaucacauggaguaauuguuccagcugaccacagaaaccugaacucagcaagaugucgagggcacugcccuuugagcuggggccccaugcuaaugagucaugguuucauccggcaaagaaauuaugguuguuucuggccacuaggucuuggagguaugugucaucacgcaguaagagcugacaucuucauauggguggcuguggugugcagaaggcaugcuaaguauguaucauagaaaaagaagccacaccaauagcauuggggacuagugggugguaagagaauuuuguauucaaggauaucccauaagggagacaaacauuuaagauaccguucagaauaaacaggggcaaacagaaucaauaaacaauagaaauauuuuucuaauuuucuagaucuuuuuauucaccccuuugucuuuucuauauuuaagcauuacaauguuuucucaagugauaaaaugcagacucacaggcccgaccucaaaccuauugaguccaauucuguguaguuacagcucgggaaccuguaguuugaacaagcacaucacuagauucccauuugaaagucugcggaccgugacucaaccauagggagacacucaaaguuacgaccaaagguugccacggugaauaaccaacuggaagucucccucgcaggcaccugccugaugcuaacaggacaagugcagcuuuucuucagaguccgggacuguucugucuggugcacggaacuagagagcauccuuaaauccucgagggccuggugccagucagcagcuccuuuccuucaagccgcacagaaacugaaacucuuaucaucagcccagcaucagagcaggcucgggcugaggucagugagguuucacagcaaauacaacauuaaugagaggaagacaagaaguuuuccauaagaauuucaagagaaaacucuuuacaguggaguuaagguauucugagagcuacaggccaucuuuagcuuuuccagaacuaaaugaguucguggcagucaaagucaaaugaugauacaaauuguaaaaacgcuggccacuaaucccagcacucuggaggcacaggcaggcagaugucuuugaauuccaggccagucaggguuaugcaugagaccuuaucucaaaagacaaaauaaaaaacuccaaauugaacauagcucuucaaaacacacccaccugaaucugaagagcuguguguauguauaugagugugugugcaugaguauguaugcauaucaguguauauguauaugacuguguguauacauaugaguguguguguauauauauauaaggauauguaugugagugugugugcacacguaugagugaguauaugcaaaugaguauguuuauauguguauauauaugagcauguguguaugacuguguauguaugucuaugaguguguauauauauaugaguauguauguaaugaguauguguguguguaugagcauguguguaugcauauuugacauucugaucucucuaugaagagagauagggucucucuaugaagucuugacuagccuugagcuugcuggguagaccaggcuggccuugcauucacaaauauccuccugccucugcuuccuggguuuaccgcaugcaccaccauucuuggcugugcaauuguguauuuuugacuaaauuuuauaacugcaugucaugaugaagucagucaguagacuuagaagauaguacgauaagggaaucuuuuuuuuuuuuuuuuugucagugguuaaccaacuucucuucugucaaaaguuggugagucgggcuggugagauggcucaguggguaagaguacccgacugcucuuccgaagguccagaguucaaaucccagcaaccacaugguggcucacaaccauccauaacaagaucugacucccucucuucuggugugucugaagacagcuacaguguacuuacauauaauaauaaauaaaucuuuaaaaaaaaaaguuggugagaacuaggauguggcacggggcuccaagggaugaugcuuuuguaucuguuugcucuucaugaaagcuacauggaacuuccagggcugcaucucaccgugguccacagggaccaggggggaagcaaggaaguauuugaggauucucuauggacaaaguacuagcuaugcuccuaaguguaacgcuaucuuguuguuguuguuguuaugcugucagcucuugagcuaauaucuuaaauauuuuaaggagggugaugaaauuugaaauuuuauuuaaauuuuaaaaagggauuuaucuuucagucuaucugucugucugucugucugccugccuaucuauuuaauguaucaguguucugccugaauuuuugccugcaugccagaagagggucccauuauagaagguugugagcccccauguaguugaugggaauugaacucaggaccucuggaagagcaaccagugcucuuaaccgcugagccaucucuccagccccugaaaauucuuuuuuuuuuuuuuucuaauuacuuaaugugguagacuacauuuucuaaagauguuugcaaugucucccuaaauuugaucagacuugggcuacuucaaauacaguaccauggaagugaugcuucaccccuugugugcaccaaacacagcaucacaaacgcucauucugcuccucacuaugcucccauggcuugagagccgagccacgaccugagcgcaccugacuggagccugugagaugguucagcagguuaaggaaccugcccccaagacuggcaacccgagcuucaucccuggacccacacggugggaggagagaaccgacuccagcaaacuguccucugaccuccacaaagcauaccguggcauguaaacauacacacagagaaauaaguaaguaaauacggaaauaaaagugucauucuaaaauugaauauauuaucuggagguucccaagugaugaggaagccagaagguacagggcaugaucuguuucuccaguugauauuccaauuuuggggaugggaggugggaagaaguuucaagacaggguuucucuguguagcccuggcugucccuggagcuugcucuguagaucaggcuggucucgaacucacagagaccgguaugcucagacaggagcaggcauuagugaaggagcugucaaucgguuccaguucccagacucugacccacucaucggagaaacuacugaagaaauaaacagaggcuaucuccaugaugucaggucuagauuccuggcccauaggaucugggaguauuguggggucguuuuaagcugcuaaguguuggguuaauucauuguuuagugauaauaaacagaauaccaucugcuaacccaccccugacaccauucugugcugguuuucuagaguauacauuacaaauuuccauuccuuuuugaucuagggugauacaguaaauucagaaguaguuugucaggaccaugcccagucucaagacucaaaucagaagugcuaauuaaaaggaccacauguggaacucauggaccucaggcuauggcugaauacauuuggcuaggaaaugcaacauguguccaaacagcugauacugucacuaccugggacaguguuugaauuuuuaacuaaugaaucuuguaacuaucaguauuaauuaauagcuccacagccacgaggccaagagggaauuucaccgguaaccaagauuauccauaguuacugagacaaauauaguuuuuuuguuuuuuguuguuguuguuuuguuuuuauuuuauuuuauuauuauuauuuauuuauuuauuuauuuauuuuggcuuuuucgagacaggguuucucugcauagcccuggcuguccuggaacucacucuguagaccaggcuggccucaaacucagaaaucugccugccucugccucccgagugcugggauuaaaggcgugcgccaccaucgucuggcucaaauauaguuuaauaaaguguagccaguacuaguggaaaaaagcccaacacuuuaauaacggacacagaucgauguucacaauacuugcuuauaugauccugcugaagaaaauugaugccccaagcuuucaagcuauacacggaagaauacagucacaaaccaagacgacucacauucccacagagcccuuucuauacucgugauagacaagcugcaaaagaccaguccgaaacauaaucuaaaaguacuauucugucucuguaauccgaaguccuaggaccgugcaaaggagaccauauccuuugauauuuuacuuaaaaaaaaaaaaaauccauggauggcuccaaauaaaacccaaagacagggcuggugagauggcucagcggguaagagcacccgauaagaaguuguuuucauuuuuuaaaagugcuuuaaauucauguguuucaaugugaaccugcaugaguguauguaugcuacguguguacaagagcccauggaagcccgagaggacuuuagaugcccugguacuggaguuacaggugcugcgagccaccauguaggugcuaagaacuaauuccuggcuaguaaacacuauucacuauugcugagccauuucuugugugucucauugucuccccaccccucauaaaaccaagcuuacuaaagaacauuuauguauuugcagcaacuuuugucuaaauuaagaaguuuuuguuuguuuuuugaaagaggaucuauguaguccuuguccuggaacucacuauguagaccaggcuggccuugaacucacaaagaucuaccuuugcguccuaaggcuccaccauguucagcuuaaauuaagaaguuuuaaaacaaaauaaccggcuggugagauggcucaguggguaagagcacccgacuguucuuccgaagguccagaguucaaaucccagcaaccacaugguggcucacaaccauccguaaggagaucugacucccucuucuggagugucugaagacagcuacaauguacuuccauauaauaaauaaauaaauaaauaaauuaaauuaaaaaaaaaagaguguacaagucaccgggcaaugguggcacaugccuuuaaaaaaaaaaaacaaaaaaaaaaaaacaaaauaacaacaguuccccccuccaaucuacgaauaaucauaucccaguuagagacuguuuggaaguagccacccaaacuacucacacaaucuccaaaauguccccaaaaccacuuucuuggguuggcaaucuuuuaguuauaaaggaagcaaccaaaaacaaacaaacaaacaaacaaaaaaaacaaaaaaagggaagcaaccuuggguuuuuagaacccuaagaggagaaaaaaaaugaaagcuuugaugaacaaauauuaggaaacuggaaauacuguuuuauaaaauguguuuuuaaaugaauaugaaauaauuagguuuugaacuuuauaauucgaauccccuuccuagcuggaaaguaaacaggggcauuguuacuauaagcaggucuuauuuaggaagaaugugggauaguuagaugcaaaaagaugaaaagagaacacugguacaggaagguuuuuaaaaacacgaugaaccaagagugguggacucuccgaaguaauauugucuggacacuauuuuaugccaagggaaaggagaaugccugugcugggcucuaauaaagcgaaguuacucagguugguaccuaaguuguuuguggaugcggaauugcagagaugacaauccauuucccaagccucaguaugugggaccucucccuaccuguggcacagacgcgcccuagauuaaacaaagccccagacuuucaccaggcaacccagucuuccacugcauuuuucaucccagcccggcuccguccuuuuuugggggggucggcccccaccacacaggcucuucaggcucucaugggucuggcauucccuccagacacagccuggcacaccccucucgauaaccaguguucuguguucuccggggcuacaaccucuggaucgaaauuccaaacccaauuuuggggucccacucacagccaccuucuggucaguacagccaggacagaggcucgcucccuagcccagucaccugcuugccgccuuagucccuaccugguggaccgcacucccagguccuccucccacccgcgucgcgagccuaccugagcuuggcuucugggcgacgacugucacgccccaacgcgaugcgggucuccagcagcuaggaucuuugcugcucugggcucccaacugccacucuccccuccgccaccuccacccgccucagccacacuggacgccgccaucccugacgggccgcacugggcacaauuccugcuguucauuggcuguuaccuaggcaaccgcgagcaacgccacuccccauugguccagcccucuuucgugccaucuuugugaggggcccaguguuuugggagucugggccaaagaucugaaagagagguggggcugagccggcuguccaaucucauuagucccaacagaaaacaaggacccagguuuccccucuccagagaccuccaggcauaaacuuuaauccuaaauaaggcugaacaaguguucaaaguggcuacccucucuaaagguugugauuuuuagaugcaugaacaacuccaccgcuaaguaugaagagaaaaccuaaaccgugcuuuagaagcucagcuuuguaauuaaugaugcgcugcacauuugcauucauagggaaucacuguguuccacgucuucuguauuuaaaauauauugcuauuauuggagcaaaucuucccaaauacuguucccgaaugucuguauagcuguauguuuauuuauugaagugcgugugggcagcaaguucuucagggcuugggaagccaggguuguccgucguugcuucucucauggaacucauaugacaugugugaggcauugaaagacaaagcaaauggcuucaaauagcuuuuuggauugggauuucuucagcugcagguuagaaaaugguaaugaugaaaauaaggguggcuuuucaggaccuguaugagaacauaacgccaaaagaacgguaguuugaaguuaauuugaaaagauuugauuucuguguucaaauccuaucuucgcuacuuacaaauuguguauguuuuugaguaacuuagugagcucucuggccuguaaaauaagaucagaccaauaaauucaauaugguauuaauaauacucacuagguaauauaagcuaaacuguggaauagauuguagauuaaagugcagucauugagucgggcgugguggcgcacgccuuugaucccagcacucggaaggcagaggcaggcagauuucugaguuugaggccagccuggucuacaaagugaguuccaggacagccagggcuauacagagaaacccugucucaaaacaaaacaaaacaaauaagugcagucauugaaaaauagaauguaaagaaagggaucucuuuagaacuuguguuaggaaauaugaagaaaugagauuaaaucacagauuaugugagaccaaauuauggaaagaccuauaaauuugcaacaacaacaacaaaagcuugcaaaauguaguuucuuuggccagcaagaugguuuguugguuuguugguaagaacaaauuaccuugucuccuugggacacagcauccaacaucauuggaguuauaaugggaguuagugaagcgaauccauguaagauacaacgcccagcacauacuuagcacuggguaagcgcucuccauguguauuucgacauagacuuaccuaaaagagaaaccuagucccaaguggcagacacagaaauaaaguuugaggggaaaacucagaauuccagggagaacucagaaucuuggaucuuuccuugcccauaauauuaaauccauuagcuaaaugagaugaaugauaucaaauacuauuuccaugguucugagaacccauuauaucacuacaugaguuagguagacaucgcuacauagcuacuuuaccuauaaaaggccauugaacucuauauagaucuuuggccaggaugguguauuuauuuuuuguuguguuggaggugaacacagggucuucuauaugguaagcaaacacucuaccacugggauagccucucagcccuggaaggauucauuggaaaaaaagaaguuggagacauucucacacauacaacuaaacaauagcucuuucgguucaguacuucucucgagucggaauaauaauuugacucaagaaaguaggcugaugggggcuggugagaugggucaccagguuggcacuugucaccaagcuugacaaccugaguuuaaucccugggacucacauagaagugagaaccaguuacuguccucugacuaccacacaugcacacacacgagacacacguguacaugcgaucauucaaaaaugaaauaaacggaaaacauuaaggugauuaugugauuggucaucuucugugaaaacuucugcuugcuggugguucugagaugaaaaacaaaaaucccauuaaucauaaucucagcaguuaugaaaggggaugucuguggaaggcuuuuuguguccugauuauagguaagggugauuacugucauuuuauagauggggaacuuuagaaaauuuaaaaaucaacuucuuaaaaaaagcuaauaauuuauagaacagagcuuaacuucaaacaucucugauuuccaagcccauguuuuuauguauuacauuuuacacuauaauuguauugaaauuauuuauuuuauuauuuauuuuauaugcauugguguuuugccugcacucugugccugugcgagggugucaaauucacuggagcuugaguuacauagacaacugucaugugggugcuaugcucuuaccuacugagucaucgcuccagucccuccuuauuauuauuauuauuauuauuauuauuauuauuauuauuauuauuauuaucauuuucucuauucuucugaaucugucuguuucucucucucucucucucucucucucucucucucuucucucucucucucucucucucucucugucacucucucuucugugccuguccgugugaagguaccugaaaaggcuuaaaggagggugucagauucccuagagcaaggcuuagagguuuuuguggcccaccugauaugagugcugggaacugguuccgguuccgguuccgguuccgguuccgguguaagagcagcaagugccuuagcuguuccuccaugccugcagccucuguucugucucuagguuuagaguggaugcgcucuacauugcacuccugcaagcucu

SEQ ID NO: 9280 - RNA, 31800 nt, Mus musculus
ugggggagugccgcggauuggucacggccgcgagcucgcugguguggagcgcgccggguccccgagccggcggccugagggauggacgagacgagcccgcuagugucccccgagcgggcccaacccccggaguacaccuucccgucgggcuccggagcucacuuuccgcaaguaccggggggcgcgguccgcguggcggcggcggccggcuccggcccgucaccgccgugcucgcccggccacgaccgggagcggcagccccugcuggaccgggcccggggcgcggcggcgcagggccagacccacacgguggcggugcaggcccaggcccuggccgcccaagcggccguggcggcgcacgccguucagacccaccgcgagcggaacgacuucccggaggaccccgaguucgaggugguggugcggcaggccgagguugccaucgagugcagcaucuaucccgagcgcaucuaccagggcuccaguggaagcuacuucgucaaggacucucagggggugagcgcgggggugcgggcgcagcgggggcggcgcccugggaccggggaaagggggaaucgaaagggugcagaaaagaaacuucagcgccagcccccggcgagauuggggaugcuucuggggacuggaaguggagaaaccucgcgggaugaagaaaucaaucagaaccuuuuugcaggggaaggcgugagcgaaaagagaaaagaggaaauugaccagauacggggcagaaaaguccugacccaagcugcuuuccagucggucccuuagcuucaaacuacugggacaaguagcuagucauugccuccagauucaggguuuuagaccuauucucuuucaccuuuuauuuauuuauuuuaguuuggcccaaagcugugugucgacccaucacggacucagaggauuuaauucccucuuguguuguggggcugucuuuguagggaucccagguuucuuauuagcagucauuggugacagcguggguggauucgucagugucaucuguccugauuauugcucacuucugggaaaagguucauaucguugcuuaugguuccucagugucagaguguggagcuuuaaaaacacgaaacugucuccugcccuuuaauuuuuccuucaguucuauauuagcaguuuacuuagcuagggcaguuuugcugaccuuaauucugucgccugcuuuuguacuggggggguguggaagcaggauaauguggggcaugaggugacugaggcagcgaagaagugaccuuuauccauuugagacuucauaagaauuuaaaacuuuggacacagaucagaccagagcuauuagaggauuaguaggucaagauaugucagcucuuucuuguugauguugucagaugugccaaaugguucauuuuaaaaauuuacuauuuuuauauguauuaaaauuauggguguuaaaguuguaucaaaauucccucccuucccucuccauauaucgccccccccccccccacacacacaccguuucucucuguagcccuaguugucucuggaauucacucuguagaccuggcuggccuugaucagccugccuguaccuucccagugcugagauuaaaggcaugugccaccacugggcagcuggucucuugcauuugugugugugugaauuuaaaaacaaaaccaaaagcgcaaccuuaaaaauuagcagguguggaccaagccuuuaaucccagcaaucagaagcuggggguucuuuguuaauuggaggccagccuaaucuacagaacgagaucuagggcagucggagcuaccuagaggcacccugucucauuucacuguagcccagguuggcuucaacucacauuccuccugccugaaccuccaggguaccguguggacucuuuguuuaucuuauuuuuucauuuuaaaacuuuuuuuuuuguucuguuuuguuuuguuuuuugagacaggguuucucuguauagcccuggcuguccuggaauucacuuuguagaccaggcuggccucgaacucagaaauccgccugccucugccucccgagugccgggaucaaaggcgugcaccaccacgcccggcuauuuuaaaacauuuuaugugucuugauauuuugucuuuauuuaugugucuuuucccagaggaugguugggucccuggaauuggaguuucagaugacugugagcugucauguggguguugagaauggaaccccgggucuuuuagaagagcggcagcuucugagccaucucuccagccccuugugugcucguuagauggguugcaugcugcuguguggaacuggucaggguggguugugacuuacugcucuugauagagcucauuuacccagagcugcccuugagauuacaaagccagagagccauucugucaacagcgcugguauaaacuggauuggaaaaaacuuugagaacguccacaaggccccugauucagcuccagcacaagaagccaagucagcaagacuucauucuuuuuuauuccagaacagaaugggacuuagguaggaauuguguuuuggcggggggcgaguggguaauguguaacguguugccuggaccuuuugauagccacaggaggaagauuuuuguuuuuuucucauuuagaaguaugucaggucaacugggaaaugaucuggugcucugauaaaugggaguaacaugaucugugaguucuguuaccucaguucaucauggaggacaggccguagggcucggguuuggaggcuguuguuuugguuugggcggugguuaggaucucaggcucuaaguuucaggccacuguccucuguuagaaguaaaaaucuacacacacauuuccaaaacaggagaaaaaaaagauuaguaauaugauugccuugcccugcucccucugaaaguguggucuaggacugaggagccacuuccugagugcuuguggagguuagacugcccacagaaacaguuugguauuugucaccucagaaucugcaccaaauguauuuaaauuuaauuaaugcuuaaauagugcuuacuguacggcagaauaguucaagugcuuuaugaauauugacuuguucccuauaaccaccucggagguugcuacuguuuugucuccacaggugacccuggguacgguguaauugauuugcacaaggucgguccccuaggaaggcaucuuggcuccgagguucugcuccucaccucacuacuguuugagaagcagucagccaugcgaacucaguuucucuggugucgguuagcauugggcuagccugugugugacagauauuuuuaaauaaugaccaaaggugggaaaaagguuuauuuaucucaaauguaaagggagucuaugggcuucucagaaccagcguggcuuuucacugugcuugcagaugugcccguccucagaguguggccuacacguccucugcuaauggcuacucaagcuuccuuguuuaucagccauugggaagagggagagaaagaauguguccccacccuugcuggcccuuccuagaaguugcaucagguuuuucugccuacaucuuauugucuagaacguaguuguagugguuagugcuugugagccuuggcuuuuaucuucccuacacaauaaauaaauuaagacaggcaaggaggagccagucguguguguaagaaccacuuuuggaacagucugaaaaguucuuuuuaaaauuuuuuuuuuuuuuuuagauuuauuuauuuauuauauguaaguacacuguagcugucuucagacacaccagaagagggagucagaucucguuacggaugguugugagccaccaugugguugcugggauuugaacucuggaccuucggaagagcagucaggugcucuuacccacugagccaucucaccagcccuuaaaauuuuuaagauuaauuuuuuuauuuucugagacaaggucuuacuauguagccuuggcugauuuggagcucacuauguagacaaggcugacuuugaaaucacagagguucagcugccuaguuauggcuaggauuaaaaguguccagcaccagucccagccuguuuuaauuuaaauuuauuuuauuuaugagugugucugcagguuuuuaugccacuuggaugugguugcccuuggaggucagaagugaguguuauggaucuccuagagucaaggcuccaggugauugagagccaccugcuuugagggcuggcagugugcucaggcccucuagaagggugcgugcuccugcucauucugaaagacucuugacugugacagucuugacuguacuucccaguuuaugguaguuucugccacuggaugauuaaguaaggaccuggcacaguaaaauggaaaaugcuagauuagcgguugccauggugaugugucucacauuaccccuccucacuuacaggcuugcugcuucagaucucauggucacuugacuacagauguauuuucuuagcaucuacucuuugaugaaguucauaguuucaggaauugcagaacaugugauauaacuaguuuuaagaagaucaauggaccaggcauggugguacaagccuguaaccccaacccucaagaggcagaggcagggagcugucgagauggcucagaaguuaagagcagugacugcucuuccgaagucccugaguucaaaucccagcaaccacaugguggcucacaaccaccuguaaugagaucugacuccuucuggugugucugaagacagcuccaguuuacuuguauauaauuauaaauaaaucuuugggccuaagugagugggauucacuauguagaccuggcuagccuggaauucacagugcuuaacacccucugccucccaaaugcugggauugaagguacacaccaccauguccugccuaugcuguuuguuuuugguugguugguuggugguuuuuguuuuuguuuuuguuuuucgagacaggguuucucuguguagcccuggcuguccuggaacucacuuuguagaccaggcuggccucaaacucagaaaucugccugcuucugccucugccucccgagugcugggauuaaaggcgugcgcugccaccgccuggccugugcuguuuucuaaaaucuguuuauuuguuuaagugugcaugugccucucuguaaauaacauuuaaaaacgguuuucuuguucacaugcacagauagaagaaacacauucaguauuugaaaaacagcaaaagaugacuuccucagcuucucccacccguucagaagaaucuucucauccuuccacuugguuaagaaccauauugauagcaucaccagaccguacugagcaaacacuuuaaugauauagugaaugcuguauauccucuguggauauagguuaugagauuuuaagcuuuaucugccaucugguacagggagcuaccacacacccaaguuaggaguaaaauaguuugcaggucaccguaguucuuagaguauggcccagggaucacugaaaauaaaugucuuuugagggcccagagaugagcauuuucauaauuaauauguguaaggcuuuauuugucugcucuccgucauuucccuuuguguguagagaagagacucggagaucagaugugagauacugaaaccuugacuagguaugaggacgcagcucuagucuguuaacucagacacuacaggguuuuacaacacuguuuugaaauggcuauuuucauaaaauauugguuauguuaauauuaguguuuauuuuuauuaaauggacaguuuuagcacuuaagcuuuaauuucaaauacagcaaguauagcuuuuacccacaaaaaugaaggcuuugggggaaucuuuuguuuuuauugauuuuauuuuaugcauauuaguguccugccugcauguaugugugguaucugcuaucugcccugguccgaggaugucagaggugucagagccucuggaacggcaguuaccgaugguuauaacucacccucugggugcuggacccugagccuggguccucugcaagugcagcaagcacucggagccacugagccagcuccaguccuggaaucuuuaaaaaauaauauuuuaguuaguucuuugaaaaucucauauauuuugaucauauucacacuccccuauuucuccuagguucucccucaauaccuuggaguuuucuuuuaaauuauuuuagucuaaucugggcugcccuggagugcaguugaccuaccaggaauuacaccauuaaaagacugacucacccucucuuagugggggaucuuacuaauuuuuuuaaaaaauuuuuuguuuuuguuuuuguuuuccgagacaggauuucucuguguagcccuggcuuuccuggaacucacuuuguagaccaggcuggccuugaacucagaaauccgccugccucugccucccaagugcugggauuaaaggcgugcgccaccaccgccuggcuacuaauuuuuaacaauuuaagagaauucuaguucugugcuaucaugccugucuugaaggaaaucuuaaaagaaagaaauuugugaaccuuccaugcuguguguaccaaacaaaauuuauuuugaauuuuugugcacauaugcacagaaugagguuggaguucagaaggcaaauugugaaguuaguucuuugcuucaaaccaaauagguucuaagcauugaaaucagucaucagacuggauggcaagaacuuuuuaacccacugagcacucuggcuagccccuaaacuuaaaaaacaaccaaauuuuaaacuaaaacucacuucuggauauaucacuguacaugagugauuuauuuaaacucaaguuuugaguccuuggaaaaaagaaauaaauuuauuccuucuuuccuuccuuccuuccuuccuuccuuccuuccuuccuuccuuccuucuuuuccuucagagacuuacuauguagccaaggcugaccauguuugugaacuuccugcugcauuacauuaccucugggccauuuuguuuauuaagaugggggucucagcauuguuuccaagcuuaacccuggggucucagcauuguuuccaaggcuggccuuguaccccuagacuccaguagaucugcagucuuucuaguggguagcuuggcugcaaauguauggcacuuuucggggucucucuaucauauccuuauguuggucauugcuuguuagugauaggaaacuuggguuccaguaagugauuguggauucugacaccagccagcaagaaguuuccugguuccugauacaguucuguuuuuauuauggacuuccuaagauaucuguauauuauuuuacauuaacuagggagcauaguaaguggggguuaaggaaggaugcuuuugggcuggagagaugguuaagagcaccgacugcucuuccaagguccugaguucaaaucccaacaaccacgugguagcucacaaccaucuguaauggaaucugaugcacucuucugguguguguaugucugaagacagcuacaguguacucauauaaauaaaauaaaucuuuaaaaaaaggaaagaugcuuuuaaaaucagauccauagagauccauucucuuggguguaacaagaauuaacuaucuaagaagagagaauggugaggagaucagucguuuucuucccgagcugagcacugggagguauuuuuuuuuuaauuugaguggugugguguuuuguaugacuaggcccccauagauucauguguuugaaugcuuggccauagggaguggcacuauuaggagguguggccuuuuuggaggagugaguccaucguucacuuguaggugagcuugagggcuccuaugcucaggcuccgccacuguggcuguuacucucauccuggcugccucuugguucuuccagcaccacaucugccugcaugcugccaagcuuccugccauuaugauaauggacuaaaccucugaaacuaagccagucccaauggaauauuugccuuuauaagaguugccuugccgggcagugcuggcgcaugccuuuaaucccagcacuugggaggcagaggcagguggauuucugaguucgaggccagccuggucuacagccaggacagccaaacccugucuagaaacccccuaccccccaccccaaaaaaaaccccaaaagagugucuucacagcagugucuuagaguucauccucaggagaggagagaauuuuuugauuugucagcaacaucguccacucuaugcaguuaacauggcuuugaaaauuagggcagaggcugcuuugugucuugaagaaaccgaccacaugcuugcacaaacuagauccuaaucaaaguuuagcagagcugaguuguacugaggucuguucuuaguccuaaaaggugugugucucccccuugccgaaugcccuucuaguucucaguucucccuccacuuuaauucccccaauucuuuaaucuagacaauauucuucauugaugucccuguguuacagagauaaccauauuuuauuccuuugaagaaccaauuaaugguuuccucaugaugaguggaaguugagaggccugggaggucaguaauaaaugacacuuaguacuuugcuguccucccugguaucuggaaugucucugucccccuuucauuggcgacugcaugcugcacuguugaaggguccaguucaguggccuguggcagcgucucugguuuucagagacuggguucugugaacacagaagcugcuucaugccaaggcgucuuacuagccaccuuggauaagaaagugauucuguggcaggguaugauggcauacaucuuuaauccagcacuggggaggcagaggcaggcggauuucugugaauucaacuagcuuggucuaucuaacaaguuaaaggccagccagggcuacauagugagaccaugucuuuaaaaaguaauuacaaagacuuacaauaucauuuauauuuuacuuuuaccaauaaauuuaccuuaaaaauaaauguauucuuguuagaaagaaaaaaaaagaguuauggguuuuucuugucuuuacaaauccuuauaaguuuuuuuuuuuuuuugaaggaucuggccucaagauuuaauucauuauuagcagugggaugagucagcucacuaguacucacuaaaugaaagcagauggauauaauacguugucuaaugugaccuacccuaacucaggaagugauacaaaaaaaauugcuuuaugacccagccacccuuggauuggcugugaaguaaggaagggaagaagaagagccuaagaugacucacuuaguuagcauaucugccucucuuccuuagaaguagcaguuuggggacuggaaggaaugcgauaaauggaaagcgaguccagagggccuaagggucuguggaagaaaaccuucagaguuuagguguuguagaacacacccuuagucccagcacucaagagguagcagagguggaucugaguuugaggucagagggucuacacugccgaauucugagccagccagggauacacaauuaagacucaacuuaauaagacacaauacuuaauacacaacucaacuuaauacacaguaagacacaacuuaaucuguuuuucugguuuuggacaaacaaaaccaggaaagcagauuaagauguagguuagagaaaaugaguuguguguucucuucuccugaaccuugccuaucagacuguguuaagagaaccccaguugugaccauguuguagcaccuucuuuuuccugcuaugauuuuuguuucuucuuugcuuguuuuguuauuagauugucuuucuuagacaaucucccacccuccaagugucucccagcauuugggaggcagagggaggugauggaucucugaguuugaagccagccuggucuacaaggcaaguuccaggacugccaaagcuacacagaaaaaccugucuugagcacccccuacccccuuccugaaagauaucuuaccaaguugucuucucaccuggaagcguacauuuacuuuguuuccuacaaaccauugacauugaagcauagaguuauaucagagaaggaagauggggaagcaaaagugugaagcaagaaagucucaggggucugguauuguuggcuguagcucuuucuagcagccugucuccacugaguuaagggccuuauaaaugcugaguaugugaucuucuacugaacaccgcccagacuugugaaucaccuucccugcccucucucuguuuugccuauguagagaaucguugcugucuucaaacccaagaaugaagagccauacgggcaccuuaacccuaaguggaccaaguggcugcagaagcugugcugccccugcugcuuuggccgagacugccuuguucucaaccagggcuaucucucagaggcaggggcuagccugguggaccaaaaacuggaacucaacauuguaccacguacaaaggucagugacccaguucuggggagccuuaguucuuugcucuaggcuugccaugucccugaguucuguuaguggaacugagggcucagggagggcuuguuaaaaucugagauacucagccuuuugggcaugggugguaggaacaggcuuacaguuuaaaagcuauucucagggcaugggugaguuuuauauauaaucucagggaucugacaggugccuuguauacauuuaugggcuuccuuggucucuguauuugggcagcugguuauaagccuaggugcuuuuccugcucauccucagugaccuucuggaccaagguuuaagugcacaguuucuuuucuuccuuuccccucucccuuuucuucuuucugggggggcaguggugguaguggauuuugagacaggguuuuucuguguagcccuggcuauucuggaauguacuauacauacuaggcuggcauagaauucacugauaacugacugccucugccuccccgagugcugggauuaaaggcaugcaccaccaugcccagcggaugcuugcuugcgcucucucucucucucuugcucucucucgcucgcucucucucucucucgcucgcucgcucuuucucucucucucucuccaaaaaaaaugauguguuugucucugcauguaugugugagcucaugugugcgggugccgacgaaggauccucuggagcuggagucacaggugauugugaguuuucucaugugggugcugggugcuggauuccacuccuacaagagcagcagugcucuuaaccugagucaugucucucuccauucccuccuuucuuucuaagagaccaggaaggucuuguuauccuccagcgaucaccuguaucaaccucccaaguaccugagucuauagugugccaccaugucugccuuuagauacaaauuaucugaugucagcuaaagagaauuugguugggcugaggaugagaguaaaaugugugcuccaacucccugcaaaggagucccuuggaguugcccucaccugccuucaugauguggaauccugggacuugucugagcauaucaggauagagggccuggcccgggguuguuacucacuguuagaacacuuacuuagcauacgcauaugcaagcccggggauucaauccacaacaccacagggaaaaaaggaaaaggaaaggaccccguccugggcaaguugaaauacagaggcauccacacaccccuuguguuuguuaugacuuagcugagauucugauaaagaguuggggccauacuccccuuuccccuuugaagcaguacugaaugcauaguugauuucauacgacuucagggaacuuaaugauccuguaguguuuaagaacaucuuaugugauaauuacugcuuuauagucuguuuccuaaccugaaauccuaggucagaccccuucgagccucuaggagccuuuuacacagucccugcucugugcuugucauaguauaagcagcacagagccacagcugcuuccucugcuagugcuucuggguacagugccuaaggccuuguccaaggacugagucugaauucuacucaguggcuuuccucuuguuagagauacagucuugaucuggcuuuaacuugugaucuuucuguuuuaggcuccuaagaacuggccucuguggcuucuuuuuuuuuuuaaaaagacuuauugauugauugauugauugauuguauaugugugcacuguagcuguacagaugguugugagccaccaugugguugcugggauuugaacuuaggaccuuuggaagagcagucaguguucuuaacugcugagcuucuuauuugugugacccauggguaaauuagugacuccccuaguguauguucacuauccuccuuguaaaaauagagauagaacuaguaguuaccuagaagagugauuuuuaagauuauacuggauccauauauaaacacauggcauaauguuaauacucuauacguuuugugauuuuuuuuuuaaaauuaucuuuaguuuuuaaaaaauuauauaauucucauuucucccuuuucucccuccaaacccuccuacguauaccaacucuuugaucucuuugaaauucacaaccucuaugucuuuauuuguguguguguguguguuucuaaguacauaaauaaguaaugcucaguuuauaugauuuuuuuuuuuuugguuuuuugagacaggguuucuguguagcccuggcuguccugggacucacucuguagaccaggcuggccucgaacucagaaauucaccugcuucugccucccaagugcugggauuaaaggcgugugccaccagcugccuggcugaugauauuuuuaauauguucuaagggcugucuguccauugauugguauuggauaacuaguuggugugcucuucccugaggaaggcuauuucuccugcucucaacauuccuuaauuaccuauaguucuuugucuaggguugaggccucaucuguuuuuucccucgcacgucagucugacucuuugugguggucuuguucaacucuuaucuaggcagccauauugguaagacuucauagauguagcuucugacauuuuuagaagacagucucauagcaaguuccuugcuccucuggugcgcgcucgggcucucucucucucucucucucucucucucucucucucugcccucccuuccagagcgaucucugagccuuggguguaaaaguggccaagaaauuugcuugaugaggggucuuguguuuuuauaagcuguuuuaaucauuaacaguaucccucugacucccuugauagagaauaaugaguucugaggcuuucuuguaucagaaugaacaauacaaaaacacuuaaucugcccaugauaguggugugcaccuuuaaucccagaggcagaagcaggaggaucucugugaguucgaggccagccuggacuacagauugagaucagaacauaaaaaaacucccuaucuucuaugaggcugaguuaagacaggacuuugcaaguuuaaauuaagcugccagagaaucuaagaggaaucucuaaccuuuacugccuguccuacucuugugccaggauucuauccaguugaucagagcaucugucacuauggaaacagggcucgcacugugaagguacuucaaauaguaaaguugugguucucacucacuggccguuccgcuuccugugaggaggugaccguuucauuagucacacagagaggaguggugggcugggaagaaaaguggcagggggagcugauggcaggggaagcugauggcagggggagcugauggcagggggagcugauggcagggggagcugauggcaggcugggguuuucaaguggaaacuggaaaaauggccugaaaacaccuuuucccacacuuauguauuauguauaguaauaauuagguaguagagaagcauguaugccaacacucacuugugggagucgaugcucucuccacagguguguguucugggggccacauuuagguggucacgcuuggugcccagugccuugaccugugagccaucuuccaguauuuuuucuuuccuuguugcuccuuucuccccucucccguuuuuuucucuccucucucuuuuccuucucuucccuucuguaaaaugaauuacuuuuuuuuuccuagggaguugguugauuuauauuaaccccuaagcuaaucuggcuaccuuucagccaugcucccaacuaaacuugcaauuagggcuucuguuguucagaugaacucuuuuuuuucuuuguuuguuuuuuguuuuuguuuuuuugagacaggguuucucuguauagcccuggcuguccuggaacucacucuguagaccaggcuggccucuaacucagaaaucugccugccucugccucccaagugcugggguuaaaggcgugugccaccacacccggccauuuuaaaacauuuuaugugugcuagucuccuuucuuaaacuuaacucuaaccuaaguauguuuucucuuuacccuguagguaguauaccuggccagugaaaccuucaacuacagugccauugaucgaguaaaguccaggggcaagcggcuugcacuagagaaagugccaaaaguugggcagcgguuuaaccgaaucggccugccaccaaagguauagauugcaccuaugugacuugacaaaguagaugguuuaugguggcaccgucacucgggggcagcagagucuuacagacuucaucugugcguggggauggccuacccgaggugcuugucucucacuucucucagggaccgaagaguccucaccucauuccucuagagucuagaccuucagcuugaaccuacaaggagaugaaggcacgauacucugaaaacgcuccuuucucugucuggugugaacgccacagggccuuugugggucuuuggcuuacuucugaggucuuuaacuuggccuccacagagaugcuuuuguuccuuccucuugguuguaggucgggucauuccagcucuucguugaaggcuacaaagaugcagacuauuggcugcggcguuuugaagcagaaccucucccugagaacacgaaccgacagcugcuauugcaguuugagcgguuggugguccuggacuacaucauccgcaacacuggugagcagccaggggugcucccaugcuuuguaccaaaucuccgaggauugaggugggccugaagcucuguaggaacugaagucuuugugaggaauguguuuuccuguguuugaauggguauuuguaaugguccuggcagaucaauuuuccagguuacauuuugucuagauauagcaucugcaaguugucagaggcaguaaagcccgaguugggauuugccuggcucuuccaaacugugaaaaguacacucacucuaggguccuuuaugacuuuuuugaaguggguucuuggaucacggauuuucuuuuguuguuuuuugaaacaagguuucuuuaucucugguugucuugggaccuugaccucaccgagaucuaccugccuuugccuuucagggcugcaauugaguggguuacuaugccuggcauguuuuucuuuccuccccuccccuccccuccccuccccuccccuccccuccccuccccuccccuccccuccccuccccuccccuccccuccccuccccuccccuccccuccccuccccuccccuccccuccccuccccuccccuccccuccccuccccucuucuuuucuuuucuuuucuuuucuuuucuuuucuuuucuuuucuuguauguuggugaacuugaauucaucuuaccugaccaaaccugcuuguauugaggauaaaagcuuuagauucuugccuucuuuuuucuuuuuuucuuuuuuuuuuuauugauuuuuuuuuuuuaauuuuuuuauuagguauuuuccucguuuacauuuucaaugcuaucccaaagaucccccauauccacccccccaauccccuacccacccacucccccuuuuuggcccuggcauuccccuguacuggggcaucuaaaguuggcaaguccaaugggccucucuuuguagugauggccgacuaggccaucuuuugaugcauaugcagcuagagacaagagcuccgggguacugguuaguucauauuguuguuccaccuauaggguugcaguucccuuuagcuccuuggguaauaucucuagcuccugcauugggggccgugugacccauccaauagcugacugugaucauccacuucuguauuugcuaggcccuggcauagucucacaagagagagcuauaucuggguccuuucagcaaaauuuugcuagugugugcaauggugucagcguuuggaagcugauuaugggauggaucccugcauauggcaaucacuagaugguccaucuuuuugucacagcuucaaauuuugucucuaacuccuuccauggguguuuuguucccauuucuaggaagggguaaaguguccacacuuuggucuuccuucuucuugaauuucauguguuuagcaaguuguaucuuauaucuuggguauccuaaguuucugggcuaauauccacuuaucagugaguacauauugugugaguuccuuugugauuggguuaccucacucaggaugaugcccuccagguccauccauuugccuaggaauuucauaaauucauuuuuuuaauagcugaguaguauuccauuguguaaauguaccacauuuucuguauccauuccucuguugagaggcaucuggguucuuuccagcuucuggcuauuauaaauaaggcuguuaugaacauaguggagcauguguccuucuuaccgguugggauaucuucuggauauaugcccaggagagggauugcuggauccucugguaguacuaagaagaucucaggagauggaaagaucucccaugcucauggauuggcaggaucaacauuguaaaaauggcuaucuugccaaaagcaaucuauagauucaaugcaauccccaucaaaauuccaacucaauucuucaacgaauuagaaagggcaaucagcagauucaucuggaauaacaaaaaaccuaggauagcaaaaacucuucucaaggauaaaagaaccucugguggaaucaccaugccggaccuaaaacuguacuacagagcaauugugauaaaaacugcaugguacugguauagugacagacaaguagaccaauggaacagaauugaagacccagagaugaacccacacaccuauggucacuugaucuuugacaaaucuaucucuaaacgcugugcuguauauccuguacauuuuaguaaggugucuauuugcuuccauugucucauaagcuuuucuuaguugccauugugauuucuuuuucaucuauugguuaaagaauuuguuguuuaauuauggaauuuugugaguuuucuucuccggccuccuccuccucuugcuccuccuguucccccuccuucaggacaagguuacauccucuagcccaggcuguucuggaacucgauguguagcucagguuagucuagaacucugcacuauuucugcuucucggaaagcaggcgugagcuccuguguucagccuuccuguuuucugucugcuguugcuuggugacugacuuuauuccauagugcuccuuuauuuguaguuuugcuuccuguuguuuguuaccuguggcuaacucuggguggaaaauauuaaaugggaagguucagaaauaaguaauucauaaguuuuauauaacuuuuuaaaaaagauuccauucugagcagcuucaaguuucuugcugucuuacccagcacgugaaucaucccuuugaccagcagaucugcacugcagaauuacccaucuguccugaugauccuagcuagucccucggcuggugcugcaagaguuccuuauuuugcugaguaguguguccuaaauacaagauuauuaacaguagcaacugggacaggucaaagacaagcauagaguauuuccuucuggaaagguaaccuuaucagagcauauacgugaggggggagaacacaguuuauauguaauuuagugcuuuaguuuuaggaucauugggagucugggaacacacccuuggauaaggaggagccgcacuuugacugucaccuacuuuucuucaguccauuaauagucugugacuucauaccugaucauccugggaagaggucugugucugugugucuguuagacuugcccagaguucugugugugucugugagggugugugugugugugucugugugggugugucuguuagacuugcccagaguucugugugcguaugugucuguuagaccuuuugcuggccuuucccuauguacauuccuuugaagaauaauuaaaguaacaaaggaagccagaauacaaggguuacaagcaaaugcugaaauuagaaaaccaggcagagggagaacauaguggugcacgccuuuaauaccaccacuugagaggcagaucucugagucugagaccagucuguuuuauagaaugaauuccaggucaaccaaggcuacacagagaaacugucuugaaaaaccaaauaaacaaacaaauaacaggcagaacuuugucucuguuuaauuacuauacugugauguuuuuuaaaugguguccuauagaaugcuauucaagugucauauaaccaaauugucucauggaaaaaguaguuuuuguuuuguuuuguuuuggaacaagaucucacuaugcagagcaggacucaaacucagagaucugucugccucuuccuccugagugcugggacuaaaggugucccauaucuguuuuguuuaauggucaugaacauaguuuuuauuacauugacuuauuuauggagguggagggagucaugucugccauggccccacauauaagguaagaggacaguucaggagucaguucucauauucuacuuuguggguccuggggauugaauuuaggugauaagguguucuuaccugcugaaccaucucaguuaaagauguauugccucuuuaucccuaaguauuuccuaaauacaaggauauucucuuauguaacaguaguagaacuauaaaacauuuaaaugugcuauuaucuaaucugugcacugaauucauucagucuucaccagcuugcuuuaugauguuuucauugugaaauaaagcucuggaucuuagauggcugcguagcacagggcuguaguccaggggagguagaggcaggggguuggaggacagugguagauuauacauaagacaucuggaccgggcuggugagauggcucaguggguaagagcacccgacuccucuuccgaagguccgaaguucaaaucccagcaaccacaugauggcucacaaccauccguaacgagaucugacgcccucuucuggggugucugaagacagcugcaguguacuugcauauaaugaauaaauaaaucuuuaaaaaaaaaaaaagacaucuggaccacuaguuuugucugguuguuaucucuuguuucuccuuuagucuggaacaguucucagucuagcaugccgucagcauuucggaagacugucauuuggaaggccagugauuauuuugcuugucugcucuugagcuugguguaucugcuuccucacaauuagcuuaaacuaagcauguuuuagcaggaguaucacagaagugguauuagguucuuagagcagcagcaggaagcauguccuaccccauuauugauccuaauuuuguuaacuugauugucucuuggauuuucucuauuguacaguuuauccguacuugaugugggaauguccuuuuacauaaguggugaggauagaaccuaguggacagaaguuuaggucacuggggucgugccauuguugaaguaaggggcuuggggcccugguuccuucucauuucuguuugccuccuaaccaucuuuaggugagcauccuccuccccauagccuccuuacuguguucugcuuccuucccacaaacccaggguaacagggccaggugacacugaaccagacuaaauguuaccuccuuauaagcugauuucuuucgcagguacuuugccauagcaauggagcacaaacacauugacuuguuuguuuauugagacagggucucuuuauguagcccuggcuguccuaaaacucuguauaccaggcuggccuugaacucauagaggaccaucucucuuuccuggcugaguaguggaacuaaaggugugcaucacccagccacauaauuuuuauuuaauguauuuacucacuuucuguccuuauuuauuuugaugcucaaauugucccuaaguuggccaguguuccugugcucuuuugauauguaugugcuauaagcacuuccuuaauuucuggcacgagauguucuggguucaccuucugguuccaagcuggaauugccauuucucugagguuccucuuuucaaaaaggauguauuuacagcuaugggaauuuaugaguucauaggacuaccuccauuuucauucauuuuagccuucuuugauuuauaauuccuuucuggauacagacugaccuagcucccauuacaacuauuuacaauacaagaaauaauauaaguuuacuuauucguuuaauccuuacagcacagaaaguaguugcagaauugcuagagggaggaaaaaguacuagguagauuugaugagacuuuguagaagcacuagccuuuuuccaaauagcagaauuaucuacuauuauugcuucuuuucacaccuuuucuacuuccucccccaagcccuucuucccauucuuuuuacuuuuucuucuucuucuuuuuauuuauuuauuuuuuuuugagaccgucuguagucuguauggccaugaauguuugaucuucccgccucaagccucauuaaugucagaauuauaggcaugugacacuaaccaacuaccagaauacuuugcccaccugaauauuuuauucguaaugugcauucaccuuuuaaaggacucaguuauucucauuuugacaaaucuuucuguuuguuuuggggauggggugugagguggccuguccauagcauauaguccagacugguuugguguaaacucauaaucuuucugccucagccuccugaguggcccuucuccacccuucuccuuuuuguuguuguuauuguuuuguauaccuuguagcccugacuguccuggagcuuauaguguagccuacacugaccuugaacucacaucgauccaccucugucugggucccaagugaugggauuaaaaggugugcuccgccagccuguauggcuugaguugcaguugccuuuaauuuuauuuuuuuuccaaugacuuaagacagucuuacuuaacccagggugaccuugaacucccaaucuuccugucuucaccuccugagugcugguauuauaggccuguaucuccacuccuggcuauuccuuuuauuuugaagauacuaaauauuuuacuuggccauuuaaaagucuguagaaaauaagucccuuguuuggagguguuacagguguuuuuguggucuuauuucuguuuuuucuguguuuguuuuugugcuugguuggaugucagauacuuuaucaaaacuguagagauuuucaggugauauggauguguguguguauguguguguguguguguguguguguguguguguguguguguauaguuuuguuuucaagacaggguuucucuguguagcccuggcuguccuggaacucacuuuguagaccaggcuggccucaaacucagaaauccaccugccucugccucccaagugcugggauuaaaggcaugugccaccacucccggcuugauauguaugucuuaucuggaguauaaaguuuaggaagggccagcaccuaagucacugguugcccagggucacauuagccucagauacugagaaggagcuuugguuguuuccaaguguuuucucucaagagccacugucccauuucccagccuuccaaccaccucuucccaaaucagugggugcugccugcaguaggggacggaagccauagguauggaauccuuucugugugugcucucucuccuggacccagcucuuagauucuuuucuucuuuccuuccuuccuuccuuccuuccuuccuuccuuccuuccuuccucccucccucccucccucccucccucccucccucccucccuuccuuccuuccuuccuuccuucccucucuuccagacaguguugugggaagaacuagguuggccuugaguuuaggaucuuccuaccucagcuucuugaaugcugggauuuugacucauuuuuaugaucguguuaaaaucaccagugccuuccagagauuuuaaaauauuuuauccugcagcugggcgugguggugcacgccuuuaguacuagcacucaggaggcagaggcagguggauuucugagcucgaggccagcguggucuacaaagugaguuccaggacagccagggcuauacagagaaacccuguauugaaaaaaccaaaaaaaaaccaaacaaacaaacaaacaaaaaaaaccaacaaauauauauauauacauacauacauacauacauacauauauauuuuauccugccuuaaaguugaucucaguuggaggggugguccacauaucccaaauguuuaauccaucauuucuaaauucagacaaguuauuucuacuaacucuguuucuguuugcagaccgaggcaaugacaacugguugaucaaauaugacuguccgauggauaauucuagcugucggguaagagguugcacccuaucaaagaggaggaugggaagaguggcccuuaaacuguggacgcacagaagagagauuuaggucacagacguacagaagagucagagaaacacaaggauuuaaaguucauaguugguauaguuuuauugcaauguguguuuucaggagcgucuugcugagugguauuaauugggguagcaucaagaaaaggagcaaguuuggagcacauuacagaccuuucccuucuuuccuuugagcuucaugcccaccguagcauagugaaggucugagaaguaccacauugaaugaaucugcccaaugugccaagguguuuaucccagugguucccacccuuugaggccauggggcacuuuuuuuuaaaacagacaaauuagacccuacaaguuuagaaaacguuucagugccuuuuuuuuuuuuuuuuacuuugaagauugaauucauguguacgaguuuuugccugugcagaugucugugcaccacaguguaccugggucuucagagaccagaagagugccugaucuguggcucugagccaccguguggguguugggaaucaauccugugugcucugcaagaacagccagugcucuuaaccucaagccaucuugcugcuuccauuucuguuccugggauggcuccacugagccugaggaagucauggaaccacaugguguuccaggugucaccugccagggcugcugacucuacccugguccuguccuguccuacucugcucugcucuuauuuucuuuuguuuguuuguuuuauuuuuauuuuuuuuucccagacaggguuuuuccuuauagcccuagcuguccuggaacuagcucuguagaccaggcugguuuagaacucagagaucugccucuaccucccgagugcugggauuaaaggugugugccaccacugccaggcuuguccuuuucauuuuuguauaucacugacacaugaugguuaccuuauacagaaaucagccaccugucaucuugauucuguuuucucaauggaaaauggggacauuguuaccauuaucaguaaagucaugucugagcuagguuccacacuaaaagaccuuggcugacugacacaaaauuuucuuuccuucuauucucaaauuuuaccuuaggauaauuuccaacaauuuuugauuuugucguuauucuaguaaggacucaggcaaauucuagguaaauaaauauacauguuccagaacaagcaaggaccucuaccaguguauaugguacauacuuguaacauuagcacuuaggagauagagaccagccugagcaacauaguaagacucugggaguaagugguggggaaagagggagaaauuccagaggaccuugaacagacucaggugccacuaauaaacagguccagaaaacaguaugaaaaccuguagaugggcuggugagauggcucaguggguaagagcacccgacugcucuuccgaagguccggaguucaaaucccagcaaccacaugguggcucacaaccaucuguaacaagauccgacacccucuucuggagugucugaagacagcuacaguguacuuacauauaauaaauaaauaaaaucuuuaaaaaaaaaaaaagaaaagaaaagaaaaccuguagagguaagaucuagguaagcuaaaggaggggcugagaugagcugucuugcugcuaucuauuuauuuauuuauuugcuugcuuacuuguuuguuuguuuuguuuguuugaggcagggucccucuaucuagccauggcuggucugaaacuuguuauguagaccaggcuagccuugaacucagagauccuccugccucugccuccugagugcuagaauugaaguuauauaucagccccauccuccuucuugcugcuauuuuaaagggccugccugagcaagucucuuuauucugcaggacacagauugggugauggugagggagccuguuaucaagguggcugccauagacaacgggcuagcuuucccacugaagcauccugacuccuggagggcauguaaguuuaagagcacuggacuuugcucuguucguugcugcaguagggucggccuaagaauuaaagaaauacuguagcuucaggcauuuuacacgguagccagcagcauaugguaaccguuccauaguauaagcuguuuuacuuuuuaccauuuauuauucccacuagagguauauagguaaagagagaguagacacacgugggcuggguauggagcaugugcagagcccuuggauuccauuucuaauucuugcaaaguaaaugaaucaguauaaagaugcuuuuucucauuuccacuuugccuucaaacuccucauauuuuauuucauuuggguuucugcagauaaauuacuguuggugcccugucuuccuuguuguacuccauaccacauuguaacugagaaucuuuaaggacaggaguagaaucauuagcccccuuuguagugcugggcuucaucuucaggaccaucuaaaagucuagcaagaaguugcaucuggaugggccuguuuguagaaggucauaugucaccugggaaagaacucugagaucaggcaguucuggugugacgccugaguccuguguauacuaguccuguagucuuaggaucaacagcucucgaauguggauuuuguuggccauguauguuagggaagaguuguuuuguuuucggagcacccugacagaaggcaggcccaggauaggggacuuuuccagcagcagcuuugcuguggccuuuucucuuuucagauccuuuuuacugggccuggcugccucaggcgaaagucccguucucucaggagaucaaagauuugauucuuccaaagauuucagacccuaacuucaucaaggacuuggaggaggaccuauaugaacucuucaaggucagccuuucugguuuuucuucuuuguccuggcacaagucaagaagucuuacucacuuaaguuagccagaagagcaagguuacuacauaccagcuggagcugguuuggacggauugaaagaaguggcagcccugguguaucucaguuugcagagugcuuacuuagcaaacagagagcccugguuccaucucuagcacacaugaagccugugugcuguaggacuccaccaggggaggcaggaggaucaaacaaacauucaguuuucuaagugggacaagaaauagugcacuacuucccagcccacugcuuccuuucucuguacugaggaaacuacucuuagaaacuuaacuguggggggggggggucucaaaaaaccaaaaaaauaaaauaaaaaauaauaaaaaaagaaacuuaacuggggagaaaaaauggcuuccugggaggcauucacgccucccaucauuucccuucugcccuucucuuguagagagauccuggcuucgacaggggccaguuccauaagcagauugcugucaugagaggccagguaagccugggacauccuccuugccuuuuucucucccgaaggguuauaugcucauguugagcagauggagcaggauugguggcgcccuuuuaacugugugccgcauauaauuaugacucugcccuaaaauaugggacaggaaagguagccuugugcagucuccuucgcucucauccacaguguugauaccaggguuggcugaaguacucauugaguguuuagcccugcacuagcugcuaugugcguuauugguaaauaaaccagcacacuggccuugaaucgcucaaggcuacaugucuuacucagggccugauaauugggcagaucacaccaguugcagguucugugaugcuugggcaagagucugcauuuucuugcuuauaaaauaggguaguaacucuaccuugcucuguuauggacaagugcauaagagaauucaugguaagcaauaaguaaaaaauacugccgggcagguacaugguaagcaugcauauacucaucauagcuacaguuuuguuguuugagguauaaguuguauucuuucuuucuauuucaccuucagagggaacuacagaaaugaagaauugucaaauuguguagacccaagcaugguggugcacaucuauauuuccagcacucaggaggcagagacaguuggaucucugaauuugaggccagccuggucuacauagugagcuccagggcagccagagcuauguaguuagauccuaucucagagacuaagcaaaacuguagguauugguguccugaguuaucacuuaaggacagucagcucagcaguaaaggauacaaagugaucagaguaccugggucuggagccugccugugagaccuccugacucucucuccuuuccuucauuuccucucaugcacuugcuucaugcucuuaugauuagauauauuuuuuugaaauaguuguaaauagaaaagucaguuucuugaauuuuuuuuuucuuuucuuuuuuuuuuuuuuuacacaugacaaguuucucugugugacagcccuggcuaucuuggagcuucauuuguagaccaggcugguuucgaacucacacagauccaccugccucugccuccugagauaggauguuguacagcccgugcugggccuaaaguuauuauguaguccaaaacucuugaucacccuggcuccaucucccaagugcuaagagaugacaggcguguggcuagaauuaucuuacuaacuugaaucuucaaagaauguauuaaucuucccaccacaaguauauuuccacucuuccugccauuuagcuaaaggcucccaaagagugcauuugagcuugcugagcucauuuuccucgguaaugggauagucaggacauuuuaagagcuaucauuuauuaaucuaucuaaaugccaauauucugccuuuccagguaaagcaagggcccagggaggcuggcauaaccuguagaaagcuacauuguagacucugauauuaaagccacagcggaaaggcuugcuuccugagaaaauccagguggcaccucaucuguauuauaccuucuucuccagucacuucucaucgaagucucuuaacaacaccguagcagucuucccacuauacccaauuaggguuaucaucuaaguagggguaaagcuagaggagacuggcaggugaaauuuuaccuuuccucuaccuuguguucuuaaugucuuuagcacagcuuuugcaacagguugcuauguaagcaaaggaagcauugguucgcgcauaggaauugcauuugauugcguacucagggacagaccugcaguguguucuggcaaaggacaggggaagccgggcagugguggcgcacgccuuuaaucccagcgcuugggaggaagagacaggcagauuucugaguuugaggccagcccggucuacagagugagcuccaggacagccagggcuacacagaaaaacccugucucacaaaaacaacccccccccccaaaaaaaagaaaagaaaaaaaaaggaagaaaaaagaacaguggaagagaaacuuacaaggaacccagcagaguagucuuaacuaugucacuuguuuugaaacuuuuuggguaaguugauggacuguggguaaauaaucauaggguaggacuguaucguagccuucugacucagauaaucauaguuugcuuagucacauacacucagccaguuuaccuacccuucaaaaugacagggccagccacggugauacucugaacccgugggaggcugggggaggagggcuuagcugaagggcacugccuggucagaggaggcucugggucuggaccccagcaccacagguuuugagagaggauugcaaggucaaggggauucuuuucagcuuucccuauaauuccacguuccagccccgcagccauguggucugugucucugagcacucuccaccucucaggccauauuuucuaucucugucaucuuaaagggcaaagaaguauuuguuucuacuugggauuauaauuucuuuauuuacuugucuguuugaaggcagggauauaccauauuguccagguuggucucagauuccugaccccugccuuacacaggcaaacacaguuuuuaaaacuugucagggagguggugcccacuuccauggaaugccuauucagauuccuacuuucuuaaaaagaaauuuaggaucauuuuauuuuauuguauggguguuuugcuuguauguuuaucuguaccccacuuguaugaaugguggccauaaaggccaggaacaaaggucagauccccuggaacugggauagcaggugguugugagcuaccauguggaugcugggaguugaacccagaugcuauggaagaguaaucagugccuuuuaaguaugagccaucucuuuagcccccacauuuucaaauuuucauuuaaaauuaugugucugugucuguguguauuugugcaugugaguguggugaccuaguauugcaucagacgccuuggaacuggaguuagaggugguugugagccaccugacagggaugcuaggagcugaacucagauccgcaagagcaguacuugcucuuagucacugagcugccucuccagccucacaugccuacuguuggaacuagccugcuuccaugguacuuccgcuggcauuuguuuuugacaugaaggaugacacugcagaggcaggcuuagaauacuaggccuuucaccuuuucucuuuucaaugcagauccuaaauuugacccaggcccugaaagacaauaagagcccccugcaccucguccagaugccaccugugauugucgagacggcccgcucucaccagcggucugcaagcgaauccuacacacagagcuuucagagucggaagcccuucuuuucauggugguagccccagaggcaggcagaagaaauccugcaggugacaggcugggaggaagccuggagucccagguucgcagaagccagagaagcuggcgggcgcacagcagagccuuucagagcccuuccucuuugcuugucaccucccucagggcuuuccuacccacagggagaagcacaauggggggacaagaguguuccuggaccuucagaguguuggggaggcuccuguccaggcaaggagcucaggcggcugaggaggagccacucccuccuagcauuugguggcugguugggaaagucccaucucucccugacaacccucuccauccagguuaccuaauauauucugcaucagaaaccaacaaaacaaaaacaaaagaaacaaauuuaaaugcuuguaggaaaaccuacauuagauccucugacaucagaagcccuuaaucuagaaccuaaauuugcucagacacaggcgcucugauaccuagcacuuguuuacuccaugaacugagcggucagagguccaucgcuggcccacggacagaagccauuccuuucugguuuugccaaauugagccuccucuugccacacugguacugacuucguguggcagugagcagguucaugcucugcuccucuaaggcucugcacacaggcuuuuucucugcccugcuguaacuugcccggcacucaucugaggugggaggggcuagccuuggcagugugcucugccaggagugguugugugacgcggaggugauugacuuggccugguugcaugcugggugcuaggaggguucugugggagccuggcacagccucacuccugguccuuaguugcggccuucccuaccuuucuguuugguagucuaguuucccccauuuuaaaaugagaaguucaguuuggguucuggaguggcucucaguagguguugugggucaguagguucaugggcagccaggacagcaucucuguucuucauguguuaacugcugcugccuggagagaacaggaccguguucugcccccuaaccggcgugccccuuggcuccugccuuccgucuugggaugguuucuucucagcuucuugaagagaggccuucggacaguuccccagugccugcccagcucagcgugcaucuuccugcuuccaugucuucucccuugccagguguuugaacccuuucuacaccaaagcagagaacugacuucaggagggagugaaaagggggccgagaggccguaggcagcggcaguggucacacccugugcuguggacccuugaguguucucacacucuacaguuggucagucagccuuggaaagaaauguccugaaggcgugaaacaaccaaagaccuggagugaggagcacaacugugccucagcugcuugccgggcucccaccgccuagaggcagggcugaagacagccuucugucagguguggcaggcugcucccugcccauuccaacccaggagccagcuugcuaugggcuuucacucagcaacaugaaucuccaagcacuggauaugcaugcccaauggacagucgcuguuguuugccccaucuugacaaucccauccagcccacguggacucuggccucagaaccuuguuugagagaaucucucucucuccucgccacaggagccagcagggguccaggugugugccggucuucacagauguuuccacaccagccggguggcgagacuucccccuggagugcuggagagaacuuaguccugccccagaccagguuugccaucaggaggaaauuggguccaauggaagagggggccggugccaggcccagugggcaagggugcaggcagccuuaccugccucccucccucgaagcuuguacucaaguugccuugaauguggacuugggagugccaggagcccagagugucagguacuucagaacagccgccccucugccagccuuaggccuguccccugugucuaggagcugaagcuggcuggugagcgcugcugcccuguucuucuaaugcacuguagaaauuguauguauuguauuuaaaucaaugcaaauguaugaauaacaaauccaguucugaccucucuguccaguuuccuuugggggaagaaagacaagauaaaugcaguuuuaaggacaaagacacauuucuguggaguuauggggacuugacucuugaaaaccaaguguuuucuuaagacauuucaaaaacugacaugagucugcauugauaaaacacauacuugcuuuugguaugaauauuuacuau

SEQ ID NO: 9281 - RNA, 35452 nt, Mus musculus
gguuaggaauugaaccuguguccucugcaagagcagccagugcucuuaaucuuaauccaaucuuaagauggagaaccaucucucuaguaccuccuuuuaaaaaaacaaacauuuuuauaaguucuuuaggaacuucacacaauguauuuugaccacaugacuucccaacuccucccagauccaccccaacuucuugucuucuuagauuguucauuuaaaaacuccaauuuuugcuccacacauuucuagguguagggcuauccaauggagcacagucaguccaccaggagcugcaccuucaaaaaaaccaaacucucugggcuaaaaagguggccaagcaguuuacaggacuuguugcucuuguaagaggacccagguucaauucccagcaaccacagaguggcucacaacccucuguaacucuggucccagaagaucugauacuuucuucagacuucugugggcaccaggcacacacguguugcacauacauacacauagcaaacacauccauacacacaaauaaaauaaaauacacauaaacacucaaaauaaaauacacauuaaauagauguguauuuuaaacaaaccccauagccccuccccccugucaguuagggguagagcuugugaccucauuccaugcuagaauguugacugagguucuccucucacaacgguccgcuguggguugucuccagaagugggggauggucucuacgagguacuuucccucugcagugagcuggcugguccaggagggagguagccggauguaaguuucugacuuuugagcaucuuggucugcaagcaauguucagcaaccccacucacuuccuuggaagucauaugcaugugcaaaggggcucagagccaucguccccagacgagcagccucugcccaucaauccggugguucugugugagggaguguguuauacgugagggagugaucccugacagguuuuguggaugauaguuaauugccucuuucgugggagccaugagguuuauuagggagguuuuugcugcuuuccacugugagaguuuuuugcgccaguguuugaugaaugguuguuuucauggcugccaagagcugcugaguaaggauguagcugccgacguucguugccuugcuguuuguccaacaacucacugucucccagcuggaaagcucauuacucaugagcucuucuuucccagguacaagaacauaaagauguauuuauggagcaccguucaagggcaacaggagcaaagcuguugaucaaaaagaauuauacagucaaagagugcauuuacauacaaaagacgaaaaugcaaaugcuaaagagaacccgaagacaugugccaaacauucuuuccuuuuuccauucauuaagagaaggggaagcacaauucauacaacguagaauuccacauaacaguuuucacuucaagaugaauuuuacagagcuaauauaagccauugcuaccagcucauuccagaauaauuucagccucaaaagaaacacuguguaucuugucaguaacuccgauuucccucuuugcagcauaaagucuguucacacuauucauugggcagcaugaagucuguucacacuguugggaagcauaaugucacacugucuguuggggcagcaugaagucuguucacaccauuuguugggcagccaucaccacugccccaucugcagagcucuucccaucucacaggauggaaauucucacuaaacaacucguuucccuucacuuauuauuuaugcauuuuaauaaacagucugacuauguagcucaggcuggcccaacaacucacaauccucccucugacuugcuaguacuaagggugcagguuugcaccaccaagcucagguagacacugaccaucuagugugucaggucucuauacuugguuuaaacuggagaugcccagauguugaaugucugcucucagaagcucagggcaccacgggagaaaugcagggugauggccgucuaccagagguaggacagaguucuguccaagcauagaaaaggaggcgagggguuaaaugagagaugccaccaaaggcauuuaacaggauguggguggugagugggagguggucaggggcacgcccuccacagggucucugcucuucucagcugcuaauguuacuuuuguauaaucuuccuuccacacuuaaaaaaaaaaaguuauuaauugcugaauuguuguauucguucuuauguaugaggcgugugugugugugugugugugugugugcauguguggggaagcggugcagagggugacuuugcaguuaauuaucuuuagucaccuuuauaugggcuuugggggucaaacucaggcugccagguucgugcagcaagcaucuugccaccccauccccgccacauaaaaucaauacaguauuguaaaagugacugagugcuauauggggaauugguuucuugccuuguuccauguuggauuucuugcucgggaauguuagucauagugccgguaagacacucaagaaucccucuggagagccccagcugagaagguaccaaaaccuucuuccagugugacuguaugcucaugccagcaccaaguuagcagccacucagcgccaacgcuuacagggacaaagcuccauccagccucagaugcaggugaagcuaagaacuagcugaggugucauccaaaccuacacacuguccauucaaacaccuccaaacccuagagcccuagaauagugugaggcagugcauguuaacugcuccuuaaggaauuuuguuuuuguuuuggaggugcccucuugcccaggccaguuaccaugguucuggggauugaauccggccagagcuuuguguauggcaggcaagagcucugccagcccgagguguuaaguuugaacaauuugagagacaauaauuugaacaaguauugagagacaugagaaagauaaggaauauucugaagaagugagaaaacaauagagccuagcacggaagaucuggccaggaaccggaauuugaagugcagagaugauuccgaaacucacaguucucgggaaggguaggcgagugcgcccccucguggcagaaaucaugcuuaaccauucaaccuucccagcuugcgcucagaaugucagcuuagaauuccuccaaaggccaucgugaauuuuaugacucaguuauguggcccauaaacacacucccguagcgaugcaagacuauccucugaaaugucaaguuaauguguuaagaguccucucuggucauuuucuguucuuucuuagccucuuguuuuuauuugcaaagccugcugauucaugauuuucaggaggagacaaauauguagaauucaauuauaaaaugucagagcuaggccuggagguauaucuaaaugcuauagcacuugccuaguauaugccacacccugggucccauuuuuuaccaguacugaaaauaacuaagauaaccccaaaguaucuuaugaauagggcaaggcuuugcucauuguucuggucuuuagagccuucuuuuauucgcugauauuugucccaaaaaaaccccuaggaguuugggaaucauauuccccaauccgagaguagcugaaggggaaaauaaauauaauuaacauugccaccagucacagccagccucaggucagacacaggugggaaaguugccaagaaaaugaaauuugccuuuggggagaguuacugaugguagaaugccaggugguuaggucaucgaaauaagcaauuuuuuucucuaaggaaggaggccuuauuuucuuugaggcaggauauugcuauuuagcccaggaugacccauggugcugggaucacaggucugcucucccacaccugacuggaacagaggcagguaacucuaacucuccccuaugcucagacuuuuacuggaggaaccagugcguuguauucugucugagucgaauuagugccuccuauggaacuaagagcuccuggagacuuuuuuuuuuuaaaccgagacaggguuucucuguguaggccuggcuguccuggaacucacucuguagaccaggcuggccucgaacucagaaaucugccugccucugccucccaagugcugggauuaaaggugugugccaccacugcccagcgaaugagacuucuuauuucuaccagacccaaugcaccauuuuaagggaagagauauuauacugggccuuagaguggaagaaacgagaacaugcaaacuuggaagaugcgggcgugagugcccagaccuuggggagauacugacaggcaugaaucacuuggggaauaguugugcuagaggcuaggugcauugaaguuacuccagccaguuuucccgguagccucagucuaggcagaggauccauuaagcaaacaggcaagcgacuuugcaugugccaagugcaggacugggcaagcccagggaagcaagccagacggacaccuaucccacugggguguaugagggaagacucccugaagaggugaggugagcucugagcugagcugugaaaagaguaggagguggucaaagcuggagcagguucuggaggagccgaauaugccugggccuggggggcgugucccaggggcguguccggggggagugucccuguguccaugaagauggucucaggugaguaucggaauggguaauggugugugugcaggagggaagagggaagagugggagcggcuauggacccuguagguucagggaugagcugggucagaagagggagaagcggggucugcagaggcugcgugcuugagagacuaagggggccccugggaauagucauccaaaggaggagguagauuccagcagacagcuuuaguacuacguguggcauucuagacuucuggaccuccuacaaugaugaugagucuccucguccuccuccuggccuugaacuagcuauguaacugaggauggaccucaucuccugauacucuuacccccauccccaagugcugagauuacagccauguaccuggaguugaugcuggagaucacaccuagggcuaugcaaauacucuagcaacugaguagaguauuucauuaacucugggucuacaucacuaacucuaaccagccccagguccucugcaagagcagcaagugcuguuaauugaugagccacuucucagugcccacccacaacuaacguuaaaaaaaacauuauuauguaugugguguguguguguguguuugcagcugugcaugugugcaugagaggaggcaagaggacaguucuggggaauugcuucuccuucaccauggggcugggggauuguacucaguccuucagguuuguacagcaaguguuuuauccaccaagucaucuugccaguccacagauuuugagcacuuaaaaugugcugaggagcugggcgguggcacugcacgacuuuaaucucaucccucaggaagcagaggccagucuggucuauagggcgcauagugccagugcucuagcuucugaugacauuagcuaacggcugauggugaaugugaacgugaaugcaauccccagggaggguuagaagcaaggaagguggcagauagaugacauucaagggaagaaaaacccuaaggagaccuugaggguaggaggccaagagagguggucuccuggacgcucagguggggaaaggaagaacagcgaaguguccaguguugcugagagcuccugcaaggaagacuggaaauguucgcuggguguggcagccagaaaggcagaggugacccaggaagacgggauuacaguuggcgagggcugaauaggugaggaaugagcagaagagcgggcaagucagaggaggaaacaaaaguggagguaaagaaauuucuugugcaucuugucuccaggcgaagggguauuacugagaguaaagauuucagagccugugggacagugaccagccugaaggaagugaggagagcccagauucccagugcagcugaguccuggcugaggagagcaggcgugccugucucucugaaaaagagaugcuggacgagaugucagugaagcuuugggguagcucagaggagggguuauugucggcugaacagcuagggaaggcugcucacagcugacuccugcuaugauggcuugcuuggguuuggauggaagcaagaaucggggcaggcaggugugacaagcaaucugaggacuuggcaagaguccagggcccuugcagguaacaaagaggguucagcuggcugagacugaggcaccugagagagaacagcaggacagaugaagccaguggaugcagccucguguggguggugguauggcugggguugcuggcauccagugauguauuuggcucaaaucccagcuccgagcaguuuaugugcugugacauuaaagaaguuacuuaccaugacuacaacuccucaucugugaaauggugauaaccccgauaggguuauugaaggaggaacagauaagauaaugugcacaaaaagcuuaguguacugccugccugcugguuaaauggaaacccaugggagguguguuuuaagggacaacagcugggucacaagaugugaagaggauagagcuaggaacggccugcacaggaccuugaacacagcagcuacggaccaccguuccgucucugcuaauguuguaacccucgaaauuacugauacuacuagagaaacuucagugucguguacaguuugucucugcguucucacggcaagcacuauagcagacagcugguuucugugcugcugugucuuccugcagcaagccaggggcucucucaccguuaaaauggcacuacccauaggcaccugacauacaagauguguuuucugucuucccuagguucucagagcuucuauccacauuuucuuucuuuuuuuuuauccuucuccaucccugcccccacacgccccacuuuuuuuuuuuuuuuuuuuuuuuuuuuugagccagaagcucccauagccaagacuggccuugaacuugcaauacuccagccucagaaaccaaaaggcugugguuacaagugugucaccacgcuagacucucuaacuguccuugcuguaauguuccggagcuaggcuggcucccagguccuaggacucccgggcauuaaacgagucaucucuuggguggcaggaacagaguuaaccagaaauuagccaaggagggaagagugcgcaggcgcaguaucaacgcgcuugcucaccugcgcuugggugggaggagcuaagcccggaggccggacccaaggcgggacgggcgcggugacgucacgggcgcgccaccgcagagugagucgcgucccggaagcgacggcgguggaggggcagacgguucccggguggaccugcgacuucggagcgucggugggagguggcguggcguggcgugggguggggcgggccuggccugagggaccgcuccggggcuugguggcccuucugucccccuggccguuccugucucuuccuuuccugggacagcguccggguaggugacgaccgugacgccccagccucacuguauuuauuuacggagccuggcccuccggcccucccaccgcgugugggucgccaccugcaggcacagcgaccuuaggcguguccugcccugcgcggccucagacaggcugguggucugggccucugucggcacugaccugcuaagccugucucgcgcuugcuuggguucccuuucucccuagcucguccugucgagaguuugggguccagucgaccccuuuccaagugaugaaugggagccaggguuaagagcgugauaagaguguuguuaggagaaauucaugaaccucugggagcccugguaagggucucccaguguacacuggcgcguucauaaagacuucccaggacaagauggucccccuuacccugacaccugaaggaggagcuaaagauaggagaaagaugucacaggacaucuuuucucuuggcauuaccuacugccuucuuucaacaaccugguuauuaaugguuuauaugcucuugaaaggucugugagggaaaggagcguuggaggggcucaugaagagugauaggcuuuauagcgaagacauccccuucacccugcuacuuccuacuucaguaggaauaaaauuucuugcagugugagauggguauucgcguucaccucucacaguuaaccuuaggaaccacacgaacuguaaugcaagggggaaauguguuguagucuggaagugcaucgugaguguagggauuuacgauuacagaaugcagacuucggaucgggaccugagugggccggaggcgagccccagcgggaugccugagguucucucugaguguccaccugccccuaccaagucagcagcguuugaucucuucaaccugguccuguccuacaagaggcuggagaucuaccuggaaccccugaaggaugcaggggacgguguucgauacuugcuaagguacagacuuuaggguuccuuuguucuuccucugggcucuccugucucccuggucuuuagcaguucuggccagcuaggcaguaguugggcuauccuuucugcucuagcgaugacuaguucuggggagacuugugugaccuuuagguguauucaggucuacuuguguuccagcgcuaugcagggaaggugggaacugagaaccacuuggucuucaucaggacuguaguuggauaagcuccucuuagggacugcuggaaagacacuggccuaguauagcuuagagcagauguagggauuuuuuuucccuuuucucucugaauauuaauguaauuaauauuaaaaucuugauuuuuauucuuuuguaugcauguggcguugugugcaggucagagggcagcuuuugggaguuagcucuccuuccaggguggauucuagggacagacacaggcuuggcagcaagcacuuuacuggcuaagcuauuuuguuguuguuguuguuuuuguuuucgagacaggguuucucugugugacccuggcuguccuggaacucacucuguagaccaggcuggccucaaacuuagaaauccuccugccucugccucccaagcgcuggaauuaaaggcgugcgccaccacugcccagcuggcuaagcuaucuuaccaucaaguuauaauuuuaaacaaacucaacuacaaauaccuuugaaaaaacgagaugccauuuucacuguuacuugggauuaugguuuucaauuuuuuucuauuuuugcuucauuuuuuuaauccucaguaauuuucuuccagcuuccuuuccuuucuuuuuguuguugagauaguguuucauuguauauaucacaggcuagucugaaacucauagugcaggcugcucucagacuuccaagcauucuguugcagacuuacaaguacugggaccaacuugcuuuaaaaaauguuuuuguuuuuguuuuuugagccauggucuuauuauauuccugacuggccuggaacucauagaggucugucugccacuaucuggagugcugugauuaagggcaugcgccacuaugccuagccugucuuguuuacauuaaaauguuuguuuuuuccuuaagugauuuaucuuuguuuuagauuuuauguguacggcuguguugucuguauauauuuauaugcaccguauguuuguuugguguccuuagaggccaggagagguugucagaucacccagaacuggaguuacagauaguugugagccucugugggggugcuaggaacucagccugcgucuuaacuaaugaaccaucucuucaacuccugccuugauuuauguuaaaaaguauuuuaucugggaauaugccuauaaucccagaauuuaggagguagagauaagagcaucagaaguucacaaaguagcuuuagcuucauagcaaguuuggggccagccugagcuaucuaacaccuugacucaaaaaaaaaaaaaaaacaaaacaaacaaccccccccccaaaaaaaaagaacaaaacaaaaagccuaaauugcaaauaaauggcuuuacacuucugauuacuuaaauuuaugguuuuuuguuguuguuguuguuguucuuuuugauuuuuuguuuuuccgagacaggguuucucuguguaguccuggcuguccuggaacucacucuguagaccaggcuguccuugaacucagaaauccaccugccucugccucccgagugcugggaucaaaggcgugcgccaccacguccggcagcuuauguuuuuuuuaauaaaggccuuugauauuaucaaaauaauguuauacugaauuaaaaguaauuuuuugauaucuuucucuggugaguucccacuuuucuauuuuuuuccaaggaugucaugggcacuuguuuugcaccuccugucagguuccuaucuggcacugcauuucaugugguuuuuaucuccuauaaaucuuuuucaaacuaucccaggcucuuguuuaauguacuggcuugcugaagugacugggcucacuguccuacagaauuuccuucugagaauggucugcuuagcuguguauagcucuuuaacuggaaaguuagacuaaaaacuggacuucauucaagcuaaagacuuucuuuuccaaaggaaguauuguguccugaauguggcaugacucccaagaaucacauaaaauuuguguccaaagcagaagaggggagaguuguguauguguauacaucagaggacaacuuggagaaguugacucucuccuucuaccaaccacaugggucucagagaugagauucaggccugcaggcuuggcugcaagcaucuuuaccugcugagccaucucaccagcucagaguagguucuuaaguuggaaccuguggacagguuuaagggugaauccccugaagcugcaaacagaauuguguguucuugcaugcuuauucaugauaaacaagccucuaguucccaucagauuguuuuaaagacaugcagcugcuuugggugccaaagaagaugguaggaguggacuguguuaccuugaagggugcguuugagucuguauccuuguuucagucuagaaguaggggaccacuucuaauuaugauuuuuuuucuuugagcucccaggcgaacaaaccugguacaccacuuaguaguacuccuugacaaggccguacagucucacccaccccuugugacuguauggcagagucgagagauggggauaagugcucacagcugugcucucugcugugagauccgugugcucugagugcaggacguaggaaggaggagaggccuuucucucuuuccuuagcccaugaacuuugacuuuccuagagagcuguggcugugcauucugccauucuuacccugucuguccccucuguuuugccauuucaggcaaagcacacaaguuacauauccccuguucuccuuuucucugcugacagagaaaagugcuucuuggcacacugacuuuaagguuuuccaugaucuggaaucaggggucugaggcuaugcggagagcagugugucgcuggauggagggggagcuccccccagcuggagucucuggaugcuggcagagggaucacuggucugugaaaguggcugucagauuaguuuaugcuuuugauuguucuuuuuuuaguaaagagaguuagacugaagagggaccuaaucuuggaguuuggcuauugggucuggagccacaguaaaauuuuaagacucuucuaggaucagcugcuccacuuugugggucucccaggaucaaacugucaguaaaggcguuaggacaggaggauggcuuuggaggagagugccuucacuggaagugugaugguuucacuucucaaacaggguugaguguagaccuuucuuacuuucuuuucuuucuuugcuuuucuuuucuuuucuuuuuuaauuugugugugugugugugugugugugugauuuuaccuuuaccauaauggcaaccaccugugguucugagacuuggugaaauguguaugacuggaugagaaagacuuccucauaaucuucagcagaagcuaagagcccuaggccggggagaugguucauuugguaaagcgcuugccgcacaagugagauuaccuaguuuuggaucucagcaccuacauaaaaagccagguguaguggugugugccuggggagguggagaccagaggacucugggaacuuccugaugaguuagccuggcugaguuggugaguucaggguucaguugagacccugucucaaaacauaagguggagagcuggagagauggcucagugguuaagagcacugacugcucuuccagagguccugaguucaauuuccagcaaccacaagguggcucacaaccaucuguaaugggaucagaugcccccuucuagugugucugaagacagcaacaguguacucacacauaaaauaaauaaaucuuaaaaaaaaaaaaaaggugaagagugauuagacacaugcacaaaguaaaagucccauauuaacuaguuaacuuaguaguuguagauuuuaaaaauuaaaacauaggaaauacacuuaugagcaggcaagauggcucacugggucaggcucuugauuccaagccuaagggcuugaguucaaucccagaagcuacacaguagagggagagaacugacuccguaagcuguccucugaccuccacaugugcacacacuggugcacauucgugcacacacaaaauauaccaauuaacuucuaaacagaacauacaugccaguucugaaugcaucguuugccagcaguggaugugguuauuuuuuuugguccuuguuucgcuccucugaugucaccguguguauaugacugaggagaggguaucaguggcuucauuauuacugucuucuuuuuuguuagcuugcuucuuuuuacuuuauuuucucuaugagacaggaucuuauguagcccauacugacuccaacuaacugugacuguggcugacccugaauaccugacccuccugccucugccuccccaugcugggaugacaggcgaggaccuccacacuguggucuacaucuguguuuguagucaauauaaaagugucccuuuccacagccaagccagcagcacugucuuguccuaggagagcugacugaauucuuucuucucucguuggggacuugaguauugccguuuggugguggugugugguggggacugcaucucuuuucaguucacacugguuguguuuucuguguggcaacagcauuuugugcucauguuagaguuucuccccccccccccuuuuuuaagcuaaggucugagcucaggacccugugcuugcuagaagugcucuaucacugaacuaaauuuccaauccuucaguguuaguauaguauaguagguaguaauuuuauccuuuugaaugauuauauacuuaaaacaaaguaugauacauucucagaauuguagaaguaaagagauaaaguaacagguggggaaggaaguccauguuguucuuucucagcuucuuuguuggugaguacuuuuauguuuuuuugguuuuucuacacaggguuucucuguguagcccuggcuguccuggaacacacagagaacuacccaccccuuucuguccugagugcugggauuuaaggcguguacuaccgcuccuugucccuguugaguuuuugugcaaaugguagacuggggaacuuaggagguuuuguuuuuuccccauaucuguuguuuucuguggucccgcaaguggccuggggguguguugauacgguguuaggaaacugugaaauaggauaagggaaccugcuaaaagaagaaccuugucacucagugcccuuaugugagagagagagagcgccuuacaaaacacgggaagcagcagugaccagguuucucaacagacguuagaaagccucuucccucuggaagaaaguucuguggguccucuaguuuggucaccccagggcuacugugugaccacuuuguuccucuguuaaccuccugucuuacagaucgacccaugugcauuucuccuggguuuuuuugucuucucguguccagauugggcugucugcacugccaggccucugugaggcuggaggaauggcugucuugugaucagaacuuucuguguuguagguggcagaugccuuuguguuccuugcugacuugccugggccucaacaucuuguuccucacuuugaacgaggguaaggacuacuucuugaggccaauguguuuuuucaaaugaaugugggggaagagcccugaggugggcucagugggagggacuaccucuuugccccuucgcuucuuccuaggucuguuugguguuggaacacaagcucugugugacuuugggcacaugauguagcccaucgguggagacuaucuuccuuaucucugaagggaggcuagcagcagucuuugcucauuggcaucaugagaugagagcauguguguguguguguguguguguguguguguguguguagcucagcucagugccucacacagauuguagccaguacacuauggcugcagucuguguacugcuugcucccuuugugguacauccaccuuucccauuuugcuuuccuaccuaauuuaggggucauuugucaacaagacacgggguaaugggaucaggaggaggagaggaggagaauuauuuuuccccauaucugucauuuucucugguucagcaauugagccucgaugugcuggguggccaccagcaguggggagaggcucacacaaagcuacgaggaagauguguggcuagguggugacuguagaugucccuggugacagugucuccugaggacuucuguuauguaugcuguaauccagcccuuucaggguuggaauugucagguacuuguagauaaagcacuguucaccccuuccccuccaggagcugagugaaggcuccagggcaggauguucugaggaacuaguccuuuauguguucuuaaaucaaucaaucaaucaaucucucucucucucucucucucucucucucucucucucucacucacacacacacacacacacuucuuaguaucucauguuuucuguggacauacggaaucaguggguugaaaauuuccccaguucauacaagaucacauauuuuuagauuuucuuuucuuuuuuugaggcagggauucucuguguagcccaggcuuuccuuaaauuuaccacauagccccaguuugccuggaaguacccauucuccugccucagccucucagauucuggggcuacaaauguaaccacugucguagccagcuuuauuuuucuuaguuggauuuuucuuugauuauaucuccuaggauuucaauauugugucacagaggagacguuucugcuuugagugugucucugccucauuaucaauccucaggaccccuauguuauccacaaagccaaaggagaggcuuccagucugccuuagugguagagagggcuacauuucuaucauuggggagcuuccagccacacccagacugcagaugugaacaucuauucuguguguuguggcauuuucuauuuuaguuuauggguauuuugccugcauguaugucuguguacuguguaugcacagugugugugaaggccagaagaaggcguuggauccucugaacuggauuuacagauggugguaagccaccguguggguggcagaagugaagcccagguggcagagcagcccauacuuuuaaucacuaaaccgucucuccagccccugagacaguucuuaaugugcuaaacaaggcuggaguuccucugugcucacagguuagagcugacuuccucagaggagacagugagagagacagccacaguccauggugugggauaaggucagugagggaaaacagagcuggggugagcaggccaugagcgggaggucuggagucuucucacccacagugugaucacaucaggccucugagcaggccuagagaggagaggaagcaagugggcgucagugggcaggcgcccgggccucauugacuguuugaucucuuaggugcgugguacuccaugggugccuugaugaucucggugccugcccuacugggcuaccuucaggaggugugccggggacagcugccagagucggagcugaugcggaggaaguaccacagcauaaggcaggaagaccugcagagaguucgccuuucccgagugcaccuuucccgcccugaggcuguugcugaggugaagagcuuguaaguauugcagggaggccaggaaugucugggagcgagccagcgccacacuacagacuaccuaugccacaggcugcacucggccuaaucuccuuaccggcccugagcagagacgcuguuauuauccuccacuuacagaggaaggcagaggcuuagggagcugugacugagacuccagguucagcuacguccacagcuauguucuuucccccagagacaccaagaggggucuugcuuagguaccgccuuugcgcuucagcccuaccucuuccacuucugugcaguguuggagagcucaauuuuuuauuucucuggucccucaucugucagacauagugcuugguuuacucagaaagugcuugugacaauggcuugaguguggaguauccaggaauuguucagcguuaguuaucauuaccagacuaaauaugacguggcuggcacuuugaggaagcagugcuaagacugcuggggacgcuaagugugucaacaucaggggcagcgggcauuuccugagccuuuccuuggaucaggcuccguggaggcuuuugacaucuaauaguggugauaacagagcccugaguccugggagugagagagcuucaggugucuggggaucucacucccaccccauccacccagaaaaagaaacuucuuuuuucugagacaggguuucucuguguagcccuggcuguccuggaacuugcccuguugaccaggcuggccucgaacucacagaggucugucugccucugucuuccaacacccuuucuguuuacugcaaacauugagcauuuauuuccugagaucaaggacauugucuauguauucccagcagaacgcucagaauuagggcauuuauauugauguauuaguacuguugucugcuacauaguucauaaucacauuugccagcuguauugaugaaguuuuuauauugauuucccuugguccagaauccgaucuaggaucauguauuacauugaagguuuuuuccuucccuguagugcuaagauucaauccaagaccuugccugccaagcaccucagcccucauaaccuguguucuguucaucuggggugagcaguucuggggugagaccugacauacuugauacagcacaagcucacuguguuguuugccaucuuguuagacugaagggguacauuuugaacaggacuaaaaguggaguaucauaguccauaucagagccaaaugaggucaggaaacacuaacuuuggucacuugcuuaagguuuguuucccuuugguucguaguaaucuguggagagacugugagacuggaauaucuuguuccucguuagcauucacuuaggugcuguaaaaagccauuggugggucuucccacaucaguuucuuucuggcaugguugagguggcucucugcuuaccauuccauuugcauuuaucuucuggcauucugcagugaggaaaugugauucucauuuguuaucaguaugaaugcauagauucuuauuucacucaguggggucugaucuaucacaguccuuccuuccauuuuggaguguuguggguuggccccugggaccauuuugagcugguuuuguguucuuccaucauauuccagucauuuuucugugccaccuuacuguauggcacaacagaauauucacauucgucuuacacuaucccugcuaagcucuagaaguagcuguguuucugagccuuuugguaguaggagaguggugccucccaauuguaauauaauaauaauaauaauaauaauaauaauagcagggaccugagcugcuucacuucagcaggguucucccgaggcgguuggaauggguuggagcaucuuugccaggccaucuuaucccuuagcaguauuuacagauggugaccacugcuggcuggcuaugcuugugaacccagguucuacuuucuuguagcuucuguacuccuaaauuugugacuagguugguuuggagggagcagggacuccacucacagaagcuccugugucugcagcuugauccaacuggaagccuucuuggcccgccugugcuauaccugcgagucagccuaccguguacuucacugggagaaccccgugguguccucacagugaguaggccccuucuuuuccacccugccauccuguaguaauugagaguggaucccuccugucuccagugaagccaaugccuugaaaaggcuucugccccaccuacuucaggggaagaguaccccaugucccuagggugugggucugcacauaugcuuuugagcucuaaagguugcuuaggugccuuuuaaaaagauauacaguaacaguacuguaauaauauauauaauagguuguaguugcugcuaaucaaacuguggucuucugcaagagccaaaagugucccaggccaaugagccaccucucuagccuguauaugagauuucuuucucuugacuaauuacaucauaagugguugcaacaaugucuuuggaguauaauguggauugugaaugacugaaauuuaugaaaguguucuguuucauuacuagcccuacagugaacauuuuaauggacuuuaguuuuaauuuuuuuaaaauuucaggaauuaacuuaaaagauaagaauacugcauaaaugaaugagguuuuccuaugucaauaaugacuguaacuaggucuaucuaggcuuuacuuugugcccgugcucagaaguuccuguuauugucuuacucuuucuagugaccccgugaaguagcugcuguuuuaaccuucgcuguguagaugaaugaaguaaugcuugagaacuaaggcacuugccauagagacaagugccgguuucagguuucaggcccaagucugugucuagaccucagagcccagacccuggagccaguaugugggcucccacuugagacacaguguagcuucacuggucucacuugauggaagccagcgaugugguacuucugugugcuuucacagauguuccacacugguuugcuuggcaggucuugucaguuugugccagagcugugucucaccagggugcuccccaccauuucccuucugacugacguuggacuuuguguucacccagguucuauggcgcucuucugggcauggugugcaugcucuaccugcuacccuucugacugacguuggacuuuguguucacccagguucuauggcgcucuucugggcauggugugcaugcucuaccugcuaccgcucugcuggguccucgcccuguuaaauagcacacucuuccugggaaauggggacuucuuccgagguaagccccgagagccagagcccgacagcuggguggguccuggcccacucagaggaccuguuuagcuuuccugcuccugucuguuugcugugcuugccaccagggggcagcuucucacucggcugucucugggagggcugcugcuagaucucuggaagugugcugagguuggggggcugacaguccucuaagguggcugccuuuagaggggucaccuuucccuuuuaagacagauacaucacucuuauugauaugguaucuucuagaagauaaggaagggaucuuuucccuaaauugcuaccuacuccugcacuggagccagcuagauuagcugccacaucucagugugaccccugcgucugcucucugacuucuggaugcugggcagucuggggaggccugugcccggaugguugcuugcuuuguuuccucuuucuguccuuaguuuauggaccacucacugaauuggaucacuggccgacucuuuguagccguggggcaggugugauggagaacacuuccagaguaccacuuauugugucucugucuaggaaauucuuccuagguuuuuuuuuaagauuaaagguguggcgugcuccagcacaccacucacuguguccuaucaccuccagcccuguucuccauucccuuggcaguggugugugaguacagggccugccugcagcggaggaugaacccccggcaggaagagugugccugugagagcucagcacugcagggggccggagggaggggccugcuggacagcucgccugcccccacacccaccgaggugagugccuccccacuggcagggccuguugccugucugcgagggccuuucccucccucuuauucuuagcgauguguuuaugaggcacagcuucugggccagagcugagggccuucugccugccuugucucugggaugcgucgucauaugaagggcaaugggaacagcugccugagcuuuucugaacacuugcuccauguccagugccucuuuaggugcccuguggggugugccauaagaauggugcugagauaauucccuguggcaggacagaaggcuagacacagagugagugccagaggcuuuuagcuagaagguagggcuugguuguuggcuacuguagguccagcagugccuuguucuguggccuggccuguggaguuggaggguccuccuugauguaauuuucaucuuucuugcagcuaugcaguuuucauggggaugggaccuaggguuuuggagccuagccacuggcugucagcagguggcucucuacuauagggaccaggauugccaaucuuccuccauuuugccagagaaucuuucuuccuaggaccucacgccaggcaguguggaggaagcugaggaggcugagccagaugaggaguucaaagaugcaauugagguggguggcccucucccaguccucucuacugaccaggccagauauugggugggaugagaguugugugugugugucuguguuuuucuaacauccacaugggaggccagaacucacugagcuagaacucacugguugaaacaguaccucuggcuccuucuacccucaucuguccuggauguccaggcagggcuggcucugcugguuugcugcaagccacuguuggguguuggugauuugucaccugaguuggaggucaugaugucgguauguuugcggaaggcucggccuugugucuuggccuuucuguguacuaagguccauagaugucccuuugggagguuggggagagugguuacauggcuaagcacuaguucagggagaguucacaaucuugacuaagacagugauuuagacugguaguuugaagauguguuuuauuuggcuuguauacuuuuaaaaaagaauccuuugggccagugaauaaaacagggcaaauuuuaguuagaaauuuagauagaaaauauacacuugcaacuuuccuagugucucugagucugcagcagucacuauagcugagggccaugguuuccuguuagauagucacaugggcuagcaagauggcucagaggggagaagugcugguugcuaagccugcgacccgaguuugauucccacaaccuaccuuguagcaggagggaacugacucugcccuucauacauguccuguggcacacacaugcacacacacaauaagugaacguagugaacccuucauacauguccuguggcacacacaugcacacacacaauaagugaacguaggugacucaugcugcaguucucgaguuguccugcacuccugcccuccgcuuacugagccucugacuguugucccuguuccacugcugcuugucauuuaugucccccuggaaagugggagguuguuugcggagcaagagucuugugaauguaacuaggcccuggaugcacggcugacuuccuccucgaaggccugccucacccauuucaguugugagugcuguagacuuccucagguugauaaugguguaggcugagucuggagagagugcgaugcuaugguggggguuuucaagauuuuucuucaugacccaaguaaggaacacauuuuuaucuccagcccugguuuauccuuugcucuguaaucuguggagcuaagggagacuuagcccaaaaggcugcuguuagggcugcuucauuuuuuacccuguucuguugaacugugugaugaccugcaggaguagcaucggcuuccugagagcaugccuguugauguccccuugcgggacgugcucagagcucaucaggcacagcuguuccccugcccccuccugcuucucccuuccugcuaucucucuguuucuucuucuucccugcacccugggaggcaggagacccaccugguggugcugguaaguaggagcagggugaaagggacggggccgggcugggcaggcugagccccacugaguuagcugugccacacuugguggggcccaccaugcccagguaccuucgcaugcagggccugggauguuguaagugacgggcagaguggaauaggcuguucucauaggaggaugaagagggcaccccgugcccagcagaggaugagcugacccugcaggacaauggauuccucagcaagaaugaggugcugcgcagcaaggugucccggcuuacagagcggcuucgcaagcguuacccaaccaauaacuucgguauggccaaagaaaugguuuggagguggggguaugguguuagggcuggugggacucauggagugggggaacaucugggccacaggggcagaauccaagacuugugggcacugguaaagcucuccguggaaccuugggaaauaaauaugucucggaaauaugaguguggagugaguggucucuucaugucuaccucucauuauugaauaucaguugauaggaagacaaggugcucauaggcccgggcugcagagagcugugguccugaggcuguagagugacugcuaauuguagcucaacuaguguccuugggcaaaucaugccucaguuuuuacccuucugaaagaguaguggugguugaguuguggauuuuaugacgguauaugccaagucagcacagguccugccugccucuugguaccugggugcuguuuaugugggaggugcugguuggucuucuggaugccugagagcccauccuggucuuuguggucuggcuuucugcagugaagggcaccuucuucugggcaugguaguuuuuuuuuuuuuuuguuuuguuuuguuuuguuuuguuuuuuuuuuggcacuucuagccaaaguuguaguuugguaagcuagucuuuucuuaggguuguggguaggucaagaucuugaaggguguguuugacucugagcccagguugggacccuggcuuugauuuggagcccugagagcagagccagcuaaaguccuggugagagccuacaguggcugcuuacugagagucacuguggccuuuggauuguguguuucaguguuuagugaguucuaagucugugagucuguggagggaggggaaauccauggauuuaucuucaggaacuugaggggccucuguggcuugccuucuugccccuuacuagugugguuaucuuuucaggauuagauguccuaggccugcuguuugugucuguguuuguaucccuggguacacagaaucccuuuuaccuuuguugacuauuggcuuugguaggcacgcaggcucagguccucucauaagcucacucucauuucucugggggauggguagggcgagacaggcucugggcccaggagcaggugggguccagaugcaaagggacuacugcuguugguccagcaagugacaguuugucugugcaguguaaggagaggcggugagaagcuccuguuuugcagagggguaaccugaggucacccaagagcuucaucucucagggggagcugggcuucaacugcaggucaucggauuccacucuggguccuguuugccaccucaucuguccugugacuucucuuagcucugauguuuaggagugccuuguauagugucaguccugucuucagaccuggguuuugggucagauucuccccaccuggauaggcagaggccauacaggugucugaggguggccuuuuuugcucuucccugccucucccccuugcugcagugccuaugucccuuuguuaguagggccugaucucuaccuugagggcaagugugacaauucugcuuccaagauguuggccccuggguccagguucccagaucagccuuggguaggcugcucugagaucucucuuaguccuuccagacugcuaugagaaaauacaccaugcugcaugcuucauaaaugaagcaaaugcgauuucucaccauugcugaaacugaagucuaaguugugccagcacaacuggguccggguaauagauggcacccuuuugcuggcuccuccgggagacaugacaaagugcuguccagggccuccauuauaagagcaguguucucaugagugcucugccagucacucacuaaaggccccacuuuguaauaccauugccuagggauuaggacucaauauaugaacuuuaggggaccuuccauucuggcugucaguagaugacgugggucuuugggagggaugagaugaaggcuuccucuggagccuccacgugagucuugguggagcugccaaggguccaggcaccccuguccuagagaugacugcccugauggcuccugcccugcccuucucucuucacaguagggucacuaggugagucgaggugggugauguggcugagaaugggcagaguggcuaggcuugggaggagcaggacuguucucugucacugugugaccuggugucagcucucaaccuagaugugcauggggacugugcaguccuggcucuccaucuacuucugaggagcucuuggaccugggcucuuuguccuguccagguucugucaccuugcugaauaggcugccuuccucuguucuugguagaggagccauagucagugagcacguuuucuuaucccgcuagcauccuggaguuuguguucucucuguccuuuacauggcugugagagguccaacagcagagauguuugccucagauaccucagccuugcuccccuggcuccauagucuauuguccuugaucccagggagcgucuuuuagcaagagcugugggcaauccuggcugacuaggaaggaacuuugggacuguuacgggcaaacauguuacccaggagucacaguuguucuuucugcugcugccugcaaggucauagcaggccccagaacccaucucucaucucuccuccauccgccccaacugccagucgucacccgagcggcucuggcacagucugaagcuccucugucccccuguacuuguggcuuuggaaggcuuguguugcugcuugccaccagugcuugagacccugcccuucaugucauguuggaaggugcccuguuucaagcuuucucuugggaucuucugaugacagaaaggaguuuguguuucuuggaggcguaucugucccucacuguggacagauguuuggaaggagacauuaugaaaaggucacaucuaguaggcuucauugaggaugcugggguucagguccauguuggcuuggcuagauuucaggggggagauucucugguuguucuuugauaaucugccaagcuugugaguguguguggcacuugguguugggagcgugcaaggacucaagcuguguguagcuuggugaaagcugcucugaggagcuggcaccuuuacuuauuuuaaauacacauauugcucucugcacccagcuaagaugcugggcugugccuggcuggguccugaguggcccaguuagagucaggaacaauuuggguugagcggccuggguuggaucguagcucagcugcugccuuugucucucagggaauugugcaggcugugccgcuacguucuccgugcugaagaagagggugagucugcugcuguuugccggggcagugugcugugacuggggcugaugcacgacuugaggagagucagcaauggagucuaagcccucauucgagucauaggaccagugcccucuguuugcuaaggcccacacccuuaucagccuucuguuggcuguuuuguccugucucaucccacccacugaggccccucuucuguuguauaaaauuggagggagcacuggggugucaggugccugagggugggcuccaucugacacuguuguucccgucuacagcggagcugcagcaacugugggaacagcuucugcucgcgguguugcuccuucaaggugcccagguccucuaugggagccacaggugagcgaggaggccagagaggcggccugugggaaggacugaggcugcccugcauagagcaagacagcucccgagacuccucuuuccucccagaggagaccaccugguugaaucuuauuucauuaccccagguccacuuuuaacagaaucaaaggaauuucucuuccuuuccuaaaugcuguguauguuuguuguaaaugaaaccuguagaugagcaaaaggaaguccuccccugccccuguguuccugacaggcagaagggagcauggaugugcacauguaggaagcaugagcgugcacauacaggagcguggauguguauuugugcucuugacaacugcggugauaucuuacuuccugcccugugaugugcugcaguguggggcaaggcuuuuugccaaucuuacaaguagcacaugcuuguuaacuauaaaguuuugagguuauuauaaagaagaaaggaagagaaaaaugauccuguaaucuuaccacccagagauuuuuuaaccacuguuaaaacguuuagggaaaauuuccucugguauuuuauuuuguugaugccagaagaauuuccaaugcauagaacaccugggagaggccugcuguuggcgucagagccacagugccccagcgugucugagggagggagcugggucagggagggugugggccgggccguggguggucugucucaggacuggggaggcuaauucaguacuuggcaccuugagccuaaaggguacaaagaacugucucacugaguuuuucuuucuuuccagcuccugaagcccagagagagacugugugugugugcgccuccugcaaucagacccugagcaaaugagaagagaagccaggcuccaacuguccuggggccagcagugacccuacugucccaacucugggccucugaggccugugcugggcaaacguagccugacagcuagguccuuccugcccuuccccugcugccuccagcugggcuggugaugcucuaaggcccagggggagaggagccccuggggucccggcucuugguucugcucuauccuauacccuguuaacucagggcuagcgagggaguguccaccagagggcagaauugagcacagccugcucucaucugggcucuggucgucaaggucaggcuggcuagaccuuaggauccaagagacuugagguuggaaaagagguucuucccuguuggguacuugucagucucucagccccagagagccugcgaggggacuuagagcuccauggccugccuuugccuuuugaauagccucaggacuggcguucccaggugucccaaggagagggaaggugagggugcugcucaaguccuucagugucaaguggauggcaggauggggaagcucugcuuacagaaucuuaacucccaugguucucugguguccucagcccugcugggguggcuacaggacccucacaucacucuuccauccugcucugagucuagggcaccccaccuuucucccacugccacauaucucuagcccuuaucucauggaacaugcggccaggugaguggagcagagagacugcaagccuuugagguccagggacguguaggacugcccggauuucagggcuguuccuggaguagagauagcauuguaggauagggucagucacauggccaguuuuauguucccucugaccugccaagggugcugugccucuucuuaagccaugagcuggcucaggccccuuccccuggagcuuuuucagaguauuuauuuauuuauuucaugguuccugagagcacgcagcacaggguaggaugaagaagacaaggggcuucugccugagacccuucugcagucauggacugcccuuggagcugaucuucaggaacuguuucugcugcccagucauggguguggugcccacaccugaaccauuugagguccuccuugcugauaggccacacacacacagcaguagagcacugaggguuuggcaguggggaccaagcaggugagguguacuccuuuguccuggugagagaugcucaccucugcguauuuauacuguagagcaguagacaggaacgcuguggagaauugucaauaaaaggccccaugcuuaugguuuugucaggucuccuagugcuguucaggucuuucauguugcccagggugggcuguaggugggcuuugcacaccuccuguggcaauucgugagccagccaggcccaguggaaagcugugccuuaucaacaggaggggugggcuuuaucuugugaccagacccacggucuuggauugagguugggaccagaacuuaacuauaaauaaugcaggcuucagaauggaaagguuuuagcuaauccucugggaaagacagaaaggccagcgcugcaggaggcugagagcugguaagcagguuucugguggggugaggugcaaguuggcccugugaucaggcuaggcuggagcugggcacugcacacauuauguuagcgcuggcaccaagcucaugagguaggcucuguuuuccacaugguaaggccggcagugcacagcagcagcacugugagccagcucugagcucagccccaccuaccaaggacccaugugcuaucauccuguagccuuuagaaagaaugcacaucuguccuguguccuuauagcaaaagccacugcugccuccucuuccuccucucccuccucuucuuccaccaccuccuucaacaaagaaugauuuuaacuuuuuuuuuuuuuuuuuuuuuuuaagguaucaggccaucuuauugaaaggugacuguguagccgggcgugguagcgcaugccuuuaaucccaggauuugggaggcagaggcaggcggauuucugaguucaaggucagccuggucuacaaagugaguuccaggacagccagggcuacagagaaacccugucuugaaaaaccgaaaaacaaaacaaagcaaaaggugacugucacugcugaaaaaggcuggcuguagucacagaugugagacagggggcuugccuuuuuuguuuccuggaggucccugugagaacagguggggaggcugucuucagaugcagguuccucuuaagagagcagagcuaacaggguucagcaagguuggugauggugucaccauggagccugugguacagagaucucaauguggaaugauagacagcuugcacguuguagaauuggaugucugugucaaaauacaccuuccaauuugcugguacccaggaacagagacagagagccagguuguguuagaguccuggcauguggcagggcagguuuggaacucuggcaucuagccugacuugggcucaggucuguugagucuuuuguggucuaguauguggaugucuucagaaggucuuggcagaccuggaauaggugaugauuuugggguguuuucuguagccccuggggcugaagccaaaugaaucuccuuuuucagagaucugugucucuucucacagcuggcccuguucacaggucauccugccagggacuauaccuagccaguagcucaugucuuacagugucacaguuugucuaguucuuggauauucuaaauagguaaauagagguacuggggugggggguguuaaguuccccacccaaaguggagugggaaacacuuguguuacaaguguucauagcagcuauggucuaagaagccuuggguaaaggccauguucugguccccacucucuaaggagcuagccacugagcuaacagacuggucugccccacccccacccucuuagcaccaucccccuucagucucuaccagaacagaaguggccuuguggcuggagcccccaccuucccuagcucccagugaccccaccuccugccagcaacaccccagcagcacauuccauucucuggcacugcugguggcuggggauuccgggcuccuuuggcggugagccuucuuuggggcuccagcagaggcuguuugggcugggacacuaggcuccagccacacacauuccagcaacaaacaccccccacauuagauuucccaaggagugaacuuuagccaggauuacagauggcugcacaguugugggaugugagcuugcuuugugcagaccugaggcuggaugcuaguaggggugaaaaggaaugggugggagcggcaggcuucucugcugcugccugggcucuuguagcaucacggaagcagcugaaggcagccuuugagauugccugucccguccuaucucaccucuguagaaggugguaauaguccucagacuuuuaagcuguaggcugugauuccgugugguaucccguaacugcaugugaggauugggaaaaguuuggugacaguaaaaggcuaucagacaccgagcaacuaaaaaacaauucaaaaccaaacuugaaaaucaguuggagguguuuguggaguccuguccugagcaucgcagucuugguucugaacacacaacaggcacccugugcccucugccuccccuccugccacacagccagugaacacuccuugaaucacacagaugugagaccacugcauauugugaacugcaguguuuuuacuguccagucagcuccugcuuuuacaggaacacaauggcuuacagaaaauaaggacauacuauugcccugcuugcauguaaauaucaaaaaaguacaucuuugcaucacauuauauuggaauacuugauuuuaaaaauuaauguuuguggacuagugagaugacucauuagguaaguccuggucacaugggcuggaccccugaauuugaucccuggaaccuguguuaaaaagccugauguguugcgucuguagucucaguguuccuauagcaagaugggaagagacaagaggauugcucuggagugugcaggaggcuggcauaaaccggagacugccucaagaagauugaaggacagaagcaguuccucuggcaucuacacuguagcacaaguaauaacaaaaauuaaaaaagaaguggaaacggcugacuucaguuucauaaauuuuuuuuuuucagugaacuuugacuuggaucagggaucaggauagaauuucaaacaauuuaugaaaugucucuaaacauacuucugccauuuuguacucucugugugucuauaugcagaacagcauucuuuauuuuuuaauuuaaauuuaauuuuuuuguuuuuugagacaggguuucucuguggagcccuagcuguccuggcacucacucuguagaccaggcuggccuggaauucaaaagauccaccugccucugccucccgagugcugggcauaaaggugugcaccaccaaugcaugccacagaacagcauucucagcacuggagauuauaaagucaaaacugaucaucuguaagaacugagugcugugcauccuaugcuaucaaccacucagccaagguuuaaucccuguguaaauacaaacacaucugugcauuacugugcagguuugcuuucauccuuacgugguguguguaugcccaaggguuauuuugaaauagauuuauggcuaaauguuugauuuauauaauauauggauuuuacguaucuaugccuggaagcaaguaagcguuucuuggguggaagguuguaagugggagggguuaagaaguccuggguggugguuaagaguuuggggacaaauggagcaucaccauuuauguugugcagcuuggucaagaaccuuaaugucuuugagcuguuacuaaaaugcaccaccucuggcucggugugguggcacacaccuuuaaucauagcacuuagggguagaagcaggugacucucugaguuuuuagccauucuggucuacauagugugguuagccacuuagggcuacacugugagauccuaucucaaaauggcagcuguaaagcuuaaauuagaauuccaaagugcuuuugaguagugucugcuauuugcccuggcauggguuuauaugcuaccuaggggccuaauucugaagcaagcaaaaccccagauguagucuccauacuucuggccuuuagguaagacgucccggcuuuucccugcccucuugucagucauguaucucaguugagugaagaaucagguauuuugcuggguaccuacugugugugggcauuguuguguuagcgacaauacaaauaaccaccauuggccaccuaagcucugcauuauguccagguccuugucgcacacucggcagcacugccauguacccaguguugccuggcuacuaauucauaggaccagaggccagaacuacauugccucuucucacccccaccccgagugugagguuccuugcucccaagucacuccuguuuucuaugagaauuuuuauguuuuuuauguucaggugaaaacuugauuuccuccgcucucucgaagggaggggguggucaugugauuuaguccuagccuggagcuggaauggaagccgaccagauuguccugcuggccugcugcuuaccugcucaggagggguggggacuccugagcuguagcuguaggccuugcugucaggaauugggaagagguacuaucuuguagucaagaacugcagacaucuggagccuggcgcauccccaacacauagcucccuaccucuagaccuuccguguggagagguccccauguaccauggaaugcauuuccacuccugugaucagaggucagccuucacugguuucuugaguccaggugugggcuuuugucaacugggaaggaacucgguaugaccagcaggacuggcuaaagaaagaccggcccggggccuugcagagccucccugcucccugggagaauuccucuccauuccagaagagauucuaggcaggcagagaacagaaguggggcauagggccagaucccuuuuggggugguaagaagugcccucuugggcucucccaaaugguaggcuacagaagcccucucccaccuccacucccugccgccagcaccugccaggcgagcacuggacuugagccagagguggccggauccugugugcuugguggaaaaauaauaucugugccuggugaaccagagaagugccugucaauauuugguuagaguggaggcugggagacaaggcacagauucagggagccaggcggguugggcaggguuugggcaggcuggguggcaaccaccuccucugaaugaggaacaggggccucugcugcuugggcagagcccaccuggccgcccagaggugauuuaugguuaaguggccaggccaccugcucgugaggccuccauggagggcaguuuaacuggcccacuuuagucuuugcuugcugugcccuucuuggccaugccaccacuucuguuuugcccaggugacauuuuuccagggaguacccuuccagagcugguggcuccuguauuuuggaggaguagcaggacuugacuucucugcuggccaggaaaaagcucucagagugccugcuguuugcccuguggacaucuacccggucuucccacaucuguggacggaccuuaccucgucuccauagugaacucuuugcacaugccucuucccuccaagccuucuccuggcccugcaccugcaccucaaagcugcugugugcaccccagccuucucccucccugcuucaggucucuuuguccuagugauugcucucagagccucccugcauaccacuagguggcaaaacacugggguucuggugcuuggcagaggcccuguuuucauuccacgggaguggggcccaggauuuguuaaaagcucuguagaugggcuaagguuauguauuuaaaaaaaaugcagguucuuagguuagauccccaguaauauucuaaaaauaacaaagcagucuauuacagcaagguagagugugaauucccaggcaagcacuuugucucccaauggcagacacuccuagcccucugagaugugucucuaacuagcuccuggguaacauggcugcugccggcccaggaacaugcuuagagugaaauccauauaaagcagcugucaccuuuaugucaggauuagugcccaggaguaucuggaaaucccaggagagaggugacauuguccccggugaucuggccuucuuagacccuucugaccuggaaaugcccagauggggacagugcaugacugggagucuucuaacuaugggaaaggguuggaaacaugggacgucugugucuucucagggacaucucuauuccuaacuuaguggcuuggaggugagaguaacaccuuguauucucggggaacaguuuuucuuaggcuuuccaaggagaugaguggaccaagugucagcucaggguccauuucucaaagccaucugaaucuuccuacacuuccaccucuugagaacuacuggauaaagaaauuaauugguccaaagcaacuguuguuuuauuuaauuaaaaacuuuuuaaaaaaauuaaggaccaaaccuguugucuagaaucagcggccccacagcaguagcaauaauuuaucgucguugggauacagggauugaggaggcagagcaagagccagggagcaaggcuguguggcagugaacgcagaagcagcugagccugcacuccaguccaucguggcuccagaugaggagugggcguggcuggaagacguggaggccuuggaucuugcucuuuggaggacugugaugacacacaaaggggcaugggggaggaaagcuauucccuaaguacggaucccgcuuagcgaugagacccacaauccuuucuggaaagccccuccccaggcugcaggaggcccuguauccuguauccguaguccuucacauuuuccuccucugccuguuuuuuuucagacacuagggcuucccccagaagagaaaguccuucuacugggagagggggcguccccgggcagaccccaggaucccagaacccuucagucaaagaggguagccccaugccucugcuuuggagccugugcaguaggugcgugaagccauccuuggggggggggggugaugggucagccugggagugaaggugaggccaagugggcguggacagaggcgaggcaaggcacagcuggcugguuggggcaaggagcagggggcccuucagugggguucagcugccccauagaaaaaaggguaguagagg

SEQ ID NO: 9282 - RNA, 7278 nt, Mus musculus
uuguggaugauaguuaauugccucuuucgugggagccaugagguuuauuagggagguuuuugcugcuuuccacugugagaguuuuuugcgccaguguuugaugaaugguuguuuucauggcugccaagagcugcugaguaaggauguagcugccgacguucguugccuugcuguuuguccaacaacucacugucucccagcuggaaagcucauuacucaugagcucuucuuucccagguacaagaacauaaagauguauuuauggagcaccguucaagggcaacaggagcaaagcuguugaucaaaaagaauuauacagucaaagagugcauuuacauacaaaagacgaaaaugcaaaugcuaaagagaacccgaagacaugugccaaacauucuuuccuuuuuccauucauuaagagaaggggaagcacaauucauacaacguagaauuccacauaacaguuuucacuucaagaugaauuuuacagagcuaauauaagccauugcuaccagcucauuccagaauaauuucagccucaaaagaaacacuguguaucuugucaguaacuccgauuucccucuuugcagcauaaagucuguucacacuauucauugggcagcaugaagucuguucacacuguugggaagcauaaugucacacugucuguuggggcagcaugaagucuguucacaccauuuguugggcagccaucaccacugccccaucugcagagcucuucccaucucacaggauggaaauucucacuaaacaacucguuucccuucacuuauuauuuaugcauuuuaauaaacagucugacuauguagcucaggcuggcccaacaacucacaauccucccucugacuugcuaguacuaagggugcagguuugcaccaccaagcucagguagacacugaccaucuagugugucaggucucuauacuugguuuaaacuggagaugcccagauguugaaugucugcucucagaagcucagggcaccacgggagaaaugcagggugauggccgucuaccagagguaggacagaguucuguccaagcauagaaaaggaggcgagggguuaaaugagagaugccaccaaaggcauuuaacaggauguggguggugagugggagguggucaggggcacgcccuccacagggucucugcucuucucagcugcuaauguuacuuuuguauaaucuuccuuccacacuuaaaaaaaaaaaguuauuaauugcugaauuguuguauucguucuuauguaugaggcgugugugugugugugugugugugugugcauguguggggaagcggugcagagggugacuuugcaguuaauuaucuuuagucaccuuuauaugggcuuugggggucaaacucaggcugccagguucgugcagcaagcaucuugccaccccauccccgccacauaaaaucaauacaguauuguaaaagugacugagugcuauauggggaauugguuucuugccuuguuccauguuggauuucuugcucgggaauguuagucauagugccgguaagacacucaagaaucccucuggagagccccagcugagaagguaccaaaaccuucuuccagugugacuguaugcucaugccagcaccaaguuagcagccacucagcgccaacgcuuacagggacaaagcuccauccagccucagaugcaggugaagcuaagaacuagcugaggugucauccaaaccuacacacuguccauucaaacaccuccaaacccuagagcccuagaauagugugaggcagugcauguuaacugcuccuuaaggaauuuuguuuuuguuuuggaggugcccucuugcccaggccaguuaccaugguucuggggauugaauccggccagagcuuuguguauggcaggcaagagcucugccagcccgagguguuaaguuugaacaauuugagagacaauaauuugaacaaguauugagagacaugagaaagauaaggaauauucugaagaagugagaaaacaauagagccuagcacggaagaucuggccaggaaccggaauuugaagugcagagaugauuccgaaacucacaguucucgggaaggguaggcgagugcgcccccucguggcagaaaucaugcuuaaccauucaaccuucccagcuugcgcucagaaugucagcuuagaauuccuccaaaggccaucgugaauuuuaugacucaguuauguggcccauaaacacacucccguagcgaugcaagacuauccucugaaaugucaaguuaauguguuaagaguccucucuggucauuuucuguucuuucuuagccucuuguuuuuauuugcaaagccugcugauucaugauuuucaggaggagacaaauauguagaauucaauuauaaaaugucagagcuaggccuggagguauaucuaaaugcuauagcacuugccuaguauaugccacacccugggucccauuuuuuaccaguacugaaaauaacuaagauaaccccaaaguaucuuaugaauagggcaaggcuuugcucauuguucuggucuuuagagccuucuuuuauucgcugauauuugucccaaaaaaaccccuaggaguuugggaaucauauuccccaauccgagaguagcugaaggggaaaauaaauauaauuaacauugccaccagucacagccagccucaggucagacacaggugggaaaguugccaagaaaaugaaauuugccuuuggggagaguuacugaugguagaaugccaggugguuaggucaucgaaauaagcaauuuuuuucucuaaggaaggaggccuuauuuucuuugaggcaggauauugcuauuuagcccaggaugacccauggugcugggaucacaggucugcucucccacaccugacuggaacagaggcagguaacucuaacucuccccuaugcucagacuuuuacuggaggaaccagugcguuguauucugucugagucgaauuagugccuccuauggaacuaagagcuccuggagacuuuuuuuuuuuaaaccgagacaggguuucucuguguaggccuggcuguccuggaacucacucuguagaccaggcuggccucgaacucagaaaucugccugccucugccucccaagugcugggauuaaaggugugugccaccacugcccagcgaaugagacuucuuauuucuaccagacccaaugcaccauuuuaagggaagagauauuauacugggccuuagaguggaagaaacgagaacaugcaaacuuggaagaugcgggcgugagugcccagaccuuggggagauacugacaggcaugaaucacuuggggaauaguugugcuagaggcuaggugcauugaaguuacuccagccaguuuucccgguagccucagucuaggcagaggauccauuaagcaaacaggcaagcgacuuugcaugugccaagugcaggacugggcaagcccagggaagcaagccagacggacaccuaucccacugggguguaugagggaagacucccugaagaggugaggugagcucugagcugagcugugaaaagaguaggagguggucaaagcuggagcagguucuggaggagccgaauaugccugggccuggggggcgugucccaggggcguguccggggggagugucccuguguccaugaagauggucucaggugaguaucggaauggguaauggugugugugcaggagggaagagggaagagugggagcggcuauggacccuguagguucagggaugagcugggucagaagagggagaagcggggucugcagaggcugcgugcuugagagacuaagggggccccugggaauagucauccaaaggaggagguagauuccagcagacagcuuuaguacuacguguggcauucuagacuucuggaccuccuacaaugaugaugagucuccucguccuccuccuggccuugaacuagcuauguaacugaggauggaccucaucuccugauacucuuacccccauccccaagugcugagauuacagccauguaccuggaguugaugcuggagaucacaccuagggcuaugcaaauacucuagcaacugaguagaguauuucauuaacucugggucuacaucacuaacucuaaccagccccagguccucugcaagagcagcaagugcuguuaauugaugagccacuucucagugcccacccacaacuaacguuaaaaaaaacauuauuauguaugugguguguguguguguguuugcagcugugcaugugugcaugagaggaggcaagaggacaguucuggggaauugcuucuccuucaccauggggcugggggauuguacucaguccuucagguuuguacagcaaguguuuuauccaccaagucaucuugccaguccacagauuuugagcacuuaaaaugugcugaggagcugggcgguggcacugcacgacuuuaaucucaucccucaggaagcagaggccagucuggucuauagggcgcauagugccagugcucuagcuucugaugacauuagcuaacggcugauggugaaugugaacgugaaugcaauccccagggaggguuagaagcaaggaagguggcagauagaugacauucaagggaagaaaaacccuaaggagaccuugaggguaggaggccaagagagguggucuccuggacgcucagguggggaaaggaagaacagcgaaguguccaguguugcugagagcuccugcaaggaagacuggaaauguucgcuggguguggcagccagaaaggcagaggugacccaggaagacgggauuacaguuggcgagggcugaauaggugaggaaugagcagaagagcgggcaagucagaggaggaaacaaaaguggagguaaagaaauuucuugugcaucuugucuccaggcgaagggguauuacugagaguaaagauuucagagccugugggacagugaccagccugaaggaagugaggagagcccagauucccagugcagcugaguccuggcugaggagagcaggcgugccugucucucugaaaaagagaugcuggacgagaugucagugaagcuuugggguagcucagaggagggguuauugucggcugaacagcuagggaaggcugcucacagcugacuccugcuaugauggcuugcuuggguuuggauggaagcaagaaucggggcaggcaggugugacaagcaaucugaggacuuggcaagaguccagggcccuugcagguaacaaagaggguucagcuggcugagacugaggcaccugagagagaacagcaggacagaugaagccaguggaugcagccucguguggguggugguauggcugggguugcuggcauccagugauguauuuggcucaaaucccagcuccgagcaguuuaugugcugugacauuaaagaaguuacuuaccaugacuacaacuccucaucugugaaauggugauaaccccgauaggguuauugaaggaggaacagauaagauaaugugcacaaaaagcuuaguguacugccugccugcugguuaaauggaaacccaugggagguguguuuuaagggacaacagcugggucacaagaugugaagaggauagagcuaggaacggccugcacaggaccuugaacacagcagcuacggaccaccguuccgucucugcuaauguuguaacccucgaaauuacugauacuacuagagaaacuucagugucguguacaguuugucucugcguucucacggcaagcacuauagcagacagcugguuucugugcugcugugucuuccugcagcaagccaggggcucucucaccguuaaaauggcacuacccauaggcaccugacauacaagauguguuuucugucuucccuagguucucagagcuucuauccacauuuucuuucuuuuuuuuuauccuucuccaucccugcccccacacgccccacuuuuuuuuuuuuuuuuuuuuuuuuuuuugagccagaagcucccauagccaagacuggccuugaacuugcaauacuccagccucagaaaccaaaaggcugugguuacaagugugucaccacgcuagacucucuaacuguccuugcuguaauguuccggagcuaggcuggcucccagguccuaggacucccgggcauuaaacgagucaucucuuggguggcaggaacagaguuaaccagaaauuagccaaggagggaagagugcgcaggcgcaguaucaacgcgcuugcucaccugcgcuugggugggaggagcuaagcccggaggccggacccaaggcgggacgggcgcggugacgucacgggcgcgccaccgcagagugagucgcgucccggaagcgacggcgguggaggggcagacgguucccggguggaccugcgacuucggagcgucggugggagguggcguggcguggcgugggguggggcgggccuggccugagggaccgcuccggggcuugguggcccuucugucccccuggccguuccugucucuuccuuuccugggacagcguccggguaggugacgaccgugacgccccagccucacuguauuuauuuacggagccuggcccuccggcccucccaccgcgugugggucgccaccugcaggcacagcgaccuuaggcguguccugcccugcgcggccucagacaggcugguggucugggccucugucggcacugaccugcuaagccugucucgcgcuugcuuggguucccuuucucccuagcucguccugucgagaguuugggguccagucgaccccuuuccaagugaugaaugggagccaggguuaagagcgugauaagaguguuguuaggagaaauucaugaaccucugggagcccugguaagggucucccaguguacacuggcgcguucauaaagacuucccaggacaagauggucccccuuacccugacaccugaaggaggagcuaaagauaggagaaagaugucacaggacaucuuuucucuuggcauuaccuacugccuucuuucaacaaccugguuauuaaugguuuauaugcucuugaaaggucugugagggaaaggagcguuggaggggcucaugaagagugauaggcuuuauagcgaagacauccccuucacccugcuacuuccuacuucaguaggaauaaaauuucuugcagugugagauggguauucgcguucaccucucacaguuaaccuuaggaaccacacgaacuguaaugcaagggggaaauguguuguagucuggaagugcauc

SEQ ID NO: 9283 - RNA, 11919 nt, Mus musculus
ugggcuaccuucaggaggugugccggggacagcugccagagucggagcugaugcggaggaaguaccacagcauaaggcaggaagaccugcagagaguucgccuuucccgagugcaccuuucccgcccugaggcuguugcugaggugaagagcuuguaaguauugcagggaggccaggaaugucugggagcgagccagcgccacacuacagacuaccuaugccacaggcugcacucggccuaaucuccuuaccggcccugagcagagacgcuguuauuauccuccacuuacagaggaaggcagaggcuuagggagcugugacugagacuccagguucagcuacguccacagcuauguucuuucccccagagacaccaagaggggucuugcuuagguaccgccuuugcgcuucagcccuaccucuuccacuucugugcaguguuggagagcucaauuuuuuauuucucuggucccucaucugucagacauagugcuugguuuacucagaaagugcuugugacaauggcuugaguguggaguauccaggaauuguucagcguuaguuaucauuaccagacuaaauaugacguggcuggcacuuugaggaagcagugcuaagacugcuggggacgcuaagugugucaacaucaggggcagcgggcauuuccugagccuuuccuuggaucaggcuccguggaggcuuuugacaucuaauaguggugauaacagagcccugaguccugggagugagagagcuucaggugucuggggaucucacucccaccccauccacccagaaaaagaaacuucuuuuuucugagacaggguuucucuguguagcccuggcuguccuggaacuugcccuguugaccaggcuggccucgaacucacagaggucugucugccucugucuuccaacacccuuucuguuuacugcaaacauugagcauuuauuuccugagaucaaggacauugucuauguauucccagcagaacgcucagaauuagggcauuuauauugauguauuaguacuguugucugcuacauaguucauaaucacauuugccagcuguauugaugaaguuuuuauauugauuucccuugguccagaauccgaucuaggaucauguauuacauugaagguuuuuuccuucccuguagugcuaagauucaauccaagaccuugccugccaagcaccucagcccucauaaccuguguucuguucaucuggggugagcaguucuggggugagaccugacauacuugauacagcacaagcucacuguguuguuugccaucuuguuagacugaagggguacauuuugaacaggacuaaaaguggaguaucauaguccauaucagagccaaaugaggucaggaaacacuaacuuuggucacuugcuuaagguuuguuucccuuugguucguaguaaucuguggagagacugugagacuggaauaucuuguuccucguuagcauucacuuaggugcuguaaaaagccauuggugggucuucccacaucaguuucuuucuggcaugguugagguggcucucugcuuaccauuccauuugcauuuaucuucuggcauucugcagugaggaaaugugauucucauuuguuaucaguaugaaugcauagauucuuauuucacucaguggggucugaucuaucacaguccuuccuuccauuuuggaguguuguggguuggccccugggaccauuuugagcugguuuuguguucuuccaucauauuccagucauuuuucugugccaccuuacuguauggcacaacagaauauucacauucgucuuacacuaucccugcuaagcucuagaaguagcuguguuucugagccuuuugguaguaggagaguggugccucccaauuguaauauaauaauaauaauaauaauaauaauaauagcagggaccugagcugcuucacuucagcaggguucucccgaggcgguuggaauggguuggagcaucuuugccaggccaucuuaucccuuagcaguauuuacagauggugaccacugcuggcuggcuaugcuugugaacccagguucuacuuucuuguagcuucuguacuccuaaauuugugacuagguugguuuggagggagcagggacuccacucacagaagcuccugugucugcagcuugauccaacuggaagccuucuuggcccgccugugcuauaccugcgagucagccuaccguguacuucacugggagaaccccgugguguccucacagugaguaggccccuucuuuuccacccugccauccuguaguaauugagaguggaucccuccugucuccagugaagccaaugccuugaaaaggcuucugccccaccuacuucaggggaagaguaccccaugucccuagggugugggucugcacauaugcuuuugagcucuaaagguugcuuaggugccuuuuaaaaagauauacaguaacaguacuguaauaauauauauaauagguuguaguugcugcuaaucaaacuguggucuucugcaagagccaaaagugucccaggccaaugagccaccucucuagccuguauaugagauuucuuucucuugacuaauuacaucauaagugguugcaacaaugucuuuggaguauaauguggauugugaaugacugaaauuuaugaaaguguucuguuucauuacuagcccuacagugaacauuuuaauggacuuuaguuuuaauuuuuuuaaaauuucaggaauuaacuuaaaagauaagaauacugcauaaaugaaugagguuuuccuaugucaauaaugacuguaacuaggucuaucuaggcuuuacuuugugcccgugcucagaaguuccuguuauugucuuacucuuucuagugaccccgugaaguagcugcuguuuuaaccuucgcuguguagaugaaugaaguaaugcuugagaacuaaggcacuugccauagagacaagugccgguuucagguuucaggcccaagucugugucuagaccucagagcccagacccuggagccaguaugugggcucccacuugagacacaguguagcuucacuggucucacuugauggaagccagcgaugugguacuucugugugcuuucacagauguuccacacugguuugcuuggcaggucuugucaguuugugccagagcugugucucaccagggugcuccccaccauuucccuucugacugacguuggacuuuguguucacccagguucuauggcgcucuucugggcauggugugcaugcucuaccugcuacccuucugacugacguuggacuuuguguucacccagguucuauggcgcucuucugggcauggugugcaugcucuaccugcuaccgcucugcuggguccucgcccuguuaaauagcacacucuuccugggaaauggggacuucuuccgagguaagccccgagagccagagcccgacagcuggguggguccuggcccacucagaggaccuguuuagcuuuccugcuccugucuguuugcugugcuugccaccagggggcagcuucucacucggcugucucugggagggcugcugcuagaucucuggaagugugcugagguuggggggcugacaguccucuaagguggcugccuuuagaggggucaccuuucccuuuuaagacagauacaucacucuuauugauaugguaucuucuagaagauaaggaagggaucuuuucccuaaauugcuaccuacuccugcacuggagccagcuagauuagcugccacaucucagugugaccccugcgucugcucucugacuucuggaugcugggcagucuggggaggccugugcccggaugguugcuugcuuuguuuccucuuucuguccuuaguuuauggaccacucacugaauuggaucacuggccgacucuuuguagccguggggcaggugugauggagaacacuuccagaguaccacuuauugugucucugucuaggaaauucuuccuagguuuuuuuuuaagauuaaagguguggcgugcuccagcacaccacucacuguguccuaucaccuccagcccuguucuccauucccuuggcaguggugugugaguacagggccugccugcagcggaggaugaacccccggcaggaagagugugccugugagagcucagcacugcagggggccggagggaggggccugcuggacagcucgccugcccccacacccaccgaggugagugccuccccacuggcagggccuguugccugucugcgagggccuuucccucccucuuauucuuagcgauguguuuaugaggcacagcuucugggccagagcugagggccuucugccugccuugucucugggaugcgucgucauaugaagggcaaugggaacagcugccugagcuuuucugaacacuugcuccauguccagugccucuuuaggugcccuguggggugugccauaagaauggugcugagauaauucccuguggcaggacagaaggcuagacacagagugagugccagaggcuuuuagcuagaagguagggcuugguuguuggcuacuguagguccagcagugccuuguucuguggccuggccuguggaguuggaggguccuccuugauguaauuuucaucuuucuugcagcuaugcaguuuucauggggaugggaccuaggguuuuggagccuagccacuggcugucagcagguggcucucuacuauagggaccaggauugccaaucuuccuccauuuugccagagaaucuuucuuccuaggaccucacgccaggcaguguggaggaagcugaggaggcugagccagaugaggaguucaaagaugcaauugagguggguggcccucucccaguccucucuacugaccaggccagauauugggugggaugagaguugugugugugugucuguguuuuucuaacauccacaugggaggccagaacucacugagcuagaacucacugguugaaacaguaccucuggcuccuucuacccucaucuguccuggauguccaggcagggcuggcucugcugguuugcugcaagccacuguuggguguuggugauuugucaccugaguuggaggucaugaugucgguauguuugcggaaggcucggccuugugucuuggccuuucuguguacuaagguccauagaugucccuuugggagguuggggagagugguuacauggcuaagcacuaguucagggagaguucacaaucuugacuaagacagugauuuagacugguaguuugaagauguguuuuauuuggcuuguauacuuuuaaaaaagaauccuuugggccagugaauaaaacagggcaaauuuuaguuagaaauuuagauagaaaauauacacuugcaacuuuccuagugucucugagucugcagcagucacuauagcugagggccaugguuuccuguuagauagucacaugggcuagcaagauggcucagaggggagaagugcugguugcuaagccugcgacccgaguuugauucccacaaccuaccuuguagcaggagggaacugacucugcccuucauacauguccuguggcacacacaugcacacacacaauaagugaacguagugaacccuucauacauguccuguggcacacacaugcacacacacaauaagugaacguaggugacucaugcugcaguucucgaguuguccugcacuccugcccuccgcuuacugagccucugacuguugucccuguuccacugcugcuugucauuuaugucccccuggaaagugggagguuguuugcggagcaagagucuugugaauguaacuaggcccuggaugcacggcugacuuccuccucgaaggccugccucacccauuucaguugugagugcuguagacuuccucagguugauaaugguguaggcugagucuggagagagugcgaugcuaugguggggguuuucaagauuuuucuucaugacccaaguaaggaacacauuuuuaucuccagcccugguuuauccuuugcucuguaaucuguggagcuaagggagacuuagcccaaaaggcugcuguuagggcugcuucauuuuuuacccuguucuguugaacugugugaugaccugcaggaguagcaucggcuuccugagagcaugccuguugauguccccuugcgggacgugcucagagcucaucaggcacagcuguuccccugcccccuccugcuucucccuuccugcuaucucucuguuucuucuucuucccugcacccugggaggcaggagacccaccugguggugcugguaaguaggagcagggugaaagggacggggccgggcugggcaggcugagccccacugaguuagcugugccacacuugguggggcccaccaugcccagguaccuucgcaugcagggccugggauguuguaagugacgggcagaguggaauaggcuguucucauaggaggaugaagagggcaccccgugcccagcagaggaugagcugacccugcaggacaauggauuccucagcaagaaugaggugcugcgcagcaaggugucccggcuuacagagcggcuucgcaagcguuacccaaccaauaacuucgguauggccaaagaaaugguuuggagguggggguaugguguuagggcuggugggacucauggagugggggaacaucugggccacaggggcagaauccaagacuugugggcacugguaaagcucuccguggaaccuugggaaauaaauaugucucggaaauaugaguguggagugaguggucucuucaugucuaccucucauuauugaauaucaguugauaggaagacaaggugcucauaggcccgggcugcagagagcugugguccugaggcuguagagugacugcuaauuguagcucaacuaguguccuugggcaaaucaugccucaguuuuuacccuucugaaagaguaguggugguugaguuguggauuuuaugacgguauaugccaagucagcacagguccugccugccucuugguaccugggugcuguuuaugugggaggugcugguuggucuucuggaugccugagagcccauccuggucuuuguggucuggcuuucugcagugaagggcaccuucuucugggcaugguaguuuuuuuuuuuuuuuguuuuguuuuguuuuguuuuguuuuuuuuuuggcacuucuagccaaaguuguaguuugguaagcuagucuuuucuuaggguuguggguaggucaagaucuugaaggguguguuugacucugagcccagguugggacccuggcuuugauuuggagcccugagagcagagccagcuaaaguccuggugagagccuacaguggcugcuuacugagagucacuguggccuuuggauuguguguuucaguguuuagugaguucuaagucugugagucuguggagggaggggaaauccauggauuuaucuucaggaacuugaggggccucuguggcuugccuucuugccccuuacuagugugguuaucuuuucaggauuagauguccuaggccugcuguuugugucuguguuuguaucccuggguacacagaaucccuuuuaccuuuguugacuauuggcuuugguaggcacgcaggcucagguccucucauaagcucacucucauuucucugggggauggguagggcgagacaggcucugggcccaggagcaggugggguccagaugcaaagggacuacugcuguugguccagcaagugacaguuugucugugcaguguaaggagaggcggugagaagcuccuguuuugcagagggguaaccugaggucacccaagagcuucaucucucagggggagcugggcuucaacugcaggucaucggauuccacucuggguccuguuugccaccucaucuguccugugacuucucuuagcucugauguuuaggagugccuuguauagugucaguccugucuucagaccuggguuuugggucagauucuccccaccuggauaggcagaggccauacaggugucugaggguggccuuuuuugcucuucccugccucucccccuugcugcagugccuaugucccuuuguuaguagggccugaucucuaccuugagggcaagugugacaauucugcuuccaagauguuggccccuggguccagguucccagaucagccuuggguaggcugcucugagaucucucuuaguccuuccagacugcuaugagaaaauacaccaugcugcaugcuucauaaaugaagcaaaugcgauuucucaccauugcugaaacugaagucuaaguugugccagcacaacuggguccggguaauagauggcacccuuuugcuggcuccuccgggagacaugacaaagugcuguccagggccuccauuauaagagcaguguucucaugagugcucugccagucacucacuaaaggccccacuuuguaauaccauugccuagggauuaggacucaauauaugaacuuuaggggaccuuccauucuggcugucaguagaugacgugggucuuugggagggaugagaugaaggcuuccucuggagccuccacgugagucuugguggagcugccaaggguccaggcaccccuguccuagagaugacugcccugauggcuccugcccugcccuucucucuucacaguagggucacuaggugagucgaggugggugauguggcugagaaugggcagaguggcuaggcuugggaggagcaggacuguucucugucacugugugaccuggugucagcucucaaccuagaugugcauggggacugugcaguccuggcucuccaucuacuucugaggagcucuuggaccugggcucuuuguccuguccagguucugucaccuugcugaauaggcugccuuccucuguucuugguagaggagccauagucagugagcacguuuucuuaucccgcuagcauccuggaguuuguguucucucuguccuuuacauggcugugagagguccaacagcagagauguuugccucagauaccucagccuugcuccccuggcuccauagucuauuguccuugaucccagggagcgucuuuuagcaagagcugugggcaauccuggcugacuaggaaggaacuuugggacuguuacgggcaaacauguuacccaggagucacaguuguucuuucugcugcugccugcaaggucauagcaggccccagaacccaucucucaucucuccuccauccgccccaacugccagucgucacccgagcggcucuggcacagucugaagcuccucugucccccuguacuuguggcuuuggaaggcuuguguugcugcuugccaccagugcuugagacccugcccuucaugucauguuggaaggugcccuguuucaagcuuucucuugggaucuucugaugacagaaaggaguuuguguuucuuggaggcguaucugucccucacuguggacagauguuuggaaggagacauuaugaaaaggucacaucuaguaggcuucauugaggaugcugggguucagguccauguuggcuuggcuagauuucaggggggagauucucugguuguucuuugauaaucugccaagcuugugaguguguguggcacuugguguugggagcgugcaaggacucaagcuguguguagcuuggugaaagcugcucugaggagcuggcaccuuuacuuauuuuaaauacacauauugcucucugcacccagcuaagaugcugggcugugccuggcuggguccugaguggcccaguuagagucaggaacaauuuggguugagcggccuggguuggaucguagcucagcugcugccuuugucucucagggaauugugcaggcugugccgcuacguucuccgugcugaagaagagggugagucugcugcuguuugccggggcagugugcugugacuggggcugaugcacgacuugaggagagucagcaauggagucuaagcccucauucgagucauaggaccagugcccucuguuugcuaaggcccacacccuuaucagccuucuguuggcuguuuuguccugucucaucccacccacugaggccccucuucuguuguauaaaauuggagggagcacuggggugucaggugccugagggugggcuccaucugacacuguuguucccgucuacagcggagcugcagcaacugugggaacagcuucugcucgcgguguugcuccuucaaggugcccagguccucuaugggagccacaggugagcgaggaggccagagaggcggccugugggaaggacugaggcugcccugcauagagcaagacagcucccgagacuccucuuuccucccagaggagaccaccugguugaaucuuauuucauuaccccagguccacuuuuaacagaaucaaaggaauuucucuuccuuuccuaaaugcuguguauguuuguuguaaaugaaaccuguagaugagcaaaaggaaguccuccccugccccuguguuccugacaggcagaagggagcauggaugugcacauguaggaagcaugagcgugcacauacaggagcguggauguguauuugugcucuugacaacugcggugauaucuuacuuccugcccugugaugugcugcaguguggggcaaggcuuuuugccaaucuuacaaguagcacaugcuuguuaacuauaaaguuuugagguuauuauaaagaagaaaggaagagaaaaaugauccuguaaucuuaccacccagagauuuuuuaaccacuguuaaaacguuuagggaaaauuuccucugguauuuuauuuuguugaugccagaagaauuuccaaugcauagaacaccugggagaggccugcuguuggcgucagagccacagugccccagcgugucugagggagggagcugggucagggagggugugggccgggccguggguggucugucucaggacuggggaggcuaauucaguacuuggcaccuugagccuaaaggguacaaagaacugucucacugaguuuuucuuucuuuccagcuccugaagcccagagagagacugugugugugugcgccuccugcaaucagacccugagcaaaugagaagagaagccaggcuccaacuguccuggggccagcagugacccuacugucccaacucugggccucugaggccugugcugggcaaacguagccugacagcuagguccuuccugcccuuccccugcugccuccagcugggcuggugaugcucuaaggcccagggggagaggagccccuggggucccggcucuugguucugcucuauccuauacccuguuaacucagggcuagcgagggaguguccaccagagggcagaauugagcacagccugcucucaucugggcucuggucgucaaggucaggcuggcuagaccuuaggauccaagagacuugagguuggaaaagagguucuucccuguuggguacuugucagucucucagccccagagagccugcgaggggacuuagagcuccauggccugccuuugccuuuugaauagccucaggacuggcguucccaggugucccaaggagagggaaggugagggugcugcucaaguccuucagugucaaguggauggcaggauggggaagcucugcuuacagaaucuuaacucccaugguucucugguguccucagcccugcugggguggcuacaggacccucacaucacucuuccauccugcucugagucuagggcaccccaccuuucucccacugccacauaucucuagcccuuaucucauggaacaugcggccaggugaguggagcagagagacugcaagccuuugagguccagggacguguaggacugcccggauuucagggcuguuccuggaguagagauagcauuguaggauagggu

SEQ ID NO: 9284 - RNA, 4606 nt, Mus musculus
auuaauugguccaaagcaacuguuguuuuauuuaauuaaaaacuuuuuaaaaaaauuaaggaccaaaccuguugucuagaaucagcggccccacagcaguagcaauaauuuaucgucguugggauacagggauugaggaggcagagcaagagccagggagcaaggcuguguggcagugaacgcagaagcagcugagccugcacuccaguccaucguggcuccagaugaggagugggcguggcuggaagacguggaggccuuggaucuugcucuuuggaggacugugaugacacacaaaggggcaugggggaggaaagcuauucccuaaguacggaucccgcuuagcgaugagacccacaauccuuucuggaaagccccuccccaggcugcaggaggcccuguauccuguauccguaguccuucacauuuuccuccucugccuguuuuuuuucagacacuagggcuucccccagaagagaaaguccuucuacugggagagggggcguccccgggcagaccccaggaucccagaacccuucagucaaagaggguagccccaugccucugcuuuggagccugugcaguaggugcgugaagccauccuuggggggggggggugaugggucagccugggagugaaggugaggccaagugggcguggacagaggcgaggcaaggcacagcuggcugguuggggcaaggagcagggggcccuucagugggguucagcugccccauagaaaaaaggguaguagagggaacagggauaggagaacaugaauuugacugcaaacuucaucuccuuauucuucuugucccagcgguagacggccgugagcagcagcugucccucuacuuugcggcccaugaccaggaagcugcccgucagguugucuaacugugggcaagggcagcuugccccguucuucauaugcaggaccagcuucuugguguccuugcgcuuuaaggggccugccuugagcagcuucuucuucuucugggcuccaaucaacuuucgguccccguugucuaucuugaucuccuuaaugcgcaucuugaccacuguggcaaggugggcaaaggauggucagaagagggucacauuugcuuaugacagcgggagcccuagugugaccagagaccuagggacaggaauccuagggagaggacccucuggcuagcuccacccuucuuccacagcuagccuccccaacucaagaagccagaaaagaacuuugcacacccagggaagggaauuguucuagaaacaucuucucuccccuuugccccaccuuuugcacuauagugacauuuucuuuccuaagaggcucccaacauaaagauuccuccaaagcaaagguuucgucauugcuccuuucccuauuuuuauagacagggaggcuaggacacaaaacagaaccaacuuugcaaaggucacaugcagaacuccguggcccacagugaucuugguccuaacuggcuugguucaacugucccaggauagaagaguccaagaugaagccguggggaaagcuagucauaacccaucccagccagaggaacacuagggacucaguagagauaccagggauaggggacauuacuucuauugccaacucccgugcccuaggagggccccauccaucuuuuagcaagcuaagcuugcuccccccccuaaaaaagauagcccagccauggaagcaucucuaugggaagugacaaaacacagcugcaguagcgguagucagguggggcugguucugagccaggcugcugcgggaacugucaggauccugugauuccacacucaccaaagucacuggagcacaucuguuccaugaggccaucagcgcugugcuccaucucacacugggcacagaucuuggucacugaagagagaaagcaaaguggguguggucuuaaacagcaggacaguacaggcuccucccuuagccccccuccucacagaagcugcucuaauuacuaaagaggaggauggcaaugacaauucaagagcucauauagugcagggacaguauggugagguagauucucuucugcagccacgacauacauuacagucuaaguuuuauuccaucuagugcuugcugugaaacgggcacugccuuuucuacuuaucagcagaggaaaaccagguguaaugugguagccuagucagcagagcuuagggcucaggacuguggccccugcucuaugaccaggguggauauuauuugcaggggucaggcacaagccagcauuaacuuucucgaagaaaguccaaacgacucauuuuuaugugaaacauucuaaugucaucuguuggccacucacacuuuucuacaaccugccuuuggguucucuugugugcuggccuccaggugacaagccucgcugugagaaggggagucauggguagcaagguagggccaggacaggguucugagccugaguuuguccugcuguucauguuugggcuccaaagaaacuauaaaaggaaccuggaggauucugggaaccguggauuucuugcuuagcugacucuauuccugccugccacucucagccuucaagauagagacuuuucccucccagaaucccccagagagggagaaggagaaggugggaggcuccuaagaccaagcugauuaauuugagagggguuagggcgauacaaagaggagcucagaugcuuugggaggagugguggggcggggggggggggagauuugaauguuccagcugugggggcucacgggagcgcucacuaucccaguuaacaggcaaagguugccugcugggagcuauggguguguauguggggggcgggggagaugcuaggggcucaggccaguuuggaagaggacaggcauucuuggagaaaggaggaggggguguggcccccagauaugggacagcuuugaggaccugcacaaugaaaaggaagaugaaucagaaaucaggucuaauggcaguauaacgagccagugggaagcagggcuugggagcucaagaugcuggacuucacugcugggcaaagaagguucagaaaaguaaaguacccaaaagccuaggaauugggaggaggggaaguuaggguuacaggccuugaaacgagggcccucagggcuucccuaaccacccgccucuucucaaaguucccgaggucagggaaggaguagcgcuugucugggugucggcaguucaggucaaagaaacugccuagcgaccccaagcauccuugagaugaggaaaggaauacggcauuuaugagggacgucuccaaggcuuccagggauuccgcagcucggaaaaccgagcgugcugugaguugcacaagguacaggucagaguugggagagaacuagugggaauacccagagcuucaaguuuauaaagguuggaaggaaaaaggagacagugccagggcgcuguguauaggggcuuggcaccuaucggggaguacagaugaggguuuggggagaggaucaguccgaggcgcucugggcgcaaaggcgcuaccuggaggcgcgguggcaggcaggugcccgaacugcaccgcgaugcagaggucguuguccagggggaacuuguggcagugcagcaucucgggccaagggaaaccguaggccuccaugagcggagcgcagccggcgcgcacggcuucgcacagcgagcggcagggguagaugggucgguccaggcagacgggagcgaagagcgagcagaggaagaccugggugucugaguggcagcgcuuggccagcaguggcagccagcugcuugccugcugcuucaccucggccaggcucucgugcuccagcagguugggcagccgcaugcgcuuguagcccaccgugugacagagcggcagaucggcggggaugucgaggcacugcgguggcuuggaguaggagcggccgugcagcggcucggccugccaaccguaguagucguacuccuggccgcguguuggcgccccaugcagcgccccgagcagcaacgccagugcggccguccgugcgcuccaggccacccacauggcuggauguugcggccugccccgacggcucggugcucggcgccccgcugcccggcgugcgccccggcugggauguucccugaagccggcugcuacuagggucguccaaguagguggcagucucugcuccgcuccgcugccggagugauccaggcgccucccaccacggggcuccagcccaggcuucgccguucccuagccaaucugcagccgcuggucccccucaccucccacccccgccccggguuggcggaccugggaggaacccugagucuuucccgcccggcucgggucccucgggucccgccucgccucgcgacccugacccgucaacuauucugcugcccagaccucuccuugugccuuuuccugggggcucagcauuuuuuucacccuugcccccugcuucgucuuuuuaucucucuccaccacagucucucuccuguuccuuuucucacucacuucaccugcuuaucucugugccucggccuuucccugcucggcucugguuucccuucuccaacaccuccaucgcucuucucagauaauggagucucuuggcca

SEQ ID NO: 9285 - RNA, 8731 nt, Mus musculus
uacauaauuaauuuauaauaaaacacacacacaaugguuuaauuucuccaagugaaugauguacuagccgccagaccucgcuggaacacaucccuugacugacugccucuuagucuggaagcaaugaccaacaguccuugggaggaaucuugucuuggagaaccugccaggccaccucugggguaugccucacaggagagcaacccccacuaccuuuguuguugcucuggacccagugaccugugggugaaggaagguuucaccccccaccucugcauugaaaucuguuauuugcuucauucuuucagaguauauaggacauccuuccuuccaucuuccauuccuucauuccuuccuuccucccucccuuccuuccucaaauacaucuugacugcuccuugcauaacauauucuuagccuggugcauaucaaguaagcaaaccagacaaauauccauggcaaaguggaucuuguacuuuagcagagggugacagccaguaacuaagugugaggugcaguaaaucccaucgcaaguggugcaaugaugggugcuacagaagaggggggaaagaccagggacaguggcccaccgggauggaggcagguuguagauuuacgauagcagagaugggacacuuacaaagcagugguucuaugauggcugagacaggggagaaugccgacauggccucccgggacuggauuuauuugcccagcucugggaccuuucaguaaagccuguaacuuuugcuuucagauggucaggauggcuuugcuccugcugccgccccuguggcuucugccucucacugggggaucccagagggcugagcccauguucacugcagucaccaacucaguccugcccccugacuaugacagcaaccccacccagcucaacuauggaguggcagugacagauguggaccaugauggggacuucgagaucguuguggcgggguaagugccucccacccugagucugacagacguauuaaucagccuuugcagcgauacgguugugugacaguaacuccaaaccacaacgcaguggccaaugcuuguucucgcuugggucugcagucuucuguggccagcaccagcccagcuggcagagcugcgguuuugggaugccguggcuuugcccucugcaaaguaggggcacugagcaaacggcagcuuagaggaaagcuaucugcaggcuucucaaggcugccucuugccacacgucagcucccuuggccgugcagguaucacuuccuucccagggagguucuacacgggcaggacauaaaaguguuaguccguagaagggguugcugcgugcucacugauucccacgguacuuuacauaaggcuaagaaaacguuaauuacccauuucaaagaagagcgaagauggaaaucaagagggauaguugagccucuccuggcuaggcauauagccugcugcuccuccuccaaaaaagaauacuauugcguagcuggaaaagcagagacucggaguucauauggcuugagauggugcccuggugugcaccuucccaguugcgugaccuugagauccacauacauccucuggaaggaagagaucacugcaacaccuuguccugaagccucacuuggcuauugcacaugauagcacauugugaguucugccagucaccauggauaguuguuacuuauugagcacuacugugugccaggcucuaucaucauauuucacaugcaucaccuucuucaucccucugacaucccagcaccccauuuagagauggagacaaaacucaaaagcgggguggggcaggguggugguggugguaaggaauguagcuuaguugguaaacugcuuguccaacauucaugaagcucuggauucaguccccagcgccacauguguugugguacacuccugggauuccagcacuuggagguggagcacugugagacugccucggaaaaccaaacaaaagacagcaaugggcuuucauaaauacacaguaaauggaugggucaggagucgaaccucagggcauccuagagucaccacauuuacuacacagagucucgacacuucaaaaaccagugauaagaacaaagcaggggccaugugccuaguucuaggagccugcuauuuuugguaauguagaacaaaauaucuaacgggugacauuauuuguagcagucauaugcaacaauaaaagcaucagccuuagaaaugaaagaauugguuuuaagcaucuugugaaagggucucaucuaucccaaguuagucuugaacuugcuauauagcugaggauagcuuuuuaauuccucuuaucuccacaucccaagugcugggauuacaggcaugugucacaacucacagugaagaacugguuuuaaguuuaacaauauuuaacccaacaguugccaaccuuugugcuccagcuuuauuuuccucaucuguaaaaugggugcauugaacuaacuggaucugcccuaucuacccaccucccagagcugaacacaggguccauggugaugcuacauaaaaaagauauuuuuaaaaggaauuuucucuauuuauuuaauuauuuuauucuacccugagaagaugagagccacucagugcuagaccuuccagaagcuagguaguauuuucccugugugguguucauuaggcaugugugacaauuaagauuuuaaguauggcugauauagucaaggaauugaauuccuucuucccuacauuuuucuggacacagcuuuuuuuuuuuuucuuuuuugcuauguacucuggcuggccugaagcgugugauaccuuggcccuggcuuuucagacaugccucaccaugcccagcucaaggaacugaauuucuaauucuaaucaaagagccacaucucaagcuagcaguucaguucugcuuaaagagcagaaaaugauaaaacagugcagauacaggugguagcacggauccguuucucccgcggugagcggggcggcucaccuguguucagccuguaaugcucaguugucccuggaagcagggagaaguagagccaugcccagcaccacaugucgccagcccuccaucuccgagauguuguaauuggcccugucuccugauaggugacaccagucuucccagaugaacccugggggcuugaggacagaggaaaugggagaguaagccuucccucuuccuuuccauccccaccccuaagcaucagggauagacuuuccguucacccaagacucugacucgagcucauuuccucacaaguuacuauggaaaaaccuaagguuugugaguccuuucacccuucuuuccucucacgggacaccuggcaggugcugucaggaccccucccucucccccauggauaaucucucugccuccauagggagguugucucugaccucuguaucuucugcucccauuccacgucugcucuauccucuggccugccucguauugccucugcauggucacuucaggagaccuugguugcugcccuguggucacucauacuuuccccugagguccccacaggggugaaaaggccuugaagaacaaagcaugcuccuguggaggaagaugcaaaggccucucuggucuuucauucucucucuuugaugcccucuccgaggcaugcugacacaguaguaccaggcuguaucacccuccucgugauucaucacccagcugcaaaaccagcagguuacagaaaaucucaaucucucucucugucucccucccagcauacacacacacacacacacacacacacacacacacacacacacacacacacaaccuccccuaaggcacacacacacacacauacacccuucauacacacacacacacacacacacacacacacacacacacacacacacccucccuuaaggcuuguccugaccuguuugaaaagaaaagaaaaacaaguuuggugucagggagggucucagggucucuuugucuuuaccaggucaaaaggcgcuugugacccacagacccauuguucaggcugguuccccaagccccagauuaaacuuggcuucugugugucuccaucucacacauccuuuggagugcagggaguugccccuguucuuccugagcaauggcugugcacuucacccuguucccccaagaccucaucucuugagcucaagaauguuuguguccucuauaguugagaaacuagacugucauucauagucauuguagagugggugacuauaccauguccagcuugccaccggccuggguccguaaaugauuggacuuaccuuugcaaacaaggccuagaucauacauggucuugacccguuucucuccaggcggcugcugaaguagcugcagcugcuaugugucauucugcacgacgcaucuguugcucgcucgaaggaagaagaguuaugggaggaacugggaugagcgaacauggagaaaucgggcagccucccagcuccaggucaggguuucucaguggcuguugcaaggcauugugaauucuuggagcaucagaaaggcacgguccaauuuaaguaccaacguacauuccaaaggcaaacacaacuuuuauuaucuucagccuaggaagauuugucacugucuucuacuuugggccggauaaccaagagcugacuauacagacguauuuaaaucaggaccuugagaggucaucugguccaccuccucuugccucuggacaaggccaguccuguauuguguggaugugcugcgcacugagcaccaucugaaguacuguggugaucauuccgcaauacagcucaguuacucaggucaaaacucauuugacuaaucuaaaccccucuugugggagcuuaauaggccauuuccuuuagcuuuuguuuccuggcugccuugaagauguaaagccaccguuguuuuacauaaagacagccaggaucccugccccgccucucauccuaccaacuccuuggcagcaucucugauuuagaccucuuacucuuucaucugcccuguauccauauuaaauucugcuuuuuucucugucugauuauaggcugucugagaggcaugucucaggaguugauuuuuuaaaaauugaauaggaaugucuuuaccuguagcaucaguguccugguaggggcaggcccacccauuauccuacagaucuuucuauuagcccaccccagagugguuuuacuuuugcaaccccugggauaacagccagcucuuugguuuauaaggcaucuaguacuugaagucgcuuuggauuuguugaccuuguggugugucugaccgggagcccuguuaccgggaguauuuacucuuugaauagguuuguuuugcuuugcuuuuucaguauccucggucuggcuaucgacagcauugauuuugcacauguugcgggugggucuguguuguguuucggauucuggaguuaauugugauggaaggcgugugcgugcuucugacucugggaggagcagaaaaugaccgcccuuuguucugcggggaugggggagggaaggggaggcucaccgcuccuccgccacagcugggcgagugccugcgcauauggagggcuuaucugcuaacccgcaggugcgugauugaggucugcgguuugcugccucccugcagggagaggggaggacuugaucgcccccagagaaggcugugcacgcacagaccauugagggucuucaggacuguucccugggcaaauggaaagcccgguggcuuccccuuuucucaguggaacuaaacacccaaucuccagucucauagagucugaagagggauuccuguuggugccaaucuggcgcaauccuuuacagcugcggucuaagggcuauccccguaggucugagauaaccccucugcccucuuuguuuccagcaggaguuggcuccaguggagaaacuguagugguuguaaaguuuaaaccacgauuuagaucaguuuuucuacacaaagagcauucauuugguaaaaccuuagcaggcucuucacacucuggagggcuuccuuuaaaggauguugcagguuguagagcaguguuuuggguuuugggguuuuuuucccucucucucucucaauuuugcaacuaugucaggaaacuuuuuuaauuuacugaagcuaauugaauuauuuaaaaggcaacccaaauucaauuaccugauuaaucaugaucacguaggagauaccauuaaaaauaauaagagcaaugaagaagaauaggauauuuauguaugauuuaacuaaaucagcacuuacugugguauuauaaccguaggcagauaugugugguuguggugcaugcauaugcaugcuauggggagacaggugccauaaauaauagguuccgugugaguauggaugcauuagauuuauguucuauguuaagaugugucuaaauguauacagauguacacauucuuuaaacacaacaggaauaaauaugguugaacuuucaguccuguuguguugcuguuguuguuguuguuguuguugugcuguuguugcuuugauaauacuauacuagggcugggggauagcccaguuggugaagcaugaggcucugagccugauccccagaacucaggcaaagagugcuggcauggcagacaugcuugucugcccagagcugggaagacagagacaggcagguccuuugggcucucugaccgggcucucugaccgaccagccuagccuacuuuuugaguuccgggccauugagagacuccgucucaaccacaggcuacccggugucugaggaguagugcuggagauuguuuugauguccacacgcaugcucacauguguacauguacauguccauacacauguggaccuccacgcccaugagcacuaguauacacacaagaguggcacuaauacuuuaauagauucggucgacuguuuugauauuaucuuaaacugucgcauugguuucucuguaugugugugagaguggcauaccaguuuguaugugugcauguguguucaggugugcucauacaugucugacugagcaugcacgggucagagggucaauaugaagugucuucuucguuugcucuccaccauguucacuccguuuugaggaagggccucucacugaacccggaacucacugguuuggugaggcugucuggucaauaaacuccaaggaucuaccuauucccugccccuaccucaaaaacugguacuacagaccucauugcuguggguucugaaaauucuaacccggaugcccaaguauguggcaaguacuuuaucaguggagcuacuugcccaggcccaguuucauuuucugcugcuaaggauguuucucauuuaauuacacuuaaauauguuucacugggggaaaaaagucagacaauauaaauaaagguaaaaaauccaccuuucccaaccucugcucacuuccacaagcucgccguagucacucucagaguaacaauuguuuccagucugguguuuguauccugauaguaaucaauguguuauagauagguagaugauagauagauagauugguugacagacagaugauagauagauagauagauagauagauagauagaugaugggugaaucaauaauagauagaugauagauauucuauauuauauaaacguucuauauauaucaaaacacacaauuugggggcuugauuucggcaguguaacauguaucucuuuaaaagaaguuguuuguuugguacagacauaccauacacauuuccuuauuuuccgaguggccuugacauuguuucucaucuccacccauugcagguguugacauacuacauguuauccucacagacacacgccaacuuuucucuaggaugccccccccccaagaaguggagaugcuggcuuaaggaaauggauaccuuaaguuuuaaugguucucacuaaauugcuucucguuucgaucuuuuucuauuuauucauaggccguaagcaaaaagcgagcuuggggauuauuuaguucaacagccgucugagccccuacuccauguauagccacccacguuccaggaucugaacuuuaccaauuuagauuuaacaguuccaaggaagaaaagggcuauucuccuucagcagagccggcugcugcugcuguuaaaacccagguagagggacuucaauacuuucuaauucaaacagcaaaaaggacuuccucuaaaggcuucucuguuaaaaaggaaaaaaaaauguauuucuuaaaugggucaccuuuaacccugcgacuuauugucaucgguaucauggaagaaugaccaagaugcugaaucuucagcugugguacagcaugcucagcccugacgccgaauacuguaagauccuguuggagccagggccaggccuuucuaucccauucuuaaacuucccuaagaagagcucucagcaguguguggcaggcuuuccagaaauaucuccuugcugcaugcaugccuccugcucugcagcuccgggcagccgcaaacaagggcaggggacagacgcugcuaaccagcucaaaagacccaggccucuauguccuccugguccccagucacacacacagaaagggggaacaacacucacccaaagaggccugugcccugguccccagaaaccacgaauguuuucucccauggcagaaggcacuuugcagaucugaacguguuaauaccuuuugauggggaggucacucccacacaauuaaacuggaaaacaggagguagaagagug

SEQ ID NO: 9286 - RNA, 1124 nt, Mus musculus
gggacgucggcgcgagugcggccccagggaaacgccgcauuuccaaucuuccggauaaagcccgcacagccaaugcaaaugcgccccgccacggcuucuuccccgaaaagcugccuuccagaauuuuucugcagcaggcaaauauuuagcgcgaacaagcugacauuuuuuaaaggaggaggaggaagaaaaaacucggaggagucgcgcagcuggagcaaagcaaugcaaguggggcgugcauuuaggaaaagcccuguugcaccccacauuuggaugaauucagagaagcguucugcugcacagaaaagcuuucaaggaugaaacccgguagugcagcgcuguucccgcccucccaacaacuguaccuucuggaaccccaaaacggccuccgcauugguggcgacgaccuccgagucuuuggcuaagcuacccugaccuggauggagcgcucggcgcagcgccuacagcuaccugcugcguccgcagaccugaggcugagcgcuaaggggcgggugcacccggaaaagcaaaacucuaagggugaaaaaugcucaauaacgaugugagucggaucuggaaugggauggagagcacucuagacucuuuggaggagcccaaacuaaggguccaacuugaagggaauuuucagaaacuuaacacuuggauauucaauauugcagagguuuauccucccuuucuuuuucuucuguguguuuucuuuuuauuuccaacgccccccucuuugcaaccgccccugaugggaaggggaucgcgguugcuuaacugccugaauaguaacaacccgggaagagggugaacccaacuagacugucagcgagacucaaccuucagguuuguuaauccaccacugcuuugggguucaaaacucccaacgcuuccccugagaguuccuaggaccuuuauggaucgcguaugaugcacacuacgacccgagcaacgauuuuuuuuccccacuguaaaaaauuaaacuaugcaguuaccaaggaaaacuaaagaggaggguggagggggaagggcuucaucuauaaaaagugucuuacaaagucaaggcugauaaugacagcggaggauacaaaauaaaaaauuuuaacuccaaucca

SEQ ID NO: 9287 - RNA, 12317 nt, Mus musculus
uaguccaccgggcgguugcgcugguagagguaguguucuggggcuuucuuguuccucucaucaaacuuaagcuccuggaucacguugggauguuucagaagccggagcaggaucuucuccgaaagguacagggacuuaaagggcuccacuucuggaaggcaacaggggguggggguggacagcugcacugcugccccucccccauuccaacugcaaaagcuggcaggaggcgagugcagcaucugggguuucaucuagaacaagacccuuaaguaggccggggugggguggggguucugcaaaucaaucccucagaugaagaauguuaauccccagugugcauccaggggccuucucugugccuucuggggcugacuauugcuucaugauaucucgggagaaacaggucagcguuugggaaaggucaguuuuguuaugacuuuugucccugauuuuauuuagaguuggacccuggacaacucuagacacaaagaauugagucuggcuuaucuggauagcauucaccugcuggcugacaugaaaucccaaguuaauagaaagguaaugacuuaagugauaaguugccaauaauguaaaauaucauuuaucauacucaacuauuaauaggcauuauauagugaugcuugcagaauuauacuaagcagaugaagcugcuuugcccugggcaauugauccaugauuaaaaaaaaauuacauucagacaagauuacauguugaaaauucuuacuguaaggaggcuccacuuuauuguuacccaccuuuuaguaccuggccagcucuggcuagcacucuacuauauccucaaagaguacguauuguauuagcuaaaaauggaacuuagucauggacuaaccauucuaggugaacauguuaauuagggcugagugaugucagagaguucaaaggcaaauccuugccucuucauacaaaggaguuccuguaccuguuuuucuuucuaagggcaccaggauucccacuccagacuccuaguggggagcaggacacaugggcuuguugcuugguaggauaaugcuuuucccucugggacaaaggucuggggcaccccaauccgaguaggauggaguagguuggcuuuaggcuccugcuaggaagugagcagaggaaauggaaguuaugcauuuucugguaaaagaguacucacuuccucuccaucaacacagcagggagccugaagcuaccucaacccaacaggaggcagccuucuuccucaaacccuggcucucagugccaguggcacacuggauggggauggagaauaguaagagauguggugccuggugccaugcuagauucuacuagaaguguugagguagggcgugggcagggcagguccuaccuguggccaugaagcgguguguggcaagcagcagcuguggcgagaucuugacucugaucucggagucugaaagcuugaacagagagaaaucaugccgccuucucucccggugugggacccucugcuuuuuccgauugucagcuauaggacacaggggaaauacgacagucagaaucauuguuggucuuuggaugcuuacacagauucuucgggaccacacacuucugcggugccaacuguaggaggcuaggccaacucccucccaguaggagccagcaggcagcagaugguucaguguuguuugugcuuaggugguagaugaagggguggggaaagauggcaggggguugggggggggagggugggagagggagggagguucccaugcccagaguucuaaggcugguucucuuacccgagagcugugcaaacucuccaugcauuggaguuuuugauugcuuuaauccauacaagacauuuaauaccuucucuaucugugcaguuauugcaagacucuaauguacuugacaguguuuauacaaugucauauagacauaagcugcugguauucuuggcaugaaagggguugggguuucucccucuguccucuuccauucccuagagcagggcucaccuagucucuuuccuguggguuuaagccacacuaggugugguagcuaagccaugucacucucuucccgcucacaauucuccugcuucccucgggacccucuggagagaggaucaugggaaauacaaggaaaacaaaaggagaaggagucaacgugcauauagaauuuuuccaaaagcggauucuucagaugaggacuaagccgagucuggaacuucagagccuguacacugggccugagucuacgcaccgagaggcguacuuucuccuaauuaguuuuuuuuuuacuugcuuuuuuaaaaggaaaagucuuuuuuuuuuuuuuuccgagacaguguuucucuuaaaaggaaaagucuagggaccuggagagauggcucagcaguuaaaagcacugacuguucuuccagagguccugaguucaauccucagcagccacauggaggcucacaaccaccucccuauaauuagcauccgaugcugucuucugguguggcuaaagacagugacaggugacaguguacucacauguauaaaauaaaucuuuaaaaagagggaaaagucuacauguguauacacauguauagauucacauuuauguauauuauauauguauacauauacauacaauuuuuuuaaguggaggaagcgauuauuuugaacacuucucuguugcuuagagaaaaaaagacauggaagugcuaaccuaccucaucugcgcugggggaaggggagagagaugugucucuguucucuucaaacuuggccuggaaaacagcagggccccagggcuugugguacaguggaccagauacacuagagaccaaagggauguguccucgcagcaggaaaucaggaccucagauuccagccccccccaaccccccuucuuuuggaacuugcuucucucaggccuuaggacuggcucccaucuacacagcucuaguggaccugccuuugccucugggcccuuauuugcacuucaaccuuccuuuugcucuguuugagaaggugggaugauuccgccccagggguccagaguguauauaaugagucacagucacauccuuuuccagcuuuguguggcccuuagggaaucuguguggggcgcgcuggcccucuccuccaggaagaggcucaugcagaaagugagcgucaaagaggcuuagaacccauuuucucugcugucacuagugaguggccuccgaguuauaugacauauucacuuaugugucuaccagcaugccauuaaccuuuccucguagagacaucccuauaaucucucccuuuaguacucugauuuuaauaguggguacuugaagcauucggguuuuuaaaaacacuaccccaggaagagacuacuaauuuagucuucuaccaacgacuaacauuucaguauggucuccgucaauuguauuuaaggauucuggaaguucuagaccaaggguggugggcagagaagggagccuggaaugggagagguccuuucugagcgccaaccuuguuugaaaaugcucaguacugcauucccagguccccgaaggaaggugcggugacacucagcuugcuuucgguaagggcuuggcccguguuuuagauuugaucucuucuuggcccacggguaucccugccauaugguaucacagccuuuugcugcgaggaaacaguuucuggaagauugcucuggcaaaccgaggcugcucaucucaaauaaaugaguuaucccugggcagggaauggaguggauagccuaggagaugaaacucuggggaggaaacauuuccuggccagagacucccauggacuuagauaacauugcaauuucacagacaaaguaagcccuuguguugcuggcagacaaagcguugauaaggcccauaggccugaagcugucacucacuacaaagaggaggccauauuguuccugagcggugcagggagaggaagagaccagaggcagaagcagcaacaggagccacacagggaccugauccagggggcaggaggcaugagagccaagaacagcauccaacaggggcauuuaaccguuuggcuuuagcgaagggugaugcuaugacggugcucguucauuggucacuggugguccggugugaggagcuccaagggagcugggcucugccucuagguagacaaggagccaccaugggaacaaugcagagggcagaaacaagagcagagagcccccugggccuccucuugggcacacugucuuucucuuagccauuuuuuccauuugaaggcgaagcuaucuuuccccaguuuuaacgguguucuggaaaguucccuucugauaauaccuuaccagcaugauucaggauaacgugggccagggugcccugccaugcuagcacugccuggccgugggugacacaccggugcacagacuugccuugacaaccuuucccauuguucaucaaaccgaugcguuccugggggucucgggaguaggaaggacccacacuuacuguagaggucaguuucgucgaggaucuccgacuugaugaucucuucuaugauguccuccagagucacaaugcccaucaccucauagaaagggucuccuucacccucguuguucacucucuggacaauggccaagugagauuuuccuggagaacaaaugaaaccauagucaaacauaugggaucauuuucagagaugauuucuguuugugagaaaacaauacagaguuucuguuugacuaaauucaggacugaacucaccccaggaccaucugaaaauaggaaauuggugugugcaaguucuuaccaaugggagccugauacucagaagaaauacagauguguguugcucagugauagaggcagguucucagaccugaacuguuaggcaguuucauugugggaauaucacagaguacaggugcacugccuaguuuuccgucaacuugacacaaguuacagucauaagagaggagggauccuuaauugagaaaaaugucuguauucaauagaggcuguaaguaagccuguaggacauuuucuuaauuaaugauuggugggggaggucccagcccauuguggacagugcugucccugggcuggugguccugacuucuauaagaaagcagacuuagcaagccaugagaagcaagcccgaaagcagcacuccuccauggccucugcaucagcuccagguuccugcuguuugaguccugcccggcuucccacaguggaaugugcuauguaagccaaacaaacccuuuccuaccuaacuugcuuuuggucaugguguuucaucacagcaauagagacccuuauuaagauagcacuuaugcaaacuaaugguuaugucauaacuaaugacauaaugguaugucaucacuagauaacauuuuuauaagaccauucuacauaaucuauuguuggccauacauugccauguggcacuuaguuauauuuuauaacguuaguuugcauauagguuggacacauaggauacaauguaacacauuuacacaauaaguaauggucagaucaaggcauuagcaugucuaccaucucaagccucauuguguccuugaaucaggucuguguguacuagcuguuuugaaauaugcgguuaaucauugucaaguaggggacuguacuguggucugagccauuagaagccacuccuccuauccagcacacagcuguaccugcuagccacaagcccucccuccuuccucccuuccaccugccucuugcuucugaaaaccucuuguuucuuuuaagggcaacuuucuaacauguaucuaaaauguaagcuaguuacauuuuuuuucuuugaacuuugacacauugauaagaauauauuaggugaaggagacucaagagccuaauugaaaaaguaagaccgaaggagaauuagauuaaaagucaggcucccuguuuaggcagacugguuauuaccuucagguaaauuauuuaacugccacugaguugccaacacucauguggaaucaggaaccagaaccaaggcuguggacuuuuggaacugccuccacggaaggcuguagcuaauauguccugccccugaaucugggugggcuuguucuguacccgagguugggugguaaaagacaacaacuucugcuguagagacccuguaagacgguuguugacuaccuuuuuuuguuuguuuguuuuuguuuuuugguuuuucgagacacgguuucucuguguagcccuggcuguccuggaacucacuuuguagaccaggcuggccucgaacucagaaauucgccugccccugccucccaagugccgggauuaaaggcgugugccaccacgcccggcugguuguugacuaccuugaggccaccaugguucaagaagccaccuugaaagugggugcuucauucucagcugaaagugggugcuucagucucagcugacccaggcuuucuugucuucccuagugauggcuuaaguacugcaaagcagagaaaaguuauccuaucaugccuuucuuagaagucauuaguguaauaagaugggaauuguuuucuaucucuguuuuggggaugacuuguuaucaauacucuagcuagaacuggccacauagcugguauauuuguaaaaagguuuaguaaacuauaauguaucacaggcagauaugacgucaucuugauuaccaauuugguuggauugagagauaucuaggagguuaguagugcauacuucuggguguuuauaugaaggcaauuuuaggaaggguuaggaggagguggggaggaggaggaggggaggagaggaggggaaagaggagggagggagggagaaggaggaggaggacccacucugggugccuauggcaccaucaaugugccucagcucagaugggauaaggggaaaggagaaagcuuguuuccacaaccauucuccgucugcuucuggccgccaugauaugagcugcuuuuucuuggccaccauggcuccccauggggacaggaugaaaccaggaaccaaagaaacccuuccuuguuaaagguguuuauagcgggaacauucugacuaauguggcagauguuuuguuuuuacugucuaacaacuuaacaagcgcuaauauuuguugagcucuugcuucaugccaaacacuauuuggaacucuugacacaugucaaaugauuuaauccucaaaagagcuggggccaggcagugguggcgcacgccuuuaaucccagcacuugggaggcagaggcaggcagaucucucaguuugaggccagccuggucuacagagugaguuccaggacagccagggcuacacagagaaacccugucuuggaaaaaacaaacaaaaaaccaaaacaaaccaaaaagagccggaaaucgauuacacucauuuuacaaaggaaagaauugagccacaaguuggguuaguguuaagccucaaguggcacagcccaaagggggcggagcuggaucacagcuguauccaguccuaacaggaggucugcucacccuuucuuuucccuucuuuuuuuuuuccccugauagaaucaaaccuaggaaaaaccaaacacuaccccuccacauuuuauuuugugacaaggucucacaaaguuacccaggcugaccuggauguuccugucuucugagaagcugggauuauggggccuuugccauuaggccuggcugaaguauuuucuagcugcccuccuccaggucaaucuguuucuuuuucuaauauagacacauuuccuggcccuguuccuaaaaugcaaaccugagugguucuucuuucuuggcugugagacauguaaggcguuauaaggagaaagaucugagguacagacucagaugaguuaguccugaaaagaaaaacuccccaaagcagcuuuuguuuguuuauuauuaaaggcaucacucaagaauaaagaagggcaguuggcuuuccagaagcauaguuagcuaucauuucacuuuccuguugcugugauaaagcaucugaccagaacaacugaagggagaaaggguuuauuucagcucacaauuugggguuccaguccaucacaguaaggaccacagcagaggaaccuugaggaccacuguauccucuaccaagaagcagagaaagguggaugucugcguucagcucacuuuccccucuacaguucaguaccccagccuagggaauugugccacccuaagguggcucuuccuacucccaucaacccaaucaagauaaacccucacagguagccaacccuaggggaccaucucccagguaauuccagauuuuaucaaguuggcaauugggauuaaccaucacagcuaucaaaauuuaaaggcaaagauacuccuugggguuugaaauggaaaugauauuugaaagaugguauuuuuaccacuuaugaauggucucuaaaauguccucaucuucuaccuacacuucaaccugcuucuacacuucuagcugugccagucagguucaagagcuuuccaugcgaugguuaauuuugacugccaacuugacagggucuagaaucaccugagccacaagccccuggguaugccugagagaaaccaucuagauaaauucuuauucucuaaaagucaaagagagcuggaugcaguguuuggcacguucugcuugccaacugaagauucaguguguccaagcacacgaagcucugacuucuauccacaguggacacauacauaaccuggaacuaccagccaaagaaacccuugcucuaaguggcccuugcagcucuucugucacaguaacagggcaagugucuacugagauagcauacaguaaguaacaguccuuacagaaucaagucuaaacuuaaguuguuuaguaaaaucaagacugcacauuguggcucuucccaauauccccauuuacucugccacaucccaucagcaggcuauccucuggguauuccagauaaacuccgcuuccugaguuucgucucggcgccccuucuaauaguucacagcacggcuuugccauaccccgucucugcuggccuuuuagguugcagcuucaggagaagcucucccaaacugaccgcauucugaaucagccccgaucucccgcugccuugggcucugaagccuuugcuauuacuauuccagcuuucugcuuggaacuaaugacucauguguccuacauuaugugugacuucuuggagggugggcucccacaggacaaacggucacgucuuuaaacagguucuuucaccucuccaacaccuggccggcauuugauaaacugaacuaggcuagugaccaaauaaaaauacaaagcuaguaugacagaugcuaccaaggauguuucauuucugauagcauauuauagguuuacauggauacuucaacccucccucagugcucuaggaaguugcccugugaaacaacuguuuccuauccaaccggacugaaguguuuuguagcuuaaauuagauuaugcuaauuguucgaaugugugccacuuaaagauuaaaacaauuuccaacacaguuuuucuuaagcuuauggcaccuguucucacuuuucugcuaacaugugcuagcagaugacaaaacaaaugaguaacaucauggaaaaucuaggcaaacugauuucuuaaaacugcuugcugaacugaaugccuuuugugcuguggggcucaggcugcauacagcacgugcuccacaguucaugugcuuaguuuauaugcuagaaucaaacacacgaacaguugacuguuuuauaaauaacuucuacauuauggacauccaaaguuguccucauacccaggaagauaugcacacccaccccagcaaagauauaugugugugugugugugugugugugugugugugugagagagagagagagagagagagagagagagagagguucuauaucuuauaaggucaauuguagggucacaaaggaauuuuaagguuuacuuauaugcuaaucaggauacugagacacaguaucuauguaauccauuuagaaacauuugacaaccagccucugagaccacacccuucaggguuguuggauacgaugauguguauauaugaaaguuacacuaaaguucaccauuuugugcacuuaauauacacuaauaaaagguaaggauucaggggcuggcgagauggcucagugguuaagagcaccgccugcucuuccgaagguccggaguucaaaucccagcaaucacaugguggcucacaaacauccguaacgaaaucugaugcccucuucuggaguauuugaggacagcuacaguguacuuacauauaauaaauaaauaaauaaauaaauaaauaaauaaauaaaucuuuuuuuuuuaagguaaggauuccccuucacagccauagaaauccauugaaacagaugaaggaagcugcccuucuuaggggcagacugggauaggaaacgggauggcaaucauaaagcucauuuugagcuaauacaacagugagauaaccagcuguuuccaugguaaacacaccucggguccuuccuucacuuucagagccccaucccugcaucccuuuuucccuuaggcucaagagggacuguuguagguggucuuaugugaagccaaucuggagauacggaagacuuucacucccuucuuuccugccaugacacucugugaauauuuuucauuuacaguuagggcaauagcuauuauuauuauuauuguuuuuacagaagccacuauuuaccauauacauucucuagugcuaggcaucagacauacaucauuguacaaugaccugucucuagaauacaugaagauuuaaauacuacaucgcaugaaaagacaacccaguuacaaaaaugacaaaugguuugaauaggugcuucuguaagggaacuauauaauugaucaauaaacaugugaaggaugcugaacacgcaucauaagcauuagggaaauucaaaucaaguggaaauggaauauuacuacguaucuacuagaauggcuauaaaaaugacaaguguuggagaggauuuaggaaauaaagauccucuaucacugcuguagugcucuggaaguucuuaaaacuauuaaacauaaacuauuacacaguccagcaauuccacuccuacacugaugauguauggccaacaucauuaaugauagccuagaaguauccacaacccacauuuccaaacaaacaagacgugguaagucuacaaugaaaugcuguuuggccacaaaggggauaaaguaaugcuaugcaacacacaugccuugaagacacagcaaaucuaagaagccaggcacauauggcugccugcuguaugagucuauucaugggcaauuuccaaaacaggcaaaucuacagaggaagagaauagauugguggcugucagaaauggcagaaagaagaaaauagguagcuacuggguucagaauuccuucuugggaugaggaacuauucugggauuagaugaccuugauguucacauaauucuguuaguauacuaaaguuguaaauuaaacauuuacaggaguaaauuuuaugccaugugaguuauaacucuaugaaaauuucuuuugaacaaaaagcuaauagcuccuggcugaagguacaguauauugguaaaguuuaaagcuacaaaccacuggaaggugugaggcagaagcagguucguaaggggagcacauuggaaggaaagagugauagugguuuggggcugaggaauugugcuggugucgcugacagcauucugucacuuuguguucuagauuugugaugaccagcaguggaccuaagaaagaccauggaaagcagaggagaggacaccguuugugcuccuauguggugaaggaaaucaugaacagaggcaugguuuuggccacagauggcaggaggggaaucugaaagcaaauaaaggccaagcugagcccugcaagguucaccucuguuaucagauguuucauuggcucucagggauggcugaagagugcuuaccacucagacuggcacaagccuggaguaacagggcucucacagccugaugcaucuguuuucauuuuucuccgcaaauguugaccuucaaccuguaguauuucucuuccagugggucgaugcugugcauggaagagugguguacauuugccuacuccccucuucugcuuccucaugagauuccaugaauuuggacugugaucuccucugcugggccaccccuguacugacuaggaacuagcaaaugacuuccuaucacgacaaacccauuccuuucaguuugucccuaauuuuguagaaaagugggcaauaugucagacaauuuagguuaaaauacaauuauauaga

SEQ ID NO: 9288 - RNA, 2697 nt, Mus musculus
acacacacacagagaaauauuuauuuguucuuagccaaaccaacaguguuuagguaaccuaggguugcuuuucucccugggaaugacgcagggagugaccaugacauuguugccuaacguugugaagacgacacuucuaaauuaaauucuaggaaggcuagguugcagaacaccccuccccaguugcccuucggcugugauuuuuggacguacucaaagugcacagccgauggaccuuccguauuagcuugugacucuuaggggaaaacauuaaugaaaugcuuugggcaguuuccuuaaaaaaacaaaacaaaacaaaaacaaggcgauguuucuggaaagaaaaagacagaaaagcuuagcaaguagugcucaaaguucgauggcuuuuguuuauccucugaaccgaaaacucgugaagauuuaucauguuacccaaaggaagccaugaugcuguuuucucgcaaaauaccaaggaauuggcgccuuccagcauugggugaauauguaguggaagaaacggagggagguuugccagaucccaggcaaagcaucaugccaucuaggaggggguguggacccugcgccauaacaaagcuaguauuuagagagcacuuacuguaugcaacuaaacacuuuaugugucuuaacucaccuaauccccacaacaaccuggaggaaaacacuauuaucuccaucuuacagagcaggaacaggccugcccaaguaggucagagucagccggcaucuaaaccuaacuugccuggcuccagaguuagguuccuacucaucaggaggcuuucuaaacuuguaacgucgacaacaaaacgcccaaguacaggaaagagagaugucuaaccaaacagcguguuaagagguuuuauggauggcugacagaugugaaaucuucaaggucaacagguggagaaaggaucuggacagaaauagacucucaggggaaggagcagccugaccugacagaaagaagcagcaguuugggugugugccaaucgaugaugacagcacgcgugggaggaaugcugcagagagaggcuucgcuagauccuucaagguccuuuagggcuaggcuuucccggccccgguuaucuaccggggcuggggguugguguuaaaauucucaagcuaguaugugcucaucccuuacuuucugcagggucuccccugccagcgaucaaggaagacaacacauccagguuucuuucuggggaagcacugaguggagacagucaaggucacccacgauuggguacaguguguccaagcggaccacuagaguccugugccagacacuuggcugucagccgggccuggccaacgcaggaacgugcgcaccgccggagccuggcggcgacagucaccugcucagcggguacagaaagaccuguucucugcuuuccccacgggcgggccaccgccccaggucuccaggccccagaaggucaggagguuguccucuggggacucccgccacccgcaccauccucaucaccccaaggaauaaaagccucagcgauuggaacacgcuacgccaaucauccuagccucugcccacaccuccuccgguguacauugcauugguugcaucauacaagccuccgauaagauccucuucucgaauuggcuaguagaggcuugccccgccuaacccuucuuagucggaagguugugauugguuaagcgcguugccaagcuccggacgcggcucgaccauuggaagccgcgggcugccccgcccgccggcgaaggugagagucuccuccagucaccggaccccgcaccgcacagagcugcucccggcucguucucgaggucucggcacauucugucgcgauggcgccuccaucagucuuugcccagguuccgcaagcuccuccgguucuggucuuuaagcucacugcggacuuccgggaugauccagauccccgcaagguuaaccucggcgugggagguaaggaugcagugccuuggaaugcgagcagccuggggggaggugggcguaggaggagcugagauuuaguuugugucucccugagaggagcccgaggagagaagguugggaccacgaggacaucaccaaccuacccauuuugcagauggcgauacagaguccuuggaaagaggggguguucaaggucacgcagaacagguguaacaucugggacacaaauguuguuuuuguuucuccacccaguguucuuuauaguacuuguucuaaagcaacgauggggaugguaaggagagagaaguaugguagcuuuagcgucucguggucaacuggaacugggaaugaaagagcuguuagccuaauggagcuguaguccggguugagcgaguagcagacgccacuuaggaagccuguuaacccacauggggaagauguagguuugguuuauucucagaguggagcagaugaggcgaagcccaugcaucucaggccacacacaucugggucuucauuucuugaucauuugccuugaaccaaguuagccuucugccaaggucguuuguguuguaguuucuaaagcccuuuaacucgagccuccggcgacuucgucaucacuguuuggauguuugaagcucuacagagcuuggugugcauuuggccacgugcagaggccagccgaggagagaagagugagcagacugaugcucucagcagggaaccaaccggaacug

SEQ ID NO: 9289 - RNA, 3570 nt, Mus musculus
cucagaaauauugcaccuucuuuauugacuccuguagugugugacagcggcuguguacacggcguguggauauaguuauagagagauaaugugcggaauacagaauacaaaacagaaaggaaaccaaccuggcgacaaccuagguugggcggacaggucuuggauuugcucagcugccucccuucccccaacuuucgaucucacugcggugguggucuccaagaacaguccccugacaaucuagggauccgggcggagucugucuuggaagggacacaguuggaaaaggaaaaauccacuucguuguggcgcuccgggcaagcaaaaggggcugcggaucgguggaauuucucaagcuaguaccccauuuuccucuccuucacguucucucuccaacuaccuuucuuuuucuuuaaauuguucuuuuucuuucuuucuuucuuucuccccccuccccccuuguucgguccgguucccggaccacacucggagaaggccaagggaaagcaggaagagaaaagcccuccuccuccuccggagagcaagcgacagccggagucccagccucccgcacucuccgcagagucaggaugggaggccaccucuucccuggcgccuggccgguguuucugucucagucuugaggacuggaccagggcauccuuucuccgcugaguuccaugccccaggccuggagugagcugcgaccauggccccuuggaaggagcgauacgucuguauuuuuauuuuaacgaggggaccuggcccuugggucuguccuuucucgugucucauucccgcggugcccagcgugcaguaggacgcccgccgcgugucccgcccaggccuuaccaagcccugaugcccugcaaaguccccugcgugcacgcggacccggcugcagcaccuugaugcaaggguugcgcgccgccgccgcugccgaagccucccagguugcucacguucacaaaggauccaccgccgguggcgcugcaggcggguugcauggcgguggucgccgcggaggccgugccgccaccaccaccgccgccaccggucggauaggcgcagccguagcugccgcuguaagccgccgcugcugcugcggcugcggcggcugcagcggcugcggcggccgaguucccguagccguaggcggggaagcuguuguaggaguaggcgccggcgcccacgccguagggcgagccguagguuugugcgcugggcgugacgcacggcuugccgucccgcacgagcaccggcacugccacgcggcgggguggcggcggcggcgcgugcguccccagcuccagggacuuauccugccgcugucucuugcacuuguaccugcgauucuggaaccagauuuucaccugcguggacgugagcuucaggcugcuggcgagaugcucgcgcucgggcgccgacagguaccgcugcugcuugaaccugcgcuccagcucaaagaccugagcuugcgagaagagcacccggggcuuccggcggcuccgcggcuucggccucucgccguccucgcucgucuuacagucucccgccgcuuccagagacuucuucaacugacagcuuucuaagggagaagcaagacauuagccuuucuaguucucaggauaccaccccugcgccccagaggcacaaaacacucccguaguaaaugcuaguuuuggggaaaguucauaguuucuggagcccaauuccgccccccccaucccccccgcgucaggcggagcaccuccaccgggagaaggcguauucggugagaguaauuagcucgcauuuauuaaauuugagcaucagcgagaaaauagauuaaaugugccgguccaggggcuaauaacaauuuucaggcgaccgcggaacaggaccccguaucugcaaacucguuugccuuccacuccccugaagguguggaacgaguugguauuggggacuggaggccuggaugcauggguugauugcaaaaauuguuucucuuuggaaauaucuaagugaaaggcguaugugcagcucaagaauugauuuuuuuuuuaauuuucaaaacuacugagaacgcgucugugacaguaucuguauguuaccuuacagaggaaaaacaguuggauggaccgauuuagacaguuucaugucuguguuaggccuggagaauuguuagagaaaagauuuuggucucagccagaucaaaucuccacucggagaagagauuauuugauccuguuucccuuucagacauuuccuuaugggcuuauucaauuaucugauucuccugccugccccaccucugaucugcugaauggccagaaucccacucagaacuaauucaggaacuuuaaccauuccacuccgccugcaguauaagaaacaaagcgagcauuacgauauuuuuuuucagaggccuucaccuccugggugugacuugcugccgucaucugauauggaucgagcucccacacauuggccaccaccucuccuccuugcaguucgaacguaagaacugcaagcuccgaaguaagcuggugucucucaaagucuugcccgaaaggauggcccaaacacaacauucuugcacugccuuuucgggacagccggggugacugcccuggccucgcugaauucaccucacguuagaagaaagacagaaaaauggcagaaaacugaccccccccuuuuuuuuugagaagaugggugugcgagagaacacacacacaacggacaaguuacgacccaggcucugggcccccgucacucauuacucaaggaaccaggauugcaauaaucacuuuuccuucccucggggacugcuccgggucccugcuccgggcaagagcuguucucucuuucucuuuuauccccgccccagcaccaucucagguaccugugcuuugcagagcuguccuugaaccuggcauaggcaugacccuagccgaaugugaaaggggcggguggccaugcaggcacgguuuguggguuuauaggcgcugagccauugccccaggugugcggacgcguuuccuucccccucuacucacuuuggcuccguucgcucacaaccuccucuucuuguuccuugggcccgcugcaagcgucucggagaacuguauggacauagcucugaggacagagacccgaaucuccauggcccucggcagcagcuagugaguucaaauaggacaguuucucucccucuucuuccucguccuccuccccugcaucggaaaacugcgucccuucagccguggccagcaugcagggugccgaguggaagugcugcuccaauuccgccugcaagugagcuccguggaagugccgcugcugcuccagauucaaaaugucuuugacugagaaagggguggaggugaccgggcuugguaacaucaucagggccacuuaauuguccaguccaaauacucaauaaaucccggcgggggcggggagggagugcgguggcuccagcucuucuucuggacuccgcgguggugcggagucgagcuuuugacagacgcgguccagucuaaauccccuccauuggccgggaccugggggucuggguuuugu

SEQ ID NO: 9290 - RNA, 2045 nt, Mus musculus
ugauuuauuuuauaauuuuuaauuuuaauaauugaguuauuuuuaauuuuuaacaagauuuauuuuauucuaugaauguuuuaccugcacgcacauauguguaucauaugcucagaagucagaagagggcuuuagaucccccuggaacuggaguuacaggcaguugugagccaccuuguggguccuggaauugaacuugagcccucugcaagaacaagugcucuuaaccuuggugccauuucuccagcccccucauguauuauugugaugucauauuucuuuguaugauaucucagcuuuuacugugagcuuuuuacuucccuuacaaucugaucugagacuguucuuugagguuggaguuaaacccaaauucguccuaagagaaaaugugaaggcuucugccaacaaccugggauaucacccaggccucuugggacuaaacucuccacuaagaguccaaagcaggcgguucaggcagcuucagggcacaaucauaaaagaccugguuugugacuuacaagucucagggagaguccccacuuaaauagguagcacuggacauggguuuuuguggcugugguuaacaucugaauucuauguuccucauuuaccuggccauuucaaaaguagccuuucaagacucaggguuaucaaaggagucuguacagguuuguuuaucuuggcuuucucuuaacugguguccuauauuauugacagagguagauuuuuaagcucucaggguuuggaaaccugccugccuuugccccaaccucacagcuccucuuuuggauugugcuggagggucacuguagucuuccauuugaggcuguaauuaugaagacuugaaucuauccagcacuucguauuuagugagguucucagagggagagaguauagcuaacguaggcuacccucucucgcuugcccuggcggugaccaguugcauugguuauccaaaucguaacuccccccccccaccccacccccaaaaguuguccagauuagauaacaguguuuccauuuccagcuccggaaccguggccaacacaguuauauagguauuaaccuguugccuuaaggaagaccuucccuucccugacucugcagauuggauacauuguaaauaguucacaauuaguggccaauuuucaaagcuagcuuuugaaauguuaccaagguauaauugcaaauuaguagauaugaaucuaacacucuauaguuugaaaaaaugcccauuguccuacauacucggaaagaacaauuaaacauggcaugucuugcaugagguaccucccauuuuuuguagcaggggaggacauuugaagauugauucauacaguccuguaccucuaacgcucugucagaacuauguuguggcuuuaacucugcuacucagguuugcucuuuuucuugcucccccucccucgccaaucuugguugcucccuuucucugccaucagcauccuuuaucccucuuccucagcccaauuucuuuuucacuucuggauaaucaguuaaguaauagaauuuucuuguucuauacuuuaaaaaaacaaacaaacaaaaaccaccuuauuuucuucucaaguacauucuaaauccguacaauccucuaguuugcuucuuaaaacgcguuucuagauacacaacauuuggagaaccaagaagaacuuuggaaaccagaggagcaguuuacaucuacugagccgucacugcccaaccagagcugugcacuggaauaaagcaucaaggaggaaggaggaggcccuauccaccucccauuuacaucccaaacuaaucagcccaggcuggucuuuguauuauuaucauuagagaacuuagauuuacagccaguucuauuuaucuauuuaucuauuaaaugucuaacauuuaaaaagucauuuaauguaaauaaaacuauuuauuuaaauaaacauccaauuccguuguguugucaguuaauccuccccucacgaaguucuuaguuuagcaaauucauuucugggacuauuuuagauaaguauggaggacuagaaaucccuaug

SEQ ID NO: 9291 - RNA, 2045 nt, Mus musculus
cauagggauuucuaguccuccauacuuaucuaaaauagucccagaaaugaauuugcuaaacuaagaacuucgugaggggaggauuaacugacaacacaacggaauuggauguuuauuuaaauaaauaguuuuauuuacauuaaaugacuuuuuaaauguuagacauuuaauagauaaauagauaaauagaacuggcuguaaaucuaaguucucuaaugauaauaauacaaagaccagccugggcugauuaguuugggauguaaaugggagguggauagggccuccuccuuccuccuugaugcuuuauuccagugcacagcucugguugggcagugacggcucaguagauguaaacugcuccucugguuuccaaaguucuucuugguucuccaaauguuguguaucuagaaacgcguuuuaagaagcaaacuagaggauuguacggauuuagaauguacuugagaagaaaauaaggugguuuuuguuuguuuguuuuuuuaaaguauagaacaagaaaauucuauuacuuaacugauuauccagaagugaaaaagaaauugggcugaggaagagggauaaaggaugcugauggcagagaaagggagcaaccaagauuggcgagggagggggagcaagaaaaagagcaaaccugaguagcagaguuaaagccacaacauaguucugacagagcguuagagguacaggacuguaugaaucaaucuucaaauguccuccccugcuacaaaaaaugggagguaccucaugcaagacaugccauguuuaauuguucuuuccgaguauguaggacaaugggcauuuuuucaaacuauagaguguuagauucauaucuacuaauuugcaauuauaccuugguaacauuucaaaagcuagcuuugaaaauuggccacuaauugugaacuauuuacaauguauccaaucugcagagucagggaagggaaggucuuccuuaaggcaacagguuaauaccuauauaacuguguuggccacgguuccggagcuggaaauggaaacacuguuaucuaaucuggacaacuuuugggggugggguggggggggggaguuacgauuuggauaaccaaugcaacuggucaccgccagggcaagcgagagaggguagccuacguuagcuauacucucucccucugagaaccucacuaaauacgaagugcuggauagauucaagucuucauaauuacagccucaaauggaagacuacagugacccuccagcacaauccaaaagaggagcugugagguuggggcaaaggcaggcagguuuccaaacccugagagcuuaaaaaucuaccucugucaauaauauaggacaccaguuaagagaaagccaagauaaacaaaccuguacagacuccuuugauaacccugagucuugaaaggcuacuuuugaaauggccagguaaaugaggaacauagaauucagauguuaaccacagccacaaaaacccauguccagugcuaccuauuuaaguggggacucucccugagacuuguaagucacaaaccaggucuuuuaugauugugcccugaagcugccugaaccgccugcuuuggacucuuaguggagaguuuagucccaagaggccugggugauaucccagguuguuggcagaagccuucacauuuucucuuaggacgaauuuggguuuaacuccaaccucaaagaacagucucagaucagauuguaagggaaguaaaaagcucacaguaaaagcugagauaucauacaaagaaauaugacaucacaauaauacaugagggggcuggagaaauggcaccaagguuaagagcacuuguucuugcagagggcucaaguucaauuccaggacccacaagguggcucacaacugccuguaacuccaguuccagggggaucuaaagcccucuucugacuucugagcauaugauacacauaugugcgugcagguaaaacauucauagaauaaaauaaaucuuguuaaaaauuaaaaauaacucaauuauuaaaauuaaaaauuauaaaauaaauca

SEQ ID NO: 9292 - RNA, 288 nt, Mus musculus
uagggguugggggugggggugucugaugcuguugggauuuacagcccugagaugaaguggagucagcgcugaaguuuagcgaucucuaaaaauuucccaugauccccgaagacagugagcccagucggacagucucgcagagaaagggcaagcugccuccagacagaagugaaguggguccugaaggaaaagaauggggcugggcugggucggugggcuggggccaggcguggggauaaagaaaaccaggauuuaugaguccuccaggcgggcgggcagugaggaaga

SEQ ID NO: 9293 - RNA, 681 nt, Mus musculus
gucugggcaauuucuuuuuaaaaagagauuacagcuaggaagagagggagacgucagcucacgggaugugagauggaagcccgaugggacaguuuucaggggaccuucgugguguuuucuucagaugugagaaccaaagggcuggccuuuccaugguuggcagaagcucagcgcccuacuccauccccuuggcugagaaugcuuccuuccuccuggggacaaguuuugaugugacaacuguugcaggugaacgguuagaacugguccgaacguccgaacaugguuaggacugguccgagcguccgagcauccgguccaugcgucuuaccuugguuuuuuuuaacucaccuccucccagccagagugcgaucccuuggugcuaaagcauccauccccucccccacccccugcagagccagcgcucacuagagcugugguggugucgcagaaacacuaugacacucccucccccuccccguggggucccccaguuugcagguuaccuucccugcucauccuuugggguuuuccuugaggaaucgccuggccgccagugcugaccuccuuccuauccggggucagcucugugacccggagcaguggaggaaaggcugccuucccagcuucucugauuuccuuccuuccugaagcugcuccaggccucauuugcugacaccucug

SEQ ID NO: 9294 - RNA, 34845 nt, Mus musculus
caguaccgggcaggugggcggggccggcuguuggcagcaguuggcggggccggguggcggcugcacgugcgggcgggggcgaugcgucacugaccggugaggcgaggcucgggggucgcgguccuccgagugccugcgaucaaggccgcccucagucgggaccuaacgcuuggggagucggggaagaggugucacgacguacgccgagccgggggcacccgcgcaggggguuggcgaggggagcgcuuagcugagagagagagagagagagcccggggccggagcgcggggcuucccgccucagccgcccgcgaccguacgcgggcucuucccuggguggggacuggccugucacucaacggacugagguuccucuucuccccaugcucaggaggaacaaggaugaauaugacucaagcccggcuucugguggcugcaguggugggguugguggcgauccuccuguacgccuccauccacaagaucgaagagggacacuuggccguguacuacaggugagcgccgcccugugcagcccgcgaugguucuagaagcacaguggaaggguccaaugggucacagcgaagucugggaaguugcucuuuuccgcggcgucaggggagcugcuuccagcccugccugggaagugguuucaucccagcugccgggaguuaaccuuuggcggggcacuuuuccguugucggggcaguuuagugccaaguucguucuguacagaauugaagacaccuuagggggcacggaaguagucacugcaaccgagaugacuucucauaguccgcacaacugcacagguguuuaguuugccgcuguggauuuuuuccggaucucugucuuacauaaagacaguucuccccaacacuaaguuggguuuuuucuucuucauuaaaaaaucucccauugucugguuaugucccccaaagucuucaugaccagagcaaugucauauaucccuaaaggccaagagacaaaaaccacauuugcaggccacuuuucucacuuuuuuuuuuucaagucaaggugaaaaagaguguggacucaguugccauccaccugauuuggcauaaaucaagucuaacuucccaccagguccucgugguauaagcugggaagagaagccaguuuguggacaacuugggauagugguuuauucugaaacaagcagauuuuugaauauuuccaucaugcccccuaaacugguauuucuacuuuuagaucaguccagaauccuagaaaauacauacuuuuggugguaugucuuaacagauggaguucuagcauaagaaauaccagccuggaccacauuuccauccaguuuaucacuguccuucugacaggaaaaccacgaagagaacauacggagauaccacuccaaaaaaaaugacuaaugaaccugcaaagguucaucuuuugaguuaugacuuaggacaaggaugaauguugugggaacuuacuauucguuguguaaaguaggacuuuguguuguauuugucccaaauuugcagggggugcuuucaccguucacauacuacagaguuugauaaacaagccccucucucagcugucaacucaacccuuucgcugucugucuuuccaugcuagguuuuuguuaccuuuagacagaaaccaucccccuaggauuggacucauguauugaaagaaccauuagccucagaaaguuucuucuuccuugaaaguuugguuuuuuccuuuuuuaaacuuagcgauuaaauguauuguuuugauuugucucuuguuaugugucauuaauugagagucauuagaauuuuuuccauaaguauuuaucggcaaacuaaagaccagagaggaucuuuugaacccaagagcagugcuagagacgcagaggugugguugguggagcuuaugaaacagggugcaauauuggcaguggacuuggaugcauuuucacacuuuuaaaugugauggauguuugaaguagcaguuguugagucacucuguugugaggguaguagguuaguaacaugaauaugagugaauguuuguuauagcauuuuaaguugaaaagagauccgaacaguuuugucaacuggaacgucuuuuugcaggggaggagcuuugcuaacgagccccaguggaccaggcuaucauaucauguugccuuucauuacaacauucagaucugugcaggugagugacuccuagggauuccagauagacaggugugacaggaguuaccgcacugguggguggagacggaguuccuuauugcuuaagcaaacguugguauuuacucagaugggaagugaaaguucauaguacaacugucacagcacaagucaugaugucaaacugccuugccaagacugccuucuggcuaaugguauuagcagguuuucuguuacugaagucaaaacaaaagaagaauugaaaacacaauuaggaauacaaauuagugauaccuugguuuagaacuguuugguuucuacagaggcaggcucccagccuacugcuaacauggaggaauacauuucaauacacagcuuuucagccucacauuuuugcuugguaaauuaaaugcaaauuuaugaggcaccugaaugaaugugguacuuugacaguguuucagaauguuugaaauacaaaucucguucuugcaaaaaguaucaugguccuaggccguacuuaauaaauaacucugacaucacaagaaugcagagcaggauuggguucucgcugauucuguaaccucagugggaucauaaauguuugaauucaguuuuauuucaaaucugcugcagaguuuucaggaaacaggagaagucgguauuauucauauucucauguuagccuucaguuuugugcuaagugagagcaacugugaauagccaguucuccuugguuucuuuucugucccuucucaauggcuuacggaaguauugugccuauuaaagugaggccuggcgaagcuggugaacguggugaggcccggguucuuuuucuagucacaaugauuuccagauuggcuucccauauuugacucacacuuuugaagguucuuuuuuaaaaccguaucuuauguauagcaauacaauuaacacuuaguaucacuguaauagaaugaauugauauauuuuuaaacaaaagaaaaaagagaaauguuuuagguuauaaaaccuuuucccuuagaacaauuauuuuauauuacucuuucuaaauguuuuggugugacagaugugcccagugacugguacuuuguacccauuuucugaucaucgguugcugaugucuacuucauucccugugccuuccugugccgccugugucuugcuggccuguuuuaggcucaucccaguuucucucuucugaccguagcguaccagcaguucuugacagucccaaaguuaccaguggcaucaucagacugagagccugggcuccuucuuagaucuuguucagagccaggcaaaucugucugccuuccugaaacccacuguuaagcaacauggugcagcaguaacaugaaguagauauaggcaauaauaguaaauagauuuuaaccauuuguauauagcaaauaugcugugugaucaucagaaauaagugaaauuaauaaaaagauuucaaccuaaacuaucauaauuuucuguuuugauuauuaauuacuuaaaaguuaaauguuacaggcaguguuacaaaauaggaauguucuuuuuuuacaaaaaaaaaaaaaaacaaagaaggcagcauucuaagcaaaaauuacauuaacaaaacccuucuaaggaacucuucuuaagcagagucauaaauuuacauuuuggaauuuagggaacauuagaggaugcagcucuauuuaaacaaaugguuucacauaauacucgaaggaacuaauauucauuaaugugaaaugccacauacaaguacagaaacaaagcuuauauuaaaaccuucaguuuuuauaaauuuacaaaguaaauguggacuaacuguuucucucuugugguuuuugaggcagggcccacuguguagccaaggcuguccuagcauuuguacaggcuaaagucaaauucacaaugccgucuccguaaggcugugguuacacaugugugccaauguaauauuucucucauauuugggaaagaauuagauguauagcaguauauaggauauuaaauugaaaaguuauuguuuaauuccuaguuuuuuauuugaaaguugauacagaauaaugaaaauugccuuaguuuaauguuuuaaaagaaauaaaauauacugaacuugauuauuagccuucuccugucacuuuauccagaauuaucucuaaucuuaccaucaugcuaaucucucaaccaaagaauuacauuuucuucuuucugugcuggaauuguacguucagccaaugaucacuccuuccuuuguuaugacuccaggacuggugucuuccaguuuuguuacccuagacaaguuacuucuuuagcuuccuagcugguuuucuucacccucacuccuaagcugaauaacacaugguaggaggaauucaggaaaacaccuuuuccuuuccagugcuaaaagaucaacccuagggauuaaacccagagcuuugagcauucuaagcaagucuccaccuccgaggcuacaucuuucguauuuucuuuccccagguuggucuggaccuugcacuccuccuaccucagccucuugcauagcugagauuauaggcuugcaugaccacucccagcucugacaauauuuuugaaagauucauuuugugauuguacauaacauggauuaaagagcgcuuaaacugcucagcaaauauucaaggcccucagccuaauaacauuguguucuuuucccagaacugaccacucaucagaauagugccuuuugaguuaggccagccagucugcguugggugugugcuuuugucuuuacuguguguauuugcauaggacauuuacuuaaacuuaagaugucucucuucuagaucugccuguuaauacuaaauuucagagaucuucuaaauuuguuaguucuuaaucuguguauuugugugugccuacuuggcuguauguguacuacaugcuguagugucagcagaggccagaagaggaguugagugcucuggaaugggaauuacaggcagcugugagccaccauuuguggccuagaaacaaaacucaggccuuugaaagaguguugaauacuuuuaauugauguuaucuaagagagcuuuugagacuaguauuuuauuucuuguagcuuaauaccuaaaagcucaauuuauauuguuauuuuuguaccuacugauaggucucuuuguaagaauuuuauuuccuagccaggcaguggugacacaugccuuuaaucccagcacuggggaggcagaggcaggcggauuucuggguucgaggcuagccuggucuacagagugaguuccaggacagccagggcuacacagagaagcccuguuuuggggaaaaaaaaaaagauuuuaugcuagauugugauguuuagauaacaggggccauauuuuguguccuaacaagguguaaugugucccagaauacacuacuaaccuauaugaaaccucagguuacaaagaaaggugagauaggcaaagcacuuaaaaccagauuauugguucacaagaaggaagaagcaguggugguauggcacucauauuaaaggcaaaacgaaccaaaccugugagugcacuagguccugaagcaaaacagcgacgagcugugcugcugaguucaaggguagcuuugguucauccaggacugcgugggaagggagucguucaucaucacuguaagcaguaacagccaggagucaaagugcagagcacagaccuugggcacagugucugcugagagugagguguggagcuugugaucucgggucaagucagcucuaaacaaauaagaugcuuaagaaaaacuuuccagccucgagucuuucuagauauauagagaaauggcuaacuuuuuuuuaaagauuuauuuuauaaaauaacauugucuucagacacaccagaagagggcaucagaacccauuucaggugauugugagucaccaugugguugcuggcaauugagcucaggaccucgggaagaauaaucagugcucuuaaccucugagccaucuauccagccugagaaauggcuaacuuaguagcugaucuuuggaggcuaaaaucauggcaggacucucuuguacuuacugacaccagcucucccaagauaguucucugggaacagcagaguguguguguguguguguguguguguguguuuuguuuguuugcucauuuguuuuguuugcuuuugagacaaagucucucuguagauuuggagcucacuguguagaccagacuagccuuaaauucacagagauccaccugucugcccuccagggugcugggauuaaggucauucaacauggugccagaucagcaggcuuuguuuuuuguuuuguuuuuaaaaauaaauuuugagccgggugugguggugcacgccuuuaaucccagcacucgggaggcagaggcagguggauuucugaguucaaggccagccuggucuacaaagugaguuccaggacagccagggcuauacagagaaacccugucuugaaaaaccaaaaaaaaaaaaaagaagaaguacacacuaaaaaaaauaaauaaaaauaaauuuugaugagcuauuuuuuuuuccagacaacacuacaaacggaugaaguuaaaaaugugccuuguggaacaagguaagcucccuccuuuguggcccaucgcucuuuucuuucuacaguaccgaggaaguucuuagagcuggagucacuugagaaaccuugguuugcauuuuguuuuguuuuguuuuugaaucauacagacucuuauuauguggcccuggcuggccuaagacuuaguauguagacuaggcuggcuucaaacuuggaauaacccuacugccucugcuuccugaaacccuaaaauuauagguauaugucaccaugccugacuaugacacuacuauauagacaugacagcaacagaaacuucugugcuaugaguuauuuucaugaggcugcaagugagagcauuccagcugaggguauuauugaaauggaguuucagagcuagcagacuaauuauauauuagcauuaucacacccgaguugcuauuuuaauugacaggaaaaugaagcagaaaguauaggcuccacauagccuuugcccuccucugauaccuugguuagcuucucuaagcugaguucucuuaagucugggaauaagaccuauguuagaauuauuguaaggauuagaauuuguguauauggcccagaacuuggaucugaauugauguucgauaaaagauuacuuaaaacaaaaucauuucacuucuucucuuuauaauguuaaaugacaucugagaguuucugagucaauaaguaggucuuuaauagaauuuauguuucuaaugaaguuccugauuacacugucggucuagaggccucuaagaauuguccuaaaaagguugaggccaagaaaggaaacaaggcugguauagcacuaaaauauacuuacuguauuaauuguaucaagugaggacugauaaggaugagguaggcuuuaauucauuaccuaguuuaaaugauguaaaguauugcuuuuacaaaccuacuaagguaccuuugacaucuauagaaggacagauacauuugaaaagggaccaagcucucuuauguucuaagucaaguucucccuacguuuuaaguuagauuaucaaguucucccuaggucugucuguaacuucuuuauuguacuuuauuauuuuuauuguggcucugacucacacuuuccauuuuuguuuguuuucagugguggagucaugaucuauauugaccgaauagaagugguuaauauguuggcuccuuaugcagguaaucuuaacuaucugcugugauucuauacuuauaaccagggcauuuacaacugaggagggagaggaagauacuuuuuaaaguuuuacucccucagugaguucugaugacuauaaaagaaugaucaugcaaggauuuucauuugcaggaaauagagguacaagcaggucacaaguucuggacagaauugguuuucaggaaccagugagccaguccucucugaauuuacuauuucugaaagcaaauguuucuagaaaaagaaaauggcacuguauccagcuuguuggggaagaauuucuuuguauccugaagaccuauaauugaucaauuuucuugggucacacucauuugccauuuucugguugugauuugccauaacuugcaaagcagucugaaaauugguaguacacggaagcauuuucuuaauaaaagaugaacaccucagagauaaaguggaugcauguuauuuuaaaaaaguuuggcuguggagagagauggcucagucugcaaaacauuuguuguguaagcuugaggaccagaauucaguccugagugcccaugagcuuaguagacuggcaugcacuugauaucccagugcugaggcagagucagggaggucccugaggcgcagaggccagccacucuacccuaacuagugagagaccuacagaugacaccugagauugauuugugguccgagagugugugugugugugucaugugaacauauaagaacuuaauugcaaauuuugaagauaucuggucuucauucuuguuaacaaauuggcaugccuuguguuuuucaagaacgucaaaaaagugaagaugguagccuccgccuucaagguguuuucauuguacuugagaagacaugguagaaaggggaaaacguacauugaaguacagggucauguuaaaguucauaucacuuguacagacacagauaggagaaagauuucagaguaaagaguugcaaguauauuauuggcaaguggcuuugaaugauauuuuuugacuguuauuuuucucgugguuucucaucuacagucagccuuccguaucugugaauuguacauccacagguccaaccgaacacacaucaaacauugaggggaaaagcugguucuauacuaaacauauguggacuucccucccccccaucaucauuccccaaacuguucaguguaguaacuauauuagauaccguauaaucaccuagacaugauaaaguauacaggaguauauacaguuuacaugcagauacuacuuaguuuaauagaagaggcuuaggcauuuguagacugcaggcucuccagaggaucuuggaagcagugcucccacagagagcaacaagugacugacuguguucucugaucacaaaccacuggaauggauaugauucagaacugacaaagaggaaaguggacgaaucucccuggagacaggcaggagaguuuuagcucacuggcuuauuuggaagcugaugagaucauauauuuagcaguuauuuaucaacaaauguuucaucaacuaugacuuagaguccgguuguaucuaauauccuauguaggaggccaguggagcaaauguuuggauaugaaaacgaauguagaaagcauguuuuauaguuagaacacagguucugacgcagacugguauguuaccuuuggggauauuucugaaaguuucugguucuuaguuuccugagauagaaaauuaggaggagggguaauuaaacaccaauguauguaaauugucuaaaguccacccuaguaaauguugccuccuucccugauaccccagagucuuuuaaaaauauaagccuuuaaaaacugcuuaagaauuuuuaaguuagcauauagaguaauggauuuuauuaugucauuuucacgcaugucauuauucuuuauuuuugugaacucccaucccccguauguccugucuccuccagcugguucccuccuagauaaugcccccuucuuccaugucauguguauuucauugcucuuaccuuucuuccuuccuucaaccacuccuuugccuuucgugagccucuuucuaguugcaugauauccacacacacauaugcacacuauuaaucuagguucuauaugagagaaaaauugucguguuuuucuuucugaauuuggcuuauuauaucuacuacauuuaaaaauauccacacaucucuugauggacaccuaggcuagauccauuuucugacugcugugaaagguacaucaauaagcauggauguugaaguagaguccuucaggacuauacccgaggagcggcauggcugaguucugugauggucaaagucuccacacucaucucuacaaugucuggucaaguaaaaaccaccuuuuaaaauucacugugcacauguauauuuuuacauuaagcugcacgugucuguuuuugcagcagcuucccuuuacucuggauguuccguugucuuuaucucuugacuggagcuuggcuuugcaauugcuuaugcuuuccuacgucucaguucaucuucacacugcugcaugaguguacaucugauccaugguacccaugagaguuuuccuccuggauaauauaccagucuuucauugcugagucugaagauaguugggucauuguugggugaaacaaacaugaauuuuauucuccuucaguguuugacauugugaggaacuauacugcagacuacgacaagacuuuaaucuucaauaaaauccaccaugagcugaaccaguuuugcagugcccacacacuucaagaaguuuacauagaauuguuugguaaguguuaauuuguuuuaaauauauaaauagacaauuaccaguuagaaaucuuauuaacuuaaguauugaugcuguaauguuaguaaaccuugggccauuugggcauuuucucugaauuuuuaauagaucaagggguuuuuguuuuguuuuuuaagauuuguuuauuuuuuauguaugcgaguacacuguagcuaucuucagagauaucugaagagggcaucagauugcauuauagaugguugugagucaccaugugguugcugggaauugaacuuaggaccuuuggaagagcagucagugcccuuaaccacugagccaucuuucuagaccuagaccuagaucagguaucuaucucucucuaucccucccucccucccucccucccucccucccucccucccuccuucccucccuccccgccuccccuccccauccccccccuccuaucuugcuauauagcacagaccucaaacuuacagggaucagccugcuucuaccucccaagugcuggaauuaaacacauguaccaccaugcccccacuaaagcaauacuuucuuauauaguuugguaggaauuacaaaaugacuauuugccaggcaguggaggcgcaugccuuuaaucccagcacuugggaggcacaggcaggcggauuucuugaguucgaggccagccuggucuacagagugaguuccagacaaagaaacccugucucaaaaaaccaaaaagaaaggaagaaagaaaagaaaagagaagagaagagaagagaaggaagaaaggaaggaaggaagaaaugaaaagaaaaugacuauucacaugcuauauucuauuuuuacugugcuagcuuauuaacgauauauucgggagcgugcuggcuaguuguauaguuuaaagucauuugggaaagggagccucaauaauuaaaauaccccccagcagauugggcuaugagcaagcauauggagucuuuucuugcuugaugauugaugugggagggcauagcuaacugugguccugggugagcaagcccuaagcagugugccccuguggcuucugcuucuauuacuugcccugcuuugauuuccuucaugauggacuguaaucuguaagaugaaacaaccccuuccuccucaaguugcuuucggucauugcguuuucucacagcaauagaaacuaagacacaggcguuccuuaagauccacuuccaggcaauuuggauucaggauuuguucagacagccaggaccuggcauguaguuguagucacagcuaagauuauuacacaaaggauaaggauaaaaaccagcaaaaguaagcggcauagugugcauuaaaaaagaaacuucauguggcuucuaggaauccugucauuguggagucacaggcugugccugauuccuuaguaacagccugugagacaugugaaacgcugacugcugggcaagcgccuuagacacucagcaccucgaaauuucccuggggguugaucguauagacgcccucugccaaccacaugacaaacuucuaagccucuaaggaaagaguguuccgcacaaacuccuguguauaaaccacuuuaccagcucugucauagaaugagaguccucuccagacccacacuugcaagcacaaagggccauagcacacugcuaugcugccuucuguaaacguuugcaguugggauuauguaaguucuaaccaaggaaucacguuuauugccuuugguguucauuucugcaugggauuuuaguuuauuuuaccucagagugagguaaagggaugguuaaucaauauaaaguuuacccagcgagggacugguaagauugcuucgggaguaaaggugcuggccagcaaggcugauggccacagcucaaucccuggacucccacagaggacggagagccaguaacacacagauaaacaaaauguaaguaagccaguugcuagcuuuugaugacuggcagcuacugcagugccuggcuugucacaccacugguugcuuucuuugguaauggugaaaccacccuugaggugauuaaaacuucauccauugggagaucgaguaaaguaaucgcuucuuaugguugaauugaucuguucuucaaagacuugccucucucguuugcuuguguuuuuguuuuuuuagacaggguuucuuucuauaggcuuggcugaccuggcacuugcucuguggaccaggcuggccuugaaccuagagauccacuugccucugccucccaagaccugggauuaaaggcaugugccacacuaccuguacuuaaauucugauuuuaaguucaaagugauaguaaggugguaaccaacagaaaugacaucuacuuauuuguguaaagauuaauuuuaaaauuaugaaaaucaauaauacauaggcuagaugugguggugcaccuauaauccuagcaccuagaaagcuaaggccggacaauugugaguuuagaccaaucugagcugugagaggaauaaggcauuaggaaacuagagacucaacuccuucauuuauucaaaagcugccuuagucaguaauuacuaaucuaguaaacguguuaguuaaguuauucaauaaacauugacccaaaguuaaauugaacucacuagguaaauauuuccaggguaaacuuagaauggcuguuugucaucuuucuuaguauguaauuucucaaaaaaugcuuuguauucaucucauuuaaacaugauaaaaacuuuguuuaucaaguugcuuaagcucugugacagagcaagaauggaaucagggucucuccugacugguuuuguuuuggugucaauuaaaaauaaccaaauaucaugagauuuguuguucuuggcuucaaaaacagaucaaauagaugaaaaccugaagcaggcccugcaaaaagauuuaaacaccauggccccaggucucacuauccagguaagcuacuuccuaaaaguuauuccaugccccuccccaaauuucuuucuugagaaguucauuauugguauauaggaaacauaaugauuuuuguauaucaauuuuguauccugcuacuuugcuaaaauguuuauacggccuaggaguuucugagucuuuaaaaucuuuuaaauuuaggcugaguauuugacuucuuuucuuguugauaccuguuuauuaaugauaacccauuaauaaaggaguccuagcacaguuaugacuaggagcacuauacuggguccccuugucucaguauauuuucucuauuuguuggguggauguccgagaacugucugcucaguucauuagcccaguugcugaucagcugauuugaugugcuuugcucuucuuguuuuguuuucauguguauggguguuuugucugcaugugugucuacaccuugucugugccugguucccucagaggccaaacagggccucagugccuccgagcuggaguuagaugaaucuuagcugcuauguggguggcugccaucccugguggcauaccauuuauuucugucucuucucuuaccaaaaugaagaaguuggauucccuguuguauucucucagcagacuucuugguccucuggcuccuacagucuuucugcccccucuucugcaaugucuccugagccuuagguguaggaauuacuuuguaaaugucucagucggcccuggacaccccaugauguuucucuuugcccuuugaccaguuguagcucucuguaauugccugccacaaagauaagucuuucagcauuuuaguggcuucucacauuguguaaggcuaauuuagauaacauuaagaaaccauuacuuuacauucauauucuuaagauggaaggcuuugauucaugugaaaucaugugauuuguuuuagcauuaauuaugaggugggacuucgauuccucccuauccuaacugggugacagugaucuucugguuuuuuugggucccuacccccuuuucuacuugcucuuuugccaguagcuaagaucuuuugaauuuauuuauauuuauuuuuuauuuuuaaaaaaaucauauaaaaauugcuguagccuugaaauauguuguuuuuuuuaauuuugucuuuuuauccaacuauuuuuuucuuauaauauuuggaaugcaguuuuagaccuucagguuuauugguugugcucacuuaacuuuuuauugaauuuuaaaauuugcuaagguaaaucauguaugcagaaauaauggccuuuagcauuucugccauuuuuauugauauuuuuaaacuaucaguuaccuaaguugguguuuaauuuauaaaauauaguuacggguuuacuugaucucgccauuuuuuguuucuuuuagaauuuuugaugcaggggaaaaauucauauccuaaaugaaacuucaaauaucuaccuuguggaauuuacugucucuaauacauuuugcauuagauuuuuuuaaguuaauauaguuaugucaaagucuugauuuaauuuuuuccucuagacuuagugauuuccugaucuucaggucauccuaguuaaguucucuuuguaguacucauaauuacuugaaauuuucucauucauuccuuuuuuuuauugguuauuuauauuucaaauguugucucccuuccccaugggagcacccucauuuccuuuuuuuuguuuguuuguuuccugucucuaaaaauuuuaauucagugagagcaaucucacuuuguuguucacuauguauccagugucuagagaaaagagccguugguacggaguaaaugccugcugaauauuucuguugucaaauagcucuggcugugacagcccguccuuguuuccuuuucugucauuccacccauuuuccuucuggaaaaauuaugguggcaacguagaauagugaaaauggcuauacuugcuuucuguguuacuuaacagagugaguuguuauaugcugacacugaguugaaaucagguaaauucacuucaucagcuucuucaccauuccugccacuguguguacaugcaugcauacgcaugugcacccuuguguauguguuagucauuguuuuuugauacauugucuuuuuguuuuccuuaaauaucucaugauucaaucaacucaugguaucugcuauacugaauaggaugucucccaagauuggcaagcuuguagcauguucugccucaaacaucaaauucuuuaaaagguccacuaugaaagucucagaaugaaaccaauuauuuguacaauuacugcacacacacacauacacacacacaagguauucuuauuuuaugcuucuuuuuauaaggcugaaaagauaguuggcaagucuuuaaauauagcaugucuguguuccucugaaucacagccauccagaguggaagucgccgucaugucugcuguucacaccgggaaaccuguuaucucauaaauucugguucuaaauuuuugacuucugaauuugccacugaauugucuuuaugaccuccccugguugacguugucccacagagccuuacucuaucccacugugauccucagacuaguaugacaguccucaguauuaccuacagauuugauuguucucuuucacaugggagaugcugugcugcuuaaacguuuuguuuuuguuugugguucugaggccccaccccaaggacucccugaugcuaaacaagcaucuuguccucuuaaagauguuuugaaugcuugcucuuaaaacccuugugcuuggcucucugaguggugggguguuguggucuagguacuccaauccauuaacuccucccaggaugcauuagggcagcaucucagccaccguaguuuuuguaccuuguuaaucucuagacugggcacagccauauuugucaaggguuugggugaccaauggguaccucaaaaagaacuucugcgguugauuguuccccuccacaccuacccuuguaguccaucagggucaagaggacccaggcaauuuaaagaggggccuagcgugccaccuucauguccacuaagccacggggcagccgaccgacauaaagaggaauaagaucacaguggguaaugugccuguggaccuuagacaagagguagaagaauuaucuuggggcuggagaaauggcuuagugguuaagagcacagauugcucuuccaaagguccugaguucaaaucccagcaaccacaugguggcucacaaccauccguaaugagaucugacgcccucuucuggugcgucugaagacaacuacaguguacuuacauauaauaaauaaauaaaucuuaaaaaaaaaaaaaaaaaaaagaauuaucucacuggaaaguucgagaaacuauauuuuggaaagcuacuucauuguaaaagaaaggaacuauuacacagcauuacccaucucugcuucagaucuucucaugaacuuaacagugaugugagagauuuuaaccaugaugugagugccauucugucgggaucuguacgauggacucagucaagcuuaugagcucugcuuuagcauccaaagacuggcuccaccuuugcccggucuggaaaacauuuugcuucuacagacauuaaaugauuugguuccuucuggccauggagacgugucuagaugagccagacaugauguccuccuccacuguucauccuguucaggcaagucaagccaguuaaauaaugagaagacuugggagucuucaccaugcauuauuuccugccugcauaugagucagaauagucgccucugaggcucuuauucucagaaggucaaugucauccaaguagaauuaugcucaucuucuuuggaucuguacauuuuucuacagcaaaugagucacuguggaaguuaggcaagaagcucauuugcuaggaccugugagcgcucugaggggcacuggacucuaggggcaguuuugaggagccauuaguaaaguguuugacaauuaugaagucauugaaaaugccccuauucuuaaguacauuguauaaggagagagcgcucugguaaaauaaagccaagaaccaagcugcccuuuuuuuuuuuuuuuuuucccaagcugcccuuuuuuuuuuccaagcugcccuuuuuaggcagaaaguuuggaggcccucacaccuucucaaccuuucuaaugcugcgauccuuuaauacaguuccucauauuguggugacccccagccauaaaauuauuucuuugcuacuuuauaaguauaauuucugucucccaggagcccaaccaaggcaaacauggcuuaacucaaagaaagaucagucaaauacuugauuuucuccaucucugccuuuggguuagagaggauaaauuccagccuucugucuagguaauuagaaacuuacagguuacgaaguauucuguguuugugcuuugaaagccaccgccaacuugaagcauuggccccucccugggggaaacuugaggauauuuuaccaaugucuggaaauaugccccagaaauuggugaucucugugucccagcuguaguaguagggaacuuguaugcauuuucacagauagccugaagaaaucgcuuaccuucauccuguuuguuucuaggugauuucuccaguaagggcuagaaauuaaacaaagaacagagaugguuuuuugguuuuuugggguuuguuuguuuggucuugacuuuuguuuguaaaugaggaaccgagugguuuuuuagaacucugcaauggcagcagcauuucuguauuuggggguuuugccuucaaguaugucugugcaccacaugcaugccuggugccaggaaggauaucagauaccuugggacugguuacaguucugagccaucacguggugcuaggaauccacccugguucucugaaucucuuuaaccauugaaccauuucuccagcccucagagguugagauucuuaggucgucagaagcuugacaaaugcuugcuuguguguuuaugcuugggaauccaacgcaugaugcugauucuuagggucuaaaauccccuugugauuuuuuucuacaaugcuagagaauuccuucauuuuagaaaaacuuaagcaaaugcauaugcauuuuuuucuagucuuuuaaaauaaacagucuuuacuacaucuguacuaucagcuuagcuacugauggagauauuauuuucacuauagacaggguuaaaaaauuaaccaugaguaaacugagaaagaaaggauuguugaaaauuaugggcugaugaaauaaauagcucagcaacuauuuauuguugaaacacacuauugccuggagcccaccuaguacaguacaaguuuuccucuggcuucugcauacauguacacacaaaacaaguguaaaaaugucuuuuaaaaaauuggaaguuuugaaaguuaaaaaaaaauaagguucaugugcuuaaaggcuuuguuacuuaaacauuuagccaguucucaaagagagaucaaaucaugaguuaugugugugcaguaucagugguaggugcaggauguuugguuagcaaaugcaaaagcuuccggagauaaaguccuuagugugggcaagucagcccguaaaagcaagauuccaaauugauacccuaauuaugccgaaguccacugugauuagaacaacaacaacguaucaguaagaaauacagguuagccugguucuaaauggagaaagaaagaaagagagagagaaagaaagaaagaaagaaagaaagaaagaaagaaagaaagaaagaaagaaagaaaagaaagaaagaaagaaagaaagagagagagagagggggggagggaaggagggagggagggagggagggagggaaagaaagagggaaaggaaaaaaggaaaagaaaaagaaagaaagaagagugcaagcucagaggugcgaguuuccuuuugagguggggugggauugagacaggguuucucuguguagccugagaacucacuggcuguccuggaacucacucuguagaccagacuggccuugaauuuagaaauccaccugccucugccucccaagugcugggacuaaaggugugggccaccccugcccggcagaguugcuaguuuccuaaagcagugguucucagccuuccuaacauuugaauacaguucuucauguuguagugacucccaccauaaaauuauuucauugcuacaucagaacuguaauuuugcuauguuaugaaucauaauguaaaaaaaugucugacauaugacuccuaugauacucaaaggauaucugauaggugacccccaaaguaguugugaccuauagguugagaaccacuucuaaagcuuugggcugcuuuauacauacaagcaacgaauuguaacuuuaggaagugaccuuuggcuaacuggacacagaauuuaguugcacacaccggccuggaauuuucauugcuuuuaacauaauuuaccucucaaccuuguuccguugccugacuucccuucuuugguuugcaaauuugaaauggcaaauaaaacucuccaacuacggagguuuguaaacuauuuucuaaggggaacuucccaguuuacuuucuuucaggaguaaggugguuuucucuugaggucuggcaccuuuugaguaaacugguaguucaucguuggcucugugccaacagaguuguagauuugcuagugggauccuuguguaaguuaguggagaacuguguuacaguuguuauuuaaaugagagcccuaggaggagcucuccuguagaaggcuuggucaaaggacuuccauuguugcugccuucuguuuggaguuuuguuguucuucccuaggucugucuguguagcccacagugaccuugaacucccaucugauugacuagauuauauauguguaugcuaccaugacugguuugaauacuuauuuuucauauauauuuuggcuuuucacuuuuuuuuuuuuuuuuuuuuuaggcugugcguguuacaaaacccaaaaucccagaagccauaagaagaaauuuugaauuaaugugaguaacacucaugggguccuaauauuucuauuuaaaacuguuuguauauuaauguaacagucuagggaaaagauagaaaaugcuuaauuugggauuggauaaauagcuguuuucuguacuuuaguaauauuaccuuuuguuucuuaauucccgguaaauucuacuggauuucucuuuauguaugggcauuuucagagcagcacucagagaugcagcuuguugggagaugauuguuggagauacaaagagcuauaaucuauauauaaauagagccuuggaugaaauaguaauaaagcagagaagccuguuaauguggaaaagacuguccuuuuuguuacuuuauuauuaugauaagaauagauaagucccagggaauucaguaccuucugcuggccuccaugccacugcacacacacacauacacacacugcacagaggcaggcaggcaaaacacccauacauauuuuuaaagggggggggaucuuuuuuuaaugaguagauacuuaguuaguauaaagcuuagggauuuuuuuauucuuuugugauaguuguagggagguuuugccugaguuugaguugacuccuuugucuuuuuaauguguacagaacugggaagaaagagguuaucugccugaugugggauuaguuucuaaguauuauagaggaucucuuuaugauaauauuuaaaauauuugaaauagcaauauucucauagauuauauaugaaagaauaaauacauuuaaaauuuuuggcuguugagaggaaaauaagugaugaaaaaugaaaugaaaauaacuacaaugaaaaauaaaaauaaaugaaaaauaacuacaaaaaucaggacuacaguagaugagggcuggggauguggcucauggcagagugcuuaccugacaugcacagggcugagucucucacacacacacacacacacacacacacacacacacacacacacgcacgcacgcacgcacgcacgcacgcacgggguggggagaugaauauagcaaguuucuagucuaucuuuuguuguacaguuuuaguuccucuguuugauuguagaguuaugaagugucaagcugagagguagauuaugaaucugagcugcuauuagaaguaauuuuugaaggaucaggaagguaucuuaaacuuuacauacaauugcuuccgcuaauagaugaauccuauggguucucuccuuccucccuccaucucucgcugccccguccccucucuuuccuuauucagaagggucauaugcaggauacgcuugcguuacacucucaaaccugcauguuacuguacuguauccccaggaccacaaagcaggcaagguggugggaagaagggaaaggcagagccuuuucugauuuguauguuuuacuucacagggaggcagagaagacaaaacuucucauagcugcacagaaacaaaaggugguggagaaagaagcugagacggagaggaaaagggcuguuauagguacuuggaucuauuugugaaaugaaugacucuguauugugacuuugucccgugcuucaucaauuucauguugacagugaggggacauaagacagcauuauguguaguggagaauucugcaaccuucauuguacguucagauguccuuaaaccuuuaaaguaagugaagccaguagauaguaaaguagccuagcuccuuuucaguuuacgguauaauuucacucugugagcaggaauccauucgggaacuccugcugaagaguucacacuuuguaguuuguucuuacugcagcacugcugugugcugacugccuuuucagugccucugcucgcaugcaggagcuucuuagcagugugacucagcagaggguaugggacaggccuguaccaacucuuuuuccuaagccauaaugaaacuguccaacuccugagagaauuuaagaaauucuuaaagcauuuucacacaguuaauuuuuugugaguuuuacuuuuuuauuauuuuauuuauuuaccuuucaaauguuuucccucuacccaucuccccugcacaagccucccaccuccuuccccuccccuuugccucugagagggugcucacccacccaccuacccacucccaccucaccucucuagcauccuacuucucugaagcaucaagucuccauggggccaaguacauccccuaccacugaggccagauaaggcaguccucugcuauguauguaaagggagccaugggccggcccauguaugguugguugguggcuuagucccugggaacucugaguaguccaguucuaauaauucauuuuuauuauaguuaguaaucuguugguuucuaauagauugaaauuuaaggaaaagguacuuuggggguaggugguggagaagcacuguuguaaaaaacaucccucagggcacaauugcugaguccaguguguggaguguucaguuccucuugcugccaagcugccccuucccugguucuucaacuccacuguccugagcagaguuugaguucuggguucuguacugcuaugcugaguucuccuuucucugugugcuccuuacaccuugggguugccagacuucauaugugcaugccaauucauugauggacagagggucacguaaugucaacuuuaauaucccagauacuuaguaauucuuuauuggauuuaaggguuaaaauaaacgcuguaagguuuacugccuuugagcauccuaugccaauccucggauggcuguuuugaacugauuaugguguucuucguauuuguugaguacugacccuuccccggauuuaugcuuugcaaguaaucuuuucuugauuaguggcuucucuuugaauugagguaucuuugagauacggauauucgacuuccacauagucuaguucaucucaaaucuggugcuuugugucuuauuuuguuuaugagguuuuuugccuccaccaaucccauuuauucugaacauuucagguuucgccucuuguguaugggccuuccauuccccagggauuuggguugauguuaaugugacagagauuuggcuuuaacccaguugucucagacuguugagggcuucaguacuuccucuuuugaaugucguucaugucgcauaguaagauauuauaugucaaagaucucuguuuuguuuaaacucuuugcucugucuucccuguuacuucuugcugcuagaguuuuuccuuagcuguuccucuuagcaauaauuguuaacuauucuuaauuauucugaaauuagccugggcuagcuaggcccuguauucagccaggagacuauaaggaccagcuuacuucuguaaaauacugucaggaauuuugcugaacuacauuggauguagacugauuuggagagaguggaaauauuuaugauacuauuuaugagaaauguacuuuaaggaguaucaaaauuaaagauuaaggagauggcucaggguguaaaguguaagcaauugugaaaaccagaaacacauaaaaacacggagaggacugggugacccacuguaauuucagccucaucaggcauagacgggcuccccagagcaaacgggcagcaagacuuuauagauaaguucuaguuucauugagaagaccccaccuuaaauaaaagggaagagucagaggugacuccugguaucaaccucaucguccaccugcugugcacccacaugcauggguucuacacgugugugcucacacgcacaugaaaacuggaaaaaguauaguauucguaaagucccugauauuugcuagaaauucacuucguuaguaucuggugugggacgcacaucucuaguccuuguacuggggugggaaggccagccugcucuacaaaguaaguuccagaacagacaaauguacagaaaaacagcaaaaaaugaaagcauuccaucccuguguaacccuuuaauuuuguuuguuuguuuguuucuguaauaaguacacucuucuacagaggaacuuuuccuggcugucguugcuuuuguguagcuaucgauugguuuuuaauuagcaacagugcugaagaugcugguauccauaaccguauccuugguuuccugugagcaauggaauuguuuugagauaucaguaagucugcuuucuucugcagagaaacaucacaccucccauuucuucuugucucacugcuuuaagcuucagccuccaaaaggagcaguagcaggccuucugcugcuacaguuccaauaacaauugcugucuuaacauuugcuauuuaaugaaguuucuuucgaccuuugcuugccaagggcccuuauuaagaauuacugaaacuaaguuacuuuuucuguauguggaguugguucuuaagcugcuaauguaaugcgguggauuguauuguuagauguuauauuacuggguuuucuuuguguuacucuaugaaaccuacucggucauguggggaaaguucaccgucacgaccucuuguggggcuuacuaagaauuuugagaauuuuuccuuuuguucccuaugaggccugcuuacaguuuucuuacagauucuuaccauguuguguguauuuguguuuuguuugguguugggauuugcuguuuguugugugccauguuucuuccaagugcagaauaaauugaagagcauuuauuucccagaacauucuguguauggugcguacuguuuccuucucguggguugaauucgugggacccauagagcacugcucuacuauggcuugugcugguuuguuuacaugugcuuugguaaucucuaaccugguuucauucucuguugcauaugaguuuacucuauuauucauuucuuuuuaagguuuggacauuuuauuuuuguugaaaacugucuauuuuauauacuacuucaaaugggguagggauauggacuuguaaccuucccuguggcuuugaagccucugccauccucucccugcccuuacguucuuuguuuguacauucuuuuuguuggagcagucaaaacugcuuauugauuauugaucuuauugauuauuuuuuuggagagcuguguuugguuuugcuugcuugcuuuccugugguauuucuacgaguuuuuuuccuucuucucugugaauuugcucaucgguuuuuuuaagaaacagauucuagaauuagaugcuuuaaccauuggcuuccagugucuccuuuuuucuuucuuucuuucuuucucuucgguuuuagguucuuuuguuuugcuuuguuuuguagugaaucgcguaggaguauacauuuucuucugaggacugcuuuggucuugcaggaugugucuaguggcucuuguuuugcguauauguguucaguguucuuuuuuccauuauaauuucaucuuuaacccaugaguuacauauuuuuucuucagguuuugguugagugaguuuugagagucuaccuuuuuuauuauugauuuucagugucagguacagucagaagauagcauuugcuguauguugcuuguugaaauuuguucuguaagccuugucuguaaaugccccguguguauauaucaccuccguuuguuggaugcagguuucugugcugauugaccgcaucuucucuguucuucucacuuuugucuucugguacugucaguuuacugagaacauuguguuaaagcguucugcugugcucauuguugacuuacaguuucuucuuuauuuugagccuauauccugaagggcguguacauuugggauuguugauuccgcagaagccuuguuacugguuuauaacauucuuuaucccuaaacauauguuguggcgugagaaucaaugcugucuagugauagcuauaugguuaugccucauaacauagcugugcucucuuggcuguuugcuugguguaucuucucauucuuuuacuuucaacuuuucuaugucauuauguuuuaggugugucucuuauaaacagcauauagcuggauuuuguuaucuuauccaaugugagaaucugucuuuuaacuggugaguuuuagucuuuuuauauuuauuguaguugcuacuguauuuagaucuguuguuacucaauuaugugcuauuuaccauguccuuuuuucucuacuucuuuuuccauugugaauugccucuagucauuuuauuucuuuuacuugccuggaaguuuuacauucugugucuggaauacacaacuagucauuacuuguaaaccgguguguaucugacucaguaaaauguaaaguuagucauuuucucuguccucuucucgauaaucuacuguugaaaugcuuuaccgcucaccgccuucuccaguugcacaugccaugguugcucugucccugucuccauguugcuuucccuucccuuugcuuacucucgucguugcuaaggacucucgucguugcuaaggacucccguagugagcauuugcuuucauucagaugugguaaucauccccucugcuucagacaguuuacuuuuuucugcuauuugguuguuuucuuguuuuguuuuucuaguauaggcaaagcuuguucagucuuccuuggucaaaagugcugucauuucauccucagauggcacuucagcucacaguucugcaccacacuaaguuuacauuguugucuggccuccugugugugauuauaagcgugcaacugcacuggauguucuuuuggguacucguucuucugcuuuuaaaauaacugguuguucuccagcucucacuaggcuagcaggcagaguucuuuaguccaggcucuuagaguugcagccucuggagaucuugguuuuauuuggaagucaguucaaauguacaaggccuuucugcuccuguuuggagcauugccuacuugccgcucuuucuugugaaauagucacaccguagcugccaccauacaaauccucagcucucucucucucucugugcccuugaggguuuaguuccugcuaugaacuugcugugcauucuaaggcagaccaauugucuaccaugacaguuucggguauaccugaaaggaauuuucuccuuugucuauuccucugucuggaauccaaaucuugcuguucauugguuucuucccaugaaauggagagugguauaucgcaguuuaucuuuaaacuagaauaauacacauuaauuucacucuauuaaguccugggguaauuuauaaaggguacugucuucuggaaaaaaaaauaaaaguguuuagaaauuuucuuucuuauuuuauguuucuccccagaagccagagacaagauaugcuaaaguaucuuuuggggccuuugggggguuucauaccauagucuacaguauuuuagccccuuauagaaaauggaauguguuucaucugacauaggugcauucucucauauacuuuacuuaucccuguuaaaugaaagcucuacggaaaccguuguuauacuacaccauucagggagugaugacaagaagaaucuuuauguucaguacacacuuguuuuaaaguucugaguguuuuccaucuguauuugguugaaucuucagaugagaaaccugugaccauagaagaccauagcugucauaaucuucaucugaaaaggaaaauugagauguuauuuuaagaauuaugucgauagacuuucaaguguaauuggaaccguuccuguuuggucuggggagcuuugguuaggacagauggucacuaaagguguuuaguuucccugugugcacuuggguauggcagcuucugugcucacugugaacauuuguuuccauugcuaacucauguccuucuuuuccuaugucaucuucuuggugauccugucacucaaaacacaggcuuccuguuguccucuuuuguugucuggcuguagacucucucuauguaggguuuuuguuuuguuuuuuccuuuaucccuauguaauuucuuuuaugcuucauggcauaucccuaccaggucauguccauuguuuccuacaacauguccucuuguuuaauuucccuaauucugccuuucccuugccacuauaugccauuguccuuugucaccaugaguuuguacugcuucacuuuuguaccggucuuuaccucuagccugugaaccguuguuuucuagucucaugaaagacugaaacugcuaaccuuuuauaaccuuccucccacaaagaagaacagcaccaaacuagaacagcaaagaaagaagggaauucccuuccucucaaucguuucagaacagauaaaaccuuggaagcaguuagacauaaagccacauguaauuaauguugcacuuuguacugcugauucuaaguguguuucucuuuguuguguuauuauagaagcagagaagauugcacaaguagcaaaaauucgauuucaacagaaagugauggagaaagaaacugaaaaacgcauuucugagauugaagguacaacagugaaaggcugaaguucugaguguccugaacugccucucugcaucaggaccaguucuugauugucuugugggggaaaaacauaggacaugcuggucuggaggaaguaacuacccugaugcucuagacaaacaacaacaaaaccuauguaauuuaguucucacuuuagucugugacuuucauuuccuuuucuacaaugaggcuuuuuuagcucuuacuauauuuucugaugaaguauaagaauuccuuaaaaucuuuuguuaaaacaaaauaagugucuagagagauggcucagugguuaagaacacuggcuacucuuccagaggacaagguucaauccgcagacccaugugauaguucauaacuaucuuuaauuccaguccccaggggaucuaacacccuuuuguauacauaugaugcucagagauacauggcugguaaaauacccacauacauuaaaaaaaaaaaaaagaaaugaaaugaaaagcuuuuaggcaugugcucaguaagggcaggggagauagcucgguacuuaagaacacguauggcucucgaagagaaucugaguucaguucuaagaaccuagcuuaggcaguacucagcugccucuaacuacagcuccagauggucucuuggguacaaucucucucucucuccuucucucccucccccuccccccucugugugucuuucuucucuuacucucacauacacacauaauuuaaacacauaaauuaaacacacaaauaauuuuuugauguucaaaauaaugaacugaaccaccaccaguuugucacaugucaacagcaauaauaacaaauuagcuggggccacacgccuuuaaucccagcacuugggaggcagaggcaggcagauuucuuaguucaaggccagccuggucuacacagugaguuccaggacagccagggcuacacagagaaacccugucuugaccaaaaaaaaaaaaaaaaaaaaaaaaaauuagcugggaaaaagauacaguccaguuguaaugaaaaaucuaaaacucuguaaucacguagaucuguucauuauugaacccagggccuugcauaugcuagcuaauguggauguucuuagaccauggucuaugcuuauauauagcuuuuucuuaucucucuguguuucuagauucggccuguaguuguuuugccugaccccuuccuggguggaggguaaggcucuaggugaugggaaguuggagggagguggaggacaagggaacuacuuagaacagaaaaugaguuaacuuagaaaggagcuguugguuaacagugaugaacuuuaauuccccuuauaaaggagcuguucugaggauugagaguuuuuaaguuguuaaauuuauaacuuacagugaggcaaacaauugaaauauuaagcaguaaaaaagauacucuuacccagaugagggaauagaguggcaauuuucuuucauugcaaacaugcuguuaccguuuuauuugcuagaugcugcguuccuggcccgagagaaggcaaaagcagaugccgaguauuacgcugcacacaaauacgccaccucaaacaaggugacugcccaugcccuucccuaguaacugcuucuggugugcauucaauaucauggguucuagugugguagaaguaguuguauucaguaucagaaaaggguaguggccaacccaucauugaccaaauacauagcaagacauauugauacccauuguuagggagggaacauugucuguuuuucuaaaaguaaggaguaaagacuaguggauucaugagcacaggucaaaugccaugaaaccauccaucucuccuguaagaaagggcucugagaaguugaagaucuuuugagaaaaugacagaaaaagaggaaaacuaaguuagaauagcuuuccugauaaguuagcuuuucaggauaaaaacugaacuuuacugccuccucucagggacauccuugcagcuucuggggcaagauaguuuuccaccguugaaggcuguccgcgugcuauggugcauuuguguaucugucccuuccugcuacacaccuguaguacuugucuuaacaucuucucucacauacauuuccacaguguaaauuuagaaacaaauuugacuucagaugaagcagaguggaauguugacagaugaaggcaggauggggacuuuccacauccgccaguacaaauuggugguuggagaucuggccagguggaagcauccggaucucacuacugggacugaagagaugguuaagggugcuuguugcacuuucagggggucagaguucaauaucuaacuccuacacugggugacucacacuccaacucuaagggguuagauucuaucuccgccccuucacagccauguacacaugugcacacacaaacauacauauaaacaaaaauaaagugucauuuuaaaaauaaaagacauuauuaugaagaucaaacuuauucugaaaaggguagucauuugauaucaucuugagaacugcuacucauaucaguguguauuaaaggcuuuagaaagucauuuaguuggacuguuugaucagacuuaacugcacuguuuuggcagaugauuagaauccgcuggagaggguggagaugcagugacuaaagaugcugaagugcagagaggaacugaucagcacugcaaaggacaggacagacucaagacagagagcagauuacuagaguaauccugaggaaauuaagaaacaauagaaauggguucuaaaccaaagcaaguuugguugaaaauaucaacacaaaauacuaguagugaggcagaugguguagcucaguggauagagugcuuagcuagcauggcugguccucaaugugguuucuaacaccaccuaaaccuggguguggugacaggugucuaagaucccaguaaucugugguaaaaacaggagaauuaaaaguucaaggucauccugugccucagagcaaguuugaggccggucugaaauaugugagguucuuuuucaaacauuaacuguugguagaagcaguucuggugguuggcaaacauccaucuuaccacaaaugacuuaaacagccaacuuguggauaaaggcagauaugucagcuuaggugauuucuagacauacuccaauucucaaauuugguugaaaaaguugagucacuaagacaccugguuaaacaguugugaaccuaggcuuuuccuuggaaacccuaacacucaucuguugaguugugcaccucucucaagagaaucugaaauucugucauugccugguugaguugagcaugaaacaaaaugcaugcaaacuacucuauaagcuauaaaagaaauacuguguuauuugauccccaaucuauuaaaaaaaaggauaagguuucuccuacauuaagacaggaguuuguuaaagggauuuuagcuaagaacuuagcuauucauaggauaaccacacuccaaaaugaaauagggucacugggaaacacucuaaguugagucauguuacucaggagagcaacuggagaaauagucuucaaggagaagagaugacugcugcaccaaacuauucuaacucuucugcucuuguuuccucacccagcacaaacugaccccagaguaucuggagcucaagaaauaccaggccauugccucaaacaguaagaucuacuuuggcagcaacauccccagcauguuuguggacuccuccugugcucugaaauacucugaugguaggacugggagagaagacucccuucccccagaggaggcccgugagcccucuggagagagccccauccaaaacaaggagaacgcagguugaugcaagagguggaaauguucucccauaucaagaugcgacccaaggggcuaagugggaacagugguuauguggacucguaagauucacagagaaugugugcucuguugugauucucuugucauaguccugguuugccagcugacuacaggauagacccagcugucuggcacucaaacggucucugcagccacaguuuuaucaaguauccuguauguguuccuuuguaaaccgguacucaugaaugagggaaagucugaugcuaagauacugccugcacuggaaugucaaacacuauauaacaagcugugguuuuuaaaagcuauugaauaauguuuacauuggucccugaggacaugugugcucagacauucaagagcuaggaggccagagagaagaccuucagaaaacgguaaguuaaagaagacaagugucaucagacacuugggacccgggcucucuuuaaagucuagucccggcauuccuccaugugauugacagccagaccucuggguucccaggaaauuaucuuccaguugaaugaccauuuacuugauacaaauuguaccuuucuguuuuucuagucagguugguggccugcagggacgcguacuuugccacccgaccagagguuccucgaagauauucccaaucacuaguuuauugcguuaggagacucagagauauagaaagcagcugaaauuuaagggagauaaagccugcacugcaccaaagcuacgggucccuguguuuccucuauucagugaugucaucaaccucacugucccagcccaugugugacuaaagugcccgguuuuagccacagacaacugcuuagaugucaccucuuggcugaccaaagcugggacagggcuuuaaccagacauaggagcagugugcaauuccugauucacugcacaguauuaugucauaauugcaggaauuauuuuuuguuuuuaaaacuggauuuggggcacauucauucaccccaacacuucuaucuaaaggccaagguucuagggcugcuauggucacuaacacacugauucuccuuaaaguaauucucgaaguguggaacaaagugaccgagacagcauccucagucaucuuugucuccuucccugggaugcagauaccgaaguugcuuuuccaacuuucgccuccgcuaggagaucagaaagaauucuugugacuuccugggcagccauugaauucauuuuccaugagaagaugacagaguuagccuguggcuauaggagaucaugucauccagaccuuuuugcccaucacauuaacuuuccuggaauauugugcugcacagguagaccugaaucugcccagcuuguugacagcucuuguguauacuguguugaagccagacagaaaaguaauggggccacuucugaaaccucucagcuguugaucucacagcagcuaaaggguugugccaaacauuuuauuaagaaaguaaagcccagauuugaauggggguuuucccuaggccuuauaguauagaggcauuuguaauauggagaaaauaauuuuucucauuuaauuauagaaauuaccuucaaacagauuuuguguucuuuggcccuucaaauacugguguuacauuguugcugcagauaaaugaugauugucgugggauaucuggaucacugagcucugugcuuucauuccuagagauguuucucauucccauuuagugaaaugcuguugccccaaagugaugguugugggauuucuuaccggucauaggccccggugaggagcagggaagcgccauugugaaagauuaaagaaagcacuuccacuugagcuccuuauggagugagcuucccugugcccacucagugaacuaagucugaccauccuucagggacguuccuuuugguaaauauacacuguaaucuuuaagucuaaauuuauaugugaaaguuaacuuuuuuuaaaaaccuaaauaaaauuauuuuccuaucagugau

SEQ ID NO: 9295 - RNA, 45204 nt, Mus musculus
ucuaccuagccucaucuaggauggcaacuucaaggugugggcugcacgggcggcgccuucugauuggaucgggcuccugcagagccgcagcgcggucgcugauuggcugcgcggggucaggcgcugugggccgagugaacgggagugacccugugggcgggugcugaccgagaguaaccccggcagggacgccacgccuuucccuuugucuccuccgacucuaggcucccgcccgccaggcuugccuaagcagagacagggcgugggagcggaggcggggcugagugcaacgagcgagcaucggaauagcagagagacugaagccuuugcgcacagcugcuuccuucugccucaggucccagcuuuguaagugggguucugugugaggccgaguggaagucucuaggaaaaaaaaaguuuauagauccucgagcagauguggcgaaugugccuuagugacucuggagugaucucuuguaaacauccuuaaacgagaaaaggcuaggcggcuucucccagccuguaccucgguggguaaggagucuagagaccgguccugggacaguuuugacaaugcaaagaggcaacgucaagagugcgcuuaaacacugaugguggggguggaaagugguucagccgcugugggaaaaaaguuggcguccccaugaaagguugaagaauuuaucgcaagaucacuccgaugcgcuccugcuacacacccaaaucaguaauggugcgacaaugcaccuagcagugucgccaguugcacagggccauaaaauuaccaccucacuuuccucauuaugauuaauuuuaauugucaggauugagaaccaccagggagauacaccuuuuugagugugucagaaugggccaacugagaagggcgagagccacccugaauguggguggcaucuugacacaggccgggaucuggacuagauuaagaaaaggcaagaggaggucgcaggcugcugaacgcuggcgcuuccagacuucagauacgcuaucaccucaugcuccugcugacagagcuggagcgccucccugccauagcuuucuaugcgagccaaaaggaaagcuuccuucauugucuggucagguguuuuauuaauagucgggaggaggggagaaacggauauaccuguuucuccaaggaauuaggaaauagacauuggaaaaagaaaauggaucuauuuacaguuuggccaaaaguacggggaucuccacuccuucccaggaguggcuguacaucuuaaaaucuguagaaugggcagaggcaaacauaugcaaaugcaacugugaaccggguuaacuggaggaaggagacuguuccccgggauaaaaagacaggcuguccugguccugugaagguucuaugccccaguauaggggaaugccagggccaggaagagcaggaguggguggguugugggaaaggggggaggggagaggggauuuucggaggggaaacuagagaaggggauaauauuugaaauguaaauaaagaaaauaucuaauaaaaaaaagauugaggaaaaaaaaaaaaaaaagacaggcugugcucgcuggagagcuggcucaguggauaaaguccuuggggcuugagggccugguuccaaaucuccagaacccaagaaaggccaguuaugcucuuaucacgggcucuuaucaugggcucuuaucacgggcucuuaucaugggauaggagggagaggcagaugaaugucagggcagcuagcuaauguggcaacucugaggaagcggauaaagagcauuguucacacacaauggggugcuaauaagaaaaaaaauaaauaaaagaauuucagugcugauuggugcuccgcugucaacagcuguacaaaacacgcuucaagaggagagccagauguggcacucacagauuguaugauucugucccugugaagugcgcaguaaguccagagaaaaaggagcgugcuguugccaacgguggggagcgggcuuggaaggugagugaggagaggggccaguggucaggugguguagugucucuuuggagagagggcauguuuugaaaguaggugugucagcucuacaacacugugaguguacuaauaccauagcgcuguucacucccccccccuuuuuuuuuaucgguuuuacuuuagaagaaaaguaagugauuuacaguuaccguagcuuauaccagugucuucaugggaauggggagagaaacucagcaggauagaauugcuaggaucccaguagggcgguuucugaccugcauaucaucagggcacugaccgaacccucgggggaaucaagaccagcagauuguuggaaaacucaagcacaccaggaguguguggggcugugauucugaucuguaucauuguccacaucaaaauggcuaauuuugguuugugaaaguccacaucauuuaaaauggcuauaucaagaguaaaaggaggcgguguguguguguucuaggucaucuagaauucucuaagaguucauaagaccuacgagcauucuugcgcccucugcuggcauuuuaaaagaaaccacuuuccuuuuucugaccagaaauauuacugauuccuaugaggaaugacccagaauuagaaccucguuggguugaugagcagguccucacgugggcccagaccuaccaggagucagcacagcccuccuacuccuuuauagcucagauagagaagccuagggaggggaaugagguggaacaaccugacugucugucccaagaagaacguucuuuuugucuccagcaacuccaaggcacacucuccauuucucggaccuugugaucauuaucggagucccuugcuccaaauucacugagcaaaauaagucuuugccugcaucauaggaaguuaauauagucacaaaaauuggacucacacucacugugacauuuaccauguuuuguaguaaagacagaaccaaagcacacucgagaccuguucacuucauugcacaccgaccauuucgccacagggagacuucccagcagcccuugagcugagaauguaauaggguagaccauuaaaacucagcugugguuuaauguuuaagauaaucuaauaaauccaagcacuggggaaauacaggcaguggaucucugcaaguucaaggccagccuuggauacauagugagacccugucucaaacaaucaaccaaacaaaagauucuguaguaaguacuuuugcacugaugugaccaaguaacugucagaaauagcucaaggaggaaggauuaaucugggcuuacaguuucagagauggagggucacggcagggaaggcaugguagaacagagcccgucacaucaugggaacacagaagagaaugauucugggaucugguuugccuuucucaagaaccuucagcacaacuaauaaacagaauuaucuguagagauguuguguuguccagaagacauuucaaacaacaauguugaaaaaccaccaauaugccucccuaaggcuggaauguguguaaccuuguggcuuggaacuccagucucaucccuaaaccaaaacagccucuuaaaaccaccuuaccguuucauuuacaaaagaagauucucuuaagagaaggaaaauaaaccagcucacgggauuucaauuuuuaaaccacguuaaaaaauguaggccuuaccuggucuucaaacucugcuguaaauuauguccuuugaggaauauaacguaaaaagccacuggugcgucuauauagguagcuauugccgagacacucauggcagacuuucugagucuucccauggucucugauauccucucuuguuccacucuuguucuuucucggucccuuuucucuccccccucucuuccuuuggaagagcagcaguguucuuaaccauggagcugucucuccagcccccuucuaauuucaugucuuuuaauuucauuuuuauuuuuuauauagucaacaaauuucauuagaauugcuuacgugaucaugagaucucucucucauacacacacagagagagagagagagagagagaaagaagagauugaucauauauccccagggaaggggacaugagucccucuccuaggcauguccaguggugacagacacaauccuggauagaucuuuugcagguaaucagagcugcuguaacuucaagagugcaacggugaaaggccuggaagucagugaucucguccacccuagccuuucccucaggcucuaauguuguucuaucuucuuccccgagaaccccggcuuugggaaacuugaugugggugucgcauacagggccgcgccugucacagucacacaguuucagugucagaggaacugugaggcuccgaauuuacugcuggccauuguaaaagagccaacaaccaaagccgcauguagugucacuuuuaacaaaaucucaaauguucgauuuuaccaauaaagacucuggagccagaugcuggggugaaagucugcuagcucagagaggcagagaaagcacccagcugaccuuccuccauagccaacaucccaaaagagcaaguucucuuccacacccucucaaaacccccucaaacugaaugucccucccuucuacuucuaaugcgucucuccauccguccuccuggcucccucucccucucucuuuuuuuuuucuccuauguucagucccugucaacugguugcuugcucugccucuugaccuaugguugacuuuauuuaaagcuguuuacagaaagcuuuuuggauuaaagaugagugcuagggccgagccacaccacgauuagaagcagucccccccccccccccaguaaauuacacaaucucaggguucacggugugaucaaauaucuugcaacacuaaucuaugggcaaaacuaguuguucagaaagcaauucgauggauauauuacauauaggaaacaacaguaauagcuuccccaguaaagccuuggaacuccacagcuguagcguuuuuaaaaauuaguagcaaugugugugugugugugugugugugugugugugguguauaugggguacauauacacaagggguacacaugugcaggccacaggacaacuuuugggagugaguucuuuuaccuuguuuuugaggcagggucucucuugcccggcuacuccuagguggcuagccaggaagcaucuaggagguucuccuuccugugcccccaucacuccgaggucuauuggaauuacagugggucucgcauugacucaugagucaguggguuacccuccuaccagacuugcuucucucaugcuggugggcacauugccggaccacuugcuuguugaauacagcguccacagcugaggaagaugaaaacuaauugaugaaaacuaaccaacccguguugcaucuuucagcuguuucguuaaaccagucguaugcaacggagauucacugaccuaagauagucauaaaccucacacuuaauaggaaggaacugggcaauaggcaucaggacgcuaugcaggaaucccugacuccuauuaacccaaggaacaaacuggacuaagaaaggaacccagcuuugaaacuguuucagaaggacaucaaggaaaucuucaacccaaacagcuguuucugagaaaguuaucucucacaaucugccuaccaaugcuaucuaucccccagccucuccaucucugccuugaagugggaagaguuucauuaccaagcucugaggcucaagacagaaaggaaggcugccguguggcgugugcugugugccgggcuccaugucugcuugggaagcagcugggucugaucacagaaagaacauuuuuauuuuuuuaaagauuuauuuuauguauaugcguacacagcggccacaccagaagaguucaucagaucccauuacagaugguuaugagccaccaugugguugcugggaauugaacuccggaccucuggaagagcagucggugcucuuaaccacugagccaucucuccagccccagaaagaacauuuuuagaacucauuccuuacaacaccaucucugcuucaggguccucccuggcaugguagcgcuccuccaugaugucuuaaugcaacaccagcucagugccaaggaaaguuuaggguuuuugguuguuuuuuuggugguggguguguauguaguguguguguguguguguguguguguguguguguguguugucuuuccuguggccugaugggaauuaacagagaacauccaggaagagcugguuggauuuggcuugagacaccuacccugaagcucaagagagaucaaggaaagagugcucuuggugggguucuuuaauuuaaaacauuugccgcguuuucaaaggucuauuccaaccuguugcucaccugcagcucuccugaaaagacaguaaaguaauaagaaggguuaagcaauaagaaggucccucggauacaagacuaagaacaggagaauuucugcuuagcaucauaaaagaaaguuuuggucuuuuaauauuugaauauuuuacaagaauauugucuugaaguaggacacuauacaacaugggugcuucuuuucgguauuugaaaaaacauuauuaaaccccuauccagcuggcuuuuggaauagacugacuccaaauucagccacucuugugacucccgucuccaguucucuuaauccuggcuaagacaguggccuuggacacucucuuccggucguaagccaggcccagugcagccaugcagucgaugaagaacguggugaaguugaugugccagcgguacucacuggcagaguagucguaggggaaggcauggugguaguuguggaagcccucgccugcaacagaagcaaggagagcagucaggggccuagccaaggugggacuucauccagccauuagggcucauaguggcuucuguugcugcugcuucucagagcuuugaugcaggaggguggugcaggggaguguccaucaaauaggaccccuauaauaaagauuucuuguuucaucagcuauugauuuuuuucugaaauuuaugauuuuuuuugaguuacaguuacuuguaaacaaaccugaacauuuaauucaauauuuuacacaaacauauugcaagauauaaaaacuguuggagucagccuggcagcucagguuggauacaaagagcucacauaacagugcaagucugaaaaauuguucucugaucaccacacaggcacuguagcauguaccauucuccucauaucagccacacagcugcguagccaugcagauacacacacugggguggcuauucuuauuuuuauguauguauguauguauguauguauguaguguguguggaggugaacggucucaugacaacuuuucucuguguagcucugguuguccuggaacucgaucuguagaccaggcuggccuugauucgucugucugccucccugugcugagauuaaagacauguaccaccaagccccauuugugauggcuauucuugguugucaaauugagaauaucuggaauuaagugaaagucugaaaugacugaacacaccagcaagggaauuuuugccuaaguaaaucauuugacaauggaagaaccacuacugguccagaucuuugaggugggaagacacaccccucucuagcgugggccacaccuuugcuggaagucuagagaagacauagaagaaggaaacuccucacucugccugcgaguccucacccucccuagcaaguuucucucgucacuggcuuacuucaggauuccagcuagcaggaacagcagaugagaccuccagccucuagacuaaucaacuauuggguucuuggccuuucuguucauaggcagucauugucagaguagcugaaccacagcuucuaagucauucuaacauauauuauauauuauguacauauaacauauauuuauucauuuucuaaguucuuuuauucuagagaacccugacuaauaaacacacacacacauucauacacacauucacacacacagucacacaacacacacacauaaauauuccuuguguaaugcgauacucaaaacauuuuucugaaauuucuaauuuauuuagaugaaaaugugcuauauuuguaacacugaauauuuagaucaauauauugcaagaaauauaaacugucacuucaagaagaauaaaaauugcuggacauuaguggugcaugccuuuaaucccagcacuugggaggcagaggcagucaaauuugaagccagccugguuuacagagugaguuccaggacagccagggagaaacagagaaacccugucucgcaccuccccucuugaguuauaacaagacaggcaaacucugaagucuggauuuauaacauuuuuaaguggcacugccuguaaucccagcuccauggaggcugaaccaggaggacaagaaaguucaagucucgccaggacaaauuagaaagacuguauuucuaagguaaagauaaaagagcuagacaagggcuggugauauggcucagugguuaagagcgccgacugcucuuccaaaggucuccaguucaaaucccagcaaccacaugguggcucacaaccauccauaaugaaaucugaugcccucuucuggaguaugugaggacagcuacaguguacuuacauauaauaaauaaauaaaucuuaaaaaaaaaaaagagcuagacaaauagcuuauugguagauuucaaggacagccugagcuacagaguaaaugcagggccagccuaggagacuuagugaguuccugucucacaauguagaaaaccguauugagggcucagggaugucguucagggcagagcacuugcacaaggcuguaaguuucauccuuagauuuuuuaggaggagugggaugaaggcaaaagggaagagagggcagaggagagagaaaagcugaagggagaggagagaagaaauugaagaugugaauggcaggaaucaggagagcagcagaugaagucagagaggaaugagaaggagcggagaaggagugacaaagcaaggugcaggccgcuaccuaagccagcgaagucacaagaggcuggaguugagagcguucacaguagcuucauucacaaaauaaagcucacaguccauagcugauuuacuuaaacauuggugaauggaagagcacacauaguggagcugcugcugcugcugcugcugguggugauggugguggugguggucccugaauaucuugguugggggugcaaguucacaccacaccagggagaggagcgaguacucugagaaugguucacuuuuaagucaacugaacaaagcuaugcuuguuuccucuuucccucauauggcaugacuaggcuuauuguauucuccguugaucuuacuguucuauguaugaaucaccugauccaagcaggaauagccuagucccaagaacugaaucagagauguguugagaaaggcccauuuggaaagcuuuuuuuuuuuuucccuuccaaucaaaggcaggauuuuuuuuuuuuuuuaaauccuuuccccucuuacauaaagagugaugcuuagccaggaauaguagugcaacccuuuaaucccagcacuugggaggcagaggcaggugaauuucugaguucaaggccagccuggucuacaaagugaguuccaggacagccagggcuacacagagaaacccugucucgaaccccuccccccccccaaaaaaaaagagugaugcuugacucucauguuuuccccaaugccacaaccucgaguuuuacaauggaagacaugagacacuaagcucccuuaagaacaggugccucacgucuuucucgacgcucaccgaauaaagaaaccacugaauguuaaaaugcccaucguagacugcugacuaacuuacccauacuucccaaggaaaccagggcauucugccggggaucgauguucuuaucguaggggcgauacccguagaggugggcggcacuguucaccagccaaguggcguugagcaccacagcguaucucaguaaaguggcaacauaaaaacuguuuagaaaagucucgccccagcaguaccagggcaccagcgugggcaggaugaagcacaucagcagaaugccaggcuuguaguaccuguguggagagaacauacgcugagucuggagaaaauuggcuauucucagugggaggggcuguuaacuuccucuuacagugagagaacgagguagaacgagguagaaaaucucaguacagaguguuaucauauuuauuuauuuauuuauuuauuuauuuauuuauuuauuuauuuauuugagccaggguuucucuguauagcccuggcuguccuggaacucacucaguagaccaggcuggccucgaacucagaaaucugccugccucugccucccgagugcugggauuaaaggcgugcgccaccacgucuuuaauaagucagcacauaagucuguguugagcagagauuguccuaaauuaauuccaccaguuaacagagcaggagcuccauuguucuuacucauagagggaugaggucggcuacucaacaaaccaggaccaaaccccauucucagccguucugugcugaggcgcuguuucacuccuuccuaaucucaccuccacacagaacaaaccgcugauuccgagagaaccgauuggugucccuucagcaguaaugucuugaacguuccagucacuggcaugaccugcauucagcguucucauucucgugcucucuuucuaacgugaguccuuucugguagcauuuugucuaagcuccgccccacaguuaccuggcaacagccaggugcgccugacucacuauaaaaggggcugcuugccccuuccgcucuauuuugcucuucuugcuccugcucugucuccucgccccuucuccccgucccucuccauucccuuuccccccccucucucuccacgugaucauggccgucccucuccauucccuuuccccccucucucuccacgugaucauggccggccuucuccuucucucccucuccccucccccuccccuccccucccucuccucucucccucuuccccucccuccucucucccucucccucucccccucccuccucucucucucucucucucucucucucucucucucucucucucucucucuuucuccccugcccucuuaacuccccuccccaugcccugaauaaacuuguggcuggucagggaugccucaggauggguccauagaggcaccuccuucccccauaccugacuaccccuccaccagaacauauuccuucucucuuuaucuuuuuauaaaacacaacauucuccacuuguuaaccuguguucuuccuuaccucacgggcugcauaccuucuucgccugaccugacauuggccuuuugaaagcagggcucuguuuugguagcacccguuguuggagaaauaaacucuuccuuuucaaccacuuugauucuaucuguagcucaggcacugccggugacaucugucuguguuaccuucuuuuccucucauuucuuuuguaggucaaggggacagacugcuucuggauccugcaugaagcuuuaauccacuuuccuauuuuuggucugcacacagaucuuuccauuguuucugaugcugcauuuucauuagccuuucuuguucucccugaaugaucucuggcccuuucugccucucgcaguacagacaguauuuugcuuuccuucaugauaucuucgguauuauacuaaaaucucccagagguuauggacuuaguugaauucaucgugucuaugaauauccccagucagugaauauuugcuccauuuaauugguuuaaugaaaucaguucagagagagaggaaagagcaacacuccaugacuuuggacauccaagcaauuaaaaacuaggguuuaaaaugaucuguuuguuuuguuuuauugaaacagcauaauacuuuauagcccuggcuguccugcacuucacucuguagaccaggcuagccucagacccacaaagauccaccugccuuugcauuucaaaucccgggacuaaagauacgugugccaccacaccuggccaaugugcucuuuaaaauuauuuuuauuauuauuauuuuuauugauguauauguguguaugucugugugaguaagugccccguguguuccugugccucugaaggucagaauggggugucagauccuuuggagcaggaauugugggaguaagucacccaguaugggugcugggaucugaacuaggguccucuggaagaagagaaagugcuuuuaacugcugugccaucucuucaguccauagaguuaucacuauguagcucuggcuggccuggacuucacagaagucuaccugcguuugucuccccagugcugggauuacagacacacuuggcugaaaugaugcuauuggacagauaaaccuggaaauuuauucagcuauuuuaaggacuaagagaaaugagaucuugaaaccucaucucucaagcuccaccccucagcccccacucaccuccucuggaacaucaccagcuucucggcuuucaggucagacauguccaguuuuccgcccuucucuuugacagccggguguuugcgcacaagcagccaacccacgugagagaagaagaagccacggcgggaauugugagggucggcguguguuucugagaacuuguggugggcucggugaucucgggcccauucauacacgucauucuggaagcacaggaaagaggaacccaguauggagaagagaggcccuccaaggagccugcaagggucuagaugucugcaagggcuugggacucuuagcgcaacucucagagucuuagggacucugucuccaaggaggccuuggcagcacccucucaggcacacaugcccgugaaacuuaugugaaaaagcaauuugaagaccccaaacaaaagaacgcuguugcuucccaagguuucgugguggguagauagaagguagaucuuaauguucagagaguuucaccaguagagaacauggugucuccuuaugcaaguaacaugaaacaggguuccuuucaagguaucugaugggggcagagagauuaugaaacagaaggccuuggaccccaagauucugcuuuguugcaaggcugcaaaaacucuaugucuuugccaucacaagaggguugucacacacguaacccaagaggacugacguccgagauaggagcaugggcacauugcugaaugaccucugagcuuuucugaacuuuauccauuucuucaagcaugugcuaaugugucauucuuuuuguccucuaaacauagagacuggaagccuucaccauacacauugucagagcgaggugaucacacacaugauaagagccucagauauugucaaggcaaaguaauuaguuuucuaguauuuuucccccuucucuuccaagcuaaauccuauucuguaagcagccuauggcuaggugagugucccucuccuaacuuccuauagucuauccauuauaagcuuguugcaagcgcuguccucagugcuugaguuauccaucaugguagcccuuuaagaucagcuuauuuaaagucucaguuacuugguuuccucaucuguuccauggguggggcaauaaggccuacuuccuggcauccugguugugaggacuuaggagaacuccauguuaaaugcugguccagcguccagugcauggagcuauagacguguuugcucuuauuaccugaaacaagggaauucuugagucugggacacaugccacuuccuauuacaguagaguucaaagacaaucacagcaaagcaugauuuauuggugacugaguguuuaaggaaccacagugucuagaugauauucuauggucuuuuaaaccaaaaggacuacaccagccauacuacauuauaacccagggaacuuaggguucaaagaaaguuaugccuggagaaccuguuccaccaauuuccuguuucccuucccagugaccuugagaugucccauguuguggggaucucaauacugggcauguacuugagaagacucugaagacuaccuuucuguguucugaugcccaccacucugcccuggaucaugcauagagcagagacacaagaaagaacagcaucagcuucuuaccuggaacgccaugguguuggcaaugaugaggaagauccgcaggggcaggcgugccuuguacguucuguggcuccacaggcgauggacuccggcuccaaugcccucaauacugaucacauaguagacaaacgcuguugggacagacaacagaagagucagcuaacugcuaaguguccaagaacacccucccgauaccagaguuugcuacuuaggauuugaaggagucuauggguuacucuuugagacaucauagcauucagccucaccaaaaaaaaaaaaaaaaaaaucaccuccuaccacuccaccuaggaauggacgugaguuaggauaacccaggcacaaagugggcggaaaagcaggaugcugcaaagaagacagguugucggcguugucggcagcauuauucugcuuucauugucagaccacugaauugcaaagguucuaugcccuuugaccuucagaucauuuuccccagggggguucaaggucaucaacuauuccagaccuaaauacucauaaccaagaauguuuauaaaauagcagucagaguucaaccucaauugaagggaagauucauggaucauggggccaugacuguuaaccuguugcugcugcagcguuucagcccuguagcagagggcuugaguauguacucgagcaggucucagggcgagucagcccugcacagucacauuuacacagagccucaagcuucacugauccuuaacauuauccuauguugcagcauagucaauugcauugugaaccccaaggcugugaacuggaaaaaccuuguuaugauauggcucagcccuugcacacacaucuuuaauccaaagagcuuucuguaaacagaauuaaagaaagucaaugauaggucuagagguggagaaagcacccagcugaccuucuuacuucacccacauccuagaagaaaaaggcucucucucuuuccccacacugucaaauacgguucaccucagagacccgccuuucucugucuugggcuuuaauauguucacucccugucaaaugguugcuugguccaccucuugacccaucacugacucuguuugguuuuuucaguucacaaucuugggguacacaaugugaucaaauauccuguaacuuucccccuuuuaucuaaauaaaagacccuuucucuaacgucaauaaacuauaaacuaucugguaagaauuacauucauaauguccaguccuuuuguacuuggcagccuuggagaaaguacucuacuauccuguguuggugagccucaaguucuguaccugaaucacuuucuauccuaaauugcauuuacuaaccuaaaaacaucuuuuuagaccuuaaaagguuuucuuucuuucuuucuuucuuucuuucuuucuuucuuucuuucuuucuuucuuucuuucuuucuuucucucuuucucucuuucucucuuucucucuuucucucuuucucucucucucucucucucucucucccucccucccucccucccucucucucucucuuucuuucuuuuuuaagauuuauuuauuuauuauauguaaguacacuguagcuguccucagauacuccagaagagggcaucagauuuuguuacagaugguugugagccaccaugugguugcugggauuugaacucaggaccaucggaagagcagucggcgcucuuaaccacugagccaucuugccagcccaaaagguuuucuuaaaucuuaaacaacuuaagcuuaacugugagaccauaacuaucuagucuucaaccccaucagagaccugagaaggauaaauauuaccugaauaaacagaaaauacagagcaagcaccuuuuaaaacuauagaaaugacagagacagcugaccgccugagcagucaccaagauuucuccgcaguguuggggcaaccgucucuucagccuacuggcccagaauaauaauagucugacacauuuuugugugaaggagaaguuacgaagggcuucucugucuuguacuggcagaauucagcaguugccauuuuuuguguccuacuuguccacagcuuguacagcauucugucagcaguugaggcaagggcaggugcuugcccaguggcagcuugccacauuugaagcaaacuccauaaggagaguccucaauagucaucaucuuugaaauagaaugggguacugccaggagcugacaugucuuaauaaaacaucuuuaaaugccauauucuacagauauuuuugaagaccauccaaccaccucagcauauaugaauaggaaacuguugcuuaucucuauuguggucugacauagcugugaccauuuuguaccaugccugcuagcuauuucauauuguugcugugccguugccugccagucauugacauagggaagugacuuggcucagagcaaggacaugcugaucacacgcccuguuuguucuguugguucugaauguucuguauaagguuggcuaaucuuaagaaacuccacaaagcuuuacauaggucccaucaaaucaaaggacaauaugaaguguuaugccugcaaucucuugggucagaggugaccaccgggcaguacaucguguaccugcauaugagcucauugugguuuuauccuuugugagcugacagagaaagauaaccauugucauaguucagauaauucugagcuaugucccugguccaaccaguaucagggugugcuguguguucaauaaccuauucuugcuuaacugagaucaguguucauaugguuuguguguugauugcugaaccccaacauuuggugcauuggcaggaacacccuugggcacuccucagucauuguuaggaaacgccaccucucucuccuaggagguaaguuucucuccaaggagguaaguuuccugugccugcgaaguucuuuuuuuuuuuuuuuuuuuuuucuuguuuugguuuugcuucugguguuggagacccaaaggugggcaacugugcacagcaugagccaacacagggaaacaggucucuaaagauacuguuaaauuaggauaauauuuuaugcaguuccuguccuagauaucagacuuauaaaagauaggauuuaaaacaauguuucuuuaaugaggcacuaaaacuguacuuucaugcauugguaugcaagaacuuuucucuucucuucucuucucuucucuucucuucucuucucuucucuucucuucucuucucuuuuuuuuuuuccuuuuucuuuuucccagacaggguuucucuguauagcccuggcuguccuggaacucacucuguagaccaggcuggccucgaacucagaaauaggccugccucugccucccaagugcugggauuaaaggcaugugccaccacugccuggcacaagaacuuuucuugcugauagccaaacuuccuaacaacaaaauaacguacuugauauuuauuuuaaaaacacuggauuuugcuuaaucuguuaaaaaaaugguuuugucuuuaaacauaugguuacauuguuagaccuuugcuuugucuuccaaaaauuaugguuagucugugugacuucauucuuuaaaaaacaaagaugcuucauuuugauauugcaaaaggaacuuuaaaaacuuauaguuaaauauauaaagcuauaggacauuuuaaauuauguugaauguuuuauuggaaugucuuuguuaauguauguugguuacaaugaaggaggaaauuuuugugaaaauagcuauaaugguaacgauaauaacuuuagaacuuauagugaaccacagcaaucaaacuagggacacaugaaggggggacaauuauggagaaaaagaaaaagcucaggcagccccugugauggugggauggucggaugccagauaccagagcagagaguuuuaaaauaaaacagaagugggcuauaguucuuagcaggaggaagaaugagaagaugccaggaaagcuguagguuccuugcagacagucgucacgaaugcauaaauggaacuauaaaaaucugccagagaaggaaccaugauccauggucaggagaguuacugcagcuucugguucaggacugucauacccacaguuugaaaaaaaaaauagcuauugauuaaugaauaagguggcagauauaagauauauauauauuccugaggccuuuuuauauguugugguuuuugucuuuuucuuuucauuacaucagauauuuccucugugaauuaggguaaggaugucaggaauaaaaauuaaggaauuuauucauuuaaaaucuuuuuuagagguuuacaagaucaaaaaaguuaagaaucacuggccauggaauuuauuuccaauuccuuucaguuugccugagcuuaggcaaggcuccagaagucaccucuuuucagccaaaggaguugagccaagcugagaagaguccuauuagccaagggcuuugccaucuuuccaacuuguuaaccguuuccuguucugacacuggcuucagcuuaaacuaaaucguaugggaaacagccauguucugcuauauucuaccagauaaaggucaaaaaaacuucuuagucucuuuaugggauaugauuugggguuaaaaaguuuuuauuuugguacuagaggaguuucaauucaaagcuguaauuuuuaagguucaaaccuaacagagauugaugucaguaaccuugaaaauggucaaauccuuuaauguguucagaaauuuuuguaagguacaauuuagagcagcaaaaaaaaaaaaaaaaaaaaaaaaaaaaacaaaaaacaaaaaaaaaaaacaaaaaacaaaaaacccaagaacaaacaaaagauuguuuaacucagauaugcuagguagguacuagcccucaaagaagucagaaaucugcuaaauauggcauuuaauauguuuaaacuuacuaugacagacaggaacucccaaaucauaacagugaccccauaaggucuccaagaagacgugggcacaaugacaaaggacuccauugggauuaggguaugauaaucacugggcauaacugccccaaugccuugccugcugccagagccuagccugaacuguggauaaacagaggacaauuggagaauugacugccacacacugcucaaguucaaggugaggucagucucucugauguuccuccuccacaggaaaagccucuucaucuucugggccucaugaccaaagacugccucugcccuacgugccauggagaccugggagcccggguugguaacugucucgguaauuaaaauauggacuagucucugucauuucgauugauacauagguccaucuggguuauaauacauccuucuucagaccucugaucacauugacaacuuaacagcuaaaagaaaaaaaaaaacaaagaaaaaaccaacaggcaguuagcuaucuccucaccuccagguacuccaccacuauguuauuaaaaaugucaaaaacaggcuugccuugccacaggcuucauauuaaaugacacucuuaauaaucaacucaacugucugugucucauaauaaguuauuggaugaaaaaauauaaaaucuaaaauuuacuuaagaucugaaaaaaguguuuauaggucuaaaaaaaugauugagauugauaauacagaugacaaagguuagaggauauuaaaaaaacuugggagaugauaggaaaauaauuuaaaaagauguugaagguugauaaauacaaauuaaaaaugggagagucugaaagauguuuaauauuugagaaucuaagaagguauuuuaagauauauaaaugcaaguuauaaagguauaaaaauaauuuaaaauaaaaaugggagauguucaaaacucccccacgugcuauuguuauuucaauguucaggauucugauauugaucgauggaguucugaugagcugaugggacaucgucaguuuccaauuccgucacaagcucacgauuuuaauuccccuuugguugucuucugaguauaugcuuaaagaugcuucccaucaugcuaaaaacaucucuguccagccugcacaccggguccuuuggacagaggagagaauggucugugccuucuaaugcaaaccuacagcaauuacaaggucucaaaggcaucagucuauuccagcugucuaacagacacuacuuuuuucccuaaaauauggauuucaguacaaugguaaauacuaauguccauccuuuuguaaacuaaaguucauauaagcuucagggaaucaagaaugcuaagacuuggacccaccugccacagaccaaauggacuccagauaaguguaccugccuguucuugaaaaugagcuuuucccuuggucuuggaauuccuuaccucucccaauuacuagacgauucugauuuccguuccuacuccauauuugugucagcagguuuuucaccuggcuaacagacuccauccagugaucaccuguggagcugcugaacuccggacuugcuaaaagcugauguuaaccaguccaacugaugugauggcuccucgucuuucaucuggauaaagcuaaguaaaugcuucuaagaaacgccccauugccuagccuuccugggccccuuggacaagguccuaaugucaacaguaagcaguuacagaaggaagauaugacaucuguccauuaucccaccuuacuggcugaaaugcugagucaaacaggaacucccccaggcccacucagaaaaggacuccacuuugucauccugaccaccccauggccacgaaaauagaugggauccaauccuggauuaaucgcucucuucugaaguucaccacccccuuccccaaaacaucuggaucccagcaauggguuguuagacaacacccacagaacccguuaaaaaucagacagauaaaagauuccagagguuugcuuucuauuucauguugccuugggcugcugagggacaugcuccaguacaacacacaugaacaucgauuagaacuacggacggaagccuaaauaacauugcuuaugguuccccccgcccucacguuugacguauguaaauuguuugggccaaaauggaacaggugcccaaaggccacaaacauauauguucccucauucucuaggucuuuggauauaggauccagaauauggaaaauacuuuggccacccuucagguauaugccugccccucaguugaagacccugacuugcaggggacauggugugugcuuuugugauauguggggcgauaaagcauuagcuuccuggguaacugauaaagauaaguauauucagccacagaagguugagucagucuagaaaacuugggaagaccaaccccacucaaauuaagauaaaaaugauacaaaugauuuaugagauacaggguagauuugggggcuccuccuuuaugcaucugguaaugacccugggaugauauucaccauccagagaguccaggucacuaggaacagggucuuagacaucagugguuccaagagaauguuaaugcccucucccuguccuagaaaggacaaggucucucugcuuauauaagauaucggucucaguaccugcaacaccguaauaauguacagaugcuaaugcaggaguuuccccuuacucuuuaguaccgccaaaaggcacuugguuugcuugugccuuggcacugacccccuguaucagucccuuuagcaucacugaaacuucugaauuuugcauacuuguacaucuguagccucugguacaguauuauccuggagaaggagguuagggacaccugggacuucuacaccauucccagauggccagggcagugccaacacuaauaaugccuuuccuaaaaagcaugagcauagcaagaccuaccagcaugagagaagcaacacuuaugaagggagaucaaaaugucaaacauuuaagccaacaaagacugauauaaaaguuuguccuccuggccucagaaaagaauuuuuuuuucugagacaggguuucucuguguagcccugacuguccuagaacucacucuguagaccaggcugaccucaaacucagaaauuugccugccucugccucccaagugcugggauuaaaggcaugcgccaccacgcccagcaucagaaaagaaaaauuuugagucaaugauuugacucauugggacagcucaaaaaaggguggaaugcuaugguuugacaccucccccuccaagcauagcuguagccauuuuguaccaugccugucagcuauuucauauuguugcuguaacaugccugccagauacacagaagugacuuggcucaaggacauacugaccacauacuguuuuguucuguauguucugaaugugcgguaugaguuuugcuaaucuuaagaaauuccacaaagcuuuguguaggacccaucaaaucaaaggacaauuugaacuguuaugucugaaaucacuugagucagagcugaccacccggcaguacuuccugugugugaacucacuguggcuuuugugguuuuauccuuugugagcugacaggaaaagauaucuguugucauaguucugauaauucugggcucuguuccugaucugaccaguauuaaagugcagucaauaacuauucugaguaguuaacugagaucaguguucacgccguuuguguggcgaugucugaacaccaacagucucuagcuauuuacuauccugguaaguauguugaugaaguuaaaagcuaaguguucaugcaggguccgagcacugauccagucucagcuguaucauacauuucauaggaaugcagcacuccaacucaaagccuacaagaucagucucucuaaugcggaguggacacuggguguacccaucuguugcucagauugguagaacuaggaggugggacugaggccuuguuaguaccuaaaggccaucuggaaaccauagaaccucugcggcuacagaacuuagcugagauuggagauaccaaacauugcacaaacugcuaugugucccucuguaucaagaguuaacgguuuucuaaguggucucuuuccuccucucuucugccuccugugugucaucugguccuucuauaggaccucaggacaaccauagagauggugucugcccuagggaagggcugaccguauccuucugaacugggaugaggccucagaugguuugcagccucugacucaguggugacuggggucuucccaugaagaggaucuaacuguaccuggacagagaagccaguggagggcaaacccugacgucacaggaggaaagggaaggaaggcuuaaagcagagccagaguaccaagaaaaguguccgaaucugcuccacacugcagaucaccaaggcgcauuggcuccagaguacagacaaugcuaucuuaacaggggugcuggagugacaguccucgugacauggagucaugaucuuauucugccaauugcuuuggucacgaagguuguauuagucaggguucucuagagucacagaacuuauggauagucucuagauaguaaaggaauuuauugaugacuuacagucggcagcccaauucccaacaauuguucagucgcagcugugaauggaaguccaaggaucuagcaguuacucagucucacgcagcaagcaggcgaaggagcaagggcucgagcuagacucccuucuuccaauguccuuauauugucuccagcagaagguggagcccagauuaaagguguguuccaccacaccuuuaaucccagaugaaaggcguagcccagauuaaagguguguuccuuaaacucggagauucaaucuucuggaauucauagccacuguggcucaagaucuucaaaccaagauccagauaaggaucuccaagccuccagauaagggucacuggugagccuuccaauuccggauuguaauucauuccaaauauugucaaguugacaaccaggaauagccacuacaauccaccccuugucaacuugacacaaauaauaucucauguucacaugaaacaauaacaagguuguaaauacgccuaacaugauauaacuauuccucguacaaucgcaaacgcauuuguaaauuuacaaugggcauucauauuacuuuauaauccucguuucugcaacugguuacguggccuuaauugguauuuauaacuaccuuccucuacuacccauucuguauuuccuucuccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccuacacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaauggaauguuuguuguagcuccugguaggagcauuccccucucuggagccaaaacuucuaggccagcagaaccuagaguuauggggacaggaagcaaaaauuuuccuagagggucacuaggagugauaguaaguggaacuauuccguuuuccaccccuugauuccuggacccaugaauccuggcuauaggugaaacuguaccauauaucgagcgcugauucaaagcauauacugccuucugaagaacucuaccccagccuuccaagcuguuaccaccuaauuggcgcuguaacugcgucuucaaaaggccauuccaucuuucuaucagaccagcugcuucaggaugguggggaacgugguaagaccagugaauuccaugaucgugggcccacugucguacuucucuggcugugaaaugaguuccuuggucagaagcaauacuguguggaauaccaugacgauagaugaggcauucugucaguccgugaauggugguuuuagcagaggcauuacgugcaggaaaggcaaauccauaaccagaauaaguaucuacuccaguaagaacaaaacgcuguccuuuccaugaaggaagugguccaauguagucaaccugccaccagguugcuggcuggucaccccgaggaauggugccauaucugggacucaguguugguuucugcuguuggcagaucuggcaaucagcagcagcaguagccaggucagcuuuggugaguggaagcccguguugcugagcccaagcauaaccuccaucucgaccaccauguccacuuuguucaugugcccauugagcaaugacagggauggcuggggagagaggcugacuguccacagaacgggucaucuuauccacuugauuauugaacuccuccucggcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucagugaauaaucguacaucuggccacuucuucuuacaaacaaacuguaauaccauguguacugcccgaaguucugcccacugugaagauuucccuucaccugugucuuucaagguugucccagaaagggguuguaaugcugcagcuguccacuucugggugguaccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugccgaugaugguagagcuuugcuccaaaaucccaaaggucuuuucugugauucaccuacaggggccugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagauauacuguuggccuugccaacugaaagcaaauugcuucuggugguccuuauggacagguacugagaagaaggcauuugccagaucaauagccgcauaccaggugccaggagauguguuaauuugcucaaguaacgaaacuacgucugguacagcagcugcaauuggaguuacuaccugauuuaguuuucgauaaucaacugucauucuccaugauccaucuguuuucugcacuggccagauaggagaguuaaacggagauguggugggaaccaccaccccugcgucuuucaaguccuugauaguggcaguaauuucugcaaugccuccaggaauacgauacuguuuuugauucacuauuuucuuuggcaaaagcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagcggaaccuggccaccccuucauucaagggguucuggaucugcaaacugucucaagucuggaaauugauucacuggccgagauugcuguuuaccacgaucuaauguagccuuucuuucauuuggcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuagaaucaccuugucucgggcgauucaaugcugccaccuggcccuuguuaccucggaauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccauggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuacacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccaucccauguuguaggaucccauucuuugccaauuagagcccuuacuuuaacugucgacacacucugaggcugagacuugaauuuucgcuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauaguugaaagugcugguggaucaacaagccaauuccagaauuuuaaaagauucauccuuguacuucuguuacucuagaaccacuccugguaccaacuucuguauuagucaggguucucuagagucacagaacuuauggauagucucuagauaguaaaggaauuuauugaugacuuacagucggcagcccaauucccaacaauuguucagucgcagcugugaauggaaguccaaggaucuagcaguuacucagucucacgcagcaagcaggcgaaggagcaagggcucgagcuagacucccuucuuccaauguccuuauauugucuccagcagaagguggagcccagauuaaagguguguuccaccacaccuuuaaucccagaugaaaggcguagcccagauuaaagguguguuccuuaaacucggagauucaaucuucuggaauucauagccacuguggcucaagaucuucaaaccaagauccagauaaggaucuccaagccuccagauaagggucacuggugagccuuccaauuccggauuguaauucauuccaaauauugucaaguugacaaccaggaauagccacuacaaagguccuuucccuguccccagggaaggauuauauguguccacacugaugguaaaagagcuuuccccucaggugaguguugggaagguuugcucuuuggcccucagucuugucagagaggucuuaauccagagggcucuacugaguggcucucaaaugagagaaaagcuuuucaaaauccccaagucaggaaaacggagcauguacagccaggugcuaaugaugcaccuuuauugcuuugggauaaaaccagaaaagccucuaaaacugaaaaguaggagagaacuccaucugagaccaagaugcugaaggcagaauuuuguaacccacauuuuacaacagucauucugagagcuaccuaaucuacccacgagggugcaggggcaagagggcaagucauuuccugugccagcuucugugugccaaauuucuuuacaaaaucauagcacacacuaacgggcagggcacugaagccagggagcacaguccuguguuuggauggcaaaccuuuucuuguaguagcaacugaugucacccaagcacaggagauuuggucaaacacugagcacugaauggggcauguaagaaagaugcaggcuggagagagaguuugcagggaaucccuucaugcccggucuuucugcuucugaaauaucauugccucggcaaguaacuaaaaaacccaagauccuacaaaagggaaucuccuauggugugucuucuuaggggacugagugaauuuucuaauuuucuucuucuucuucuucuuuuuuuuuuuuuuuaagauuuauuuuauuauaucuaaguacacuguagcugucuucagacacaccagaagagggcaucagaucucauuacagguggcugugagccaccaugugguugcuggaauuugaacuuaggaccuucggaagagcagucagugcucuuaaccacugagccaucucuccagcccguuggguggauuuucugagacaaugcuuaaggacccaaaugucaccaacuucaagauagaagaggucuggggcagacagaauaacaccagucuuucuacaccaauacauucugagagagaguugucaaagaguuccucacaucugacacuguucacccaccccucaaaccucccaggaguaucuaggaaaguauggagggcucaccagcccucauagccccugggcugcagagcuccuuagagucagggcugguguggaccaaaagccuucuucaaggcuugauccucugacaugccugucucugccaagaaaagauggguagagggcagagacaacugaaguuagagggugcuagguucauggcaugcuauggcuucaggaaaaagggacagcuguaggcuggacagagagcaggaugggaagcacccuguuauguaaauauuggaaaagcaucuugcugacuggcaugggccacacccugacgaccuaccuggaguagcagagccacaggccugcauacucgaguguuagaggagccugccucacccuccuccaggccaaacuggccuggucuggccagagacuaaggucugaaugguuguaaggauaaccaacucuguuuuguacuuuuuccuuuuccauggccucuucuccuuugcaguauacccugacuuguuccuugacugggcucacucagcauguagcucaugcuguugguaugguaccuuauucccauguccccuagguagggccugguucucucauggcaggcaggaagggcugggacaggcagccaaauaagugauauaaaaaugugugccaggcuguugguuaccuaggugcugcauugcuaccccagagugagcccuacacaugguuucagagcuugguccccagcacccauguuaaaguacuuccaauaauuaaggauaugacacagugggagaauaccuggcuaguaugcccaaggucauggguuuaacaaacaaacagcaaaacaccccaggcugcuuuugccagagagguuagcucaggauguaaucccagcaggcugaagcaggaggauuaccauggguccgaggugaaccuggacugcauagagaguuccaggacagucuagguaacacaaugagauucuggaaaaucaaucaaacaaaacaaaccaguuguggugauggacacuauaaugccugcacuugggaaguggguccagaaaaucagagacuuaagagcauucucugcuagagagaguuccaggccagccagggccacaugaggaccugucucaugagagaaagagagaaagagacagagagggagacagggagagagagagagagagagagagagagagagagagagagagaggagagagagagacagagagagagaggagagagagagacagagagagagaggagagagagagacagagagagaggagagagagagacagagagagagagacagagagaggagagagagagacagagagagagacagagacagagagagagagaggagagagagagacagagagagagaggagagagagagacagagagagagaggagagagagacagagaggagagagagagacagagaggagagagaggagagagagagacagagagagagggagagagagagagagagagagagagagagagaggagagagagagagagagaaaacaagacacucuugcuacccaauccaaccgggcuguguucaguuaguuuaucaagaaaagguuagggaaaccuggauacagaggggccacugcccauugcaagaauguccuucauuaaagaggggggagaaacuggagacacucacugacccagaacaaugaaagguacuuaccgaagaggcagguguagagcuugcaggagggaaccagugugaucccguacagggcucccacgugcagcagggccaugagaaugauguuccuccagacguacuccagcuugggcgggggccccuccucauccugauagguggggucguauauaucuucuuucauuucaggacggaugucuucuuccagguagaggggcaccgucuucaccuucucucguccauucugcaggcuuccagagggaggcgcugugaugguggugguggucguguacgaaggcgucaucuaugaggacaaggaaggagacuuaggagagcagacuccagaagaagacacuccccucuugcauacagcacuagggugcauuagagguccaaucccuucuccagggucuggcuuaauuaaggcuugguggaagaggaagugagcagaaacuguagagacugguugucaaaccucgaggugaaggggugaaccccuuacaucacugcaagccaaagaaagccucacauguacgcauaaagguacagauagaaccagguuauucuuuaaagcuugugaaacaaaaauuuggacuucaaguguccaaaaugccacccauaucucuaccaauugauggcaguacaaguuagaaauggugauccaggaguuuccagcagucucucccucaccuacaggacaccuacagguccugggagcaucaacucgagauuccagugcccuaaagggaaaaucauuuuggacugaauuccuguacuaguugccaacagagcagaccaauccaaagugaggcuguaaccagaauuguuagggucaaacccaacgcuuuagcagccuccagcaagcugggcuaggucauccgucaucuguccccagcaucccagugaaagagaccauagugaagagcgugagacagagauuuacuucauguggccauauuguuacuauggaaauugacauuccccuuuugugguuuaguauggcuaaugaaagaacuuaaaaguagccauaaaaggaaacuuaaggaccaauuuauuauuagauuuugaaagaaaaccagcaaagcaggcaggcuguaaaucucggcagcuacuagaaggaggaagauggagaugaugggggagaaggcccugaguuaggguccaagaauacaggcauagucagcaauaagguuggcaagccugccgggagggaggcagugguguugagugcuacagaaggcaagggaaaagccuaaacugucugggaaaacuuuagggucuugguugcuaaccaaaaaaagagaaagaaagaaacaaaguuacuccuuuugagauagaacucagaaaaacaacaacaacaacaaaaaaaaaaaacaggaaaacguaacaguguggcauugaagaaguucuguaagcagcugugcuucaaaaggacuucugagaggcggaaguguaguauggcauuaagagauguauucuuggggacuaggcucuuuaacucuguauuuugacugguuguaguuuucuguaauggacucuaucuguagcaaaaagaaauuuccuugauagggcugacggugaggacuacacuuauuuuuauuuauuuauuuauuuauuuauuuauuuauuuauuuauuuaauguaaguacgcuguagcugucuucagacacuccagaagagggcgucagaucucguugcagaugguuuugagccaccaugugguugcugggauuugaacucaggaccuuuggaagagcagucagugcucuuacccacugagccaucucaccagccuaaggacuacgcuuauaucugguuacaaaggcagauauguacagaauguaguuaggaaguauauuuguuuaguagagugcuaguuguagguucuucuccaagacucacgacuucacuggucucggguaguuagucaucugaguugccaguagcagacauuaguuuccucuuauugagcuguuggcuacuaccaagguaugugcaccacuacuguauucuuaggguuaucaugcuaugcuggucauuguugugguuuauaggugucaugguuggacagggccauugguuauuuccauccuuuggaagcuuccauggcgacauuuaguacuuauggaagcuaguccucagggaagaggcuuuugggucaguuccaacucagaggucucagcccugugucugaaguacauggugucuuuagcaguagacuagucuuccacccuugggaggcauucaagggcaguagcaauagucuauaauguuguaagagucuuuugagcgacucugaccaacaacucaaaagagggcuuuauuagaaccuuuuugauuaaauguuuuagaguuuuguuuuagaccacaaucacuaguccuccucuacacaaaugucaaguauccugagaaaggaaucagacaagcaauaccguccacaacaaccucucaagagugagugaaagacaaguacaaugaacauuuuaaaucauugaaaaaaagaaaugagagacgauaucaggagauguaaagccccccccccccccccccccgccgugcucauggauugguaagauuaauacugugaaaauggccauccaaccaagagcaaucuaugaauuccaugcaaucuccaucaagauuccaaagcaauucuucacagaaaccagaaaagugaucuuaaauuucuauggaaacagagaaaggaggaggaggaggaggaagagaguccuauaugacaacagaacauaaacaaaacaaaauaacaaacaaaaucugcuggaggaaucaccagcccagauuucaagcuagacuacagagcuauaguaguaagaagaaaaugacacuggagugaaaauagacacacugacuaauggaauaaauuuugagcaucuacauauaaguccaaaacccuaaauccauuaacguuugacaaagaggccaacaauauacauuugagaaaagacgccauugucaacgaauggugcuuggucaaacuggauagcuacaugaagaaaaauaaaugaaacaaaaugcuuuucucucacccugcaugaaacucaacucugaauggaucauggacuacaaccuaugaacugauaaccugaaacugacagagaugaggaaacuuggaacacacuugaacuuggcacaggaaaggacugucugggugagcccucaguagugcagacauggaaaaugggacaucgugagacugaaacaucaauggacacagucuucgagaaaauaggcaguccagagucugggaaaaauuauuaccagcuacacaucugacagaggguuagucucuagaauauacaaagaacucaagaacuaagcauuucaaaauuuuucuuuaaucucagcacuugggaggagaggcaggggaauucuuuaacuacaaggcuagccuagcccacauacugaguuccaggagagccagggucacauagaccuuuaguuauuaaaaaauaauaaaugaagaaaaaagagaaacaaaucagauguaaaagugggacauggaaugaaguauaacgcuuucaaaguaaaauacaaauggcugagaauuuuaacguuaacagggacuggggagaugacucagcaauugagacuaauuguugcuuuugcaggggaccuuauucagcgcucagcacccacauagcaucucauaaccauuuguaacuccacuuccaggggaugcaaugcccucuucugaccucuguggacaccaggcaugcauuuggugccuauguuacagacagcauacaugaaauaaaaaaaaauaauaaauccuuaaaaacaaauuuuaaaacguucaacauucucagccaccagagacaugccaaucaaaacugcuuugagauuucaucaucaaucagaauggcuaagauaaaaacaaacaaacaagcaagaaaugaugaccaauucuggcaugguuguggagaaaggggaacacacguucagagcugaugggagugugaccuggugcggccaccaugggaaucaguauggaaguuccucacaaagcuagaaacgggcuggagagauggcucagcggucaagagcacugacuguucuuccagagguccugaguucaauucccagcaacugcauggaggcucacaaccaucuguaaugggauccgaugcccucuucuggugugccugaagacaacuaccuacaguguacucaguuacauaaaauaaacaaguaagcuuuuauaaaaagcuagaaacagauaugaugcaugauccauacacccaaaagacuacauccuacuacagagacaguugaucaucaggcucauggcugcucugcucacgacagcuugaaaaucgaaacagccuaccugccagucagcagaugaguggagaaggaaauguaguucauuuauacaguggaguauuguuuagcuguuaugaauaauggaauuacgaaauuugcagguaaauggaggagccuggaaacaaccauuccgauugagguaacccagguauccaggugcagaagacaaaugucauauguuuucuuucuuucuuuuuuuuuccccugguguucaauuugaauauuuagauuuaucuauuuuguuuggacugucuacaggaauuaugaagaggucaggggggugggaaguagagagagcuuucaaagagaggaagauagucacagugacaccuugggcuguaacggggaggagagccacaggucagggcuggcuggcugagauggcccaucccagcagccuuucugucugagccagcugccaguguaguagcugacugaagagucuggcagcuaugcgugagaugguggccagcuguggcugaaagggggcagaagaggcaaguagccaaggggaaaguccuggcccuuuagaugcuagccaguaauuucucuuuuuaaacaaccugucccaaauagcucagcagcuauaguggcaacgggauccacgcuggugaaucagauggcuccuggauuugugcugcuuuacccaauggcucggccacacccuccugugccugcuuuuggggggccauuucucuaacuacccagagucccaaaugggcucccuuuaacuuuucagagguuacagcccugagauuuauucaggauuuaaucugucauguggacuauccacauacauguguuucagaacuugcuuagaaugagagcaaauauaauuggaaauuaauugggacccaucuccugggugcuugagcccacaauaauggauauggcccaauuacguccucacauccuacaaggguaucuuuaucccaugauuagcuauagcuuuuccaccucuggguauguucuaacaaccuagugacugucagauagcuuucagaugaaagcugaccaagaccuaaagggucaugagacugcaucugaggucuaucccagaguuuccugcuuugccaaaaccugacucuucgguguuuccucaauguacuuagaaagagcuugauuuaugacuuucuuuguccuguuauuguaaaaaccuucauaaaacuacuucuauauugggacauugaaauuggggugccacagucaaucauauuugguuccagaauaaacuuccucccauccccuuggagaaaucaguugugauuuuauaucaauaauaucauuuuaugugaauuacagacuuaauagauaucucauauuuauacacugcauauaugaauauucuuggaaaagaaacuuauaucagaaauuuaauuuaaaaucuuaagccagcaauagugcuccucaccaucaauccuagcauuugagaggcagagacggacagaucucuguggguuugagaccagccuggucuccauagcaaguuccaggucauucaggguacauaguaagaccaucacaaaaaaaaauaauuuaauguacacuauuuaaagguauuuuugaauaacguaaagcacuuuuuaauaaaaucucauuuucuuuuaccacugacuacuaaagacacugaaccaagauaauccagaccugacauuuuucacagcugcacaaauuacaguacagcucuucucugcgcuuagaucccuucaugguuaguuaccaacacagcucaaaucuccuuccaagaagaugcccuacauaguucaguaggauuuaaguuuacaaagacuaggcuuaccacacaaaugacagucacccaggugguucaacagaacucuaauggcucagaagagcccaccaaacaaguaauccagucuucccaucaaacaaauucuugggaguucaaguuagcucagaaugaagcugaacagccuagaaaaacuucucacugagaagagaaggggauccagguccugaaggcggggagagcagugguaagaagcagccaguguuagccaaauggaaaaguaagacaucucuggcucccucucucaaucuuuucucaaagacaggggacuuccaacagugccaaacuucccaggccccucagaaaagaccagaaucaggauaguguugggucagggacaggcaggaccacacgggacuagaacuaucaaucacauguaucucucgccuucucuuuaaaccucaaccucauaccaggacucucacaaugggcuucguggucacuggauuuccugagccuugucccauuguggccgcauugaguaccaugccaaauucugcuuuucaucauuaauuugacucuuuuaauuagcuucuugagaauagguagcugagccuggcuuguuggggcacaguuugugacccuaaauccagucacacauugcccagccaugccagcucaucuuugugaguauugacacgaggauuauauuuaaauagaaggaaagaauuauguagaauuaaaaagcuccagucagcugugaucuucccuggcacugaccccucgcucucaacacugugaaaucucuuccuagaagacaaccuugcccuccccucagcaagagauuccugggaagggaaugcuuuuaacucuuuugggguauguagccaaagggaaggauucuauugugcauuuagaauagcucucuucccgccaggguuauuauauagugggaccccuagagcugagacuuuuccguaggauucuggaaugagaaaugagcccaccuaggugguacggggaggcuauuuaaguggcaguaaugcaggucucaugcuuggaccuuucuuuaaaagagcuuguaaaaccaugggcuaaaguuucaggauucugauuccuggcucagaucaaaaccaacuaaaccuacuaucggguucugcguccuacaucugguccuagguggagaugugacaugccgaacugucugguaggaccgagaugagguaagacagggcagaaguuccuccaucuuguauucuugcugaagccauuucagguuugucuagaacuaaaucuccucgauggggaauucuauaguaaauuacucaacucuauucuaggaaccccccaggccaagaugucccagcuggcuugucuuagucucuguuagaugucugccugcuuguugggaacucccuccagcucacugcuuaucugagcuucuguuaaacuguuugcuucugagaaggagcaagaugcuaguccuugguuucugccuucaaacccgcugugcuccggacauuugauguuacacuucaggccugaauaccugaguguagucucagcuagcuggaauaaagaauuucaauuugcuauaagcugugucugaguggugaguuccccauaauaggacacauacuuacaugucaaacacuuaguuuuuuuuuguuuuguuuuguuuuuguuuuuuuuuuuuguuuguuuuuuccuggagucagagucucucuauagcccuggccuggcugcccuggauuucacuauguuccaggguagccucuacuagaccaggauaaccuccaauuuacagaaaucugccugucccucucuccaaaaugcugggauuaaaggcaugugccacuauaucuagcuaaaucguauuuugagauuaucuagcccaaggcuuuccaaacugucccuuucuauaagaggcaaucauaaugcccuguuagucaccuaguuagguaauuauuccucagagagagacuaggauuuagauagacacccuaauagacaggcagauagagagaggggccaaggcuaaguaauaaaaggugccgaauguccaauaugaacagcuucuuucucaccuuucuauuuuaagaucuaaaacuuggcaacuuaaaacaaaggcccuguugacuuuugucuuccugcuuaugacugacuuaaauucauggcaggaucaggucauguuacacaacauguuaagccaacuaaggaugcuaucuuuuaucacagcaguagaaacuccaagauagagcuacucuugcaaaggacuauggguuccaagcacucagggggcucacagcugccugguauccaccuccagggcaucuggugcccucuucuggccuucaccagcacauaacccacguacagacacauacauaauauauaaaauucccuaaacuuuuuuuugaagacuacugugacuacccaucugggugguucacaaccuuccuuaggaacccaugaaaauaaagaagguaagcagauagccaauguuuugaccucuguuccaggucaucgaguuccuguagggugaugagacaccucugaaaggauccuauacuucaaguaaguuacccauucucuuaaucaaagacaaaggugguguacauucugcagaggagagucauugcagaggaaaaugcccucagaacuucuaaggcaagccacaccugauacagggucagcaagacacuacuacaucccaacagaugacccaaucuaaaaaaucuaaaagaaaaaaaaaucuaaaggagcuacaaaguuccuuccaagucccuagggagccucaacaaaccccaacaaaacacucuuaaucacugagggauggcucagugauuaagagcaccagcugcucuuccagaggucccgagucaaaucccagcaaucacacgguggcucacaaccaucugugaugggauccaaugcccucuuuuggugugucugaggacagcuacaguguacucauauacauaacauaaauaaaauauuuuucuaaaaaaagaauuugauucguuauuguucucugagacuugaucucucuacauugcccuagcuguccuggaacucgcucuguagaucaggcugaccucaaacucacagacaucugccugccuccucuucucuaauguugggguuaaagaaaugugccaccaugccugggcuaggauagauuauuaagaagggacaaauaccagauucauucucuccaugguccccuguuagcugcaagguacucuagguaggacaccacacucaccccagcccuaucccuggugcaggaagaucauggguucaggccaaucuuagggucauauaaagggccugucucaaaauguauaaaugugcaacuuuugauguuuuuauuugauauuuucagaucgcaguugccaucagggaacugaagaggccuuggcugcuauacugugcggaugugagcugcagcuuuuagguuuuccccuggugcugggucguaggcaaguucuccguguugcagauuuugugucccugcaauuaccucuuagauauauccuguacuuagguaggaaggaguugcuggcuaaguaugucaaggagaucucagaacuaaaucacagguugaccaguugacuuguuuugaauguguaagagcauuuaagacacauguuaacuaaaauuaauucuucaggcagaagauacauggaacugaacaugccuugagaaaacacccuugcaaggaaggaaggaauacugugaaagucugacaagaccaaaauuccaagguguuuccucuuuagggucuuagcucugagagacccaagauucacugcaaaaaaaggaaucuuuuaauuucuaaagagaugagcuuuccacccaccagcuacccuuguauauaucucaauuucagacacuggaaccuguaaauaccaacaaaaguggcuuaauguaggccaggacauggguucauuugcagcccuggggaagaaagacucaaauugggucagccaaggugcaugucaauguucagaaauuucuggaacaaugcuaaacaaaaguccuucugucucuucuuaaugauccuuuccagggaugcagagaaggcucaguggggaaaagugccuacugagggagugugagaaccugaguucaaauccauagaaaccacuuuaaaaagccagcaacaguggcagaagacucuggacuuguacagaaaggggagguggagacaggagauucccagaagccaaucagcuaaccuggcacacacaauggaaaaacagacugucuccaaaaaacaacagcagcaaaaccccacaaaaggcagaagguaaggcccaacaccugaggguuuucucugaccuacauguucuauguaugcgcacgcacgcacacacacacacacacacacacacacacacacacacacggggggggggagagagagagagagagagagagagagagagagagagagagagagaagagacuuaugaaacagcuaaauuggaaaaaaucaauucuucaagauaagucuuuuuggcaucuaauugauuaguucaaacaggcuucugaauuauuuguaggcucaacuguuugcuccuucauaaaauucuuuauauuuuaugacuucuuucuuccuuccucccuuucucucucccucccucccucccucuuucuuucuuucuuucuuucuuucuuucuuucuuucuuucuuucuuucuuucuuucuuccuuccuucccuuccuuccuuccuuccuuccuuccuuccuuccuuccuuccuuucuuucuuucuuucuuucuuucuuucuuucuuucuuucuuucuuucuuucuuucuguuuuucaacauaagguuucucuagcucaggcuguccugaaacucacuuuguagagucggcuggccucaaacucauagaaauccaacuggcccugccucccgacaguugggguuuaaggcaugugucacuauuaucuaggucuucuuuuuccuuuuuuaaaugucugcauccauuuggguuucuugugacccagcugaggaacacauauaaacuuaaaucucccucuacucaggacuuucuuagagaguggccaucuugauaggccaaccacaaaggucuagcaugaauagcuuuccuucagagacgaaccucaagaccaggcugcagcaaagugucaagugcauuuguaagguuguccuuuucauuuuaucugcuucuuucuugccuaagccaggguuuuucaauugcucaauaggguuuucaguugcucaaauaccuuucccauauuuucaaagaacacagugcuucccaauuagaucuguaaguuugcuguagguuuucuuuuugacaagcuuaagaaacacagguuggggguugcagacacuacucagugguuaaaaugcuugccacacaagcaaaugaaccagaguucagcucuccacaacucaugucaguuauguugggcauggaagcuggccuguaggucugguggaugguaaaacuggcuagcaaagcuagccauaucagaggguucuggcuuaacugugaggauuugucucagugaaucagaggaaucacugggauggggcaguuaaaaacauuguauguuuuuugcagagcaaccagguucaguucccagcacccauguggaggcuaacaaccauccaucaccugauucccuauucuggccuaucuggauacucauacacacaugaagaaaaaccauccauaugcguaaaaaugaaaauaaaccuuaagaaugaucaacgaugacccccaacaucaaccgugggucucuacacucauauccacauacaagcaguuacacccacacacaauaugccucuaagcaugcagacacacaugcacacacaugcacaguacaaauacacaugacaaaggaaaaagaagaagaaaagugggaggaucaaaucugcagauuagagucccacauccucaaacaguggaaggcggcacagcuuuuuaaaaggaacucucagaucuuccacaccagguaauuuacuagaggcccagucugggcuugcacacacuggaagggauccauugcauggaagcuuaccucuucuugcagcaggugcccuggcaugcugguucuuggaggccgggaagaucuuccaaggauuuaaaguuguggcguuuggggcugcagggcagaggaggcuucuguugcagauccuguuucugcaaaacaagcuagguguuggcacaaaccccucccgugugccuuccacccagggugguuauccaaguucacccuugguguguguaugugcgcacgcgcguacgugugugaguccucaccccaagcguguauguguguguguguguguguguga

SEQ ID NO: 9296 - RNA, 22397 nt, Mus musculus
agugcaacgagcgagcaucggaauagcagagagacugaagccuuugcgcacagcugcuuccuucugccucaggucccagcuuuguaagugggguucugugugaggccgaguggaagucucuaggaaaaaaaaaguuuauagauccucgagcagauguggcgaaugugccuuagugacucuggagugaucucuuguaaacauccuuaaacgagaaaaggcuaggcggcuucucccagccuguaccucgguggguaaggagucuagagaccgguccugggacaguuuugacaaugcaaagaggcaacgucaagagugcgcuuaaacacugaugguggggguggaaagugguucagccgcugugggaaaaaaguuggcguccccaugaaagguugaagaauuuaucgcaagaucacuccgaugcgcuccugcuacacacccaaaucaguaauggugcgacaaugcaccuagcagugucgccaguugcacagggccauaaaauuaccaccucacuuuccucauuaugauuaauuuuaauugucaggauugagaaccaccagggagauacaccuuuuugagugugucagaaugggccaacugagaagggcgagagccacccugaauguggguggcaucuugacacaggccgggaucuggacuagauuaagaaaaggcaagaggaggucgcaggcugcugaacgcuggcgcuuccagacuucagauacgcuaucaccucaugcuccugcugacagagcuggagcgccucccugccauagcuuucuaugcgagccaaaaggaaagcuuccuucauugucuggucagguguuuuauuaauagucgggaggaggggagaaacggauauaccuguuucuccaaggaauuaggaaauagacauuggaaaaagaaaauggaucuauuuacaguuuggccaaaaguacggggaucuccacuccuucccaggaguggcuguacaucuuaaaaucuguagaaugggcagaggcaaacauaugcaaaugcaacugugaaccggguuaacuggaggaaggagacuguuccccgggauaaaaagacaggcuguccugguccugugaagguucuaugccccaguauaggggaaugccagggccaggaagagcaggaguggguggguugugggaaaggggggaggggagaggggauuuucggaggggaaacuagagaaggggauaauauuugaaauguaaauaaagaaaauaucuaauaaaaaaaagauugaggaaaaaaaaaaaaaaaagacaggcugugcucgcuggagagcuggcucaguggauaaaguccuuggggcuugagggccugguuccaaaucuccagaacccaagaaaggccaguuaugcucuuaucacgggcucuuaucaugggcucuuaucacgggcucuuaucaugggauaggagggagaggcagaugaaugucagggcagcuagcuaauguggcaacucugaggaagcggauaaagagcauuguucacacacaauggggugcuaauaagaaaaaaaauaaauaaaagaauuucagugcugauuggugcuccgcugucaacagcuguacaaaacacgcuucaagaggagagccagauguggcacucacagauuguaugauucugucccugugaagugcgcaguaaguccagagaaaaaggagcgugcuguugccaacgguggggagcgggcuuggaaggugagugaggagaggggccaguggucaggugguguagugucucuuuggagagagggcauguuuugaaaguaggugugucagcucuacaacacugugaguguacuaauaccauagcgcuguucacucccccccccuuuuuuuuuaucgguuuuacuuuagaagaaaaguaagugauuuacaguuaccguagcuuauaccagugucuucaugggaauggggagagaaacucagcaggauagaauugcuaggaucccaguagggcgguuucugaccugcauaucaucagggcacugaccgaacccucgggggaaucaagaccagcagauuguuggaaaacucaagcacaccaggaguguguggggcugugauucugaucuguaucauuguccacaucaaaauggcuaauuuugguuugugaaaguccacaucauuuaaaauggcuauaucaagaguaaaaggaggcgguguguguguguucuaggucaucuagaauucucuaagaguucauaagaccuacgagcauucuugcgcccucugcuggcauuuuaaaagaaaccacuuuccuuuuucugaccagaaauauuacugauuccuaugaggaaugacccagaauuagaaccucguuggguugaugagcagguccucacgugggcccagaccuaccaggagucagcacagcccuccuacuccuuuauagcucagauagagaagccuagggaggggaaugagguggaacaaccugacugucugucccaagaagaacguucuuuuugucuccagcaacuccaaggcacacucuccauuucucggaccuugugaucauuaucggagucccuugcuccaaauucacugagcaaaauaagucuuugccugcaucauaggaaguuaauauagucacaaaaauuggacucacacucacugugacauuuaccauguuuuguaguaaagacagaaccaaagcacacucgagaccuguucacuucauugcacaccgaccauuucgccacagggagacuucccagcagcccuugagcugagaauguaauaggguagaccauuaaaacucagcugugguuuaauguuuaagauaaucuaauaaauccaagcacuggggaaauacaggcaguggaucucugcaaguucaaggccagccuuggauacauagugagacccugucucaaacaaucaaccaaacaaaagauucuguaguaaguacuuuugcacugaugugaccaaguaacugucagaaauagcucaaggaggaaggauuaaucugggcuuacaguuucagagauggagggucacggcagggaaggcaugguagaacagagcccgucacaucaugggaacacagaagagaaugauucugggaucugguuugccuuucucaagaaccuucagcacaacuaauaaacagaauuaucuguagagauguuguguuguccagaagacauuucaaacaacaauguugaaaaaccaccaauaugccucccuaaggcuggaauguguguaaccuuguggcuuggaacuccagucucaucccuaaaccaaaacagccucuuaaaaccaccuuaccguuucauuuacaaaagaagauucucuuaagagaaggaaaauaaaccagcucacgggauuucaauuuuuaaaccacguuaaaaaauguaggccuuaccuggucuucaaacucugcuguaaauuauguccuuugaggaauauaacguaaaaagccacuggugcgucuauauagguagcuauugccgagacacucauggcagacuuucugagucuucccauggucucugauauccucucuuguuccacucuuguucuuucucggucccuuuucucuccccccucucuuccuuuggaagagcagcaguguucuuaaccauggagcugucucuccagcccccuucuaauuucaugucuuuuaauuucauuuuuauuuuuuauauagucaacaaauuucauuagaauugcuuacgugaucaugagaucucucucucauacacacacagagagagagagagagagagagaaagaagagauugaucauauauccccagggaaggggacaugagucccucuccuaggcauguccaguggugacagacacaauccuggauagaucuuuugcagguaaucagagcugcuguaacuucaagagugcaacggugaaaggccuggaagucagugaucucguccacccuagccuuucccucaggcucuaauguuguucuaucuucuuccccgagaaccccggcuuugggaaacuugaugugggugucgcauacagggccgcgccugucacagucacacaguuucagugucagaggaacugugaggcuccgaauuuacugcuggccauuguaaaagagccaacaaccaaagccgcauguagugucacuuuuaacaaaaucucaaauguucgauuuuaccaauaaagacucuggagccagaugcuggggugaaagucugcuagcucagagaggcagagaaagcacccagcugaccuuccuccauagccaacaucccaaaagagcaaguucucuuccacacccucucaaaacccccucaaacugaaugucccucccuucuacuucuaaugcgucucuccauccguccuccuggcucccucucccucucucuuuuuuuuuucuccuauguucagucccugucaacugguugcuugcucugccucuugaccuaugguugacuuuauuuaaagcuguuuacagaaagcuuuuuggauuaaagaugagugcuagggccgagccacaccacgauuagaagcagucccccccccccccccaguaaauuacacaaucucaggguucacggugugaucaaauaucuugcaacacuaaucuaugggcaaaacuaguuguucagaaagcaauucgauggauauauuacauauaggaaacaacaguaauagcuuccccaguaaagccuuggaacuccacagcuguagcguuuuuaaaaauuaguagcaaugugugugugugugugugugugugugugugugguguauaugggguacauauacacaagggguacacaugugcaggccacaggacaacuuuugggagugaguucuuuuaccuuguuuuugaggcagggucucucuugcccggcuacuccuagguggcuagccaggaagcaucuaggagguucuccuuccugugcccccaucacuccgaggucuauuggaauuacagugggucucgcauugacucaugagucaguggguuacccuccuaccagacuugcuucucucaugcuggugggcacauugccggaccacuugcuuguugaauacagcguccacagcugaggaagaugaaaacuaauugaugaaaacuaaccaacccguguugcaucuuucagcuguuucguuaaaccagucguaugcaacggagauucacugaccuaagauagucauaaaccucacacuuaauaggaaggaacugggcaauaggcaucaggacgcuaugcaggaaucccugacuccuauuaacccaaggaacaaacuggacuaagaaaggaacccagcuuugaaacuguuucagaaggacaucaaggaaaucuucaacccaaacagcuguuucugagaaaguuaucucucacaaucugccuaccaaugcuaucuaucccccagccucuccaucucugccuugaagugggaagaguuucauuaccaagcucugaggcucaagacagaaaggaaggcugccguguggcgugugcugugugccgggcuccaugucugcuugggaagcagcugggucugaucacagaaagaacauuuuuauuuuuuuaaagauuuauuuuauguauaugcguacacagcggccacaccagaagaguucaucagaucccauuacagaugguuaugagccaccaugugguugcugggaauugaacuccggaccucuggaagagcagucggugcucuuaaccacugagccaucucuccagccccagaaagaacauuuuuagaacucauuccuuacaacaccaucucugcuucaggguccucccuggcaugguagcgcuccuccaugaugucuuaaugcaacaccagcucagugccaaggaaaguuuaggguuuuugguuguuuuuuuggugguggguguguauguaguguguguguguguguguguguguguguguguguguguugucuuuccuguggccugaugggaauuaacagagaacauccaggaagagcugguuggauuuggcuugagacaccuacccugaagcucaagagagaucaaggaaagagugcucuuggugggguucuuuaauuuaaaacauuugccgcguuuucaaaggucuauuccaaccuguugcucaccugcagcucuccugaaaagacaguaaaguaauaagaaggguuaagcaauaagaaggucccucggauacaagacuaagaacaggagaauuucugcuuagcaucauaaaagaaaguuuuggucuuuuaauauuugaauauuuuacaagaauauugucuugaaguaggacacuauacaacaugggugcuucuuuucgguauuugaaaaaacauuauuaaaccccuauccagcuggcuuuuggaauagacugacuccaaauucagccacucuugugacucccgucuccaguucucuuaauccuggcuaagacaguggccuuggacacucucuuccggucguaagccaggcccagugcagccaugcagucgaugaagaacguggugaaguugaugugccagcgguacucacuggcagaguagucguaggggaaggcauggugguaguuguggaagcccucgccugcaacagaagcaaggagagcagucaggggccuagccaaggugggacuucauccagccauuagggcucauaguggcuucuguugcugcugcuucucagagcuuugaugcaggaggguggugcaggggaguguccaucaaauaggaccccuauaauaaagauuucuuguuucaucagcuauugauuuuuuucugaaauuuaugauuuuuuuugaguuacaguuacuuguaaacaaaccugaacauuuaauucaauauuuuacacaaacauauugcaagauauaaaaacuguuggagucagccuggcagcucagguuggauacaaagagcucacauaacagugcaagucugaaaaauuguucucugaucaccacacaggcacuguagcauguaccauucuccucauaucagccacacagcugcguagccaugcagauacacacacugggguggcuauucuuauuuuuauguauguauguauguauguauguauguaguguguguggaggugaacggucucaugacaacuuuucucuguguagcucugguuguccuggaacucgaucuguagaccaggcuggccuugauucgucugucugccucccugugcugagauuaaagacauguaccaccaagccccauuugugauggcuauucuugguugucaaauugagaauaucuggaauuaagugaaagucugaaaugacugaacacaccagcaagggaauuuuugccuaaguaaaucauuugacaauggaagaaccacuacugguccagaucuuugaggugggaagacacaccccucucuagcgugggccacaccuuugcuggaagucuagagaagacauagaagaaggaaacuccucacucugccugcgaguccucacccucccuagcaaguuucucucgucacuggcuuacuucaggauuccagcuagcaggaacagcagaugagaccuccagccucuagacuaaucaacuauuggguucuuggccuuucuguucauaggcagucauugucagaguagcugaaccacagcuucuaagucauucuaacauauauuauauauuauguacauauaacauauauuuauucauuuucuaaguucuuuuauucuagagaacccugacuaauaaacacacacacacauucauacacacauucacacacacagucacacaacacacacacauaaauauuccuuguguaaugcgauacucaaaacauuuuucugaaauuucuaauuuauuuagaugaaaaugugcuauauuuguaacacugaauauuuagaucaauauauugcaagaaauauaaacugucacuucaagaagaauaaaaauugcuggacauuaguggugcaugccuuuaaucccagcacuugggaggcagaggcagucaaauuugaagccagccugguuuacagagugaguuccaggacagccagggagaaacagagaaacccugucucgcaccuccccucuugaguuauaacaagacaggcaaacucugaagucuggauuuauaacauuuuuaaguggcacugccuguaaucccagcuccauggaggcugaaccaggaggacaagaaaguucaagucucgccaggacaaauuagaaagacuguauuucuaagguaaagauaaaagagcuagacaagggcuggugauauggcucagugguuaagagcgccgacugcucuuccaaaggucuccaguucaaaucccagcaaccacaugguggcucacaaccauccauaaugaaaucugaugcccucuucuggaguaugugaggacagcuacaguguacuuacauauaauaaauaaauaaaucuuaaaaaaaaaaaagagcuagacaaauagcuuauugguagauuucaaggacagccugagcuacagaguaaaugcagggccagccuaggagacuuagugaguuccugucucacaauguagaaaaccguauugagggcucagggaugucguucagggcagagcacuugcacaaggcuguaaguuucauccuuagauuuuuuaggaggagugggaugaaggcaaaagggaagagagggcagaggagagagaaaagcugaagggagaggagagaagaaauugaagaugugaauggcaggaaucaggagagcagcagaugaagucagagaggaaugagaaggagcggagaaggagugacaaagcaaggugcaggccgcuaccuaagccagcgaagucacaagaggcuggaguugagagcguucacaguagcuucauucacaaaauaaagcucacaguccauagcugauuuacuuaaacauuggugaauggaagagcacacauaguggagcugcugcugcugcugcugcugguggugauggugguggugguggucccugaauaucuugguugggggugcaaguucacaccacaccagggagaggagcgaguacucugagaaugguucacuuuuaagucaacugaacaaagcuaugcuuguuuccucuuucccucauauggcaugacuaggcuuauuguauucuccguugaucuuacuguucuauguaugaaucaccugauccaagcaggaauagccuagucccaagaacugaaucagagauguguugagaaaggcccauuuggaaagcuuuuuuuuuuuuucccuuccaaucaaaggcaggauuuuuuuuuuuuuuuaaauccuuuccccucuuacauaaagagugaugcuuagccaggaauaguagugcaacccuuuaaucccagcacuugggaggcagaggcaggugaauuucugaguucaaggccagccuggucuacaaagugaguuccaggacagccagggcuacacagagaaacccugucucgaaccccuccccccccccaaaaaaaaagagugaugcuugacucucauguuuuccccaaugccacaaccucgaguuuuacaauggaagacaugagacacuaagcucccuuaagaacaggugccucacgucuuucucgacgcucaccgaauaaagaaaccacugaauguuaaaaugcccaucguagacugcugacuaacuuacccauacuucccaaggaaaccagggcauucugccggggaucgauguucuuaucguaggggcgauacccguagaggugggcggcacuguucaccagccaaguggcguugagcaccacagcguaucucaguaaaguggcaacauaaaaacuguuuagaaaagucucgccccagcaguaccagggcaccagcgugggcaggaugaagcacaucagcagaaugccaggcuuguaguaccuguguggagagaacauacgcugagucuggagaaaauuggcuauucucagugggaggggcuguuaacuuccucuuacagugagagaacgagguagaacgagguagaaaaucucaguacagaguguuaucauauuuauuuauuuauuuauuuauuuauuuauuuauuuauuuauuuauuugagccaggguuucucuguauagcccuggcuguccuggaacucacucaguagaccaggcuggccucgaacucagaaaucugccugccucugccucccgagugcugggauuaaaggcgugcgccaccacgucuuuaauaagucagcacauaagucuguguugagcagagauuguccuaaauuaauuccaccaguuaacagagcaggagcuccauuguucuuacucauagagggaugaggucggcuacucaacaaaccaggaccaaaccccauucucagccguucugugcugaggcgcuguuucacuccuuccuaaucucaccuccacacagaacaaaccgcugauuccgagagaaccgauuggugucccuucagcaguaaugucuugaacguuccagucacuggcaugaccugcauucagcguucucauucucgugcucucuuucuaacgugaguccuuucugguagcauuuugucuaagcuccgccccacaguuaccuggcaacagccaggugcgccugacucacuauaaaaggggcugcuugccccuuccgcucuauuuugcucuucuugcuccugcucugucuccucgccccuucuccccgucccucuccauucccuuuccccccccucucucuccacgugaucauggccgucccucuccauucccuuuccccccucucucuccacgugaucauggccggccuucuccuucucucccucuccccucccccuccccuccccucccucuccucucucccucuuccccucccuccucucucccucucccucucccccucccuccucucucucucucucucucucucucucucucucucucucucucucucucuuucuccccugcccucuuaacuccccuccccaugcccugaauaaacuuguggcuggucagggaugccucaggauggguccauagaggcaccuccuucccccauaccugacuaccccuccaccagaacauauuccuucucucuuuaucuuuuuauaaaacacaacauucuccacuuguuaaccuguguucuuccuuaccucacgggcugcauaccuucuucgccugaccugacauuggccuuuugaaagcagggcucuguuuugguagcacccguuguuggagaaauaaacucuuccuuuucaaccacuuugauucuaucuguagcucaggcacugccggugacaucugucuguguuaccuucuuuuccucucauuucuuuuguaggucaaggggacagacugcuucuggauccugcaugaagcuuuaauccacuuuccuauuuuuggucugcacacagaucuuuccauuguuucugaugcugcauuuucauuagccuuucuuguucucccugaaugaucucuggcccuuucugccucucgcaguacagacaguauuuugcuuuccuucaugauaucuucgguauuauacuaaaaucucccagagguuauggacuuaguugaauucaucgugucuaugaauauccccagucagugaauauuugcuccauuuaauugguuuaaugaaaucaguucagagagagaggaaagagcaacacuccaugacuuuggacauccaagcaauuaaaaacuaggguuuaaaaugaucuguuuguuuuguuuuauugaaacagcauaauacuuuauagcccuggcuguccugcacuucacucuguagaccaggcuagccucagacccacaaagauccaccugccuuugcauuucaaaucccgggacuaaagauacgugugccaccacaccuggccaaugugcucuuuaaaauuauuuuuauuauuauuauuuuuauugauguauauguguguaugucugugugaguaagugccccguguguuccugugccucugaaggucagaauggggugucagauccuuuggagcaggaauugugggaguaagucacccaguaugggugcugggaucugaacuaggguccucuggaagaagagaaagugcuuuuaacugcugugccaucucuucaguccauagaguuaucacuauguagcucuggcuggccuggacuucacagaagucuaccugcguuugucuccccagugcugggauuacagacacacuuggcugaaaugaugcuauuggacagauaaaccuggaaauuuauucagcuauuuuaaggacuaagagaaaugagaucuugaaaccucaucucucaagcuccaccccucagcccccacucaccuccucuggaacaucaccagcuucucggcuuucaggucagacauguccaguuuuccgcccuucucuuugacagccggguguuugcgcacaagcagccaacccacgugagagaagaagaagccacggcgggaauugugagggucggcguguguuucugagaacuuguggugggcucggugaucucgggcccauucauacacgucauucuggaagcacaggaaagaggaacccaguauggagaagagaggcccuccaaggagccugcaagggucuagaugucugcaagggcuugggacucuuagcgcaacucucagagucuuagggacucugucuccaaggaggccuuggcagcacccucucaggcacacaugcccgugaaacuuaugugaaaaagcaauuugaagaccccaaacaaaagaacgcuguugcuucccaagguuucgugguggguagauagaagguagaucuuaauguucagagaguuucaccaguagagaacauggugucuccuuaugcaaguaacaugaaacaggguuccuuucaagguaucugaugggggcagagagauuaugaaacagaaggccuuggaccccaagauucugcuuuguugcaaggcugcaaaaacucuaugucuuugccaucacaagaggguugucacacacguaacccaagaggacugacguccgagauaggagcaugggcacauugcugaaugaccucugagcuuuucugaacuuuauccauuucuucaagcaugugcuaaugugucauucuuuuuguccucuaaacauagagacuggaagccuucaccauacacauugucagagcgaggugaucacacacaugauaagagccucagauauugucaaggcaaaguaauuaguuuucuaguauuuuucccccuucucuuccaagcuaaauccuauucuguaagcagccuauggcuaggugagugucccucuccuaacuuccuauagucuauccauuauaagcuuguugcaagcgcuguccucagugcuugaguuauccaucaugguagcccuuuaagaucagcuuauuuaaagucucaguuacuugguuuccucaucuguuccauggguggggcaauaaggccuacuuccuggcauccugguugugaggacuuaggagaacuccauguuaaaugcugguccagcguccagugcauggagcuauagacguguuugcucuuauuaccugaaacaagggaauucuugagucugggacacaugccacuuccuauuacaguagaguucaaagacaaucacagcaaagcaugauuuauuggugacugaguguuuaaggaaccacagugucuagaugauauucuauggucuuuuaaaccaaaaggacuacaccagccauacuacauuauaacccagggaacuuaggguucaaagaaaguuaugccuggagaaccuguuccaccaauuuccuguuucccuucccagugaccuugagaugucccauguuguggggaucucaauacugggcauguacuugagaagacucugaagacuaccuuucuguguucugaugcccaccacucugcccuggaucaugcauagagcagagacacaagaaagaacagcaucagcuucuuaccuggaacgccaugguguuggcaaugaugaggaagauccgcaggggcaggcgugccuuguacguucuguggcuccacaggcgauggacuccggcuccaaugcccucaauacugaucacauaguagacaaacgcuguugggacagacaacagaagagucagcuaacugcuaaguguccaagaacacccucccgauaccagaguuugcuacuuaggauuugaaggagucuauggguuacucuuugagacaucauagcauucagccucaccaaaaaaaaaaaaaaaaaaaucaccuccuaccacuccaccuaggaauggacgugaguuaggauaacccaggcacaaagugggcggaaaagcaggaugcugcaaagaagacagguugucggcguugucggcagcauuauucugcuuucauugucagaccacugaauugcaaagguucuaugcccuuugaccuucagaucauuuuccccagggggguucaaggucaucaacuauuccagaccuaaauacucauaaccaagaauguuuauaaaauagcagucagaguucaaccucaauugaagggaagauucauggaucauggggccaugacuguuaaccuguugcugcugcagcguuucagcccuguagcagagggcuugaguauguacucgagcaggucucagggcgagucagcccugcacagucacauuuacacagagccucaagcuucacugauccuuaacauuauccuauguugcagcauagucaauugcauugugaaccccaaggcugugaacuggaaaaaccuuguuaugauauggcucagcccuugcacacacaucuuuaauccaaagagcuuucuguaaacagaauuaaagaaagucaaugauaggucuagagguggagaaagcacccagcugaccuucuuacuucacccacauccuagaagaaaaaggcucucucucuuuccccacacugucaaauacgguucaccucagagacccgccuuucucugucuugggcuuuaauauguucacucccugucaaaugguugcuugguccaccucuugacccaucacugacucuguuugguuuuuucaguucacaaucuugggguacacaaugugaucaaauauccuguaacuuucccccuuuuaucuaaauaaaagacccuuucucuaacgucaauaaacuauaaacuaucugguaagaauuacauucauaauguccaguccuuuuguacuuggcagccuuggagaaaguacucuacuauccuguguuggugagccucaaguucuguaccugaaucacuuucuauccuaaauugcauuuacuaaccuaaaaacaucuuuuuagaccuuaaaagguuuucuuucuuucuuucuuucuuucuuucuuucuuucuuucuuucuuucuuucuuucuuucuuucuuucucucuuucucucuuucucucuuucucucuuucucucuuucucucucucucucucucucucucucccucccucccucccucccucucucucucucuuucuuucuuuuuuaagauuuauuuauuuauuauauguaaguacacuguagcuguccucagauacuccagaagagggcaucagauuuuguuacagaugguugugagccaccaugugguugcugggauuugaacucaggaccaucggaagagcagucggcgcucuuaaccacugagccaucuugccagcccaaaagguuuucuuaaaucuuaaacaacuuaagcuuaacugugagaccauaacuaucuagucuucaaccccaucagagaccugagaaggauaaauauuaccugaauaaacagaaaauacagagcaagcaccuuuuaaaacuauagaaaugacagagacagcugaccgccugagcagucaccaagauuucuccgcaguguuggggcaaccgucucuucagccuacuggcccagaauaauaauagucugacacauuuuugugugaaggagaaguuacgaagggcuucucugucuuguacuggcagaauucagcaguugccauuuuuuguguccuacuuguccacagcuuguacagcauucugucagcaguugaggcaagggcaggugcuugcccaguggcagcuugccacauuugaagcaaacuccauaaggagaguccucaauagucaucaucuuugaaauagaaugggguacugccaggagcugacaugucuuaauaaaacaucuuuaaaugccauauucuacagauauuuuugaagaccauccaaccaccucagcauauaugaauaggaaacuguugcuuaucucuauuguggucugacauagcugugaccauuuuguaccaugccugcuagcuauuucauauuguugcugugccguugccugccagucauugacauagggaagugacuuggcucagagcaaggacaugcugaucacacgcccuguuuguucuguugguucugaauguucuguauaagguuggcuaaucuuaagaaacuccacaaagcuuuacauaggucccaucaaaucaaaggacaauaugaaguguuaugccugcaaucucuugggucagaggugaccaccgggcaguacaucguguaccugcauaugagcucauugugguuuuauccuuugugagcugacagagaaagauaaccauugucauaguucagauaauucugagcuaugucccugguccaaccaguaucagggugugcuguguguucaauaaccuauucuugcuuaacugagaucaguguucauaugguuuguguguugauugcugaaccccaacauuuggugcauuggcaggaacacccuugggcacuccucagucauuguuaggaaacgccaccucucucuccuaggagguaaguuucucuccaaggagguaaguuuccugugccugcgaaguucuuuuuuuuuuuuuuuuuuuuuucuuguuuugguuuugcuucugguguuggagacccaaaggugggcaacugugcacagcaugagccaacacagggaaacaggucucuaaagauacuguuaaauuaggauaauauuuuaugcaguuccuguccuagauaucagacuuauaaaagauaggauuuaaaacaauguuucuuuaaugaggcacuaaaacuguacuuucaugcauugguaugcaagaacuuuucucuucucuucucuucucuucucuucucuucucuucucuucucuucucuucucuucucuuuuuuuuuuuccuuuuucuuuuucccagacaggguuucucuguauagcccuggcuguccuggaacucacucuguagaccaggcuggccucgaacucagaaauaggccugccucugccucccaagugcugggauuaaaggcaugugccaccacugccuggcacaagaacuuuucuugcugauagccaaacuuccuaacaacaaaauaacguacuugauauuuauuuuaaaaacacuggauuuugcuuaaucuguuaaaaaaaugguuuugucuuuaaacauaugguuacauuguuagaccuuugcuuugucuuccaaaaauuaugguuagucugugugacuucauucuuuaaaaaacaaagaugcuucauuuugauauugcaaaaggaacuuuaaaaacuuauaguuaaauauauaaagcuauaggacauuuuaaauuauguugaauguuuuauuggaaugucuuuguuaauguauguugguuacaaugaaggaggaaauuuuugugaaaauagcuauaaugguaacgauaauaacuuuagaacuuauagugaaccacagcaaucaaacuagggacacaugaaggggggacaauuauggagaaaaagaaaaagcucaggcagccccugugauggugggauggucggaugccagauaccagagcagagaguuuuaaaauaaaacagaagugggcuauaguucuuagcaggaggaagaaugagaagaugccaggaaagcuguagguuccuugcagacagucgucacgaaugcauaaauggaacuauaaaaaucugccagagaaggaaccaugauccauggucaggagaguuacugcagcuucugguucaggacugucauacccacaguuugaaaaaaaaaauagcuauugauuaaugaauaagguggcagauauaagauauauauauauuccugaggccuuuuuauauguugugguuuuugucuuuuucuuuucauuacaucagauauuuccucugugaauuaggguaaggaugucaggaauaaaaauuaaggaauuuauucauuuaaaaucuuuuuuagagguuuacaagaucaaaaaaguuaagaaucacuggccauggaauuuauuuccaauuccuuucaguuugccugagcuuaggcaaggcuccagaagucaccucuuuucagccaaaggaguugagccaagcugagaagaguccuauuagccaagggcuuugccaucuuuccaacuuguuaaccguuuccuguucugacacuggcuucagcuuaaacuaaaucguaugggaaacagccauguucugcuauauucuaccagauaaaggucaaaaaaacuucuuagucucuuuaugggauaugauuugggguuaaaaaguuuuuauuuugguacuagaggaguuucaauucaaagcuguaauuuuuaagguucaaaccuaacagagauugaugucaguaaccuugaaaauggucaaauccuuuaauguguucagaaauuuuuguaagguacaauuuagagcagcaaaaaaaaaaaaaaaaaaaaaaaaaaaaacaaaaaacaaaaaaaaaaaacaaaaaacaaaaaacccaagaacaaacaaaagauuguuuaacucagauaugcuagguagguacuagcccucaaagaagucagaaaucugcuaaauauggcauuuaauauguuuaaacuuacuaugacagacaggaacucccaaaucauaacagugaccccauaaggucuccaagaagacgugggcacaaugacaaaggacuccauugggauuaggguaugauaaucacugggcauaacugccccaaugccuugccugcugccagagccuagccugaacuguggauaaacagaggacaauuggagaauugacugccacacacugcucaaguucaaggugaggucagucucucugauguuccuccuccacaggaaaagccucuucaucuucugggccucaugaccaaagacugccucugcccuacgugccauggagaccugggagcccggguugguaacugucucgguaauuaaaauauggacuagucucugucauuucgauugauacauagguccaucuggguuauaauacauccuucuucagaccucugaucacauugacaacuuaacagcuaaaagaaaaaaaaaaacaaagaaaaaaccaacaggcaguuagcuaucuccucaccuccagguacuccaccacuauguuauuaaaaaugucaaaaacaggcuugccuugccacaggcuucauauuaaaugacacucuuaauaaucaacucaacugucugugucucauaauaaguuauuggaugaaaaaauauaaaaucuaaaauuuacuuaagaucugaaaaaaguguuuauaggucuaaaaaaaugauugagauugauaauacagaugacaaagguuagaggauauuaaaaaaacuugggagaugauaggaaaauaauuuaaaaagauguugaagguugauaaauacaaauuaaaaaugggagagucugaaagauguuuaauauuugagaaucuaagaagguauuuuaagauauauaaaugcaaguuauaaagguauaaaaauaauuuaaaauaaaaaugggagauguucaaaacucccccacgugcuauuguuauuucaauguucaggauucugauauugaucgauggaguucugaugagcugaugggacaucgucaguuuccaauuccgucacaagcucacgauuuuaauuccccuuugguugucuucugaguauaugcuuaaagaugcuucccaucaugcuaaaaacaucucuguccagccugcacaccggguccuuuggacagaggagagaauggucugugccuucuaaugcaaaccuacagcaauuacaaggucucaaaggcaucagucuauuccagcugucuaacagacacuacuuuuuucccuaaaauauggauuucaguacaaugguaaauacuaauguccauccuuuuguaaacuaaaguucauauaagcuucagggaaucaagaaugcuaagacuuggacccaccugccacagaccaaauggacuccagauaaguguaccugccuguucuugaaaaugagcuuuucccuuggucuuggaauuccuuaccucucccaauuacuagacgauucugauuuccguuccuacuccauauuugugucagcagguuuuucaccuggcuaacagacuccauccagugaucaccuguggagcugcugaacuccggacuugcuaaaagcugauguuaaccaguccaacugaugugauggcuccucgucuuucaucuggauaaagcuaaguaaaugcuucuaagaaacgccccauugccuagccuuccugggccccuuggacaagguccuaaugucaacaguaagcaguuacagaaggaagauaugacaucuguccauuaucccaccuuacuggcugaaaugcugagucaaacaggaacucccccaggcccacucagaaaaggacuccacuuugucauccugaccaccccauggccacgaaaauagaugggauccaauccuggauuaaucgcucucuucugaaguucaccacccccuuccccaaaacaucuggaucccagcaauggguuguuagacaacacccacagaacccguuaaaaaucagacagauaaaagauuccagagguuugcuuucuauuucauguugccuugggcugcugagggacaugcuccaguacaacacacaugaacaucgauuagaacuacggacggaagccuaaauaacauugcuuaugguuccccccgcccucacguuugacguauguaaauuguuugggccaaaauggaacaggugcccaaaggccacaaacauauauguucccucauucucuaggucuuuggauauaggauccagaauauggaaaauacuuuggccacccuucagguauaugccugccccucaguugaagacccugacuugcaggggacauggugugugcuuuugugauauguggggcgauaaagcauuagcuuccuggguaacugauaaagauaaguauauucagccacagaagguugagucagucuagaaaacuugggaagaccaaccccacucaaauuaagauaaaaaugauacaaaugauuuaugagauacaggguagauuugggggcuccuccuuuaugcaucugguaaugacccugggaugauauucaccauccagagaguccaggucacuaggaacagggucuuagacaucagugguuccaagagaauguuaaugcccucucccuguccuagaaaggacaaggucucucugcuuauauaagauaucggucucaguaccugcaacaccguaauaauguacagaugcuaaugcaggaguuuccccuuacucuuuaguaccgccaaaaggcacuugguuugcuugugccuuggcacugacccccuguaucagucccuuuagcaucacugaaacuucugaauuuugcauacuuguacaucuguagccucugguacaguauuauccuggagaaggagguuagggacaccugggacuucuacaccauucccagauggccagggcagugccaacacuaauaaugccuuuccuaaaaagcaugagcauagcaagaccuaccagcaugagagaagcaacacuuaugaagggagaucaaaaugucaaacauuuaagccaacaaagacugauauaaaaguuuguccuccuggccucagaaaagaauuuuuuuuucugagacaggguuucucuguguagcccugacuguccuagaacucacucuguagaccaggcugaccucaaacucagaaauuugccugccucugccucccaagugcugggauuaaaggcaugcgccaccacgcccagcaucagaaaagaaaaauuuugagucaaugauuugacucauugggacagcucaaaaaaggguggaaugcuaugguuugacaccucccccuccaagcauagcuguagccauuuuguaccaugccugucagcuauuucauauuguugcuguaacaugccugccagauacacagaagugacuuggcucaaggacauacugaccacauacuguuuuguucuguauguucugaaugugcgguaugaguuuugcuaaucuuaagaaauuccacaaagcuuuguguaggacccaucaaaucaaaggacaauuugaacuguuaugucugaaaucacuugagucagagcugaccacccggcaguacuuccugugugugaacucacuguggcuuuugugguuuuauccuuugugagcugacaggaaaagauaucuguugucauaguucugauaauucugggcucuguuccugaucugaccaguauuaaagugcagucaauaacu

SEQ ID NO: 9297 - RNA, 64261 nt, Mus musculus
ugggauugagauacugcugacugaccuuggcugugcucucggagugugcacagugaccauggugacccagaccagugugaaugggcaagccacagaucuaugaaaacuugauuacaguaccagagcuccgaguuauuaucugguaagcauccuggagcuggugggcaaggcugagccauuguuccaaaagggacuacagaggcgccuguuggggagggaggccccucucagcuuugcucucuguuggugguagccauuuccccucccacgcgccucuggaaaugcaaagaccggauggaguugcaaguggucggcgcucuaguggcuuucccacuuuauguaccucuccgcgucuuccugccccgguagccaacccccacugcuagauugggucuucucuuccagagaaagcgcugaagcgcccccguggcagggugggggcuggguggaggaccagcgggggaugggugagaagccaggagcagaaaaagaagggaggaggggggggcggagcuggaggcagagggaacagcagauugugcagagccaaugagagcagcaggacgaggugguaccaaauucccaucggccaaugacuagccagaguuuacgaaggccucauuagcaucgccccccuccgcuuggcuagggaugggacaaugcgguguuggugucugcaguauucugacuccuggacaccgguggcugcaagcugcgauuuuggcguccucucauuuucuauccuuaucuccgcccgcggcugcccuggccagccaguuuuugauuuuuuaucuggucauugaucaauauaacgaaccuaaggauauacaggacauuaauaccccacugccagcucuggcccagagcuuguaccgcgcagcgggcugcagaaacuuagucauagcacccuuugucgcugaggucugaagcucgcugcacguucucaucccugggaacgugaccccagcauccgacgccaagaugccggcccacauacugcaagaggugagcuuacaccccaccccccacccccuccucagguuggcgguugcagauuggacuucuagguggguggcuguugaggguuggagagaguucagagcagcugggagcauuuagccaucauuuccgaauugcucaaccuugauagauuguuucuggaccgggugauaaccggauuuuuacucaguacaguugauugucccaacuuguguuucuuaaaguaaaaccugaccucuuuucgauaugcgcagauuuuccuuugugaguugcuaagggugcugcuaauaaagcguccuuuccugccccuucaucauaaggcuuauucccgauggccugcacauuuccguguuccauuggugcgcucuacagucaugcaaccuuggcacugggguauggccguuauugcaucucucccgcaguuauauuagagggaaaguaaccccugcugcccccacgcgucugcagucccuaauucuccacccccucucauugcagaucucuggcgcuuacucagccaccaccacaaucacagcgccaccuucugggggacagcagaauggaggcgagaaguuugaaaagaguucucaccacuggggagcagauguucgcccugaacuaaaagaugaucuauaugaccccaccuaucaggaugaugaggggcccccgcccaagcuggaguacgucuggaggaacaucauucucauggcccugcugcauuugggagccuuguacgggaucacacugguucccuccugcaagcucuacaccugucucuucggugagcagcaccccuugucuugggccaauacuucagauuucuccuugaucuuuaaagagguggccucuggucucugacccaaggcaguggcccuuucuuuuugguucuuguuggaccagcuggacugggcaaagaaccucgugguguuaagaauggggggaggggggaacuugagucuugagagucucauaacauugaugcagaggucucugagcaggcuuuucuguaugagucacuugauggcaccugucccagcuuugccugccacaagagaagcagggccugccucagagacgucagagccaagagcuagaccacgggccuaguggguaaccuguugaguccagugaggggacaaagccaugggaugcuguuuuaggcagagagaacagaggguagguuauaagccuaacuguuuggacuuccugccuggccagacuaggcugguuugccuggagaaagaugacgaaggcuccuguauauccaaguucaaagguguaugguaccacgauuugguacaagccagucaacagaccauucuuagaauaaaauaagauugcaggaagguuuuaccuucuauucagccuucugccccucuuuuccuguccacauugugcuguggcacuuuucucuccacaccuaacacauaccuccugagcaggaagagagccuggagcagccacagcccaacugugaugagugugccccugugccacugaccugccuagcucagcugcccagggagccauggguagugcugcccccuagcgacacgcaugugcuuugcgggugguuacacaacugaacauugaaccaggaaggagggacugcaucuauagucagggccucuugcugcucucagagaagcggagagcaaggguuucuuuagaacaauugauuuucuagaacaguaucugcauguagguacuaauggcaggucucuugcaggacaguguauagaaaggcugguugucucauuguuggcugucucucugccucaguccuccuagguccuauaaguggugagauucgauucuugagaguuuuccagguaccaaacuuuuucucccaagacaagguuucucuguguagcccuggcuguccuggaacugggucuuuagaccagacuggccuccaacugcaagaucggccugccucuacuuccugaguucggggaucaaaggcgugugccaccaccacccagcucccacucauagucuucacaucuuugucaaaaguaggaauggaauacuucuuuagaauaguugugugcccugccagccuuuuccugacucggcugcuuuaagagucuuuuguaccuuuguggacuccguaacucuggagccgaauaggugcuuuugacagcacagagagauuuuacaaagcuccacccccucccccucccccuccccaucccgauucugaaguuaaagcuaagaaagagauaguuccuacccaccauugugaacacuuuucuggcagacaggggagggaucuaagucuccuguuugcuagacggagagguggacugaagaggccuaagacugccuagguuuguguguccugugugguugugcgcacaaccacacacacacacacacacacacacacacacacacacaccccucuaccccaucaucugaguuuugauccagucuacuugggucaucugcagcauaagcccuuggugcucagcgaagggcuuuggcucugcccaaagccaucccgugaugcagggcucugguuacccuaggauuuuuccagauaggaaggccuuucauccguggcuggucuccugggauccuguaggagguacgggaguugggaaggaggagagaggggucucaggaaacauguuaucugacugcagaaggacgcagcaguuggugcaaugugggguguuuccaguagcaacuaaguucuguagucugugaagguccuuuguuucuugguguuccuugggagggagccaguauuagccuauucuaccaaggccccugcucccuaguucugcaaauagggggagggugucagaugucuguaccgcucucugucccagugagauaucaggacugucacuucuugagccuuucugcuucaaggacagugaagcaguguuuuucugccagcuuugagcaucuaacauucugcaaggacaggaccauggccagggagagaaacaagacgagggaguggauaugcagaucuuaggggcugaguaguagaacggaaacaggugauggcggauggaaaacucaccuucgaacaguagacagacgaccuuuuccagaaucuguuucuuuaauaaaagugcuugguacaacuaguaguaccuuguucaagguguguggagaauaugagaguauuaguacccuugguaauguuugcgccacuaugcaaaucugacuucccguuaugcugcugugguguugaaaugcaccuuugcuaaaagccuuguguagaguuagcuauucaguaugccacugcuugucuuuuccaguuagccauugcccaagcuguucuggcuggugcuucagaacugcccuuggauauggguucuaaguugaggaaaugcaguuuccugaccagaaaucuuuagaggacugcuagaggucaaagaacauuggcccugggaaugaaacccagugauagccagacucgugaugaccagugguaccaaauguuuaaaauguaugaaguuucuacaaaucagugcgccccagggcugcagggaaaaccaggccuuuacccaaaggcuaacugagaagcugacgggugccaggaaccugucuuuggcauacuucccuuauggaucuuggcuuguuggugacacccaacuuucugguccuacagcguauuuguacuauguaaucagcgcccugggcaucacagccggggcucaucgccuguggagccacagaacauacaaggcacggcugccccugaggcucuuccucaucauugccaacaccauggcguuccagguaagaagugggugcuguggcugugucuccgcccagggguggguagucagggaucaaggucuggauaguugacuaggacagccauuguuucuacugcuaugugguccccuagagugaagaucagugcugaaguccauauaccauagagucacuuguaaagggaaacaagaaaggguccccaugugccgggucacuuuucaucuuagagucccaggggugucacacagcuuggcaguugugggucuuuaguauaaagggcacacaagagcugagcacugacucugguuucuuagaccauaagugaaccguucguuuuaaaguaacugucuuagacucuaccacagugggauggacacggacccacaggugucguaagacccuggggcucuuuuaaguccucaaagccauuugaggaaguagacacaauuguugcuaccccucuacaagcgccggagcuuacaccggagaaaagacagagacuugguagaggacccucguggcuccuaagcucuuaaggacacaaggguagccacugguggguuuaauuugcagcaagaugaaacuaggaaaccaaauugguccucugugccgugucgagauuugagaugcucaccagauuugccaaauccucucugguggagcaacuuuacuuuucaaagaucccuaguauucuugggggacagaggggguguggaggaagagacagugguguacucuugagguaagccaggaugcagacaggcccagagguccuugggugauguaccugugcucgggaguuaccugcuggccuugauccugggcagaaagggcugccacuuggugaauggguuucuccacuguuucuacagaggagcaccccaggagucaggccacuugccuuguaacuaacucugugagccauaggauaaggcgcuccaugugagcccugccccgaagucccugcuuggaaagcugcuaugggauucuccaaauggcucauugguuaaaagugcuuucugugcaagccugacaguuugaucuuaaaucuggaaggagagaucugaguccugaaaguuguccucugaccacacaugggccgugacacgugugcaccuguacccacacacguaaaauuagcuuuaggauugacucuucuugcuaaugaagcaugaggacugugacuuacccacgcuugcuuucguauaaccucaggaggugaccgugcuguuccucugcucugggacuuuaaauugcuuuuucuauaugugccccuaaggcaaggaugaagcacaggauagccccucaccuuccacccugugcguauucuugagccagaguccugaggauuuugugaguugggcugagagucccaggcccuugcagacaucuagguccuugcaggcuccuuggagggccucucuucucaauacuggguuccucuuuccugugcuuccagaaugacguguaugaaugggcccgagaucaccgcgcccaccacaaguucucagaaacacacgccgacccucacaauucccgccguggcuucuuuuucucucacguggguuggcugcuugugcgcaaacacccggcugucaaagagaagggcggaaaacuggacaugucugaccugaaagccgagaagcuggugauguuccagaggaggugaguaggguguggggguugaagcugaggcugugcccccccccccccgggaauguacaguuuacacugucugcauuuuuuauuaggaauuauaaaguaaaagccaugacuuacuguguccacauguucagaucauuuuuaaaacguauuuuuaacauccuguagggcacagagagaaaccuauuuuccuccgugcguguuaucuuauaauaggcaccaguuaacugcaaaaaaaaacccaaaaaccuugcucauuguccuaagcggugcaggacggcccugagugcaaucgagagcuuaucuugcaggacuaaguggccuccuauaagggggugauaagucaaggagccugagagucaccaugcaagucaggaucugucuagacuggacagcugcaaagagcagggggcaggcuuaggagaaaguggcauugaagccacagcacacagagacauggaggguuccagguuccagggagaggccuugccggcagugagcugaaggguggguguucaggggugcagccucugcuugaaaucccaggugugagagagaaaaagagcgaugaugaagacguaucgccaacucccuuccuacagacuccuccacacagacuuaaguaguuaaguuagcagccgaaucacuaaaggcuucuccagcagcgugaggcaggaguguugcccacucuugggaagggcacaaguuaggugguaggaaagacuuaagcagagaaacaaggaguuacaagcaggggacuuccuagggugugagaggaaaaugguggcuauugaaggacgcggcgagucaguucccuuggaaggaucuguggucuuguguacccgagggauagugcuguugucugugucagaggcuuacaguuuggggguuggggaacagaucuaggaacacugguagcaggaaguggaggcaugccaccacaugcuaagugacgauucugguggucaugagaggaaacaaaggcaggggcuggaaagaugauggccccgcugugaagagcacugacugcucuuccagagguucugaguucaauucccagcaaccacccgauggcucacaaucaucuguaauggggucugauagcaacaguauacucacauauaaaauaaugugagagagagagagagagagagacagacagacagacagacagacaaaggcagcccagaaagcaauagggauaacagggucaucuacugcauccaucuccccccaucuaaacagagagcuaacagcacuugcucucaaaucuucuaccacagguuuugggcugguuccuucuggucuuuacucaugggacaggggagaaaucagcccugccugcaaggagugugagaguucucucuccaugaagccuaaaauaugucaucucauuguagguacuacaagcccggccuccugcugaugugcuucguccugcccacgcuggugcccugguacugcuggggcgagacuuuuguaaacagccugugcguuagcaccuucuugcgauacgccguggugcucaacgccaccuggcuggugaacagugccgcccaccucuacggauaucgccccuacgacaagaacauuagcucucgggagaacaucuugguuuccaugggagcuguggguaaguccccacagcaggaccacaucuggugacuggcuucuuagagauucuuggccgggagccagaggaaugaugaugaugcgauuuuugauauuucccacugugagacuugggggggggggaugggggaugguaauuuauuagggaauucuuuugagaggccauaacuucuuuggaaagggugaaaaugugccugugaugggaccuuuugaguuaguucuuccguuuccugauuaccucugacagcucagggcagggaucauuaauagaaaagcagagucgucuccaugaguguaagcuucauguguugauuuagccaugcuguauaaaagcuagaguuacaauucauuucaaguauguuccuggauagcauuuuuaucucuagagugcuugggcguggcuuauccauuagugacaccuguaggugcacguuggcacauguuccucgucacccugccacccucugcccaccuauccucuguuuuucugauuucuccuguuuugugcuggagcuccccuucgcacaggguugaucugggaguccuaccagaucaguugaucguaauuguuggguccaagcuauaaauccaaucccaguugucaggaugcaugcacgcaugccucugccaccugugccgcccacauuuuccuguucuuucaaguuaguuuucccuaugcagaccugugguuucuuuuucuuacugauaagagcuguuggucagccaacgacacuguucagauuggugcuuguauaucuugguacaacacucaauuuagccaguuuggauggagcuagauauaucuauauaucuauacacacacacacacacacacacacaucuauauauuuugauggauauauauauauauauauauacacacacacacauauauauauauauauauauaauuauauauuuaacuuauaaguacacuguaacugucuucagacacaccaguagagggcaucagaucccauugugagccaccaugugguugcugggaauugaacucaggaccucuggaacagcagucagugcucuuaaccacugagccaucucuccagcuccaacuuuggauauuauuaaaaguauuuuuccuggguugucaugaagggucagcagguaaaagcacuuaccugccaaaccugagcagccugaguuugaucccugagacccaccucguggaaggagaaaaccgacuccugcacgcuguggcacucauugugcguaugcagaaacucauacaaauacuaaaaguacauuuaaaaacugcucauguucucuuuauguuugaaauaaauuaccuaaacucugcagcacugagauccucuuagagauggagucacuuagacaagauguguaggucccagaguauaaauggaacugcaaugccuuugguggugucugucuguuccgaguaaaugaaacuggguuuagccauucacucaccugcagcccugauuccccuaagucugaggagcccacuggguaagaggcgugggcagaggaggaagcacugagcccccucucuguucuccuugcuucuauuugcaggcgagggcuuccacaacuaccaccacgccuuccccuacgacuacucugccagugaguaccgcuggcacaucaacuucaccacguucuucaucgauugcauggcucuccugggccuggcuuacgaccggaagagaguguccagggcugcugucuuggccaggauuaagagaacuggagacggaagcugcaagagcggcugaguguggggucuugcaguuccuguuccagaagccagcuuggcagaggcuuacuguucuguuaauuaacuacugaguauugccacccagaugcuaaaaugaugacugacguuaacccauucugguacaguauuguaaaacggacaaaaaucggaagucgacagcucuuccuucuaugcuaagcucaucuucccuucuaguuucuuuucccguugucuuuuucuuugcuuugucccugaugaccucguuucucauugcuucucccaagccagccgccgcucagcuauaggucaguguucaccuuccagaguacaccaacuucucaagggucuacaguaaagguucgugccccacccccaacucuucuuaagcugcucugaguuagaaauacaagaaaaaucuugagagauuucuccuguuauuuuuagcccaggcuuugccagauggaaugaaaaagaaaauaguuuuuauuuggcagggagccuauaaaagagguaaaucuuaaggggccaaguucaacacgcaggcuaugauucaucaaagccgugggagagggggaucucuuaugaacaggcucagcuccgucuggcagagcuaccgcagccuuucaacauagcgcgccuccucuccuaauucuuaguagguggcaacugaggaacuucgugacacuaaaauacaguaacacaucaguaucucaguguaguuuaggcugaagauuuaaaaaauauauauauauauauauacuaguaaagugaaaaacaauuuguaggaaaaguggucuuuaauaaggauuuucuuuuccuuuaaugacaaggacccggggccaggugugguggcuugcaucuuaaauugcaggacuggagaggcagaggcagguggaucucugaguucaaagccagccagggcuagauagugagaccuugucucaaauuaaaaaaaacaacaguuagcaggacaugcagagcaagggacccucgagugaggcauguuuggaauccguagggcagucgcucaugguuucgagcgucccgugagcugcacccccagggucuuuuuaauuccuguucuuccaucuuuaagaugauggucgugcccacaaauugaggauagcuguggcguuuccauacaucuaacaguggaaggauuucaagaguugaacuugagucacaguuaaaacugaaaagucguaaagucuguccuggauccuuacaaacacuccgugagugcuucccucagaagacgaugcugcgcgccuucucccucccacugucgggcaguggacgggcacguuggaagucgcugugggcgccuccuaaugacuucucaaaggaaagcuucugagggccccuuaccaggggacuucacggcuuugggguguucuaguggagcagguuagguuuuuuuuagccccuuucagucccgcugcuguuuguggcaaggcaguacugacucaugccucacuagcucugugaccagguaggacucugccugggauacaugguugaaaucucucagcucuaccacaccugccucuuuuccccuacccauuuuuuguguuuugggguggguuuuuuuguuguauuucuuuuuuccucuuugacauuuagucuuggucuaggcagaaauguccuggauauuuccaggcaguaaagaugugugguccuggcaccuuccucacucagagauacaaccucuaucugcaguagguagagacggcuauccuuuucugguggguuucagauucuccaccucuuaucccucccaggcuucugacacucucuucagcucuaaagaaaaaguuuggccaacuuucuagaaacaucccuggcucagagagacucuuugucagucauuccaaaacaaaugguuugguggcacacaugccggcgagucagggcggacagagcaugcaccgugcucccggcacuuggcaaagcuucggcaaagcuucgcgggcuaaucagcccuccugggugaugcugugguuaagugggaagcacagcacucgagguuguguucuuaagugccucuguuugaaagcuuuggguaggguaggagagcugagaugccaugaauuucacagaaaggcucucgugcagcagugcagaagccuggccgcgucggcuguacagcauaccaggugcugugcuucgaggggacagucuuccugggcuaguugaauagagagaggcuuuagggccuuccugugcccacuugaaaguagccuuacccuucagcuguuugcuaaaagagaauucuugggcgaauccaagguauuugcugagcuguggcccuauucuauuccuuggauaugccuuuugagugauuucaguuccgcugguuauggugcccacuuaaacaaaugugaaaaauaaaagcagcucucuucuuagccugccccguggaucugaaccaugcuguggcuaaggaccccguaaaauaacaucugucguuaaggguguaccagcucacuaagaaacacugcuaucaagauuuuuaaagcucaaaccaagugacacuuuuaauaagagacuaagaucugauugagggaguuuucuaacaguccuugccucguggacacgcuaaaguuugacuugggugccuuaccucuuuucuaaccaguguugcucgugagccuguggcgcucgcuugcucgcucgcucgcucgcuccguggauuccuuaaaaccagagagccuguaaguguggcaagaucaaaacuggccuggcuggaggguuagcuggacauggaucugcaggauugccucuggggaccucguuuugggaacuuuucuuggggcuguuuugcucaagugcccguagcugauggaugggugaaguaauuuugaacguacgcgauuuguagguuuuguuauuuguuuuaagauuuaaaagcugguuauaggauuuuaagugaaagcuuuucuuccugguuugcuaguguucuugagugucuucuuuaguugaaauagguuaguaggaaauuuaagaaagugguggccguguuacacugguggugaaggccagggccgccuaccaacucucaguuuuuuguaacagucccacucugacgauaaugaguucacuccuuggauaaggauguuaaugagggaagagccuucccgaccugaccuaaucagcucuuacuggacccagcugucaacacuguugcauuggggauuuaaguuuccaacccaugacuuaugggacagauucaaaccguagcacugggcauuucgccuaacaauacugugacucaguauucugugaaacugggauaauauuccugaccuaccuccacggguaggugugagcaugagaaaaugcucuuuauaaaacauuuggggauccucugcagaggaguauuuaaguccugcacauuuuuguaguaacuguccaucguggacuugacaugugccuaugucccagaugacguuguuaaucuacaucauucucagagguugaauggaugcgucagauaauguauacucacugcuaugaaaacaugcaggacuccguuuccuuccuugggugggauuuuuccuuuauuaugugcaacuguaguuauuuguaaucuaauaauuuucauuaauaccaacuccgaaaguauuucuacucaucugagguuguguuuguucauaauaaaaugaaaugaucugacugcaaaaugucucgugguguuuuggcugcaauacagccucccaggagcugggugguggcaacgguggcgcgcaacuuuaaucccagcaauagggagucaggggcaggcagaugucugaguuugaggccagccuggucuacagagugagacucaggacaacuagggcuacacagagaaacccugucuuaaauuuaaaaaaggaaaaagagaauuuagaagucaugagguuugagucauaccccaguaaccugcccugccuucgguguuauuugagauucauuucugggaacaggaaaccaguaguaaguggauauuaaaucagaaacaucagcuggcaccuuggcuugacaaaugccaggucuuugaguagcucauggccaaacacacccagucaacgaagcgucuuagugcagaucuuuccuugaagcucugguugggcaguccagcucauucuuaggaauauccugucuuuagggaacagcuagccucucaaagugcugaugccugaaggaaagccacccagggagggguucaccaucacaagaugggaaaggcagggcuugguuucccuccuuauguccuucucuguagccuuuucugcuuccucugcgguuacuuagaggcuaccaaaagggaacacgggucgggucgugcaagacugggcuccuaguucaccucaaucccugagucuguuuuuaccuaagacauccauucuaaaggacucuuguaaggucauggugccagccugugauucuagcuacuugagggagggaggaagagagggagggaaggccuggaaguucaaggccugccaggcaaccuagugagauugccucaaaauuuaaagaaauaaaggggaccgguggagucagugaagguguguuccuuagcaacucuacagggcucaguaauucugaaucccgaaucagggacugcaugcugacucuuugccaguccuuaagagccaggccaacaauuguugcuucuuguucaaggguaaagauccccugaagauagcaauaaauuccuuugggugguggugguuuuguaggagaggcuaaucuuagguuaagguccuagugaaaucaaaccaugucacaaaaggaaaagaaacacuucaaagauacugauggagacaagaguagauugccugaugcccaguggcuaccaguuuucuacuuccacagagaaaccgggaaauguccuccaaaaugucuaccagggcaggaaaaggggaagaaauaaaaccaagucacacauguaacuauuggaagcuguugauauauugccagaaaaaaggcaaauuuaccuccauaaacuagcaauggauaauuuaacaaugacacagaacgggaucgccacaaaaucaaaagcaguaaguguuaugcuuaaguaccccagggugcugccuggagaagugggucggguggucauaccucugaucccagcacuugggguauggggaucccgacagguagguggaucucuaaggccagcuugacccacugucaugagcaccaggccagccaaggcaaguagugaaacccucucucaaaaguaucaaguacuauugaaggaaaacacaaggggaaaaaaaauaaggcuaaguaacguuauaggugggaaggcuuaguauugaugguagugcucccaaaacagacuugccaauucaagacaauccuuaucaaguaauguuccagugagguagaugaauauauagauuauaacauucacaggggaauucaagagacccagaauagacaaauagaaaacaugcacacgugcacauacaaagauggaugaaauuuauucuuucaaacuuucuucaaagggccauuaauaaaaguggauaaauccagaccaagugggguugaaaguagacauuuacaauuaacagauacuuggcaagcauucagauggcucaacugguaaagagaaucuucuagcagaguuaaacaagugaauauccgcagguaacuguuacuauuguuggcccaccacgucauaucacacacagcuaggaacucaaauauauuauguaaagcuaaaauucccugaggagaaaacacuggugugcacagaugauaauuucuuaugacaguagaaacaacgacccuuuuuaaguguuacgaauucgguuucgucaaaguagaggcuuuaggucuucaaaagauaccaucagguaacugagaaggcagauggggaugugugagggcuuagugcugagagucugugaaaugcaugcuuucauucugcuguuagcaagacugagucaaauccugccuggaagcaagagcuguacugcugagcaagacccacagcaaaggaacccuuacaggucaacaacaaaaagacgacagggauaccaugcuacauauauaauauguauuaugguauauauauaauaauacauauauaauaacaauaaauaccugcuauuagaaauaaggcauuugaguagacauucaugaccagaagacccacagaugggcaaaaaagacauggaaagguacuugguauuagcagcccucaaccccguacuaagcagcguacugaaauaccucauuuccacuaaaauaacuguaauaaaaacauaaaaguaaaaaggaaguguugcugaggaugugaacagacagagacacucacucgcugcggaugaaaaucugagauugugcgucuccuuuggaaagaagaccagccaucucccaaauaguuagcaacaagcaggcacggaucgcagacacacuucuaggcauccacccaaaggauguggaaagauguguccacacaaaaacuugcacauggggcuggugagauggcucagugguuaagagcaccgacugcucuuccgaagauccugacuucaaaucccagcaaccacgugguggcucacagccaucuguaaugagaucugacgcccucuucuggugcaucugaagacagcuacaguguacuuaagauauaauaauaaauaaaucuuuaaaaaaaaaaaaaaacuugcacauggauguccauaccugcauuacaucacaguacaaaagcagaaacaauccaaacaucuaucagcagagguguaaacacaauguauuuuuaagacagugcaguauuucucagcuauaggaaugaaguacaagacagaccauuuuucugacucagaccaaagagguacuucaggagucuauuuauaugaagugucugaaacaggcacaucuagagucagaaggcagauugggaguuaccaggggccagagaagaauggaaaguaaugagcccucuuacggugaauaacauuuccaaaagauacauugugaugguugcacaacugagcaaauaugcuaagauagcuguaggguuuccauugcugggaacagacaccaugaccaaggcaacucuucuaaaggacagcacuuaauuggggcuggcuuacagguucagagguucaguccauuaucaucaaggcaggagcauggcagcauccaggcaggcaugguagcugagaguacuacaucuucaucugaaggcuguuagcagaauacugacuuccaggcagcuaggaugaggugacacacguacuccagcaaggcuacaccuccaaauuaguaccacucauuggaccaagcauauucaaaccaugauaauagcuaauaauuuuuuuuuaaguuuugguuuuucuagauaggguuucucugugaagcccugccuggcuuggaacucuuuguagagucugaccucaaacucagagauccaccugccucuuccuccugaguguugggacuaaagguuuucgcuacaaugcccuggcuuaguaacuauaaauuuuuaaggugcaauuucgguuuauagauuauuugucuaauaacagacguuaaaugagaagggcacuuuguguuggauuguuuuuaguccuaacagagccugagguuggauugcaaauguaccagaaagcacuggugaaaaaucacgucuucaauggaaggacauucucucuucuacauucuaauucaacagugaaguggcuuccggacuuuaaaaaaaaaaaagacuaagcaugugaccaaaagcagcugcuauaauguagccugugagaugauaaucuugccccaucaaauuacagugguuggggaaagccagauacggucuuuucuguaaaugaaagggcuugugccaaacucaaacacaaaugcagcaccuuuugaaagacagacaucaagcucgcaggcuggaagaugcgaugauuguuagcauucugucuaaacuccaccccacaguuaccuagcaacagucagacaggccuagcccacucuaagaggggcugcuugcccccuccucccucucuuacucuuguuucccucuuauuucucucuugcccucuugggaucuucccuucuccauucccuucccaccucucuccaugagcucauggccguggccagccucuacuucucuacucucucccucucucugccuuucucugacucuauuacccuucuaacuccccuccccaugcccuaaauaaacucucuucuauacuauaccaucauguggcuggucccucaggggaagggaugccucagcaugggcccgcuggggcacccccuucccccacaccucaccacacccccauagaacacauccuauaccuccuuaucuuuuuauaaacacaucagugauaaugccaggaucauuucucuggucaggcacuaagcuaaaggcuggaggaugucucaucucacaucagaagcaagagaugggagcgccucagagugguagcugaguucauuuagaggcagcaggagugguguggcgauacugcagucaggcuccacagaauccaggcacccucucccugcaugagcuuacuguguucuggaaccaaacaaucuauccagcucccauucuugcugugaccuaccacaccccaguuuuacacccaccucucagaccacauaaauagugcuggcauuuucucuccucgcaacuacagucuggcugccuguaaaggacugagcacuauuauaacuaagggcagcuuccauuaauugcaaaugucucccugcacuucaauaguggcgcucaguggcaaaugucacgggaagugggcguucucuucggugaccugugcuuaauguucuaugcaacaaagaaagcacugaguuuuggacaaugaauucugagcacacgccauaaaucccaaagauaaacucccuaagggacagagauucugcccugaaguugcuggaggcagaaagagcccuccuccucuggugagcacuccucccacgcuaucugcccggggaacagcagagagcucacaaaagggcagugugugcugugcugacucauggugauuuuggugcuggggacauccaagaguccauuggcaucuuggccauuuuccacugagaacaaugaguagucagggucaggccuugaaagacuuugugaacaagaacagcaaacgagagaaaacugguugucaaaggcauggcaggcccagaaccacgccuggcuguauucuuacgauuucuuuuuuucuuuuuucuuuuucuuuagaaguggagggugaggguaagaauucuccucugagacucuuuggguuaguuaugccuguuaacugaagcagcauuucuuuggcguagaagcaacuuacacuguaaaaauaaggcucuguuuacucuugccaugcuuguaagaugcccuggauugcguccccaacacuggaaaaacaaaaacaaaaaaccuaacuaagugaauaaaugacaucauaaaagcaucauuuuaaaggucccaaauccaugaccauggcgcaugaauuuauauacuuauacuguuuagccaccgccauuuauuacuauuauuaguuauuaauuaaucaccugguuuucagacaagguuucucucaguauccuuggcuguccuggaauucaguccguuagaccggacucucucucucugcaucucuagugcugcuauaagagauguuuaucacuauacugggccucaucuuuaguuuuaaaaaaaugucauuauccucaccccaaaaggaaacacuauucccauucgaaugacuccucaugacccucccacuguaucaacaaccaauaugcugccuaugaaucgguuguuguuuaugucggagaaauagccauacugugugugucugguagccucccugcaugacauucugugugucucuuuguaacaggucccccaccgccccccccccccaaccugguccuuaguuggcucccaaaucuuaacacaacuaacauggugaagugauagaaguacuauucaggucauggaacccagcacauaggcagcaccacccgccaaaaugaaaacaaagaucuaauucaucaaaggccauagcucugggaagucuguaaauguacuagccuugcuuuuuggcuucuguaguuccccuucuggcuaacuguucuugcuaaaugugucaaacaaagacauguuuuguauugugugugugugugugugugugugugugugugugugugcuuaaaagcuugcccugagagagcugaagagauggaacagcaguucagagcauugaccgcuuugcccaagguucuaaguucaauucccagcaaccacaugguggcucacagucaucuguaaugggauccgaugcccucuucuggugugucugaagacagcuacaguguacucauauuaaaaaaaaaaaauacaaaaaaaaugccauaagccgggcguaguggcgcacgccuuuaaucccagcacuugggaggcagaggcaggcagauuucugaguucgaggccagccuggucuacagagugaguuccaggacagccagggcuacacagagaaacccugucucgaaaaaccaaaaaaauaaauaaauaaauaaauaaaauaauaauaauaauaauaauaauuaaaaacaaacaucucaccccgagaaaggcucaagucuguaaguaccagccagcuaauagacuuucuacuggcuuaaaucugugucuaagucauuucuuugauuuaucuucuuugaucgauuccuaacauuuucacacuggcacaaaucaguuuuuaacuccucauuaugauuaacaguccauuguauuuauggggagcaguugaguugucccccccuuucggcuucuaugaauaguaugcucugcacauuuguguguguauauucuagcauuugcucucugucgauuuguguacacaggaaugggauuucuucuguaauaauucuguuuaacuuuuuuuuuuuuugaguaaacaguuuucaacagcaguaauggacagugucacccacccuucaccauaacauuucuccuuuuuuuuuucuuuuuucuuucugcuuucggggaaggccagaccccauggaguaaaguagaagcucugcuuccaguagcaagauugcuuuagccaaagccucaaaccgugccuccaaccucgccauuuccaggagcaggcaguguggcuaccucccuggaucacuaacgcaccucccaccccacugcggccaaacacacauacacagcccugugacaucauaaauuacuguccuggugaccguacauggagcccuaccaaacuccaacucagguuaagcugagugccugaaauagaagcaacaugcaacgcucuuccuccaguccuggcccucugccagugccugcccgggagagguccagcuagggugaggaaaagcaagggucaggcgugcgggccccucccgggguuacucuggguuagcauuggccccagauucacucgcguucaccaggcccaaagcgccugaccccucgcagccaaucagcggccucaccgggcucugcacgcaucgcuccaaucaggaugcgcugcuccugaagcuagccgguguaccuugcagucacagauggaggcuagcccagucccugaccucacaacccccccccccccccccgccuccgcuccccggaccuugaaugugggcucuggucgccagcuuucgccaaggaagggggugggggugugugcuggcaaagcagcgcacguuuuuuuuuguuuuuuuguuuuguuuuuuuccaucuacguagugcaaacgcuuauggaggaggaggcagagcuaggacuuagcaaaacagaccucagauugggucaugguguagaggagagcacuccgaaaagcacagcauuaaugugaucaggaacuuuccaggcugaugucagcaggcaugaaggggcguggagugggcagugggaggagaaaaugcaggggaggcggugagagucuggaaaucucgauauuuaagaaacuuacugugauagcagaggggaccacaggggcuggaagccuuauuccaggcuuugaaaagacuccgaugggggcauggggaaggaaaaggaaggacacaucugaaaaguauuuuuggagcagaguagacauucagaugcuggaauggugaaguggaugcagggugggaggggcacccaugacaggcuuuuagcucgagucgcucugcaggggcagccucugcaccaacuuaaaauaagaagcuugaaacaaagcaggcuuggacugggagcgggaaguuaguauuuaacacgggagugggaguuguacaaaguuugcugggauuaaaggcaguaaucaccacacauaaucuuaacgugcccuuaaauguggcuugcaagaauugcauugagaauuuuuuuuuucugucuccauguucaucaggggaaaaaacggcugacaauuuucuuuuuuaaaaaugugugugcucugaaccaguuuuuauaucaagguaaugcagacuuggcagggugaacuugguaguguucuguauaccauaugaaacaguuuaaggagcuugguuauuaccucuuccuuaaagauuugauaaaacucggcaacgagucagucuggugcuacauuuugacuuuuggggaaacuuuugguuacugucucagucuuguugacuuuuuaaaaaaaugauuuuagagcuuuauuauagaaagacagggggaaagagagaagguagaaaagagagagaagaaaggcuagagaauaaagagggagagagaggagaggagaagacaaaaagagagaggagugaggaguaagagccgucuuguugauuguuaugaauccauuuuaaucguuuauguccuuuuggcuugauuuugugaguccucuaugacuaggaguuuauuuauuucuucaaugccugcuaauguauugccaaugaucauggaacugaagaugguuaaaaacuacuuuagaauguuaggaagugaagcuagugcacaccuuucauuccagcacucgggaggcugagcaagguggaguucugaguucgaggccagccuggucuacagagcgaguaaaauaaauaaaaaagacuguuaggaaguuaaaagcuauuuaaggagcacgugggaagaaugagugaaugggaugaagacaguggguagagaaagggaaagacuagagagacaauggaugaaagaaggagaaagaagaggagggagaggcuguugagggaaaagagcaggagacuggggaaaaaauaaagagaaagaacaaacacaaagacgacccaacaguauaaaaagguguugcccuuuaaagauuuaauucacauuaauuuuacguauauggaugcuuugccugcguguaugucuguaccuggugcucaaagaggcagaagaagcugucagaucaucuggaauuggaguuacagaugguugugaacugccaugugggcacuggggaucaaacccucuacaaaagaaacaagugcucuuaacagcugagcuaucucccuggccccuaaaagaagcguggguggggguggguggguggggcaugaaguagauaaaugucaaaggggggaauaagacuuaaaaacaaaaacccaggggcuggagagauggcucacugguuaagggcacugacugcucuuccagagauccugaguucaauucccagcaaccacaugguagcucccaaccaucuguaaugggaucugauguccucuucugguguggauacaaaccacagcagugagaacggugccugccuuugugccuuccagaccuccugcauacugaccacccugauggaagggugcagcuguaagugucaugcacacuccuugaacuuuuggcuucuguggcaguuagcggcagaggauugacuccagagaggcagaggaucaacuccagagacuuacccacccgcuggccucaagcucagagcuauuaagcuccagggucauucuauguggcagagaacugcguccagccacccauccuuucucuauguaauuugagcuuaguuuccucuggcccccuugcuucugcacaacugccucauguuccuguggcaggccaaacauugagguccccugagcugugggggacuccugaucucaagacucuagaguagcucgguuucaaauaaauuacccauuaaaaugaugccugaugcuccuaucuaguucauaugugcugagagagagagagagagggaaggggagggggagggggagggggagggggagggggagggggagggggagggagagggggagggggagggggagggggagggggagggggagggagagggaggggaagagggagagaaugggauuacucuuuaccugacugagagaggaguccacagcuggauuggaggccugagagagcuguggguuugucuuggggguagaacugccggccucuccuugucagggccaucugguuuaccuuuugaaggcuacuuccguuuuucagcccacugcuggggaaccugugcacuugaggugugucugacucgcuggugcgcucccuuuucuucucugauauccuuccuggaugucugguuuugguuuuuuuuuuuuuuuuuuucgagacaggguuucuuuguauagcccuggcuguccuggagcucacuuuguagaccaagcuggccucgaauucagaaaucugccugccucugcuuccugagugcugggauuaaaggcgugcaccaccacucccggcucuuccuggaugucugaagcaccccccucccccuucuuuggaauagcaucuauugccaaagaucagccuaggcuuggagagggguucugaggaaaguguguuuggggguggcaagagaaaucacuugaaguugaucaugggguacaagcugauaggccuguguucugcuggagacagcucucuagagaucuccagacagcucaguuccuguuagaaaaauucuaaaagggcuguucucucugaguaguucucucuugcaggccaaagccuggucuguuauuuauauaucaauugaaucauuugcccagguucccuuuugauugucucauaaaucagcauuuuuacaaccuuagcccauugauucuuaaagaagacagcaagcacacuuuuaaaaaaagauuuauuuauuuuauguauaugaguacacuguagcugugcugaugguugugagccaucaugugguggcugggaauuugaauucaggaucucugcucacucuggucagcccucuggcuuaaagauuuauuuauuaucauauguaaguacaguguagcugucuucagaagcacaaggagagggcaucagaucucauuauagaugguugugguugcuggaauuugaacucaggaccuuuggaagagcagucggugcucuuaaccucugagccaccucuccagcccaagugcucuuaacugcugagccaucucucuagcccuugaagauuauuuauuuauuuuauaugagaguaugcuguagcucuuuucagacacacuagaauauauggacacacacauguacugauguguguguguguguguguguguguguguguguguguaucagcacaugcaauacucaagauguccagaagagggcauaugauccucuggaacuggaguuaaagacuuuccuguggguuuugggaacccagcugcaguucuuuccaagagcaacaauuacucuuaaccacugagccaucucuccagccucaccaucaugauuuuaaauaaaucagcuuaaauugucuuuaugaucuagaauaguuauaccuaaaguguguaggcauacuugaugcccacuaaugauggucuauuuccuagcaauguuauagauggaauucaggguccagcacucuaaaagaauccaaccccauacuccuagccucugugaccugcaguuauaacuaguccuacaguagcaauuucaguauaauuuuaauauaauuuucaucauauuuucuacccuuaucacuuauuuaauaugcuguggugaaauagagaauccacuagauuaagaaucauuaaaacugggcuggugagauggcucaguggguaagagcacccaacugcucuuccaaagguccgaaguucaaaucccagcaaccacaugguggcucacaaccacccguaaugagaucugacucccucuuccggagugucugaagacagcuacaguguacuuacauauaauaaaaauaaauaaaucuaaaaaaaaagaaucauuaaaacuuaguuucaaauaucauuuccauucuuuacaaacuucauaguuuggggagaaaaaaauuaaugcaaggguuuucaaugagucaaccugaaaucaaccuaagguauguuaaggacagccaugaggccaaaacgaccuuacaauauuaugggacccuuguccccuuucaacacuauuuuagggucacuauugcugugauagacaccaugaccaaagcaacuugggaaggaaaggguucauuuggcuuauacuuccucaucacugcucaucaucaaaggaagucaggaaggaacuuaaacagggcaggauccuggaggcaggagcugaugcagaggccauacaagaugcugcuuaccuacugucuuguuccuccuggauugcucauccuucucucuuauagcacccagagccauagcccaggggaugacaccacccacaauggacugagccauccccaaucaaucacuauuuaagaaaaugcucuauaggcguuuggacagcugugucguagggagguauugucucaauugaggcugccuacucuuugaugacuuuauccugugccacguugacauaacccaugccagcacaaccaacaaauauugacauuugauguaaccaaagcaauaguggguguaaucuguuguaacaggacuaaggcagcagugucagaguacuuuugcuggguuccucacugccaacgcacugaggauucaacuacaguucugauggucuucauuaaagaaguaaacuucauuaagggacuucagucuuuaaccuuuacaagacgacuuuuaaaaaggcugugucagaaaacagagguguacuugaggguuuucuguuucacguacagaccauucaaggguguauggccauuacuuacgaacacaaucaacucucucugaauaagaauggcccccauaggauuauauacugaaugcuucgucaccaaggagcagaacuguuuuaaaagaauuagaaggguuaggagguguggucauauuggaaguaugucacugagggguggguuuuaguuuugacauuucaaaagcccacaccagguccaguccuguccauccaccuucaaugaaaucaggauguagcucucagcuacuuuuccaucaccauguccgccugcaugccaucaugcucccuaccaugauaauaaugagcuaacccucugaaacuguaagccagccccaaugaaaugacuucuuuuacgaguucccuuagaucauggugucuccucacagcaauagaacagugacuaagacacauaacaucuuugucacuugaaagaaugacugacagcuagccuguuagugcaucccaauaaccaaguggcugagaaagucagcuuacaugaugcaguuuuaugugggaaucuggcuucagagguucugguccauggagggcuccauugcaucuagcccuugguaacacaaaacauuauggugugguagggcaaaguggguaggucugagggucagucaacgggggcugcaagagagagaguagggacugaggggcaagagacaugaagaauggagacaagacaggcuaucugaucaaggaucaagucucaagucuugagucucauuuauugaaaggcaacuauggauauauaugcacucgcuggggagugcaacuggagacacuuaaccacaaguccaggauguauaggagaaaaacaagauguuaucagaguguguucagcuguggugggcuucuugcaaaaacaucauacuaggaaaacaagucucccgucaggguggaaaagggacugccuguaaguaagcagccagagguggcugcagagcugauagcugcuucuuaagagucagcucccagcagcaaaguuccuugcuucaguauucaaguaauaacauucgagcuuucaagugaguuagaaauauuuuaugcaguucuugagguuggcagccucuccauuauuaaagaccuuccugauuacagggcgaauacuaaugaauguggccuuggccuugcuggauccccugcaagaacagaaaguacucuuaacuguugagucauuucuccggccucacaucacuuuuuaaaagcaaucuucuggacacuugcuacugcgcauuuaguaaguuuauggcugcccuucuucauguaaacaguuacccugggucuucuccauuccaugauuuuuuaaaugaauauuuugaacauuaaaaguauuccuguuaucuuuucauccuaaccuuggaaacuauugagagcuuuugaaucccagcucuuucuuucaaaauauuaaauauuccuuauugagccaaugagauggcucagugggcaaaggcuacacaagcuugauaaccugaauuugaucccuggaacccacagccagggggaaggagaggacugucuccauaaagaaggcuguccucugauccccacacuugugccauggugugcacaaacccaguccauccccuccccccaaauuaaaggcuggaucgaugacuucaugguuaagaacuguagccuccccuagccuggaagcaggcugauccagacuuugaccuuguugccacuaagaaggagauuaccuagggaggagccuuccgaccuagauggcucuuugguucugucaccugucacugcucuccucaaagacacugcuaccugcugagagaccccugagauaaacuucauuuuuuaaaaaaguauuacuggaagugcggaaggauacgggcuaaguuuggaacagugcuaacccggugcuuuuuccacuuaggauuugacagcgaaauaugugugggacuagaaacugugaaucaggugguuguguuuaaaagcuguuucaagagagaggaauagggggcuggagagauggcucaguggguaagagcacccaacugcagagaacuucugcugcaggggccagagagaaaagggcagggcgucccccaauuuucucucugucucugggagagauucaaaauccauuuuccucuauauauuuuuuauuauuaucuuaaacccuauuccucggcuggugagauggcucagugguuaagaggacugacugaucuuccgaagguccugaguucaaaucccagcaaccacaugguggcucacagccaucuguaaugagaucugacgcccucuucugagugucugaaguaugcuuacauauaauaaauaaauaaauaaaaaaaaaucuuuaaaaaaaaaacccuauuccucuagccugaugcaguucuugacuguggacaaccaccuguuucguuauuuuaaagccuauuccucucucucucucuuuuuuuuaaauuuauuuuauuuuuauuauauguaaguacacuguagcugucuucagacacuccagaagagggagucagaucucauuaaggaugguugugagucaccauaugguugcugggauuugaacucaggaccuucggaagaucagucaguccucuuaaccacugagccaucucaccagccgaggaauaggguuuaagauaauaauaaaaaauauauagaggaaaauggauuuugaaucucucccagagacagagagaaaauugggggacgcccugcccuuuucucucuggccccugcagcagaaguucucugcccucuuuguguuggcuaaugucuggugcaccaaauccauucacguguuaauccauguguguuuguguuuaguugucugaaugacugaauguucuguguuucauguuggaaaauaaaagauggcuaaaacuuuaucugcugguucagcaaagccgagaguggccacacuguuagccagggaucaagcacagcaaggaagucacugauggaaaagcugcuuucaaagaaagggagucuauagcuucuuaguucuaaggcaaaaaagcugauaguugguuccuuccuggaaaauucucugcaaucaugauuauuguguuuggcaaaugacaaaguguuuuuuuaucuuauauuauagcuagaaaaauggaaauucuuugauuggucuaaaucuauaagacucauguagccacuucauuggguuuuuuacuggucuuagagguguaauauacucugcgugucuucaucacaagaguauuagcuuauaaguuauuggguaugaucaaaaagguguaacacugguuacuagaaaguuagcuuuaaguugguaacucagguuuggagucuuucaaacauguugcauaaagcaggccaaaaaacuaggccucuaaggauacuucuaguugagauaauauuuaauguggauucuuauccuaaaagguagacuuaaagauaagauuuaaagcaaugucucuuuaaugaagcauuaaaacuugcacugucaugcauucauagguauaaauuggcagccaaauuuuguaaugugauagugauguuucuaacauugauucuaagguuauaaauuguuuugaaauuggguuuugcuuucccaagguuguagauauuauucuaauguugcaaaagaaacuuaaaaaucaugguuaaaauugccaguguucuauugacugcagcuugcaguuugaucacaagcuuaagauuuuaaacucacccauauauuguuaauuaagauuauuacaagaguaaucauugagacgggugugguggcacacgccuuuuaucccagcacuugggaggcagaggcaggaggauuucugaguucgagguaagccuggucuacaaagugaguuccaggacagccagggcuauauagagaaacccugucucgaaaaacaaaaaaacaaaacaaaacaaaaaaaaaaaagaguaaucaucuuaugagagcgcuacaaaacuaagacagaguuaucuagauauguuuguuuuuguacauaaauuagacccucagacaguagauuuugcuuaugguugcugccuggcaggagacuacaguacaggcaauuuuuuuuuuuuuuuuuuuuuuuacagcaccaaaguuauaaaguaaguuuuaaguauaagucauuuuaagaaagacuauccaaaauuagaggcauggacaguugaauuguuuccccagaauuuguccucauugcaggagggccaagaugcucagauuaaaaaaaauuuuauguuuugaguuaaugcaaaguucgagcagccucugcggggugggguggaggggugggggggugggugugugugugacuuucuuuuguuuugcaaacagugccuggggaaguucuugccagccuucaggggaauuucuaaaagaacacuguugcagaucuauccagauguuguucuaaauaaaguucuaauucaaaguuuauaaagggucaaucaggcuguagaauuuaucaagacauuacaguuugacuugccuacuucauguaaaguuauuauaggcuuaaaaguuuguuuuuuccuuugaauucugauaauuauaaagaguuuugcuucuagugaacugguaaucacuggaaaauuuugccucuagguauggcuaauauagcuuuacauuauguaagaaaaaauuuuuauugccucugcuucuauauaagaagcuaagagcuugaauuuuucaguguauauuguuuccuaaguggaaaguauuuuaaagcuaauggcucucaagggaaguuuacuuuaaaucuuugcucucauacaaugagcuuuaaaguucuggggaguagcuguugcuccagaaaagauucagaggcaauaucuuuuuaauauuuaggguuuuaguuauacuauaaaauuuugguacagaaaaucuaagaacgaaaaauugauuugcuucaaaauuuuauuuucaaaagcuuccaggagauguuaauuggcuaagaccucaccuuaaacucaccacaggagaacuuaagccuuuguuaggugcuauuaagugagacacaaaugaacuggcaaagaacaaaaggcuuugcagaaaauaaagaaagcuuuuauaauuguuaucaauuauaaucaauaguaauuaaauauuagcugcuuauuuuaguuaugguuauuaaaugugcccacagcaauucuuuggcaagagaaaaauuuaauguaaaaucaucuuucuuugccucaaaguaaaguuuuaacauccuuuuaaggcugcuguggugcuaauaaagaauuguaagauaacuuuguguauuuuagaaaaccuauaacaaaaaauugugucuuaagaaccugacaaagugucuguuccuuguuccaauagcaauuaauuugguuauugcagaauauugauauuuggccuauugcacaccaucauuuaaaauaaaauugauaaucauuauccuaaagauaaguuaaaaauuguuuuuaugcaugcuuuuguaccuucuauaaauccaugcauguaugcaucccauuuacuguguuuaaaaacagcccuucuaugggagaaaaguauaugugaauuggaucacacgcuuauucuuuugaguuucuuccugcuucagcauagauaauuaaauugugugcuguagaugguguuuuaaaauguugaauaaucaagcuuuaauuuguauguuaauuaucaauguauaucucagagcuuacaauugcuuaaaauuguucuucucucagauacuauaaauucucaaauuugcaaugguuuaugcauacauaacucauaagaaaaaaugcugcucuuuuaagaagacuguuuuuggacauuuaauaaaauuuucuggauugucuggacaagaccccuuaaggcaaugccaugcuagauuuauaucucaggcagauacaggccuuacauaagaauaaucucauucuuuauuuaaucaaaacaguaaugguuuaagauaauauuuugguauuuuuagagaaggugcauaucaaauugugaaagaguuguucuugguguccucaauuccuaccuguuuccacauaauggcgggaccauuagcuaauacguggaaugguucccgucuuaauauuggggaagagagggagugcuucuguuuuuuccacagaaugcugcaggaguaugcuagcuuccaaugugacaggcugaccuguggguuccugagcacccugacagugguuacaggaaagcuguauugagcgcacagaggaggaggaaauuggagagcagccauuugcaaacaagaugaagaaacuuccuauccccgccaugggcuacagcaaggagagcugaccuggugucaacuuggggacaacuaaaaaugaugacucgugaggcagagggacugcuacagaguauuggacaagauuucgucagagacacuguuuuuggccauucaggccaacuccccuauagcuguaaaaacuuguguaccuuaccuguaugcuauaauguuagauaauuuuaagaguuaagaucaccaaucuuggcaagucuuuucauauucauuguaauucuugucaaauaacuaauuguguagauccuaauuuagauaagaaaucugcuguuaugauuuuguuaaagagaucugcuuauguuuugcugccaauuagaguuaggaaaugauccuugguuuaaaaaucugggaaugcaaacuuugaaaagguaucuaccacagcuuuagaucagcagcugcauacugcucauuuuguuaaugauaagcauaggaauauuuccauagccuugucaaagcugcauauuauagauaaaaauuggaggcaaagguuaaugucuuagaaguaguagucuuagcaauagggcaggacauagcauauauuaaggcuagaaaggcagaaauuucagauauuagcaaaagucacuuggacacuuggaacauugaugaauuggccagagauuaaaacaacagcaacaacaacaacaacaacaacaacaacaacaacaacaaacuaagugcauugaauccccuggauuggguucaauauauaauccuacuugcuacuauuauuggcauuauuuucuuaguaaucauuguguuuccacucaucuuuagagcacucuugagaucuguagcuacgaugaggugggacauuccggaacuucggcagaaauauaaaaaagauaggggaagaaugcuacacacacuccagugaaguuugcuuggcaggcuuagaggccugggagcacucacgaggcaaagaguuucacggaaacucaccuccuggaacuuuggcguccucauaaccuguacccuauccccauaacucauacccuauccucgaguuagucugguguauggauccacgugcucucuuuuaguauuauuuuauuauaagugccuuuuaagauugaauucugacauagcuaagccuuugccaguguuacaauguuccagaaaacccuugaagccaacaaacugggaauucaguaggaauucagugagaagguuagguaacauucaaguuuacuucuaguagagacagugaaacuaaugaggcauuacacagaacgagauagaauagcucagggcuagucugcagagugaucacuugggacaguagccagucuuacccagacaagggaauucaccagggccuagcgauuagguggguuuaccaugagaaagcuagggaaucucacugagacagguuucuucauuaggcccaaagaaaucaggcaggacuauggagcauaaaauuuuuuuuaugcugaaaaaguaaaacguaaaaacaaaauucuaggccuuugggaguguggccuuuguggcucagugcuccgaggugugcuggucauaaaacagauagcaacauuccuccaccaccugcuuccuggguucaaagaguguuaauucaaagaaugugcuauuguuaggggcucuuagaaacugucuugagaaauaacccucacaauuaccagguauuccucgugacucuugugacuuugcacuuccuugugacucuuaacugguauuuuugguauuuuccaacaaugcccuccccacuuccuugaguugugguuucucccuuuaaauacccccuuauccagcuacucggggcaccacgguccucuaccccugcgugguguaugaucguggaccugagagcgcucuugaauaaaaauccucuugcaguuugcagcaagaccguuucuugugggugauuuugggguguugccucuccugagucagaacaugggggaguccucacguugugagucuuucaaugccuugguccagcuauuuuuauuauauaaucagggaggaagcaggcugauccagacuuugaccuugcagccacuaagaaggagauuaccuaggggguagccuuccgaccuagauggcucuaugguucugucaccugucacugcucuccucaaagacacugcuaccugcugagaggccccugaggcauucugaggaacauccuauccugcacaggcuggcuccagacaccaagaaugaacuggcgggggaugggacuucccccuuauaagcacacucucuuaguaaacucgugggccuuacacagaauugugucuuggucuccauuaucucucucaccgucuaagucuuuuucagccccaaacugccucccagguguaccugguucaaguaggcugugggccggcauacaacaaagaacauuuguuucucuuggaaaagccuggaguuugguuuccagcacccauguaacaguucauaaccaucuguaacuccaguuccaaaggauccugugcauucuuucggcuuccaugcacacuguacacacauguagugcauagacauacaugugaggaaacacucauacucauaaacuaaaaauaaacacaacuuuaacauaauuaaaauuuaaauguccauuuuugcuuuguuguaucacagagaagagaauuguguagaucaaagccaaaggcaggaugugaguaggaaaagaaaaaucggauaauuugugcuucaguaaaacuugaaauaguugugcuuccaaaagagacuaaaagaaagugaaaggagccaagcagugauggugcacaccuuuaauuccagcacuggggaagcagaggcagguggaucucugugaguucaaggccagccugaucugcugaucuucuaauuuugucuuccaguuuccuugguuaugucauagacuuccuuucaaucagagccaauagcauagcuaaugaaggaaagggggaguuauuguagauuucauaagugaaggguaauauuauguauaaaaggccauagcugaaagugccuuuguccuuuauccccagggagggggacaaagugaagugaaaaggugucuguguguguaucuguguguguccuugacugcccuucaccuugguuuugaaacagucuuuuauugagccuggugcucacagauuggcuugcuuggcuggcaggccacacaccccagcauccuucucccucuuucccaggcuuucauggucugggaguagaggccugcccuaucccuucuuguuuuguaugugggugcuggaggucuggacucagguccucauguuuauccacugagcuaugugcccagccccuaguugauuuuuuuuaaacuuugaugaauaauuaacuuagccuacgugucuccauugccggcugcuucuacccuccaugguugucugacuuccauguguuaggugaaaaacugaaaaugcauguauaaaaugagccaaggaaacuucaguucagaccagauguccuuuaccugccuuuuguguaccugaguggcucacagauucucacaaagaucccaaauucuaaagauaggcauccccacccuauaaggcuguaggcuguauaacugggucauacucaaaccccggucugagguccugcucuuuuuacagacccuggaucauuuuaguucaguguucuugaaaaggaaggauguugauuguaaagaucuuucaaaacguacacaugcaggcucuagguucaaguguucuguucccucacugagagcaucccucagugugugagaauuuuuagcuuagaccuuuguguaaauaugaugaaaacggauuuuguuuguuguuguuuugagauagauucucaacucuguagcucugacuggcuggggacucauugaguagaccaggcuggccucaaagucauagaaacccaacugccucugccucccaagugcugaaaaggauuuuaauuuuuguuuuugaaacagagucuggcuucaucacccaggauguccucaaguuggucauccuccuucagccucccaaaugcugggauuaggccugacgacaugugagacugaauugucugaccuauuugcccaucaucuaucuccaacuguguguuggagugucggaaggcucuuuccuuaaaacaaaacccaugaaauccccagcuacucuagcugaggcagagggguucgauguuccaagccagccugagcuacauagugaaaccuuucaagaaacaacccagggcugagaaauguagcucagugguacagcacuugccugguauguaccagguuaugaauuugaucccccauagagccaaaaguacacaaaaacaagacacaaaaaucugcccugacgaaagucacugaagaaaacaguuucuugggagcggaaaucucuggaugauagaugcacacauuugaucuuauugggugccgauagauuguucuuuagaacaguugggcaacuuccaggcucauaagugcccuucgagucuccauuucucugcuuccuagccagccguagauaaugccaugccuacuuuuacaacugcaguaggggguuccucuagcucgcauuuacgaauuucauuucaagcaaaucacaguccccacuggucccuucucagaucccguaacuuaucucucuucugggaagugaucacugaauaauuaaugucuguaagaaauucuauaaugcacuagagaaaccaaggaaaggucaggcagggcuccugccaugaggaggcuuaugguuuacccgugagauggacuugcaaacugguuuuugguuuuuugguuuuuuugguuuuuugguuuuuugguuuuuugguuuuuuuguuuuuuuuugguuuuuugguuuuuugguuuuuugguuuuuuguuuuuuuugguuuuuuuugguuuuuugguuuuuugguuuuuugguuuuuugguuuuuugguuuuuugguuuuuugguuuuuugguuuuuugguuuuuugguuuuuugguuuuuugguuuuuugguuuuuugguuuuuugguuuuuugguuuuuugguuuuuugguuuuuuugguuuuuuugguuuuuugguuuuugguuuguuuuuccagacaagguuucugucuauaguccuggcuguccuggaacuugcuugguagaccaggcuggccucaaacucauagagauccaccugccucugccucccaagugcugggaugaaaaauguacaccaccaugcccagugcaaacaagucucaauauggcuguuaaaauaaaauuguggggucaaagcaaagcaaaguauguggggagccaaaaggacuguggggucccucgcuguuugauaagaggggaagaggauggagaggccaaggaagcuuucacagagggacaaguuggucaugcuugcccucauauagucuccuuugugugugugugggggggaaguguacaggggagaugucuaucucaggagacccuagugaaugcaaaucccugcaguuugagcuuccucauccugcugugaaucuacugaagacggccugugaagucauuuugucuugggacucuaggccagcaucgcuuuccgagcaggguuugagccugggcucuggcaucuugccuacuaugaucaguuucuagcucugugagucacuggcuccugggaccacagacaaauuaucugagcucucuauaucucaacuuccuucuccuuaaaaaccacaggucaugggucacggggagacuuuuuaaaaaguuaguauuagcuuuuuuuuuuuuuuuuuaaagucauuccauaccagcucagucuucuuauuucacaggcaaaccuuugcaccucugcugccuguaaacgccugucugagguucccacuuuuuccuuauagaagacucccaauucccaaccugaugggagaaucuucagaccucccugccugcagcagauguuccgggggcaggaacauagggaaguaauuaaaugcuaaugucuggaggugguuauccccugugaaacgaguccuaugacugagcgugggcucagacacucagcccugugcgugugacugugugugugagcuggucagagcauucugcgauucugcugaacauccugggcagguggguggggaagagccgccacuggcuugagaugcuaaguaagaaggcgggcuaugcaccugcucuugucucgagaucuggggguggaggccaguccacccccccuuacccccaccacaccugaugaguggaaagagaagguggaauugugguggacacugaugagcuguccccacugugcaacugccccagugugacacauuugccaagcaccuguguuaguccugggcuugaacuugacucucaccccccagauucacucuuuucccacuuuguggacauuuucuacccucuaugaagcuugagaacuggaccccagauuccuccagucaugaugcuggcagagacccaggguccacagagaugaaaccgaggagguuggcacagagggcugucugccagcgagauagcagauuucuggaugccagagccaggaagacaagagaguaacaaauuccucugcucagagcuugccagagugcugagaauacuccaucugucuaggaauggggacaaagguggcucucucuuagugugugcagcaucccauagccuugccuuaggugaaugugggcuuugcuggcuguccuccccucucucgccuucagucuuuaucuccucauggggcugccuugacuagccagcucugaauucuuuaucccuuguuggcagucaugaagcacaucugaacaaauaccagacacagucaccaagugccagcucuacauacccuuuaaauccugugccuggaaacaacaacacacagcagaacugacuggugacaccugcacaguuagccgggcaucaacgcaguacacacagcgcacagugggcucuggacucaacgcuucaccgauccucagucgcugcagaccuggaccuugcucucucugccuucacaagaggaucuaggcuuccaaggagcaagaugacggcccacuugccacaagaggucagcuuuucaucaaugacccccucccucuagcacaggaucuuugguaccaggugggacugugcugacuggagagaggccagagcugagagcuacagagacaucucagauaucuuauuagauuuguaugaccuucaagugagggauguggcagucauguugccaguugacuuuaaaggaaagaaagcucccguccagccaauaccuuucugcaugcacaugcauuuuccuuuguauguugcuugagguaugaauguuugauccccgucccugccccuucacugugagguuugauugucaacacauucuagguaguuucugggaaguuuucucugcuucaucuagcacaucuguacucugucuuccuaugaucagggcacugggguuucugccucuacugccuuggcuguauuacaggaggaccccccccuugcuguccuauguaucugcuuuugacuuucacuuccucccguugaagaucuccagcagguguagcacuaccaacaucauggaaccccacucccggagacagcaggauggagaagagaagaugccccuccaggcagaagauauccggccugaaauaaaagaugaucuguaugaccccagcuaccaggaugaggagggacccccgcccaagcuggaguacgucuggaggaacaucaucuucauggcccugcugcacgugggagcccuguacgggaucacacugguucccuccugcaaggucuacaccuggcucuuggguaaucuccaaacccuccgcccugggccagcaccccaugucucccccgcccccaacucuuuaauaagguagacucugauucugaaaaguagccgcucucuguccagauuuuucaaguuuucucuccacuuucugagauacugauaacuagacggggaacagagccucgugggauugggguacaagagugucagaucugggggguucuuuagcuuggaugcuaaagucuauaaaagguggagggauaacuguaugacaaaggauugacagucuccuaaagagcuuuuccguccaaaaagcuuucugacuuagcauugccugccacaggaaaacuagagcccuugcugagaggcaugggggcuuaaugaggggguauuugcuuagucgggagacagaguaaaguaagacuauccagaggggaucgcuggagaagaaggaauaaaaugggauuaccaacaaaaaauauuuguaugugauucugaccaggacaggcuuguuugccccagagaaagaugaggcagguucccacacgguccaaguacacugguguagaguucugcugcuccagguccguccugucaguuagcaagauguucuuaaaaugacaaaaauagagggggagggggguuucagaauugggugacauuccauucauucccuggccagccaguuccugcucuugucucuggauaccauguaggacaaagggcccagaaccuucugcucuuuccucucuaccuccaccuccccuugcccaaaauagccaggcucagagacugagaaacccuggccuucagacuguuguaacaagaaagaagguugccacugugucucuucccuagcucagcaacuuggggaucugugcguaugugcugaugcagggcuggccccuggacccacaugugugcuuucagguagauucgccucugacucccaauucuuaaaucagggagagaggagcaggccagggccccuugcuaccuucugaggaacgaugagccagagaucacucucuggaaggcagaagacuuucugguagcugccucuagaagguagugauguagaaguuggcugcugguguuggccaccccugcccuccgucucuuaguaccugcagcaggugagcucugcauuaccuuaaaaguucuguaggugccagggaaaauacaacugaggaaaaacucuuuuuuuuuucuuucaggacuacaguuuuuccagguaccaaguggggggcaacagaauuugcugugauuaggaaggccaagccaugguccuugggcuaguugugugcuuuuccaguauucuccuaacuuggauacucugagagccuucuacccugcucggguacugacauggagugcuaaaagaggaaagcucuccugcucacgucuuagaagugcuuaaagauguugcuuaauauaccugggacacaaacagaccuugucuggaggucauggaacuaaucuauuugaacugagccaucuauuugaacugagaugucuauuugacagucaugggguugagaaagaggccacacaguaacagggcucuugucucaauucccuugugcaugcuccgaguguuuucaaagccaaugaauguccuagagacaccugugacauaaaacugacacuuuuggguguuccacugagggccucugauuuggccaaagcucuuucuuuucuccugugauugcaggauccuggcuccccugugguucggggucaucuuggauacgugggaagagcucaaucuaaauacaucuagaagcagaaaaucacuugggucuggucccagcucagagagaacgugggcagaacuuucccugccugcacacuggcucugugaucuuugugggaagcccaaaaaaggaaugcuauugggcaggagaggggagaugcuguuugggaaacuguuacuucuggcucuagaagaacacaagagaguuuauacaauguauuuugacuucaagcugaacuaugcucugcggccucccaggggccaugguuuccagccucucauaggagcgaagcaugguugaaugucuccucuaagcccucacaggggacagagugaggguagucuguuuccuucucuauuaacagcugcaccucccaagccuuugacuucaagacagugagguaggacauggcaccuauccuuaguccaggauacaaauguaacagagaugacucacccuaacguaggcacuaccagcugccagcuuuaaguauuacccaguguuguacuggcagugagcauccagauugacagagagacagggcagaggagagguuugagaucucagugaacaucuugaggguggaugguggggcuggaccagugcuuuauuuacaggaaacugggcuucagccccuggcuacagcaugauucugggaaaaaacguagccuuccuguaugaucaaauucuucgagauguagcagaaucacacccagguguccagugauuaugaaaauauuaauauucuugguaaggcucaagccacuguaagaauguaguccugugcagggcugacucgcccucauacaagcaugugucugccaucauaucaaaaugguucagcuggugaauuggcacaggccugugagcucuuaaaauuuggagguuguuguaacugaucgaaccaaauugcucugguugcuauuuuucaagccacugagggcuaaucuguggcccugaacaacuuagaucagaggaaggucaugguugguaggcucaggguacugcccccugcagacagacaguugucugccuugaauucuggggcuucuuugcuuaccuccaucucuaaauagauagauagauagacagacagacagauacauaaggcaacuauucaaguguucaaagccacaagauaggaagaccaaggcaugggcuagagagauggcucagugguuaaaaacacugguuucucuuucagagauccugaguuuaauucccaacaaccacgugguaguucacaaccaucuguaaugggaucuaaugccuuuuucuggugugucugaaaauggccacaguguacucauauacauaaaauaaauaaauaauaaacaaacaaacaaacaaaaccccaaggcaucucaggguucugggaaggaaaggauucucucuaaccucugaagaagaagcagaguagagagucagccaaggguccucacacccuuggcccaacaggaccagcaaugguuggugacucucccacugucuccugacaggaguauucuacaacgugguugccgguuugggcaucacagccggagcgcaucgcuuguggagccaccgaaccuauaaagcaaggcugccccuacgcaucuuccucaucauggccaauaccauggcuuuccagguaagaggcugcucauagaggcucugugucuacucugugagggcugggggcagugugaagcagguuagcaccccaagaggagccaauuggaaagccaccacagugcaugcuugaugcugagguucacguagcaugggagucaccgggaugggaaacaguucacuggaggacucgcugguuagagggucgcuguuuuccccaagguccccauguuauacuucacugguguuugugacauagaugaacucaucaaauccucaaaauaccuuuccuaagagaucaagccccauuuugcacguggucacuaagagguuggacagguaaacacuguggucuaggcaugacugccaugcugggcaagucaacgguugaaguuugcugaggcaaaaaguuagaaaacagaaaaaagcugggcggugguggcgcacgccuuuaauccuaguacuugggaggcagaggcaggcagauuucugaguucgaggcuagccuggucuauagggcgaguucuaggacagugaaaaguaauagggaccuguuauugcuguuagacuucagcagugagcucaggcuagcucaugggauggggcuuacccugcaguaagaggccaucaaaucagccccucucucuuggcauggcuuaagaugcucaccucaugugcuaaucacuucuacccaacgacuuauuccucaaaggcuccugauguccuagugggacaaaaucaaaaagagacauuggagcaguuuugaaaggauagaaagagucacaaauaagccagagggcgcuugggagagggacgaggaucaugaguuacacccuggcccugacacugggcuggcuaagcugucauuuguaaaggcgucagggugacuaucccuguaccuuuuugacagagcagaauccauguuccccggggagccuuacuucacagucucugcacccagugacuagguauucugugaggcaccugagaacucguguuccuugccugccgccuuccguguugggcuugugaaccucauugucccucuccuccaugugccaucuccccaucacacauccuaaggcagcaugaguaccauucccuaaccugggacuguagguugcuuucugacaagugugcagaagagagugcucaacaaggacuccuuugggucagaguccugaggauuuugugaguugggcugagagucccaggcccuugcagacaucuagacccuugcauucacuuuggagggccucucuucucaauacuggguuccucuuuccugugcuuccagaaugacguguaugaaugggcccgagaucaccgcgcccaccacaaguucucagaaacacacgccgacccucacaauucccgccguggcuucuucuucucucacguggguuggcugcuugugcgcaaacauccggcugucaaagagaagggcaaaaaccuggacaugucugaccugaaagccgagaagcuggugauguuccagaggaggugagggauggggugggggguggggguggaacccagggcaccugggguuuggggaaucccacuucuucuaauagagcacauuaaauaagaacugaagucuucugcucuguuugcaugcucacaaucguuuuaaaacacaguucucuaaugucucacaggcccauaguuacagauuauugcuauguuccuuucucucugagauauuuucauaaaugcaacacacauguucauugaccuagaacugucauggacacaauaggagaagcaacgggguccuuuucuuugcaaggccuguauccuaggcagguaugcaaauaaccagaagcaaagcggaauacugucuacucugggaaagcuucgugcauucaugcagcccaagacugcugggaagagcuguugaaaaagcagcuugcaaaacaacagugauucugaugugugugugugugugugugugugugugugugugugugugugugagagagagagagagagagagagagagagagagagagagagcacagagacaacacaaacacuugagacuugcuaaagccuucuugaaggaggucccuuagcaucauggagaagagauauguuucagagaugcugucuaaauacaggugaaaggagcccuugauugacagguaaaggucagagaaacauguuagauauggaagacccaggccagggaugcagagguaagaguggaaagggaaggaauaggaugugaauaaugucaguguagguugaauaucagacuguuugacagaccucgaucaaauccuugcaauguuaaagauugaguaaagccuccaaaggggcagagaacuggaggcaggcaguaacagguuauuucucugcugcuggagaagugagccaauugaagccagguuagauuauauugaaaucagguuuauugggaagcugcucucagugggcaaguucacuggccccaaggauugaggugaggggagucaccaugguuggggguggggagaaagagagaaggggcaugugcaggaagaagaagaagaagaagaagaagaagaagaagaagaaggaggaggaggaggaggaggaggaggaggaggaggaggaggaggaggaggaggaggagaagaaggagaaggagaaggagaaggagaaggagaggaagaagaaggaggaggaggagaaggagaaggagaagaagaagaaggagagagagagagaaagugugugugugugugugugugugugugugugugugugugugugugugugaaaaugucuggauuguauagggaagauucuuuggggaagggcagcccagucccuggguugcaaaguucagguugggaucagaguaugccaggaagggaugagagaugcugggagaaccugguggccaugucugcuuuggcuuguagaauauacaccucagucccuguccuugguccaccaaacagccaagggggcacucagugugccuccugggaagcagagcagacguugagcauuagccauggaaacgaacacuugucacacacucugugucaaagauggaggcagacucaagaaagaaaggaucccaaaggcagcuggacagggcuccaggcagcuaaaguuagcagaugaguucaugcuuugaucccaaccucuucggccaacguagccuuccacuuggugagaaaaaagaauggauuucuagucaacagacacacauucuaacccauauuccagcaguguuccccaucuaaagauugagauaaggacucaagagagauggcucagugggaaagagcacuggcugcucuuccagagguccugaguucgauucucagagccuacaugauugcucagaacuuguaaaucuaguuccaggcaaaucagugcugccuucugaucauuuuggauaccugcacacaugugauacacauacauacacauagcaaaacacucacguguguguguguguguguguguguguguaagagugagagaccauauaccccuccuguauucauaguguaggaaaaaaagacagcgcagcccaguaaaugcggccuucucaaguuugccuguggucccucuacccagauucagugugugaucucugcacgcagguacuacaagcuagcugucacgcucauguucaucauucugcccacacugguacccugguacuuguggggugagacuuuucaacacagcuuaugcgucucgaauuuccugcgguaugcugugcuucuaaacuucacuuggcuggugaacagugcggcccaccucuacggauaccggcccuaugacaggggcauuggugcccgggagaaucccuucguuucaauggcaucuuuagguaagucuucagcucgcaucaagacugcaugaggcaggcuguugauuaggcauuaaggcuaagucagagcggccagacuagaaucuacuuuuauguuuguguguuggagcguagguuuccaccagaagagggcugaucuguugaucuuaauuucccaaaccaccaacaaaugugacuggguccuuuaaguuguucuuucccaguugcuucugaguuagguugcaucuuccuaagggcaggagaugcagaauagagcaguaacgucgauggaaaggccuauacaucauaguguuuuauauauguaagccugcuacauagcgggaagaaaaugacgauuacuuaguucaguaaaccuuaacugugccacaaccacuguaguuuccuggaucugucuccagcuuuuagguacuugccaccauuacacacacucuuaauuugacuguguuugaaaaacaaaacaaaacaaaacccaaaaaacaaaaacaaaaacaaaaaacccaaacccuaccaccuaugcuauaaaauucggagauuuucauagagauggaguaacauaggccgacguguguccugaaccaguaagcagagucuauacaaugaguccuuaugaacuugaaguggcugccagccucuggcuucaucaucgauguuacucugcuccccgcaucuguucuucuaucccugucaccucauccuugacugccaaagguuuuauuucauuuaauuaccugucccauagucauaugcucauguuguuugacaaagauuauuauucuccauugcuuuccugagugaucucuuccuguccuagccguuacccguacggccgagucucccuuuucucuccucuugccaucccuuguaguguguguguguguguguguguguguguguguguguguguguguguaugaaagagagagagaaaaggggaagggaaggaggaggggaagggaggaggggggaggaaggggggacagaaagggagagggagggagggagggagggggagagggagagagagagagagagagagagagagagagagagagagagagagagaaugaguagauucuguuuuaaaugucacacaagagccagugaggucugguuaggucucacucagagccucccuguggaaacauguguggaaguuaucagccucgugucacuacccuuggcuacagcacacacaacccagaggacagcaggaguguaucccuugagaagucuugguggaagucauuugguuagaaaggauuccuucucuguuuuuguuuucuauagaaugcccauuaucucugggggguauuuuuguguuuuauuuuuuuggccaaggucccacaugguagcucugguuggccuuguacucccuguguagaccagguuggccucaaacuuucagagacccaccugccucuggcuccuaaugcugggguauaagucguauguugcuauguucugcuuugggagauauuuucuaacuagauugauuuguuuuuaugugcaugaguguucuuguuugugugcauaucuguauaccauuugcauggguacccguagaaucuagaaguggguguuggauccccuggaacuggaguuagcgaugguuuugagugaccauaugaaugccaagaacuguauccaggcccucugaaagaacacucagugcucuaaacugcuggguaucucuccagaacuuggguguauuuuuuuuuaacuuaaaaauguuuuaauuaguauuauuaauuacacagagucauggggacauuuucaugcgugugcaugacuucagucauucuuagcccuuugcccucucucuugccccucucacuucugcuccccaucuuuccaaccagcccuccuuuccuaucucucugugugcccgagacugggaugguucacagaaacacaggcugaaagcugauucuccgaagcauggacgcuggucaguggugcagccccugaugguguccaugucuccucuauuaaccauucucuguguauacauccucaaggaagggauggcaccccaugagcccuuccuucuugccauggcuggugcuauucagcucagucggguacagagcuggugcauuuaaucacagcugcugagauuucaagaucgcuaaagccaugcugugcccggaagucagcauuacacaaugcucgcccccucccccuacuucucuggcucuuaauguucuucccgcucuucugacuuucucuaggaguguuuuuaucuucagggaucaaugauuuuucuuauucacugucuuuacuucaaccuggacaggaucaguauuguugaaaucaguucagaaguaagagccacacggccaauaggaaaacagcaaaccgguuacagagaguaucgggaugcagauuucuguucuccuuaaucccgcaagagccucaucccuaggagagucacagaaucucaaguguuagagggaugucugaguacuuucagaguucuguuuucuuagugccucucccaccgcaaggucaaaauucugagaauuagcagccagagcgucuccagugagucaggauuggcuaaguaaaugccuagcacuggacuggacuacuuccuguaaaauuugguggcugugucagguuguaguggugcaugccuguaaucucagcacucgggaggcaggaaggcagagagguagguggaaugaguucgaggacagccuggucuacagagcaagaucuaggacaggcaggacacagagaauccuuaucucaaaaaaaaaaaaaaaauuggugguuguuauguacccuguugaaaccuccaccuuauagagaacagcaguucauggggacagugggguuuacuccaucuaagaaaaguagcuacagaucugacccgcauccucugcccugcccugcccugaccgcaggcaccuaggcacagacccuguggggcuuggagcccucuuuccugauauuuuccaucguaaaauauguucccacagacccagcuucucucccauccucuuaucuuacaauagaaacuuccucugacaaaggcucucagacacacaugugugagcagacccugguuucuugagauaccucuagggcaucuauuugcauuagaauacaagacuggggguucaucuguucaccccaacagugggauucuucaagguaugagguacauaacagcuaagaagugugcaaaagggaagcagcaaucacugagcccccugacugcucuccuugcuucuguugcaggcgagggcuuccacaacuaccaucacacguuccccuacgauuacucugucagugaguaccgcuggcacaucaacuucaccacguuuuucaucgacugcauggcugcccugggccuggcuuacgaccggaagaaaguaucuaaggccguugucuuagccaggauuaagagaacuggagaugggagucacaagaguagcugaguguggggucaucugggucucuguuccauaaaacaacugggccaacauuuaauuuucuguuaacuacugaauaaugcuaccaaagcccucuccugaacuuuuuuuuuuagggggaggggaggguacauggucucucugucucucugucuugucuguaucucugugucucugugucugucucugucucucucucucuagucuauacuauagaccaggcuggcuucgaacucacagagaucuuccugccuccgccucccaauuguugggauuaaagggguguaucacugugcccagcucugcgaagucuugucaaauguucaaggcaacucuccuuuaugaccccuuuguccucuagucccauccccacccuucguuccuacuaugcuugucuuucuuuucuccuucucuaagaagcagccagugagugcuuggccaaccuccccaaggcuucacagccuuucuguugucucaaaguaaggaccuucaucauggacaguucucugccuagguauuugucuaaagcuaucaguacaacaaaaccuuuuagggaaugucuucuuaauugccguuaguucaugcuuuucugaagaaaagggggaaaauagcaucaguugucauagaagugcuaaagguggagaauccucaggugggaaagcaugcagaguaugacucagaagcagggggaccaucaagguaggaagugacucaguagggaguacucaccaaaauaagaccucccacagacagagcccagacacagagcaggaaacggccguugaaaguggccaugcuagaacacaauagaaugucucugcagcucagucugguccaagccagaaguaaaggaaaaacaauucaguuaguaggaaaagagauuucuccugagacaggguuuuuguuuguuuguuuguuuguuuguuguuguuuucuguauugacaaggaacauuguuaugccacagaacaagaaggcuucggcuugguuaaaaaaaaacagaaaacucauagauuccacaagcuacacauccaaucuguuuuacacuucucuucugccugccuugcguugucaauguuauuuauguucugcucucauagugauuggguaacuauagcaaccccaaacaucccaacuggaaggauuguaggcaaaguugggucaaaccuaaaaucauguagacgauuguuuagagcagggagggagguguuucacugaguccucugagaagguuccagaagcuuuagaacagaggguuacuuggguuuccuguagcucccaccccugagaagagagggaagucugauggccaguaucaguagucacuucagaagaaauagcuuugcaaagagagagagcucugagaacacauugugcugugggggcuccagaaguuacugaguuacuaaguauugagagaguagcaaacucagugcuccaagguaugcuagucauaaaacagagagcgacauuccuccacccaccgcuuccuggguucaaggaguguucauucaaagaaagucacccugacccacccugaccauugcuggaacccgcuaugcaaaggugcuauuguuaggggcucuuagaaacugucuugagaaauaacccucacaauuaccagguauuccuugugacaccugugacuuuguacuuccuugugacucuugacugguauuuuugguauuuuccaacaacgcccuucccaccuccuugaguugugguuucuuccuuuaaauacccccuuauccagcuacuuggggugcccccuuauccagcuacuugggguacuugggguacuuguaugaucguggacccgagagcgcucuugaauaaaaaaauccucuugcaguuugcagcaagaccguuucuugugggugauuuuggggugucgccucuccugagucagaaugugggggaguccucacguugugggucuuucaguaucagaaugaaacuaguuugagucuagcagccuaaaugucuccuuggauucgaggagcaauuaguuuuuucucgguuuugugccucucggggauucuugcucuaugacuguccagccuauauuuaugccagaggaaagaugccuaucucuuaacauccuaauucuugauuuucccaucgguuucuuuucuccuauaggucuguuuguucccuucccucaacaggaagucucuuguguacauucagggugguccuucuccuccagauaccaugcucaagggcguagacuuucagugucucuagcaaguaaaguuguuggauacuuuccugucauuucuguuucuacuuuuccuaguccucuguguaacucugucacaggaauaacuucagaaaaguucagcaaaccuucuuagaaacgccucuggcucagaagggcuuucuagcucaaaucccaaccaaugcaaaauguucacgcugugccagggagccaccacugagcaagaggguguuaucuguccucuguguggaucagaguggagagcgugggagcauggccagugccucccaucaguccgagugcaccagagcucccagaugacaguggaaugaggagucauugggaggauucucauacguacauagugagaucccccuacucaccucaagcaaaccccacccccacuccaccccaccccccaaaauacccuauggacagcaagcacaguuuucguuucuuccccuucauguuguuuccccagaucugauccuugcauaucccuauauaaguccaaauggauauucauggcccaaguguguauuucagauccauguaggagagugauguuucaauucaaaacacuggcuuugagguucuaaagcucaauucaagugacuuguuaacgagaaacugagaucuaaccgugugacucucugauaguuauucccuugugagugcccuggcaacacacuaaggucccauuccccuuucuuacuccccagaguucacacagagcccugcacagagucccacuauaccugagauccugcuguaccuagugaucaaaggagccugguuggggaguuaucagugcagcgaguuacaggagguuuuguuggguuucaguuuggaaacuugcuuagaguuguuuuuuauuaagugaccacauuugauggaugguggaaauaauuugaauauauucuuuuuucuuuuucuucuucuuuuuguuuuuuuguuuagaucaaaaaauaguaguaguguuguuggucuggauugguuucucaaacucaccagacuaagugaagaagacucugcugugcccuccuccuuuguccuccucuuagccaaucggagacagccacgccaacucucucugggacauucaucuuucuucuuuucccaugcuagagcccuuaaaaagucauugugccaguuggccauugauaccuuugccugauccagggguaucccaauuauccuucuagaguaaauacaucuccuuugcucugagaauuuugguguccagcuguguucugugccaagcccaagcucacccccaucccuagcuucaauaaccugagucuucucuagagguagcucagacacuugucugugggaucuugaagcaagauucauguuaaggcuuauuuuauuuuauggauaugcauguucagcuuacauguauguagacauaccacgugugucuggggcccacagagaucagaagaaucaaugguuaugagccuccacaugugugcugggacuugagccaggguccucugcaagaacaagugcucuuaacuacugagccaucccuccaguccaagaugaacguuuaaauagaagucuagagguauccacucugagcagucucagccacggugugguccugcugccguuggcccauuccaucauccguagaaucccauaagguuucauuguuaaccccggguaaagugucuuuccaggagcuaagucccccucaggcugguggccuuuccuccucccagcauuagauucuuggagaaaguuucauuucugagauucauuguuucaauagucuaauaguuagacugaggucuauucauaauaucuucauuucugccuggcuaguuacauuguaagguuuuucuucaaguucugggaauguuuugaagccagggaugguauucguacaacucugucaguaugggaaaugacacagaaguagcuuaaaaauaguuguuuuuuuacauuguagaaguuccacuucagauaaaaugucauucucuagaauguacagccugaaaaaaaaaaaagaggucuuuugcauguaaaauucugugagaaauaaacaaaaauagaaugucuaauaguccugagccacuuaccacccaucacauuuguugugagcgcaacaugaagguccuugugcccauagaucuccagagaaaccgggaauguuaagcccacaggauuguccucucaggaauggacaaaaaaaaaaaaaaaaaaaaacaacaaaaaaaaaaacaaaaaccguguucuucuguccagaaagcuggggauuggaagugauugaaagcuugcugaucuguguuaucuuaugagccaggccauaucaaaaucccacaaccaagaccagagauggcuacugaccuuugcaugaccuguacagcuaggggccccuaagcucucacaaccagggccagaggggacuaauaauccaaaugaguuccaaaccagcugugugaccuacaccaagucagauccuucccuuggcccgucuccagaacccaucuucuuggaggaaauaaugugugccaugacuugaguuuuaauguaauuauguuucuuuguguaccuagaauuguacaaauuauacuggguuuaaauaugcuggcaguaaauccccuggcaccagacuccccgagguuugauccaggaugaagaugccaaucagacucagguuuucauucucaccucuuggagguucacuucccugcccacugcgagcaccugcgggucucucacacacaaaucgcuuccucuuuuuccuaccuugaugcagaaaacugcuuuuaucucaagccaaacgugacuauagccaggaacauagauuuaaguuacguccaacugcucuaaccgguaacaguuucucaagguuuuuauagcaacagaacaaaagucauaccuuaaaguagucuuaaaacugcauugcuguggaacugcacgggcucuugcuauucuugcagaggaccugaguucaguucucagcaccuacauuggaugccucacaaacagccuguaauuccagcuccaggguaucugacaugacaccccccuucuggccuuuguggccucacaccugauauagacauagauaaauaauugaauaacucuuuuuaaaagugggguuuuguuuuguucuuguuuuguuuuuuguuuuuguuuuuguuuuuuuuuuguuuuuuuuuuuguuuuuuggcggggugagugagagaaaguuucucuguguagccacaaguuuaguuacacagcuucggcucccagugggucacacgugugcaccugcccaggagcaauccgacugggugcuccuaaaccuuccuuccccugcuagcaaacacucccuccggugcuccugagauuccuaaaucuuccuuccucugcucccccagguccaauuggagaaguggccaguggccgacuucuuucauggcuguuggcuuucucuccugcagcucuuacaucccauccuucuucccgagucacggugauucucugucuccuuccaguucguagccugcacaaauccaaauguccccccucagucuaccugcuuagccauuggcuguuagcucuuuauugauggaccaaaaaccagugugugugugugggggggugcgggagguuggaaagauggcucagugguuaagagcacugacuguucuuccagagguccugaguucaauucccaacaaccacgugguggcccacaaccaucuguaaugggaucugaugccccuuucugugugucugaaaacagcuacaguguacucauaugcacuaaauaaauaaaucuuaaaaaaaacaaaccaguuggggacgaggaccuucagcauuguuuaaacacccauuugggggccagauuaauucaaaguguuagaaccaauccccaacaucucuguguagcccuggcuauccugaaacucauucuauagaccaggcugggcucaaacuuggagaucugccugccucugccuccuaucuggcauuagagacaugccccaccaccacccagucaagcauccguuuuuaauguaacgagucacuggguuuagaggguggcuugguacuauggcucuuccagaggacccagguucaguuuccagaaaccacugggcagucacagcuucuguaauuucaacccuaaggcaucugauacccacuucugaccuccauggguacugcaugcauaugaugcacauagauauagucaaaacacccauaugcauaaaauaaguauuuuuaaagaaaaaaauaaaggaacuguaaaaaaaaaaaaucuaaaagcaaaauggguaauucccuaugacgggucuuggaugucaucgaauggcaggcuuaguugggggcuugguggaaaccaggagucugcauucauaaaaggauuuuucuucauauggauguuagaucaaacacagagacgggcugugaaaggguauugauugagacauacaacaucccagcucuccaacaucacacuaacgaaggguguugaguucggaacucaaggggaauccugaggcugacugaugguaaggucuuugaugagaacucaggcccacauggcagugugugggguuucaauggaagccugaagccugcagccaggaugcccuugguuucuagcagagcagggagcgggauuggaggcaaggaaucugcagauguggaggaagugaagagagucugcagaugugggggaagugaacaaaggcacguuuauuuaagagguuuucauugcacaguuuguaagcaugugcgcgugcacgugugcacuacaacccucuguuaccucaagagucuggcaaccgaagucagugggcuuccuuggggaagugaacuggcacucaucagcuccugggaucuggcugggcaccuaggggcucaauuugccuauuuauagacucacggacaggcagggcaggugucaggguuggggggaaggccaguggggggagcugcaauagccauuucuucuauagccaguguaagaugcuucugugggugggcggcccauccuccuauagccuucaauccagcaacaagccucauagaaucuucgacacagguggagcuuguuccccacccacaaaaugcaguucacauuucacuuccucuaguucagaaaguuuaccacagcuagcccuggcuacucauguaagaaaugacuugagggcuggagagaugacucagagguuaagagcacugagugcacuuccaaagguccugaguucaauucccagcaaccaccugguggcucacaaccaucuguaaugggaucugaugcccucuucuggugugucugaagacagcgacagugcacucauaugcauuaaauaaauaaauaagaggcagaggaaggcggauuucugaguucgaggccagccuggucuacaaagugagcuccaggacagccagggcuauacagagaaacccugucucgaaaaaaaaccaaaaauaaauaaauaaaaguuaaaaagagaaagagaaagaaagaaauugagccucagaugagcaaagaucuaacauuagucagcaugggacauacugcucccccugucccccuuugagcagaggaugaugggugaaggacagaucugacuggacaaggaaaauggcaauuucaucuagucacaaccuauuguauguagccuguggucauuucaccuugaccauucuucaaagucaggaagaaccagcaggucucuuacaucucccacagacuguagcauuuacagaacuuaaaaagucccacaaccucuccaaccuuuuaucugguucuguuuagacacagucuuccaguaagagaagacgccccggggagagacaagaacaugacaaggggguagacugugguuggaaaaguccagagccaaugccagugggcuucaggagcaugagaggcgaaccuaaacucaguugaaugcaagaugugucacaaggggaguggcuggguucucauagaauaaauguuguuauguguagaauggcuaugcacaaguucaacucccugccauugcgggaucaggagugagaccccaucagacuaugaacaaagagaauuuauggcaauacaaauggguuaaccaggaacaaagccaacaucagucaagcaaaugcauucaggaggaccauggacagaaauccaaauucaaguaaugcagaguuaagcauaguaauagccaugucuuagucagagauucugcuccugcacaaacaucaugaccaagaagcaaguuggggaagagaagguuuauucagcuuacacuuccacauugcuguucaucaccaaaggaagucaggacaggaacucacacagggcaggaacuuggagggaggagaugauggggguugcugcuuacuggcuugcuuccccugccuugcucagcuugcucucuuauagaacccagaaccaccagcccagggauggcaccacccacaaugggccauuccauccucaaucauuaauugagaaaaugccuuacagcuggaucucauggaggcauuuccucaagaggggcuccucucucugugauaacuccagcuugugucaaguggacacacaaaaccaggcagcacaagcagcaugccugggagaaauggggacaugcuaaagcagugguucucaaccugugggucuugaccucuuuagggacccauuugcuuuuaauagguguggccuaagaccaucggaaaaacacagagacuuacauuacaacucauaacauuagcaaaauuacaguuaggaaauugcaauaaaaguaauuuuacgguugggggaaucaccaccucgugaggaacuguaaugaagggcuguagaauuaggaaggcuguagccacugauguagagaauggcccuugacaccacuuacugagacacuguugugucucccacuaucuggauuguuaaagcaggcaauggaguuucucccaggaaucacccgccagaagaaggaaaagcugacccuuggcuccagccaagauuucacacagugcuaacaacucagaccaccucacuagugaagcaaggauggaccacuguggggcaggaccaugcucugaccaaggcgucucaccucuaccuaacuaaacauugucacacgucagaacucugaaaggcgagcuucaagacccacuugcugauuugucuuucccaaucuagucacggugacuaaaucuccuuuuucuuuuuuuuguuuccaauucgcauuuguuccuuuauuggggcaggaggugugugugcuacagaaugucuguggggucagaggacaacuuacacggcuuguuucccccuuccacuguuguagguccuguggauugaaaugauugccagucuuggugccagaugaaguaggugacuucaccugcggagccagcucccuuuuauagugaaaauggaauuuacuucuauguagggccaugcauuaagaguuaacccaguuggguggguccaugacaugaccaaucccuuaggaaggugggcucaccuuaacucuuccugagaaggaaguagaauaauuaucccuuuacagggacaugggguaaccucaauuuuuucaaaaccuauuuuuagugauugcucuuaaaugcuuuaaccucccuuuucgcucagcgcccaccagagguaguagaaaagaaaggauacaggggaaguugaucuguuuagaaagguucucuggagcaacucccaccuguguugucuggaaaucugcaguucaguucacagguuagcaggcaguggcagcuccauccacuugcaaacacuucacagauacaccagcagcccagcucaguagagucagguuagcaacaauggugaccugaccuagcagagacaagcaggccucaaccuuggcuugagugagcaggaggaaccaggaggaacacgaggagaaguucuuggccgugcuucucccagggaaguaaagaucagugaagaugugagacucacgagcauuacacagcuagcucuguaagcaagccaagcucagccucugucacuguccgucuggguccuauuuauacccucuauacaucacauguccucuacauauuuugccucugagugugcaucugucucagcugauaucacccugccaaucagcccaagugacaaaaaaacugcagcacaccaccagaaguuuguuggugcguuucucucuauggauccugacaaaugcagcucaacuacgcaauggaaggugggccaaugcaugcauguuguuagcaaaggauccuucaucacguguccuuucacaugcuugcuuuagcagaacacucuuuccccugugucugcuucagcuaaauguuccuucaugugucugccuuagucucucaccuguguccacuucagcuaaacguucugucacguguuugccccagcaaaacuucauucaacgacuuucuaaagaaccuuuuaaguuuccacuuggacaccguccucucucugccuucccagauuccccacucccuagaacagucugugcguaagguuuggcugagucuaucauccuuccgaugcguagacauggaacuuuuccuuuuucucucuccugucuccuacuuucagaugcugccagaagcuaagcauccuuguucuggcacucugggcuucauuauucuuucugaaaagccccuccaugcagcugcccaccacuauguggcugaucuccaugcuggcuuaacucaaacagcauggcuuuccccucuccuccauuuuccucuccucugggcagcugcugagaauuccagcuaaccugccuugggguucuuguguguguguguauaauauauacauauauauauaauuuuauauuauaauauauuauauuuauauaaugcuauuauaauuauauguuauauauuacauguuguauguaauauguaacauguuauauauuauaugaaauuuuauauuauauuaugcguauguaaugcuauuauaauuauauauuauauacauuugcauuauauuuauauguaauauauauuuauauuugauagcgaaaguguaaaagcaugaaucuccauagcuucagaauggcuauucuaacugcacaaauguucacugagauguguagacuccagaucagguuaaccuguacaugcgaucuccugccaaaggccagcuuugacaggucagauaaaccgagaaggggcuggaguuggcaauuaaucacuaggcagauuuuuuucugagggaacaaaacuuaauuuuucuggagacggugaaaaacucucuggggccagcaaaaaaggaagaaaaaaaucacacacacaccccccacacacacacacacauacacacacacacaauguggaugaagcaagcuucaaaacgcuccaacacuuuuauuuuuccucuuagccuuucaacaccagcuaagacaaaaauguucuauguaagaaaaagaugaccucauagccacacguuacauauucuccagaaacaaucaccacaaaacauagucuucaaaaccagauuaagaucacugcacaaagggaaaucgcaucaggauuauugacuacauauucuccuuuugaaacuucaaaccuaacaaaacaguucccgucuuucucuacagauucauuguaaccacaaagcaauaauucuuuuguuauuaauuaacaaaguuuaagcaagccagucuauaguagcgaguucccccuaugcuuagcugacaacaauguguauuuaucaagaaacagaucaucauaaauuuuacauuuaaucuuugaagucuuguucagcuaaacuggcuaaucgccuguucucuguucuuacauucagaauuaccuacucuuugugcauaacucuguccuuucauguugcacacuaaagccuaugaugacuuuccuagaucacaacacccaggaacucagacccaaccuagaaugaauuuuuuauuauuauuguuaacuugucccaagccuguuuuucuuccuaguacaauuaagugcuugcaacgcaugaaagcucacagaagucccuuguaaaccuaugcagcccuggcuauucuacaaggagcaggugcauucuauucguaauuuuaacuuuauuauaucuuccuggucaaacaaccuaaaccauucuuuaaauguucuacccccuauccuaacuuccucaaacuauuuaaaucaaaucaggaauuauguaaaaucaugaauccauuuaaacagcauuauucuaugagaggucuuauugaucugcaggaaaauugcccuguagaguggguugugucuuaggagcaaucccaccagacugucggcagugggggucccccuacgaccaaccacaccacgccagauucaggaggaacucagcaaagacaagcaugagaagacagagcagcagcaagaagcaauccucgaggaacccccagccagggcugcgccucucugacguacaaucaucgcaucuguguaaaacgauggaccguuuccagaaagcucacuugccauuuuccguuauuauuuguaagacuuuuuuuuuuauauauuaaaguuuucauuuuuucuaaaguucuuuucuuucaaacucuaauaaaaucgcucucaagcuuccag

SEQ ID NO: 9298 - RNA, 64261 nt, Mus musculus
cuggaagcuugagagcgauuuuauuagaguuugaaagaaaagaacuuuagaaaaaaugaaaacuuuaauauauaaaaaaaaaagucuuacaaauaauaacggaaaauggcaagugagcuuucuggaaacgguccaucguuuuacacagaugcgaugauuguacgucagagaggcgcagcccuggcuggggguuccucgaggauugcuucuugcugcugcucugucuucucaugcuugucuuugcugaguuccuccugaaucuggcguggugugguuggucguagggggacccccacugccgacagucuggugggauugcuccuaagacacaacccacucuacagggcaauuuuccugcagaucaauaagaccucucauagaauaaugcuguuuaaauggauucaugauuuuacauaauuccugauuugauuuaaauaguuugaggaaguuaggauaggggguagaacauuuaaagaaugguuuagguuguuugaccaggaagauauaauaaaguuaaaauuacgaauagaaugcaccugcuccuuguagaauagccagggcugcauagguuuacaagggacuucugugagcuuucaugcguugcaagcacuuaauuguacuaggaagaaaaacaggcuugggacaaguuaacaauaauaauaaaaaauucauucuagguugggucugaguuccuggguguugugaucuaggaaagucaucauaggcuuuagugugcaacaugaaaggacagaguuaugcacaaagaguagguaauucugaauguaagaacagagaacaggcgauuagccaguuuagcugaacaagacuucaaagauuaaauguaaaauuuaugaugaucuguuucuugauaaauacacauuguugucagcuaagcauagggggaacucgcuacuauagacuggcuugcuuaaacuuuguuaauuaauaacaaaagaauuauugcuuugugguuacaaugaaucuguagagaaagacgggaacuguuuuguuagguuugaaguuucaaaaggagaauauguagucaauaauccugaugcgauuucccuuugugcagugaucuuaaucugguuuugaagacuauguuuuguggugauuguuucuggagaauauguaacguguggcuaugaggucaucuuuuucuuacauagaacauuuuugucuuagcugguguugaaaggcuaagaggaaaaauaaaaguguuggagcguuuugaagcuugcuucauccacauuguguguguguguauguguguguguguguggggggugugugugugauuuuuuucuuccuuuuuugcuggccccagagaguuuuucaccgucuccagaaaaauuaaguuuuguucccucagaaaaaaaucugccuagugauuaauugccaacuccagccccuucucgguuuaucugaccugucaaagcuggccuuuggcaggagaucgcauguacagguuaaccugaucuggagucuacacaucucagugaacauuugugcaguuagaauagccauucugaagcuauggagauucaugcuuuuacacuuucgcuaucaaauauaaauauauauuacauauaaauauaaugcaaauguauauaauauauaauuauaauagcauuacauacgcauaauauaauauaaaauuucauauaauauauaacauguuacauauuacauacaacauguaauauauaacauauaauuauaauagcauuauauaaauauaauauauuauaauauaaaauuauauauauauguauauauuauacacacacacacaagaaccccaaggcagguuagcuggaauucucagcagcugcccagaggagaggaaaauggaggagaggggaaagccaugcuguuugaguuaagccagcauggagaucagccacauaguggugggcagcugcauggaggggcuuuucagaaagaauaaugaagcccagagugccagaacaaggaugcuuagcuucuggcagcaucugaaaguaggagacaggagagagaaaaaggaaaaguuccaugucuacgcaucggaaggaugauagacucagccaaaccuuacgcacagacuguucuagggaguggggaaucugggaaggcagagagaggacgguguccaaguggaaacuuaaaagguucuuuagaaagucguugaaugaaguuuugcuggggcaaacacgugacagaacguuuagcugaaguggacacaggugagagacuaaggcagacacaugaaggaacauuuagcugaagcagacacaggggaaagaguguucugcuaaagcaagcaugugaaaggacacgugaugaaggauccuuugcuaacaacaugcaugcauuggcccaccuuccauugcguaguugagcugcauuugucaggauccauagagagaaacgcaccaacaaacuucugguggugugcugcaguuuuuuugucacuugggcugauuggcagggugauaucagcugagacagaugcacacucagaggcaaaauauguagaggacaugugauguauagaggguauaaauaggacccagacggacagugacagaggcugagcuuggcuugcuuacagagcuagcuguguaaugcucgugagucucacaucuucacugaucuuuacuucccugggagaagcacggccaagaacuucuccucguguuccuccugguuccuccugcucacucaagccaagguugaggccugcuugucucugcuaggucaggucaccauuguugcuaaccugacucuacugagcugggcugcugguguaucugugaaguguuugcaaguggauggagcugccacugccugcuaaccugugaacugaacugcagauuuccagacaacacaggugggaguugcuccagagaaccuuucuaaacagaucaacuuccccuguauccuuucuuuucuacuaccucuggugggcgcugagcgaaaagggagguuaaagcauuuaagagcaaucacuaaaaauagguuuugaaaaaauugagguuaccccaugucccuguaaagggauaauuauucuacuuccuucucaggaagaguuaaggugagcccaccuuccuaagggauuggucaugucauggacccacccaacuggguuaacucuuaaugcauggcccuacauagaaguaaauuccauuuucacuauaaaagggagcuggcuccgcaggugaagucaccuacuucaucuggcaccaagacuggcaaucauuucaauccacaggaccuacaacaguggaagggggaaacaagccguguaaguuguccucugaccccacagacauucuguagcacacacaccuccugccccaauaaaggaacaaaugcgaauuggaaacaaaaaaaagaaaaaggagauuuagucaccgugacuagauugggaaagacaaaucagcaagugggucuugaagcucgccuuucagaguucugacgugugacaauguuuaguuagguagaggugagacgccuuggucagagcaugguccugccccacagugguccauccuugcuucacuagugagguggucugaguuguuagcacugugugaaaucuuggcuggagccaagggucagcuuuuccuucuucuggcgggugauuccugggagaaacuccauugccugcuuuaacaauccagauagugggagacacaacagugucucaguaaguggugucaagggccauucucuacaucaguggcuacagccuuccuaauucuacagcccuucauuacaguuccucacgagguggugauucccccaaccguaaaauuacuuuuauugcaauuuccuaacuguaauuuugcuaauguuaugaguuguaauguaagucucuguguuuuuccgauggucuuaggccacaccuauuaaaagcaaaugggucccuaaagaggucaagacccacagguugagaaccacugcuuuagcauguccccauuucucccaggcaugcugcuugugcugccugguuuuguguguccacuugacacaagcuggaguuaucacagagagaggagccccucuugaggaaaugccuccaugagauccagcuguaaggcauuuucucaauuaaugauugaggauggaauggcccauuguggguggugccaucccugggcuggugguucuggguucuauaagagagcaagcugagcaaggcaggggaagcaagccaguaagcagcaacccccaucaucuccucccuccaaguuccugcccugugugaguuccuguccugacuuccuuuggugaugaacagcaauguggaaguguaagcugaauaaaccuucucuuccccaacuugcuucuuggucaugauguuugugcaggagcagaaucucugacuaagacauggcuauuacuaugcuuaacucugcauuacuugaauuuggauuucuguccaugguccuccugaaugcauuugcuugacugauguuggcuuuguuccugguuaacccauuuguauugccauaaauucucuuuguucauagucugauggggucucacuccugaucccgcaauggcagggaguugaacuugugcauagccauucuacacauaacaacauuuauucuaugagaacccagccacuccccuugugacacaucuugcauucaacugaguuuagguucgccucucaugcuccugaagcccacuggcauuggcucuggacuuuuccaaccacagucuacccccuugucauguucuugucucuccccggggcgucuucucuuacuggaagacugugucuaaacagaaccagauaaaagguuggagagguugugggacuuuuuaaguucuguaaaugcuacagucugugggagauguaagagaccugcugguucuuccugacuuugaagaauggucaaggugaaaugaccacaggcuacauacaauagguugugacuagaugaaauugccauuuuccuuguccagucagaucuguccuucacccaucauccucugcucaaagggggacagggggagcaguaugucccaugcugacuaauguuagaucuuugcucaucugaggcucaauuucuuucuuucucuuucucuuuuuaacuuuuauuuauuuauuuuugguuuuuuuucgagacaggguuucucuguauagcccuggcuguccuggagcucacuuuguagaccaggcuggccucgaacucagaaauccgccuuccucugccucuuauuuauuuauuuaaugcauaugagugcacugucgcugucuucagacacaccagaagagggcaucagaucccauuacagaugguugugagccaccaggugguugcugggaauugaacucaggaccuuuggaagugcacucagugcucuuaaccucugagucaucucuccagcccucaagucauuucuuacaugaguagccagggcuagcugugguaaacuuucugaacuagaggaagugaaaugugaacugcauuuuguggguggggaacaagcuccaccugugucgaagauucuaugaggcuuguugcuggauugaaggcuauaggaggaugggccgcccacccacagaagcaucuuacacuggcuauagaagaaauggcuauugcagcuccccccacuggccuuccccccaacccugacaccugcccugccuguccgugagucuauaaauaggcaaauugagccccuaggugcccagccagaucccaggagcugaugagugccaguucacuuccccaaggaagcccacugacuucgguugccagacucuugagguaacagaggguuguagugcacacgugcacgcgcacaugcuuacaaacugugcaaugaaaaccucuuaaauaaacgugccuuuguucacuucccccacaucugcagacucucuucacuuccuccacaucugcagauuccuugccuccaaucccgcucccugcucugcuagaaaccaagggcauccuggcugcaggcuucaggcuuccauugaaaccccacacacugccaugugggccugaguucucaucaaagaccuuaccaucagucagccucaggauuccccuugaguuccgaacucaacacccuucguuagugugauguuggagagcugggauguuguaugucucaaucaauacccuuucacagcccgucucuguguuugaucuaacauccauaugaagaaaaauccuuuuaugaaugcagacuccugguuuccaccaagcccccaacuaagccugccauucgaugacauccaagacccgucauagggaauuacccauuuugcuuuuagauuuuuuuuuuuuacaguuccuuuauuuuuuucuuuaaaaauacuuauuuuaugcauauggguguuuugacuauaucuaugugcaucauaugcaugcaguacccauggaggucagaaguggguaucagaugccuuaggguugaaauuacagaagcugugacugcccagugguuucuggaaacugaaccuggguccucuggaagagccauaguaccaagccacccucuaaacccagugacucguuacauuaaaaacggaugcuugacuggguggugguggggcaugucucuaaugccagauaggaggcagaggcaggcagaucuccaaguuugagcccagccuggucuauagaaugaguuucaggauagccagggcuacacagagauguuggggauugguucuaacacuuugaauuaaucuggcccccaaauggguguuuaaacaaugcugaagguccucguccccaacugguuuguuuuuuuuaagauuuauuuauuuagugcauaugaguacacuguagcuguuuucagacacacagaaaggggcaucagaucccauuacagaugguugugggccaccacgugguuguugggaauugaacucaggaccucuggaagaacagucagugcucuuaaccacugagccaucuuuccaaccucccgcacccccccacacacacacacugguuuuugguccaucaauaaagagcuaacagccaauggcuaagcagguagacugaggggggacauuuggauuugugcaggcuacgaacuggaaggagacagagaaucaccgugacucgggaagaaggaugggauguaagagcugcaggagagaaagccaacagccaugaaagaagucggccacuggccacuucuccaauuggaccugggggagcagaggaaggaagauuuaggaaucucaggagcaccggagggaguguuugcuagcaggggaaggaagguuuaggagcacccagucggauugcuccugggcaggugcacacgugugacccacugggagccgaagcuguguaacuaaacuuguggcuacacagagaaacuuucucucacucaccccgccaaaaaacaaaaaaaaaaacaaaaaaaaaacaaaaacaaaaacaaaaaacaaaacaagaacaaaacaaaaccccacuuuuaaaaagaguuauucaauuauuuaucuaugucuauaucaggugugaggccacaaaggccagaaggggggugucaugucagauacccuggagcuggaauuacaggcuguuugugaggcauccaauguaggugcugagaacugaacucagguccucugcaagaauagcaagagcccgugcaguuccacagcaaugcaguuuuaagacuacuuuaagguaugacuuuuguucuguugcuauaaaaaccuugagaaacuguuaccgguuagagcaguuggacguaacuuaaaucuauguuccuggcuauagucacguuuggcuugagauaaaagcaguuuucugcaucaagguaggaaaaagaggaagcgauuugugugugagagacccgcaggugcucgcagugggcagggaagugaaccuccaagaggugagaaugaaaaccugagucugauuggcaucuucauccuggaucaaaccucggggagucuggugccaggggauuuacugccagcauauuuaaacccaguauaauuuguacaauucuagguacacaaagaaacauaauuacauuaaaacucaagucauggcacacauuauuuccuccaagaagauggguucuggagacgggccaagggaaggaucugacuugguguaggucacacagcugguuuggaacucauuuggauuauuaguccccucuggcccugguugugagagcuuaggggccccuagcuguacaggucaugcaaaggucaguagccaucucuggucuugguugugggauuuugauauggccuggcucauaagauaacacagaucagcaagcuuucaaucacuuccaauccccagcuuucuggacagaagaacacgguuuuuguuuuuuuuuuuguuguuuuuuuuuuuuuuuuuuuuuguccauuccugagaggacaauccugugggcuuaacauucccgguuucucuggagaucuaugggcacaaggaccuucauguugcgcucacaacaaaugugaugggugguaaguggcucaggacuauuagacauucuauuuuuguuuauuucucacagaauuuuacaugcaaaagaccucuuuuuuuuuuuucaggcuguacauucuagagaaugacauuuuaucugaaguggaacuucuacaauguaaaaaaacaacuauuuuuaagcuacuucugugucauuucccauacugacagaguuguacgaauaccaucccuggcuucaaaacauucccagaacuugaagaaaaaccuuacaauguaacuagccaggcagaaaugaagauauuaugaauagaccucagucuaacuauuagacuauugaaacaaugaaucucagaaaugaaacuuucuccaagaaucuaaugcugggaggaggaaaggccaccagccugagggggacuuagcuccuggaaagacacuuuacccgggguuaacaaugaaaccuuaugggauucuacggaugauggaaugggccaacggcagcaggaccacaccguggcugagacugcucagaguggauaccucuagacuucuauuuaaacguucaucuuggacuggagggauggcucaguaguuaagagcacuuguucuugcagaggacccuggcucaagucccagcacacauguggaggcucauaaccauugauucuucugaucucugugggccccagacacacgugguaugucuacauacauguaagcugaacaugcauauccauaaaauaaaauaagccuuaacaugaaucuugcuucaagaucccacagacaagugucugagcuaccucuagagaagacucagguuauugaagcuagggaugggggugagcuugggcuuggcacagaacacagcuggacaccaaaauucucagagcaaaggagauguauuuacucuagaaggauaauugggauaccccuggaucaggcaaagguaucaauggccaacuggcacaaugacuuuuuaagggcucuagcaugggaaaagaagaaagaugaaugucccagagagaguuggcguggcugucuccgauuggcuaagaggaggacaaaggaggagggcacagcagagucuucuucacuuagucuggugaguuugagaaaccaauccagaccaacaacacuacuacuauuuuuugaucuaaacaaaaaaacaaaaagaagaagaaaaagaaaaaagaauauauucaaauuauuuccaccauccaucaaauguggucacuuaauaaaaaacaacucuaagcaaguuuccaaacugaaacccaacaaaaccuccuguaacucgcugcacugauaacuccccaaccaggcuccuuugaucacuagguacagcaggaucucagguauagugggacucugugcagggcucugugugaacucuggggaguaagaaaggggaaugggaccuuaguguguugccagggcacucacaagggaauaacuaucagagagucacacgguuagaucucaguuucucguuaacaagucacuugaauugagcuuuagaaccucaaagccaguguuuugaauugaaacaucacucuccuacauggaucugaaauacacacuugggccaugaauauccauuuggacuuauauagggauaugcaaggaucagaucuggggaaacaacaugaaggggaagaaacgaaaacugugcuugcuguccauaggguauuuuggggggugggguggagugggggugggguuugcuugaggugaguagggggaucucacuauguacguaugagaauccucccaaugacuccucauuccacugucaucugggagcucuggugcacucggacugaugggaggcacuggccaugcucccacgcucuccacucugauccacacagaggacagauaacacccucuugcucagugguggcucccuggcacagcgugaacauuuugcauugguugggauuugagcuagaaagcccuucugagccagaggcguuucuaagaagguuugcugaacuuuucugaaguuauuccugugacagaguuacacagaggacuaggaaaaguagaaacagaaaugacaggaaaguauccaacaacuuuacuugcuagagacacugaaagucuacgcccuugagcaugguaucuggaggagaaggaccacccugaauguacacaagagacuuccuguugagggaagggaacaaacagaccuauaggagaaaagaaaccgaugggaaaaucaagaauuaggauguuaagagauaggcaucuuuccucuggcauaaauauaggcuggacagucauagagcaagaauccccgagaggcacaaaaccgagaaaaaacuaauugcuccucgaauccaaggagacauuuaggcugcuagacucaaacuaguuucauucugauacugaaagacccacaacgugaggacucccccacauucugacucaggagaggcgacaccccaaaaucacccacaagaaacggucuugcugcaaacugcaagaggauuuuuuuauucaagagcgcucucggguccacgaucauacaaguaccccaaguaccccaaguagcuggauaagggggcaccccaaguagcuggauaaggggguauuuaaaggaagaaaccacaacucaaggaggugggaagggcguuguuggaaaauaccaaaaauaccagucaagagucacaaggaaguacaaagucacaggugucacaaggaauaccugguaauugugaggguuauuucucaagacaguuucuaagagccccuaacaauagcaccuuugcauagcggguuccagcaauggucagggugggucagggugacuuucuuugaaugaacacuccuugaacccaggaagcgguggguggaggaaugucgcucucuguuuuaugacuagcauaccuuggagcacugaguuugcuacucucucaauacuuaguaacucaguaacuucuggagcccccacagcacaauguguucucagagcucucucucuuugcaaagcuauuucuucugaagugacuacugauacuggccaucagacuucccucucuucucaggggugggagcuacaggaaacccaaguaacccucuguucuaaagcuucuggaaccuucucagaggacucagugaaacaccucccucccugcucuaaacaaucgucuacaugauuuuagguuugacccaacuuugccuacaauccuuccaguugggauguuugggguugcuauaguuacccaaucacuaugagagcagaacauaaauaacauugacaacgcaaggcaggcagaagagaaguguaaaacagauuggauguguagcuuguggaaucuaugaguuuucuguuuuuuuuuaaccaagccgaagccuucuuguucuguggcauaacaauguuccuugucaauacagaaaacaacaacaaacaaacaaacaaacaaacaaaaacccugucucaggagaaaucucuuuuccuacuaacugaauuguuuuuccuuuacuucuggcuuggaccagacugagcugcagagacauucuauuguguucuagcauggccacuuucaacggccguuuccugcucugugucugggcucugucugugggaggucuuauuuuggugaguacucccuacugagucacuuccuaccuugauggucccccugcuucugagucauacucugcaugcuuucccaccugaggauucuccaccuuuagcacuucuaugacaacugaugcuauuuucccccuuuucuucagaaaagcaugaacuaacggcaauuaagaagacauucccuaaaagguuuuguuguacugauagcuuuagacaaauaccuaggcagagaacuguccaugaugaagguccuuacuuugagacaacagaaaggcugugaagccuuggggagguuggccaagcacucacuggcugcuucuuagagaaggagaaaagaaagacaagcauaguaggaacgaaggguggggaugggacuagaggacaaaggggucauaaaggagaguugccuugaacauuugacaagacuucgcagagcugggcacagugauacaccccuuuaaucccaacaauugggaggcggaggcaggaagaucucugugaguucgaagccagccuggucuauaguauagacuagagagagagagacagagacagacacagagacacagagauacagacaagacagagagacagagagaccauguacccuccccucccccuaaaaaaaaaaguucaggagagggcuuugguagcauuauucaguaguuaacagaaaauuaaauguuggcccaguuguuuuauggaacagagacccagaugaccccacacucagcuacucuugugacucccaucuccaguucucuuaauccuggcuaagacaacggccuuagauacuuucuuccggucguaagccaggcccagggcagccaugcagucgaugaaaaacguggugaaguugaugugccagcgguacucacugacagaguaaucguaggggaacgugugaugguaguuguggaagcccucgccugcaacagaagcaaggagagcagucagggggcucagugauugcugcuucccuuuugcacacuucuuagcuguuauguaccucauaccuugaagaaucccacuguuggggugaacagaugaacccccagucuuguauucuaaugcaaauagaugcccuagagguaucucaagaaaccagggucugcucacacaugugugucugagagccuuugucagaggaaguuucuauuguaagauaagaggaugggagagaagcugggucugugggaacauauuuuacgauggaaaauaucaggaaagagggcuccaagccccacagggucugugccuaggugccugcggucagggcagggcagggcagaggaugcgggucagaucuguagcuacuuuucuuagauggaguaaaccccacuguccccaugaacugcuguucucuauaagguggagguuucaacaggguacauaacaaccaccaauuuuuuuuuuuuuuuugagauaaggauucucuguguccugccuguccuagaucuugcucuguagaccaggcuguccucgaacucauuccaccuaccucucugccuuccugccucccgagugcugagauuacaggcaugcaccacuacaaccugacacagccaccaaauuuuacaggaaguaguccaguccagugcuaggcauuuacuuagccaauccugacucacuggagacgcucuggcugcuaauucucagaauuuugaccuugcggugggagaggcacuaagaaaacagaacucugaaaguacucagacaucccucuaacacuugagauucugugacucuccuagggaugaggcucuugcgggauuaaggagaacagaaaucugcaucccgauacucucuguaaccgguuugcuguuuuccuauuggccguguggcucuuacuucugaacugauuucaacaauacugauccuguccagguugaaguaaagacagugaauaagaaaaaucauugaucccugaagauaaaaacacuccuagagaaagucagaagagcgggaagaacauuaagagccagagaaguagggggagggggcgagcauuguguaaugcugacuuccgggcacagcauggcuuuagcgaucuugaaaucucagcagcugugauuaaaugcaccagcucuguacccgacugagcugaauagcaccagccauggcaagaaggaagggcucauggggugccaucccuuccuugaggauguauacacagagaaugguuaauagaggagacauggacaccaucaggggcugcaccacugaccagcguccaugcuucggagaaucagcuuucagccuguguuucugugaaccaucccagucucgggcacacagagagauaggaaaggagggcugguuggaaagauggggagcagaagugagaggggcaagagagagggcaaagggcuaagaaugacugaagucaugcacacgcaugaaaauguccccaugacucuguguaauuaauaauacuaauuaaaacauuuuuaaguuaaaaaaaaauacacccaaguucuggagagauacccagcaguuuagagcacugaguguucuuucagagggccuggauacaguucuuggcauucauauggucacucaaaaccaucgcuaacuccaguuccaggggauccaacacccacuucuagauucuacggguacccaugcaaaugguauacagauaugcacacaaacaagaacacucaugcacauaaaaacaaaucaaucuaguuagaaaauaucucccaaagcagaacauagcaacauacgacuuauaccccagcauuaggagccagaggcaggugggucucugaaaguuugaggccaaccuggucuacacagggaguacaaggccaaccagagcuaccaugugggaccuuggccaaaaaaauaaaacacaaaaauaccccccagagauaaugggcauucuauagaaaacaaaaacagagaaggaauccuuucuaaccaaaugacuuccaccaagacuucucaagggauacacuccugcuguccucuggguugugugugcuguagccaaggguagugacacgaggcugauaacuuccacacauguuuccacagggaggcucugagugagaccuaaccagaccucacuggcucuugugugacauuuaaaacagaaucuacucauucucucucucucucucucucucucucucucucucucucucucucucucccucucccccucccucccucccucccucucccuuucuguccccccuuccuccccccuccucccuuccccuccuccuucccuuccccuuuucucucucucuuucauacacacacacacacacacacacacacacacacacacacacacacacuacaagggauggcaagaggagagaaaagggagacucggccguacggguaacggcuaggacaggaagagaucacucaggaaagcaauggagaauaauaaucuuugucaaacaacaugagcauaugacuaugggacagguaauuaaaugaaauaaaaccuuuggcagucaaggaugaggugacagggauagaagaacagaugcggggagcagaguaacaucgaugaugaagccagaggcuggcagccacuucaaguucauaaggacucauuguauagacucugcuuacugguucaggacacacgucggccuauguuacuccaucucuaugaaaaucuccgaauuuuauagcauaggugguaggguuuggguuuuuuguuuuuguuuuuguuuuuuggguuuuguuuuguuuuguuuuucaaacacagucaaauuaagaguguguguaaugguggcaaguaccuaaaagcuggagacagauccaggaaacuacagugguuguggcacaguuaagguuuacugaacuaaguaaucgucauuuucuucccgcuauguagcaggcuuacauauauaaaacacuaugauguauaggccuuuccaucgacguuacugcucuauucugcaucuccugcccuuaggaagaugcaaccuaacucagaagcaacugggaaagaacaacuuaaaggacccagucacauuuguuggugguuugggaaauuaagaucaacagaucagcccucuucugguggaaaccuacgcuccaacacacaaacauaaaaguagauucuagucuggccgcucugacuuagccuuaaugccuaaucaacagccugccucaugcagucuugaugcgagcugaagacuuaccuaaagaugccauugaaacgaagggauucucccgggcaccaaugccccugucauagggccgguauccguagaggugggccgcacuguucaccagccaagugaaguuuagaagcacagcauaccgcaggaaauucgagacgcauaagcuguguugaaaagucucaccccacaaguaccaggguaccagugugggcagaaugaugaacaugagcgugacagcuagcuuguaguaccugcgugcagagaucacacacugaaucuggguagagggaccacaggcaaacuugagaaggccgcauuuacugggcugcgcugucuuuuuuuccuacacuaugaauacaggagggguauauggucucucacucuuacacacacacacacacacacacacacacgugaguguuuugcuauguguauguauguguaucacaugugugcagguauccaaaaugaucagaaggcagcacugauuugccuggaacuagauuuacaaguucugagcaaucauguaggcucugagaaucgaacucaggaccucuggaagagcagccagugcucuuucccacugagccaucucucuugaguccuuaucucaaucuuuagauggggaacacugcuggaauauggguuagaaugugugucuguugacuagaaauccauucuuuuuucucaccaaguggaaggcuacguuggccgaagagguugggaucaaagcaugaacucaucugcuaacuuuagcugccuggagcccuguccagcugccuuugggauccuuucuuucuugagucugccuccaucuuugacacagagugugugacaaguguucguuuccauggcuaaugcucaacgucugcucugcuucccaggaggcacacugagugcccccuuggcuguuugguggaccaaggacagggacugagguguauauucuacaagccaaagcagacauggccaccagguucucccagcaucucucaucccuuccuggcauacucugaucccaaccugaacuuugcaacccagggacugggcugcccuuccccaaagaaucuucccuauacaauccagacauuuucacacacacacacacacacacacacacacacacacacacacacacacacuuucucucucucucuccuucuucuucuucuccuucuccuucuccuccuccuccuucuucuuccucuccuucuccuucuccuucuccuucuccuucuucuccuccuccuccuccuccuccuccuccuccuccuccuccuccuccuccuccuccuccuucuucuucuucuucuucuucuucuucuucuucuucuuccugcacaugccccuucucucuuucuccccacccccaaccauggugacuccccucaccucaauccuuggggccagugaacuugcccacugagagcagcuucccaauaaaccugauuucaauauaaucuaaccuggcuucaauuggcucacuucuccagcagcagagaaauaaccuguuacugccugccuccaguucucugccccuuuggaggcuuuacucaaucuuuaacauugcaaggauuugaucgaggucugucaaacagucugauauucaaccuacacugacauuauucacauccuauuccuucccuuuccacucuuaccucugcaucccuggccugggucuuccauaucuaacauguuucucugaccuuuaccugucaaucaagggcuccuuucaccuguauuuagacagcaucucugaaacauaucucuucuccaugaugcuaagggaccuccuucaagaaggcuuuagcaagucucaaguguuuguguugucucugugcucucucucucucucucucucucucucucucucucucucucacacacacacacacacacacacacacacacacacacacacacaucagaaucacuguuguuuugcaagcugcuuuuucaacagcucuucccagcagucuugggcugcaugaaugcacgaagcuuucccagaguagacaguauuccgcuuugcuucugguuauuugcauaccugccuaggauacaggccuugcaaagaaaaggaccccguugcuucuccuauuguguccaugacaguucuaggucaaugaacauguguguugcauuuaugaaaauaucucagagagaaaggaacauagcaauaaucuguaacuaugggccugugagacauuagagaacuguguuuuaaaacgauugugagcaugcaaacagagcagaagacuucaguucuuauuuaaugugcucuauuagaagaagugggauuccccaaaccccaggugcccuggguuccacccccaccccccaccccaucccucaccuccucuggaacaucaccagcuucucggcuuucaggucagacauguccagguuuuugcccuucucuuugacagccggauguuugcgcacaagcagccaacccacgugagagaagaagaagccacggcgggaauugugagggucggcguguguuucugagaacuuguggugggcgcggugaucucgggcccauucauacacgucauucuggaagcacaggaaagaggaacccaguauugagaagagaggcccuccaaagugaaugcaagggucuagaugucugcaagggccugggacucucagcccaacucacaaaauccucaggacucugacccaaaggaguccuuguugagcacucucuucugcacacuugucagaaagcaaccuacagucccagguuagggaaugguacucaugcugccuuaggaugugugauggggagauggcacauggaggagagggacaaugagguucacaagcccaacacggaaggcggcaggcaaggaacacgaguucucaggugccucacagaauaccuagucacugggugcagagacugugaaguaaggcuccccggggaacauggauucugcucugucaaaaagguacagggauagucacccugacgccuuuacaaaugacagcuuagccagcccagugucagggccaggguguaacucaugauccucgucccucucccaagcgcccucuggcuuauuugugacucuuucuauccuuucaaaacugcuccaaugucucuuuuugauuuugucccacuaggacaucaggagccuuugaggaauaagucguuggguagaagugauuagcacaugaggugagcaucuuaagccaugccaagagagaggggcugauuugauggccucuuacugcaggguaagccccaucccaugagcuagccugagcucacugcugaagucuaacagcaauaacaggucccuauuacuuuucacuguccuagaacucgcccuauagaccaggcuagccucgaacucagaaaucugccugccucugccucccaaguacuaggauuaaaggcgugcgccaccaccgcccagcuuuuuucuguuuucuaacuuuuugccucagcaaacuucaaccguugacuugcccagcauggcagucaugccuagaccacaguguuuaccuguccaaccucuuagugaccacgugcaaaauggggcuugaucucuuaggaaagguauuuugaggauuugaugaguucaucuaugucacaaacaccagugaaguauaacauggggaccuuggggaaaacagcgacccucuaaccagcgaguccuccagugaacuguuucccaucccggugacucccaugcuacgugaaccucagcaucaagcaugcacugugguggcuuuccaauuggcuccucuuggggugcuaaccugcuucacacugcccccagcccucacagaguagacacagagccucuaugagcagccucuuaccuggaaagccaugguauuggccaugaugaggaagaugcguaggggcagccuugcuuuauagguucgguggcuccacaagcgaugcgcuccggcugugaugcccaaaccggcaaccacguuguagaauacuccugucaggagacagugggagagucaccaaccauugcugguccuguugggccaagggugugaggacccuuggcugacucucuacucugcuucuucuucagagguuagagagaauccuuuccuucccagaacccugagaugccuugggguuuuguuuguuuguuuguuuauuauuuauuuauuuuauguauaugaguacacuguggccauuuucagacacaccagaaaaaggcauuagaucccauuacagaugguugugaacuaccacgugguuguugggaauuaaacucaggaucucugaaagagaaaccaguguuuuuaaccacugagccaucucucuagcccaugccuuggucuuccuaucuuguggcuuugaacacuugaauaguugccuuauguaucugucugucugucuaucuaucuaucuauuuagagauggagguaagcaaagaagccccagaauucaaggcagacaacugucugucugcagggggcaguacccugagccuaccaaccaugaccuuccucugaucuaaguuguucagggccacagauuagcccucaguggcuugaaaaauagcaaccagagcaauuugguucgaucaguuacaacaaccuccaaauuuuaagagcucacaggccugugccaauucaccagcugaaccauuuugauaugauggcagacacaugcuuguaugagggcgagucagcccugcacaggacuacauucuuacaguggcuugagccuuaccaagaauauuaauauuuucauaaucacuggacaccugggugugauucugcuacaucucgaagaauuugaucauacaggaaggcuacguuuuuucccagaaucaugcuguagccaggggcugaagcccaguuuccuguaaauaaagcacugguccagccccaccauccacccucaagauguucacugagaucucaaaccucuccucugcccugucucucugucaaucuggaugcucacugccaguacaacacuggguaauacuuaaagcuggcagcugguagugccuacguuagggugagucaucucuguuacauuuguauccuggacuaaggauaggugccauguccuaccucacugucuugaagucaaaggcuugggaggugcagcuguuaauagagaaggaaacagacuacccucacucuguccccugugagggcuuagaggagacauucaaccaugcuucgcuccuaugagaggcuggaaaccauggccccugggaggccgcagagcauaguucagcuugaagucaaaauacauuguauaaacucucuuguguucuucuagagccagaaguaacaguuucccaaacagcaucuccccucuccugcccaauagcauuccuuuuuugggcuucccacaaagaucacagagccagugugcaggcagggaaaguucugcccacguucucucugagcugggaccagacccaagugauuuucugcuucuagauguauuuagauugagcucuucccacguauccaagaugaccccgaaccacaggggagccaggauccugcaaucacaggagaaaagaaagagcuuuggccaaaucagaggcccucaguggaacacccaaaagugucaguuuuaugucacaggugucucuaggacauucauuggcuuugaaaacacucggagcaugcacaagggaauugagacaagagcccuguuacuguguggccucuuucucaaccccaugacugucaaauagacaucucaguucaaauagauggcucaguucaaauagauuaguuccaugaccuccagacaaggucuguuugugucccagguauauuaagcaacaucuuuaagcacuucuaagacgugagcaggagagcuuuccucuuuuagcacuccaugucaguacccgagcaggguagaaggcucucagaguauccaaguuaggagaauacuggaaaagcacacaacuagcccaaggaccauggcuuggccuuccuaaucacagcaaauucuguugccccccacuugguaccuggaaaaacuguaguccugaaagaaaaaaaaaagaguuuuuccucaguuguauuuucccuggcaccuacagaacuuuuaagguaaugcagagcucaccugcugcagguacuaagagacggagggcagggguggccaacaccagcagccaacuucuacaucacuaccuucuagaggcagcuaccagaaagucuucugccuuccagagagugaucucuggcucaucguuccucagaagguagcaaggggcccuggccugcuccucucucccugauuuaagaauugggagucagaggcgaaucuaccugaaagcacacauguggguccaggggccagcccugcaucagcacauacgcacagauccccaaguugcugagcuagggaagagacacaguggcaaccuucuuucuuguuacaacagucugaaggccaggguuucucagucucugagccuggcuauuuugggcaaggggagguggagguagagaggaaagagcagaagguucugggcccuuuguccuacaugguauccagagacaagagcaggaacuggcuggccagggaaugaauggaaugucacccaauucugaaaccccccucccccucuauuuuugucauuuuaagaacaucuugcuaacugacaggacggaccuggagcagcagaacucuacaccaguguacuuggaccgugugggaaccugccucaucuuucucuggggcaaacaagccuguccuggucagaaucacauacaaauauuuuuuguugguaaucccauuuuauuccuucuucuccagcgauccccucuggauagucuuacuuuacucugucucccgacuaagcaaauacccccucauuaagcccccaugccucucagcaagggcucuaguuuuccuguggcaggcaaugcuaagucagaaagcuuuuuggacggaaaagcucuuuaggagacugucaauccuuugucauacaguuaucccuccaccuuuuauagacuuuagcauccaagcuaaagaaccccccagaucugacacucuuguaccccaaucccacgaggcucuguuccccgucuaguuaucaguaucucagaaaguggagagaaaacuugaaaaaucuggacagagagcggcuacuuuucagaaucagagucuaccuuauuaaagaguugggggcgggggagacauggggugcuggcccagggcggaggguuuggagauuacccaagagccagguguagaccuugcaggagggaaccagugugaucccguacagggcucccacgugcagcagggccaugaagaugauguuccuccagacguacuccagcuugggcgggggucccuccucauccugguagcuggggucauacagaucaucuuuuauuucaggccggauaucuucugccuggaggggcaucuucucuucuccauccugcugucuccgggagugggguuccaugauguugguagugcuacaccugcuggagaucuucaacgggaggaagugaaagucaaaagcagauacauaggacagcaagggggggguccuccuguaauacagccaaggcaguagaggcagaaaccccagugcccugaucauaggaagacagaguacagaugugcuagaugaagcagagaaaacuucccagaaacuaccuagaauguguugacaaucaaaccucacagugaaggggcagggacggggaucaaacauucauaccucaagcaacauacaaaggaaaaugcaugugcaugcagaaagguauuggcuggacgggagcuuucuuuccuuuaaagucaacuggcaacaugacugccacaucccucacuugaaggucauacaaaucuaauaagauaucugagaugucucuguagcucucagcucuggccucucuccagucagcacagucccaccugguaccaaagauccugugcuagagggagggggucauugaugaaaagcugaccucuuguggcaagugggccgucaucuugcuccuuggaagccuagauccucuugugaaggcagagagagcaagguccaggucugcagcgacugaggaucggugaagcguugaguccagagcccacugugcgcuguguguacugcguugaugcccggcuaacugugcaggugucaccagucaguucugcuguguguuguuguuuccaggcacaggauuuaaaggguauguagagcuggcacuuggugacugugucugguauuuguucagaugugcuucaugacugccaacaagggauaaagaauucagagcuggcuagucaaggcagccccaugaggagauaaagacugaaggcgagagaggggaggacagccagcaaagcccacauucaccuaaggcaaggcuaugggaugcugcacacacuaagagagagccaccuuuguccccauuccuagacagauggaguauucucagcacucuggcaagcucugagcagaggaauuuguuacucucuugucuuccuggcucuggcauccagaaaucugcuaucucgcuggcagacagcccucugugccaaccuccucgguuucaucucuguggacccugggucucugccagcaucaugacuggaggaaucugggguccaguucucaagcuucauagaggguagaaaauguccacaaagugggaaaagagugaaucuggggggugagagucaaguucaagcccaggacuaacacaggugcuuggcaaaugugucacacuggggcaguugcacaguggggacagcucaucaguguccaccacaauuccaccuucucuuuccacucaucaggugugguggggguaaggggggguggacuggccuccacccccagaucucgagacaagagcaggugcauagcccgccuucuuacuuagcaucucaagccaguggcggcucuuccccacccaccugcccaggauguucagcagaaucgcagaaugcucugaccagcucacacacacagucacacgcacagggcugagugucugagcccacgcucagucauaggacucguuucacaggggauaaccaccuccagacauuagcauuuaauuacuucccuauguuccugcccccggaacaucugcugcaggcagggaggucugaagauucucccaucagguugggaauugggagucuucuauaaggaaaaagugggaaccucagacaggcguuuacaggcagcagaggugcaaagguuugccugugaaauaagaagacugagcugguauggaaugacuuuaaaaaaaaaaaaaaaaagcuaauacuaacuuuuuaaaaagucuccccgugacccaugaccugugguuuuuaaggagaaggaaguugagauauagagagcucagauaauuugucuguggucccaggagccagugacucacagagcuagaaacugaucauaguaggcaagaugccagagcccaggcucaaacccugcucggaaagcgaugcuggccuagagucccaagacaaaaugacuucacaggccgucuucaguagauucacagcaggaugaggaagcucaaacugcagggauuugcauucacuagggucuccugagauagacaucuccccuguacacuucccccccacacacacacaaaggagacuauaugagggcaagcaugaccaacuugucccucugugaaagcuuccuuggccucuccauccucuuccccucuuaucaaacagcgagggaccccacaguccuuuuggcuccccacauacuuugcuuugcuuugaccccacaauuuuauuuuaacagccauauugagacuuguuugcacugggcauggugguguacauuuuucaucccagcacuugggaggcagaggcagguggaucucuaugaguuugaggccagccuggucuaccaagcaaguuccaggacagccaggacuauagacagaaaccuugucuggaaaaacaaaccaaaaaccaaaaaaccaaaaaaaccaaaaaaaccaaaaaaccaaaaaaccaaaaaaccaaaaaaccaaaaaaccaaaaaaccaaaaaaccaaaaaaccaaaaaaccaaaaaaccaaaaaaccaaaaaaccaaaaaaccaaaaaaccaaaaaaccaaaaaaccaaaaaaccaaaaaaccaaaaaaaaccaaaaaaaacaaaaaaccaaaaaaccaaaaaaccaaaaaaccaaaaaaaaacaaaaaaaccaaaaaaccaaaaaaccaaaaaaccaaaaaaaccaaaaaaccaaaaaccaguuugcaaguccaucucacggguaaaccauaagccuccucauggcaggagcccugccugaccuuuccuugguuucucuagugcauuauagaauuucuuacagacauuaauuauucagugaucacuucccagaagagagauaaguuacgggaucugagaagggaccaguggggacugugauuugcuugaaaugaaauucguaaaugcgagcuagaggaacccccuacugcaguuguaaaaguaggcauggcauuaucuacggcuggcuaggaagcagagaaauggagacucgaagggcacuuaugagccuggaaguugcccaacuguucuaaagaacaaucuaucggcacccaauaagaucaaaugugugcaucuaucauccagagauuuccgcucccaagaaacuguuuucuucagugacuuucgucagggcagauuuuugugucuuguuuuuguguacuuuuggcucuaugggggaucaaauucauaaccugguacauaccaggcaagugcuguaccacugagcuacauuucucagcccuggguuguuucuugaaagguuucacuauguagcucaggcuggcuuggaacaucgaaccccucugccucagcuagaguagcuggggauuucauggguuuuguuuuaaggaaagagccuuccgacacuccaacacacaguuggagauagaugaugggcaaauaggucagacaauucagucucacaugucgucaggccuaaucccagcauuugggaggcugaaggaggaugaccaacuugaggacauccugggugaugaagccagacucuguuucaaaaacaaaaauuaaaauccuuuucagcacuugggaggcagaggcaguuggguuucuaugacuuugaggccagccuggucuacucaaugaguccccagccagucagagcuacagaguugagaaucuaucucaaaacaacaacaaacaaaauccguuuucaucauauuuacacaaaggucuaagcuaaaaauucucacacacugagggaugcucucagugagggaacagaacacuugaaccuagagccugcauguguacguuuugaaagaucuuuacaaucaacauccuuccuuuucaagaacacugaacuaaaaugauccagggucuguaaaaagagcaggaccucagaccgggguuugaguaugacccaguuauacagccuacagccuuauaggguggggaugccuaucuuuagaauuugggaucuuugugagaaucugugagccacucagguacacaaaaggcagguaaaggacaucuggucugaacugaaguuuccuuggcucauuuuauacaugcauuuucaguuuuucaccuaacacauggaagucagacaaccauggaggguagaagcagccggcaauggagacacguaggcuaaguuaauuauucaucaaaguuuaaaaaaaaucaacuaggggcugggcacauagcucaguggauaaacaugaggaccugaguccagaccuccagcacccacauacaaaacaagaagggauagggcaggccucuacucccagaccaugaaagccugggaaagagggagaaggaugcugggguguguggccugccagccaagcaagccaaucugugagcaccaggcucaauaaaagacuguuucaaaaccaaggugaagggcagucaaggacacacacagauacacacacagacaccuuuucacuucacuuugucccccucccuggggauaaaggacaaaggcacuuucagcuauggccuuuuauacauaauauuacccuucacuuaugaaaucuacaauaacucccccuuuccuucauuagcuaugcuauuggcucugauugaaaggaagucuaugacauaaccaaggaaacuggaagacaaaauuagaagaucagcagaucaggcuggccuugaacucacagagauccaccugccucugcuuccccagugcuggaauuaaaggugugcaccaucacugcuuggcuccuuucacuuucuuuuagucucuuuuggaagcacaacuauuucaaguuuuacugaagcacaaauuauccgauuuuucuuuuccuacucacauccugccuuuggcuuugaucuacacaauucucuucucugugauacaacaaagcaaaaauggacauuuaaauuuuaauuauguuaaaguuguguuuauuuuuaguuuaugaguaugaguguuuccucacauguaugucuaugcacuacauguguguacagugugcauggaagccgaaagaaugcacaggauccuuuggaacuggaguuacagaugguuaugaacuguuacaugggugcuggaaaccaaacuccaggcuuuuccaagagaaacaaauguucuuuguuguaugccggcccacagccuacuugaaccagguacaccugggaggcaguuuggggcugaaaaagacuuagacggugagagagauaauggagaccaagacacaauucuguguaaggcccacgaguuuacuaagagagugugcuuauaagggggaagucccaucccccgccaguucauucuuggugucuggagccagccugugcaggauaggauguuccucagaaugccucaggggccucucagcagguagcagugucuuugaggagagcagugacaggugacagaaccauagagccaucuaggucggaaggcuacccccuagguaaucuccuucuuaguggcugcaaggucaaagucuggaucagccugcuuccucccugauuauauaauaaaaauagcuggaccaaggcauugaaagacucacaacgugaggacucccccauguucugacucaggagaggcaacaccccaaaaucacccacaagaaacggucuugcugcaaacugcaagaggauuuuuauucaagagcgcucucagguccacgaucauacaccacgcagggguagaggaccguggugccccgaguagcuggauaaggggguauuuaaagggagaaaccacaacucaaggaaguggggagggcauuguuggaaaauaccaaaaauaccaguuaagagucacaaggaagugcaaagucacaagagucacgaggaauaccugguaauugugaggguuauuucucaagacaguuucuaagagccccuaacaauagcacauucuuugaauuaacacucuuugaacccaggaagcaggugguggaggaauguugcuaucuguuuuaugaccagcacaccucggagcacugagccacaaaggccacacucccaaaggccuagaauuuuguuuuuacguuuuacuuuuucagcauaaaaaaaauuuuaugcuccauaguccugccugauuucuuugggccuaaugaagaaaccugucucagugagauucccuagcuuucucaugguaaacccaccuaaucgcuaggcccuggugaauucccuugucuggguaagacuggcuacugucccaagugaucacucugcagacuagcccugagcuauucuaucucguucuguguaaugccucauuaguuucacugucucuacuagaaguaaacuugaauguuaccuaaccuucucacugaauuccuacugaauucccaguuuguuggcuucaaggguuuucuggaacauuguaacacuggcaaaggcuuagcuaugucagaauucaaucuuaaaaggcacuuauaauaaaauaauacuaaaagagagcacguggauccauacaccagacuaacucgaggauaggguaugaguuauggggauaggguacagguuaugaggacgccaaaguuccaggaggugaguuuccgugaaacucuuugccucgugagugcucccaggccucuaagccugccaagcaaacuucacuggaguguguguagcauucuuccccuaucuuuuuuauauuucugccgaaguuccggaaugucccaccucaucguagcuacagaucucaagagugcucuaaagaugaguggaaacacaaugauuacuaagaaaauaaugccaauaauaguagcaaguaggauuauauauugaacccaauccaggggauucaaugcacuuaguuuguuguuguuguuguuguuguuguuguuguuguuguugcuguuguuuuaaucucuggccaauucaucaauguuccaaguguccaagugacuuuugcuaauaucugaaauuucugccuuucuagccuuaauauaugcuauguccugcccuauugcuaagacuacuacuucuaagacauuaaccuuugccuccaauuuuuaucuauaauaugcagcuuugacaaggcuauggaaauauuccuaugcuuaucauuaacaaaaugagcaguaugcagcugcugaucuaaagcugugguagauaccuuuucaaaguuugcauucccagauuuuuaaaccaaggaucauuuccuaacucuaauuggcagcaaaacauaagcagaucucuuuaacaaaaucauaacagcagauuucuuaucuaaauuaggaucuacacaauuaguuauuugacaagaauuacaaugaauaugaaaagacuugccaagauuggugaucuuaacucuuaaaauuaucuaacauuauagcauacagguaagguacacaaguuuuuacagcuauaggggaguuggccugaauggccaaaaacagugucucugacgaaaucuuguccaauacucuguagcagucccucugccucacgagucaucauuuuuaguuguccccaaguugacaccaggucagcucuccuugcuguagcccauggcggggauaggaaguuucuucaucuuguuugcaaauggcugcucuccaauuuccuccuccucugugcgcucaauacagcuuuccuguaaccacugucagggugcucaggaacccacaggucagccugucacauuggaagcuagcauacuccugcagcauucuguggaaaaaacagaagcacucccucucuuccccaauauuaagacgggaaccauuccacguauuagcuaauggucccgccauuauguggaaacagguaggaauugaggacaccaagaacaacucuuucacaauuugauaugcaccuucucuaaaaauaccaaaauauuaucuuaaaccauuacuguuuugauuaaauaaagaaugagauuauucuuauguaaggccuguaucugccugagauauaaaucuagcauggcauugccuuaaggggucuuguccagacaauccagaaaauuuuauuaaauguccaaaaacagucuucuuaaaagagcagcauuuuuucuuaugaguuauguaugcauaaaccauugcaaauuugagaauuuauaguaucugagagaagaacaauuuuaagcaauuguaagcucugagauauacauugauaauuaacauacaaauuaaagcuugauuauucaacauuuuaaaacaccaucuacagcacacaauuuaauuaucuaugcugaagcaggaagaaacucaaaagaauaagcgugugauccaauucacauauacuuuucucccauagaagggcuguuuuuaaacacaguaaaugggaugcauacaugcauggauuuauagaagguacaaaagcaugcauaaaaacaauuuuuaacuuaucuuuaggauaaugauuaucaauuuuauuuuaaaugauggugugcaauaggccaaauaucaauauucugcaauaaccaaauuaauugcuauuggaacaaggaacagacacuuugucagguucuuaagacacaauuuuuuguuauagguuuucuaaaauacacaaaguuaucuuacaauucuuuauuagcaccacagcagccuuaaaaggauguuaaaacuuuacuuugaggcaaagaaagaugauuuuacauuaaauuuuucucuugccaaagaauugcugugggcacauuuaauaaccauaacuaaaauaagcagcuaauauuuaauuacuauugauuauaauugauaacaauuauaaaagcuuucuuuauuuucugcaaagccuuuuguucuuugccaguucauuugugucucacuuaauagcaccuaacaaaggcuuaaguucuccuguggugaguuuaaggugaggucuuagccaauuaacaucuccuggaagcuuuugaaaauaaaauuuugaagcaaaucaauuuuucguucuuagauuuucuguaccaaaauuuuauaguauaacuaaaacccuaaauauuaaaaagauauugccucugaaucuuuucuggagcaacagcuacuccccagaacuuuaaagcucauuguaugagagcaaagauuuaaaguaaacuucccuugagagccauuagcuuuaaaauacuuuccacuuaggaaacaauauacacugaaaaauucaagcucuuagcuucuuauauagaagcagaggcaauaaaaauuuuuucuuacauaauguaaagcuauauuagccauaccuagaggcaaaauuuuccagugauuaccaguucacuagaagcaaaacucuuuauaauuaucagaauucaaaggaaaaaacaaacuuuuaagccuauaauaacuuuacaugaaguaggcaagucaaacuguaaugucuugauaaauucuacagccugauugacccuuuauaaacuuugaauuagaacuuuauuuagaacaacaucuggauagaucugcaacaguguucuuuuagaaauuccccugaaggcuggcaagaacuuccccaggcacuguuugcaaaacaaaagaaagucacacacacacccacccccccaccccuccaccccaccccgcagaggcugcucgaacuuugcauuaacucaaaacauaaaauuuuuuuuaaucugagcaucuuggcccuccugcaaugaggacaaauucuggggaaacaauucaacuguccaugccucuaauuuuggauagucuuucuuaaaaugacuuauacuuaaaacuuacuuuauaacuuuggugcuguaaaaaaaaaaaaaaaaaaaaaaauugccuguacuguagucuccugccaggcagcaaccauaagcaaaaucuacugucugagggucuaauuuauguacaaaaacaaacauaucuagauaacucugucuuaguuuuguagcgcucucauaagaugauuacucuuuuuuuuuuuuguuuuguuuuguuuuuuuguuuuucgagacaggguuucucuauauagcccuggcuguccuggaacucacuuuguagaccaggcuuaccucgaacucagaaauccuccugccucugccucccaagugcugggauaaaaggcgugugccaccacacccgucucaaugauuacucuuguaauaaucuuaauuaacaauauaugggugaguuuaaaaucuuaagcuugugaucaaacugcaagcugcagucaauagaacacuggcaauuuuaaccaugauuuuuaaguuucuuuugcaacauuagaauaauaucuacaaccuugggaaagcaaaacccaauuucaaaacaauuuauaaccuuagaaucaauguuagaaacaucacuaucacauuacaaaauuuggcugccaauuuauaccuaugaaugcaugacagugcaaguuuuaaugcuucauuaaagagacauugcuuuaaaucuuaucuuuaagucuaccuuuuaggauaagaauccacauuaaauauuaucucaacuagaaguauccuuagaggccuaguuuuuuggccugcuuuaugcaacauguuugaaagacuccaaaccugaguuaccaacuuaaagcuaacuuucuaguaaccaguguuacaccuuuuugaucauacccaauaacuuauaagcuaauacucuugugaugaagacacgcagaguauauuacaccucuaagaccaguaaaaaacccaaugaaguggcuacaugagucuuauagauuuagaccaaucaaagaauuuccauuuuucuagcuauaauauaagauaaaaaaacacuuugucauuugccaaacacaauaaucaugauugcagagaauuuuccaggaaggaaccaacuaucagcuuuuuugccuuagaacuaagaagcuauagacucccuuucuuugaaagcagcuuuuccaucagugacuuccuugcugugcuugaucccuggcuaacaguguggccacucucggcuuugcugaaccagcagauaaaguuuuagccaucuuuuauuuuccaacaugaaacacagaacauucagucauucagacaacuaaacacaaacacacauggauuaacacgugaauggauuuggugcaccagacauuagccaacacaaagagggcagagaacuucugcugcaggggccagagagaaaagggcagggcgucccccaauuuucucucugucucugggagagauucaaaauccauuuuccucuauauauuuuuuauuauuaucuuaaacccuauuccucggcuggugagauggcucagugguuaagaggacugacugaucuuccgaagguccugaguucaaaucccagcaaccauauggugacucacaaccauccuuaaugagaucugacucccucuucuggagugucugaagacagcuacaguguacuuacauauaauaaaaauaaaauaaauuuaaaaaaaagagagagagagaggaauaggcuuuaaaauaacgaaacaggugguuguccacagucaagaacugcaucaggcuagaggaauaggguuuuuuuuuuaaagauuuuuuuuuauuuauuuauuuauuauauguaagcauacuucagacacucagaagagggcgucagaucucauuacagauggcugugagccaccaugugguugcugggauuugaacucaggaccuucggaagaucagucaguccucuuaaccacugagccaucucaccagccgaggaauaggguuuaagauaauaauaaaaaauauauagaggaaaauggauuuugaaucucucccagagacagagagaaaauugggggacgcccugcccuuuucucucuggccccugcagcagaaguucucugcaguugggugcucuuacccacugagccaucucuccagcccccuauuccucucucuugaaacagcuuuuaaacacaaccaccugauucacaguuucuagucccacacauauuucgcugucaaauccuaaguggaaaaagcaccggguuagcacuguuccaaacuuagcccguauccuuccgcacuuccaguaauacuuuuuuaaaaaaugaaguuuaucucaggggucucucagcagguagcagugucuuugaggagagcagugacaggugacagaaccaaagagccaucuaggucggaaggcuccucccuagguaaucuccuucuuaguggcaacaaggucaaagucuggaucagccugcuuccaggcuaggggaggcuacaguucuuaaccaugaagucaucgauccagccuuuaauuuggggggaggggauggacuggguuugugcacaccauggcacaaguguggggaucagaggacagccuucuuuauggagacaguccucuccuucccccuggcuguggguuccagggaucaaauucagguuaucaagcuuguguagccuuugcccacugagccaucucauuggcucaauaaggaauauuuaauauuuugaaagaaagagcugggauucaaaagcucucaauaguuuccaagguuaggaugaaaagauaacaggaauacuuuuaauguucaaaauauucauuuaaaaaaucauggaauggagaagacccaggguaacuguuuacaugaagaagggcagccauaaacuuacuaaaugcgcaguagcaaguguccagaagauugcuuuuaaaaagugaugugaggccggagaaaugacucaacaguuaagaguacuuucuguucuugcaggggauccagcaaggccaaggccacauucauuaguauucgcccuguaaucaggaaggucuuuaauaauggagaggcugccaaccucaagaacugcauaaaauauuucuaacucacuugaaagcucgaauguuauuacuugaauacugaagcaaggaacuuugcugcugggagcugacucuuaagaagcagcuaucagcucugcagccaccucuggcugcuuacuuacaggcagucccuuuuccacccugacgggagacuuguuuuccuaguaugauguuuuugcaagaagcccaccacagcugaacacacucugauaacaucuuguuuuucuccuauacauccuggacuugugguuaagugucuccaguugcacuccccagcgagugcauauauauccauaguugccuuucaauaaaugagacucaagacuugagacuugauccuugaucagauagccugucuugucuccauucuucaugucucuugccccucagucccuacucucucucuugcagcccccguugacugacccucagaccuacccacuuugcccuaccacaccauaauguuuuguguuaccaagggcuagaugcaauggagcccuccauggaccagaaccucugaagccagauucccacauaaaacugcaucauguaagcugacuuucucagccacuugguuauugggaugcacuaacaggcuagcugucagucauucuuucaagugacaaagauguuaugugucuuagucacuguucuauugcugugaggagacaccaugaucuaagggaacucguaaaagaagucauuucauuggggcuggcuuacaguuucagaggguuagcucauuauuaucaugguagggagcaugauggcaugcaggcggacauggugauggaaaaguagcugagagcuacauccugauuucauugaagguggauggacaggacuggaccuggugugggcuuuugaaaugucaaaacuaaaacccaccccucagugacauacuuccaauaugaccacaccuccuaacccuucuaauucuuuuaaaacaguucugcuccuuggugacgaagcauucaguauauaauccuaugggggccauucuuauucagagagaguugauuguguucguaaguaauggccauacacccuugaauggucuguacgugaaacagaaaacccucaaguacaccucuguuuucugacacagccuuuuuaaaagucgucuuguaaagguuaaagacugaagucccuuaaugaaguuuacuucuuuaaugaagaccaucagaacuguaguugaauccucagugcguuggcagugaggaacccagcaaaaguacucugacacugcugccuuaguccuguuacaacagauuacacccacuauugcuuugguuacaucaaaugucaauauuuguugguugugcuggcauggguuaugucaacguggcacaggauaaagucaucaaagaguaggcagccucaauugagacaauaccucccuacgacacagcuguccaaacgccuauagagcauuuucuuaaauagugauugauuggggauggcucaguccauuguggguggugucauccccugggcuauggcucugggugcuauaagagagaaggaugagcaauccaggaggaacaagacaguagguaagcagcaucuuguauggccucugcaucagcuccugccuccaggauccugcccuguuuaaguuccuuccugacuuccuuugaugaugagcagugaugaggaaguauaagccaaaugaacccuuuccuucccaaguugcuuuggucauggugucuaucacagcaauagugacccuaaaauaguguugaaaggggacaagggucccauaauauuguaaggucguuuuggccucauggcuguccuuaacauaccuuagguugauuucagguugacucauugaaaacccuugcauuaauuuuuuucuccccaaacuaugaaguuuguaaagaauggaaaugauauuugaaacuaaguuuuaaugauucuuuuuuuuuagauuuauuuauuuuuauuauauguaaguacacuguagcugucuucagacacuccggaagagggagucagaucucauuacgggugguugugagccaccaugugguugcugggauuugaacuucggaccuuuggaagagcaguugggugcucuuacccacugagccaucucaccagcccaguuuuaaugauucuuaaucuaguggauucucuauuucaccacagcauauuaaauaagugauaaggguagaaaauaugaugaaaauuauauuaaaauuauacugaaauugcuacuguaggacuaguuauaacugcaggucacagaggcuaggaguaugggguuggauucuuuuagagugcuggacccugaauuccaucuauaacauugcuaggaaauagaccaucauuagugggcaucaaguaugccuacacacuuuagguauaacuauucuagaucauaaagacaauuuaagcugauuuauuuaaaaucaugauggugaggcuggagagauggcucagugguuaagaguaauuguugcucuuggaaagaacugcagcuggguucccaaaacccacaggaaagucuuuaacuccaguuccagaggaucauaugcccucuucuggacaucuugaguauugcaugugcugauacacacacacacacacacacacacacacacacacacaucaguacauguguguguccauauauucuagugugucugaaaagagcuacagcauacucucauauaaaauaaauaaauaaucuucaagggcuagagagauggcucagcaguuaagagcacuugggcuggagagguggcucagagguuaagagcaccgacugcucuuccaaagguccugaguucaaauuccagcaaccacaaccaucuauaaugagaucugaugcccucuccuugugcuucugaagacagcuacacuguacuuacauaugauaauaaauaaaucuuuaagccagagggcugaccagagugagcagagauccugaauucaaauucccagccaccacaugauggcucacaaccaucagcacagcuacaguguacucauauacauaaaauaaauaaaucuuuuuuuaaaagugugcuugcugucuucuuuaagaaucaaugggcuaagguuguaaaaaugcugauuuaugagacaaucaaaagggaaccugggcaaaugauucaauugauauauaaauaacagaccaggcuuuggccugcaagagagaacuacucagagagaacagcccuuuuagaauuuuucuaacaggaacugagcugucuggagaucucuagagagcugucuccagcagaacacaggccuaucagcuuguaccccaugaucaacuucaagugauuucucuugccacccccaaacacacuuuccucagaaccccucuccaagccuaggcugaucuuuggcaauagaugcuauuccaaagaagggggaggggggugcuucagacauccaggaagagccgggagugguggugcacgccuuuaaucccagcacucaggaagcagaggcaggcagauuucugaauucgaggccagcuuggucuacaaagugagcuccaggacagccagggcuauacaaagaaacccugucucgaaaaaaaaaaaaaaaaaaaccaaaaccagacauccaggaaggauaucagagaagaaaagggagcgcaccagcgagucagacacaccucaagugcacagguuccccagcagugggcugaaaaacggaaguagccuucaaaagguaaaccagauggcccugacaaggagaggccggcaguucuacccccaagacaaacccacagcucucucaggccuccaauccagcuguggacuccucucucagucagguaaagaguaaucccauucucucccucuuccccucccucucccucccccucccccucccccucccccucccccucccccucucccucccccucccccucccccucccccucccccucccccucccccuccccuucccucucucucucucucucagcacauaugaacuagauaggagcaucaggcaucauuuuaauggguaauuuauuugaaaccgagcuacucuagagucuugagaucaggagucccccacagcucaggggaccucaauguuuggccugccacaggaacaugaggcaguugugcagaagcaagggggccagaggaaacuaagcucaaauuacauagagaaaggauggguggcuggacgcaguucucugccacauagaaugacccuggagcuuaauagcucugagcuugaggccagcggguggguaagucucuggaguugauccucugccucucuggagucaauccucugccgcuaacugccacagaagccaaaaguucaaggagugugcaugacacuuacagcugcacccuuccaucaggguggucaguaugcaggaggucuggaaggcacaaaggcaggcaccguucucacugcugugguuuguauccacaccagaagaggacaucagaucccauuacagaugguugggagcuaccaugugguugcugggaauugaacucaggaucucuggaagagcagucagugcccuuaaccagugagccaucucuccagccccuggguuuuuguuuuuaagucuuauuccccccuuugacauuuaucuacuucaugccccacccacccacccccacccacgcuucuuuuaggggccagggagauagcucagcuguuaagagcacuuguuucuuuuguagaggguuugauccccagugcccacauggcaguucacaaccaucuguaacuccaauuccagaugaucugacagcuucuucugccucuuugagcaccagguacagacauacacgcaggcaaagcauccauauacguaaaauuaaugugaauuaaaucuuuaaagggcaacaccuuuuuauacuguugggucgucuuuguguuuguucuuucucuuuauuuuuuccccagucuccugcucuuuucccucaacagccucucccuccucuucuuucuccuucuuucauccauugucucucuagucuuucccuuucucuacccacugucuucaucccauucacucauucuucccacgugcuccuuaaauagcuuuuaacuuccuaacagucuuuuuuauuuauuuuacucgcucuguagaccaggcuggccucgaacucagaacuccaccuugcucagccucccgagugcuggaaugaaaggugugcacuagcuucacuuccuaacauucuaaaguaguuuuuaaccaucuucaguuccaugaucauuggcaauacauuagcaggcauugaagaaauaaauaaacuccuagucauagaggacucacaaaaucaagccaaaaggacauaaacgauuaaaauggauucauaacaaucaacaagacggcucuuacuccucacuccucucucuuuuugucuucuccucuccucucucucccucuuuauucucuagccuuucuucucucucuuuucuaccuucucucuuucccccugucuuucuauaauaaagcucuaaaaucauuuuuuuaaaaagucaacaagacugagacaguaaccaaaaguuuccccaaaagucaaaauguagcaccagacugacucguugccgaguuuuaucaaaucuuuaaggaagagguaauaaccaagcuccuuaaacuguuucauaugguauacagaacacuaccaaguucacccugccaagucugcauuaccuugauauaaaaacugguucagagcacacacauuuuuaaaaaagaaaauugucagccguuuuuuccccugaugaacauggagacagaaaaaaaaaauucucaaugcaauucuugcaagccacauuuaagggcacguuaagauuauguguggugauuacugccuuuaaucccagcaaacuuuguacaacucccacucccguguuaaauacuaacuucccgcucccaguccaagccugcuuuguuucaagcuucuuauuuuaaguuggugcagaggcugccccugcagagcgacucgagcuaaaagccugucaugggugccccucccacccugcauccacuucaccauuccagcaucugaaugucuacucugcuccaaaaauacuuuucagauguguccuuccuuuuccuuccccaugcccccaucggagucuuuucaaagccuggaauaaggcuuccagccccugugguccccucugcuaucacaguaaguuucuuaaauaucgagauuuccagacucucaccgccuccccugcauuuucuccucccacugcccacuccacgccccuucaugccugcugacaucagccuggaaaguuccugaucacauuaaugcugugcuuuucggagugcucuccucuacaccaugacccaaucugaggucuguuuugcuaaguccuagcucugccuccuccuccauaagcguuugcacuacguagauggaaaaaaacaaaacaaaaaaacaaaaaaaaacgugcgcugcuuugccagcacacacccccacccccuuccuuggcgaaagcuggcgaccagagcccacauucaagguccggggagcggaggcggggggggggggggggguugugaggucagggacugggcuagccuccaucugugacugcaagguacaccggcuagcuucaggagcagcgcauccugauuggagcgaugcgugcagagcccggugaggccgcugauuggcugcgaggggucaggcgcuuugggccuggugaacgcgagugaaucuggggccaaugcuaacccagaguaaccccgggaggggcccgcacgccugacccuugcuuuuccucacccuagcuggaccucucccgggcaggcacuggcagagggccaggacuggaggaagagcguugcauguugcuucuauuucaggcacucagcuuaaccugaguuggaguuugguagggcuccauguacggucaccaggacaguaauuuaugaugucacagggcuguguauguguguuuggccgcaguggggugggaggugcguuagugauccagggagguagccacacugccugcuccuggaaauggcgagguuggaggcacgguuugaggcuuuggcuaaagcaaucuugcuacuggaagcagagcuucuacuuuacuccauggggucuggccuuccccgaaagcagaaagaaaaaagaaaaaaaaaaggagaaauguuauggugaagggugggugacacuguccauuacugcuguugaaaacuguuuacucaaaaaaaaaaaaaguuaaacagaauuauuacagaagaaaucccauuccuguguacacaaaucgacagagagcaaaugcuagaauauacacacacaaaugugcagagcauacuauucauagaagccgaaagggggggacaacucaacugcuccccauaaauacaauggacuguuaaucauaaugaggaguuaaaaacugauuugugccagugugaaaauguuaggaaucgaucaaagaagauaaaucaaagaaaugacuuagacacagauuuaagccaguagaaagucuauuagcuggcugguacuuacagacuugagccuuucucggggugagauguuuguuuuuaauuauuauuauuauuauuauuauuuuauuuauuuauuuauuuauuuuuuugguuuuucgagacaggguuucucuguguagcccuggcuguccuggaacucacucuguagaccaggcuggccucgaacucagaaaucugccugccucugccucccaagugcugggauuaaaggcgugcgccacuacgcccggcuuauggcauuuuuuuuguauuuuuuuuuuuuaauaugaguacacuguagcugucuucagacacaccagaagagggcaucggaucccauuacagaugacugugagccaccaugugguugcugggaauugaacuuagaaccuugggcaaagcggucaaugcucugaacugcuguuccaucucuucagcucucucagggcaagcuuuuaagcacacacacacacacacacacacacacacacacacacaauacaaaacaugucuuuguuugacacauuuagcaagaacaguuagccagaaggggaacuacagaagccaaaaagcaaggcuaguacauuuacagacuucccagagcuauggccuuugaugaauuagaucuuuguuuucauuuuggcggguggugcugccuaugugcuggguuccaugaccugaauaguacuucuaucacuucaccauguuaguuguguuaagauuugggagccaacuaaggaccagguuggggggggggggcggugggggaccuguuacaaagagacacacagaaugucaugcagggaggcuaccagacacacacaguauggcuauuucuccgacauaaacaacaaccgauucauaggcagcauauugguuguugauacagugggagggucaugaggagucauucgaaugggaauaguguuuccuuuuggggugaggauaaugacauuuuuuuaaaacuaaagaugaggcccaguauagugauaaacaucucuuauagcagcacuagagaugcagagagagagaguccggucuaacggacugaauuccaggacagccaaggauacugagagaaaccuugucugaaaaccaggugauuaauuaauaacuaauaauaguaauaaauggcgguggcuaaacaguauaaguauauaaauucaugcgccauggucauggauuugggaccuuuaaaaugaugcuuuuaugaugucauuuauucacuuaguuagguuuuuuguuuuuguuuuuccaguguuggggacgcaauccagggcaucuuacaagcauggcaagaguaaacagagccuuauuuuuacaguguaaguugcuucuacgccaaagaaaugcugcuucaguuaacaggcauaacuaacccaaagagucucagaggagaauucuuacccucacccuccacuucuaaagaaaaagaaaaaagaaaaaaagaaaucguaagaauacagccaggcgugguucugggccugccaugccuuugacaaccaguuuucucucguuugcuguucuuguucacaaagucuuucaaggccugacccugacuacucauuguucucaguggaaaauggccaagaugccaauggacucuuggauguccccagcaccaaaaucaccaugagucagcacagcacacacugcccuuuugugagcucucugcuguuccccgggcagauagcgugggaggagugcucaccagaggaggagggcucuuucugccuccagcaacuucagggcagaaucucugucccuuagggaguuuaucuuugggauuuauggcgugugcucagaauucauuguccaaaacucagugcuuucuuuguugcauagaacauuaagcacaggucaccgaagagaacgcccacuucccgugacauuugccacugagcgccacuauugaagugcagggagacauuugcaauuaauggaagcugcccuuaguuauaauagugcucaguccuuuacaggcagccagacuguaguugcgaggagagaaaaugccagcacuauuuauguggucugagagguggguguaaaacuggggugugguaggucacagcaagaaugggagcuggauagauuguuugguuccagaacacaguaagcucaugcagggagagggugccuggauucuguggagccugacugcaguaucgccacaccacuccugcugccucuaaaugaacucagcuaccacucugaggcgcucccaucucuugcuucugaugugagaugagacauccuccagccuuuagcuuagugccugaccagagaaaugauccuggcauuaucacugauguguuuauaaaaagauaaggagguauaggauguguucuauggggguguggugaggugugggggaagggggugccccagcgggcccaugcugaggcaucccuuccccugagggaccagccacaugaugguauaguauagaagagaguuuauuuagggcauggggaggggaguuagaaggguaauagagucagagaaaggcagagagagggagagaguagagaaguagaggcuggccacggccaugagcucauggagagaggugggaagggaauggagaagggaagaucccaagagggcaagagagaaauaagagggaaacaagaguaagagagggaggagggggcaagcagccccucuuagagugggcuaggccugucugacuguugcuagguaacugugggguggaguuuagacagaaugcuaacaaucaucgcaucuuccagccugcgagcuugaugucugucuuucaaaaggugcugcauuuguguuugaguuuggcacaagcccuuucauuuacagaaaagaccguaucuggcuuuccccaaccacuguaauuugauggggcaagauuaucaucucacaggcuacauuauagcagcugcuuuuggucacaugcuuagucuuuuuuuuuuuuaaaguccggaagccacuucacuguugaauuagaauguagaagagagaauguccuuccauugaagacgugauuuuucaccagugcuuucugguacauuugcaauccaaccucaggcucuguuaggacuaaaaacaauccaacacaaagugcccuucucauuuaacgucuguuauuagacaaauaaucuauaaaccgaaauugcaccuuaaaaauuuauaguuacuaagccagggcauuguagcgaaaaccuuuagucccaacacucaggaggaagaggcagguggaucucugaguuugaggucagacucuacaaagaguuccaagccaggcagggcuucacagagaaacccuaucuagaaaaaccaaaacuuaaaaaaaaauuauuagcuauuaucaugguuugaauaugcuugguccaaugagugguacuaauuuggagguguagccuugcuggaguacgugugucaccucauccuagcugccuggaagucaguauucugcuaacagccuucagaugaagauguaguacucucagcuaccaugccugccuggaugcugccaugcuccugccuugaugauaauggacugaaccucugaaccuguaagccagccccaauuaagugcuguccuuuagaagaguugccuuggucauggugucuguucccagcaauggaaacccuacagcuaucuuagcauauuugcucaguugugcaaccaucacaauguaucuuuuggaaauguuauucaccguaagagggcucauuacuuuccauucuucucuggccccugguaacucccaaucugccuucugacucuagaugugccuguuucagacacuucauauaaauagacuccugaaguaccucuuuggucugagucagaaaaauggucugucuuguacuucauuccuauagcugagaaauacugcacugucuuaaaaauacauuguguuuacaccucugcugauagauguuuggauuguuucugcuuuuguacugugauguaaugcagguauggacauccaugugcaaguuuuuuuuuuuuuuuaaagauuuauuuauuauuauaucuuaaguacacuguagcugucuucagaugcaccagaagagggcgucagaucucauuacagauggcugugagccaccacgugguugcugggauuugaagucaggaucuucggaagagcagucggugcucuuaaccacugagccaucucaccagccccaugugcaaguuuuuguguggacacaucuuuccacauccuuuggguggaugccuagaagugugucugcgauccgugccugcuuguugcuaacuauuugggagauggcuggucuucuuuccaaaggagacgcacaaucucagauuuucauccgcagcgagugagugucucugucuguucacauccucagcaacacuuccuuuuuacuuuuauguuuuuauuacaguuauuuuaguggaaaugagguauuucaguacgcugcuuaguacgggguugagggcugcuaauaccaaguaccuuuccaugucuuuuuugcccaucugugggucuucuggucaugaaugucuacucaaaugccuuauuucuaauagcagguauuuauuguuauuauauauguauuauuauauauauaccauaauacauauuauauauguagcaugguaucccugucgucuuuuuguuguugaccuguaaggguuccuuugcugugggucuugcucagcaguacagcucuugcuuccaggcaggauuugacucagucuugcuaacagcagaaugaaagcaugcauuucacagacucucagcacuaagcccucacacauccccaucugccuucucaguuaccugaugguaucuuuugaagaccuaaagccucuacuuugacgaaaccgaauucguaacacuuaaaaagggucguuguuucuacugucauaagaaauuaucaucugugcacaccaguguuuucuccucagggaauuuuagcuuuacauaauauauuugaguuccuagcugugugugauaugacguggugggccaacaauaguaacaguuaccugcggauauucacuuguuuaacucugcuagaagauucucuuuaccaguugagccaucugaaugcuugccaaguaucuguuaauuguaaaugucuacuuucaaccccacuuggucuggauuuauccacuuuuauuaauggcccuuugaagaaaguuugaaagaauaaauuucauccaucuuuguaugugcacgugugcauguuuucuauuugucuauucugggucucuugaauuccccugugaauguuauaaucuauauauucaucuaccucacuggaacauuacuugauaaggauugucuugaauuggcaagucuguuuugggagcacuaccaucaauacuaagccuucccaccuauaacguuacuuagccuuauuuuuuuuccccuuguguuuuccuucaauaguacuugauacuuuugagagaggguuucacuacuugccuuggcuggccuggugcucaugacagugggucaagcuggccuuagagauccaccuaccugucgggauccccauaccccaagugcugggaucagagguaugaccacccgacccacuucuccaggcagcacccugggguacuuaagcauaacacuuacugcuuuugauuuuguggcgaucccguucugugucauuguuaaauuauccauugcuaguuuauggagguaaauuugccuuuuuucuggcaauauaucaacagcuuccaauaguuacaugugugacuugguuuuauuucuuccccuuuuccugcccugguagacauuuuggaggacauuucccgguuucucuguggaaguagaaaacugguagccacugggcaucaggcaaucuacucuugucuccaucaguaucuuugaaguguuucuuuuccuuuugugacaugguuugauuucacuaggaccuuaaccuaagauuagccucuccuacaaaaccaccaccacccaaaggaauuuauugcuaucuucaggggaucuuuacccuugaacaagaagcaacaauuguuggccuggcucuuaaggacuggcaaagagucagcaugcagucccugauucgggauucagaauuacugagcccuguagaguugcuaaggaacacaccuucacugacuccaccgguccccuuuauuucuuuaaauuuugaggcaaucucacuagguugccuggcaggccuugaacuuccaggccuucccucccucucuuccucccucccucaaguagcuagaaucacaggcuggcaccaugaccuuacaagaguccuuuagaauggaugucuuagguaaaaacagacucagggauugaggugaacuaggagcccagucuugcacgacccgacccguguucccuuuugguagccucuaaguaaccgcagaggaagcagaaaaggcuacagagaaggacauaaggagggaaaccaagcccugccuuucccaucuugugauggugaaccccucccuggguggcuuuccuucaggcaucagcacuuugagaggcuagcuguucccuaaagacaggauauuccuaagaaugagcuggacugcccaaccagagcuucaaggaaagaucugcacuaagacgcuucguugacuggguguguuuggccaugagcuacucaaagaccuggcauuugucaagccaaggugccagcugauguuucugauuuaauauccacuuacuacugguuuccuguucccagaaaugaaucucaaauaacaccgaaggcagggcagguuacugggguaugacucaaaccucaugacuucuaaauucucuuuuuccuuuuuuaaauuuaagacaggguuucucuguguagcccuaguuguccugagucucacucuguagaccaggcuggccucaaacucagacaucugccugccccugacucccuauugcugggauuaaaguugcgcgccaccguugccaccacccagcuccugggaggcuguauugcagccaaaacaccacgagacauuuugcagucagaucauuucauuuuauuaugaacaaacacaaccucagaugaguagaaauacuuucggaguugguauuaaugaaaauuauuagauuacaaauaacuacaguugcacauaauaaaggaaaaaucccacccaaggaaggaaacggaguccugcauguuuucauagcagugaguauacauuaucugacgcauccauucaaccucugagaaugauguagauuaacaacgucaucugggacauaggcacaugucaaguccacgauggacaguuacuacaaaaaugugcaggacuuaaauacuccucugcagaggauccccaaauguuuuauaaagagcauuuucucaugcucacaccuacccguggagguaggucaggaauauuaucccaguuucacagaauacugagucacaguauuguuaggcgaaaugcccagugcuacgguuugaaucugucccauaagucauggguuggaaacuuaaauccccaaugcaacaguguugacagcuggguccaguaagagcugauuaggucaggucgggaaggcucuucccucauuaacauccuuauccaaggagugaacucauuaucgucagagugggacuguuacaaaaaacugagaguugguaggcggcccuggccuucaccaccaguguaacacggccaccacuuucuuaaauuuccuacuaaccuauuucaacuaaagaagacacucaagaacacuagcaaaccaggaagaaaagcuuucacuuaaaauccuauaaccagcuuuuaaaucuuaaaacaaauaacaaaaccuacaaaucgcguacguucaaaauuacuucacccauccaucagcuacgggcacuugagcaaaacagccccaagaaaaguucccaaaacgagguccccagaggcaauccugcagauccauguccagcuaacccuccagccaggccaguuuugaucuugccacacuuacaggcucucugguuuuaaggaauccacggagcgagcgagcgagcgagcaagcgagcgccacaggcucacgagcaacacugguuagaaaagagguaaggcacccaagucaaacuuuagcguguccacgaggcaaggacuguuagaaaacucccucaaucagaucuuagucucuuauuaaaagugucacuugguuugagcuuuaaaaaucuugauagcaguguuucuuagugagcugguacacccuuaacgacagauguuauuuuacgggguccuuagccacagcaugguucagauccacggggcaggcuaagaagagagcugcuuuuauuuuucacauuuguuuaagugggcaccauaaccagcggaacugaaaucacucaaaaggcauauccaaggaauagaauagggccacagcucagcaaauaccuuggauucgcccaagaauucucuuuuagcaaacagcugaaggguaaggcuacuuucaagugggcacaggaaggcccuaaagccucucucuauucaacuagcccaggaagacuguccccucgaagcacagcaccugguaugcuguacagccgacgcggccaggcuucugcacugcugcacgagagccuuucugugaaauucauggcaucucagcucuccuacccuacccaaagcuuucaaacagaggcacuuaagaacacaaccucgagugcugugcuucccacuuaaccacagcaucacccaggagggcugauuagcccgcgaagcuuugccgaagcuuugccaagugccgggagcacggugcaugcucuguccgcccugacucgccggcaugugugccaccaaaccauuuguuuuggaaugacugacaaagagucucucugagccagggauguuucuagaaaguuggccaaacuuuuucuuuagagcugaagagagugucagaagccugggagggauaagagguggagaaucugaaacccaccagaaaaggauagccgucucuaccuacugcagauagagguuguaucucugagugaggaaggugccaggaccacacaucuuuacugccuggaaauauccaggacauuucugccuagaccaagacuaaaugucaaagaggaaaaaagaaauacaacaaaaaaacccaccccaaaacacaaaaaauggguaggggaaaagaggcaggugugguagagcugagagauuucaaccauguaucccaggcagaguccuaccuggucacagagcuagugaggcaugagucaguacugccuugccacaaacagcagcgggacugaaaggggcuaaaaaaaaccuaaccugcuccacuagaacaccccaaagccgugaaguccccugguaaggggcccucagaagcuuuccuuugagaagucauuaggaggcgcccacagcgacuuccaacgugcccguccacugcccgacagugggagggagaaggcgcgcagcaucgucuucugagggaagcacucacggaguguuuguaaggauccaggacagacuuuacgacuuuucaguuuuaacugugacucaaguucaacucuugaaauccuuccacuguuagauguauggaaacgccacagcuauccucaauuugugggcacgaccaucaucuuaaagauggaagaacaggaauuaaaaagacccugggggugcagcucacgggacgcucgaaaccaugagcgacugcccuacggauuccaaacaugccucacucgagggucccuugcucugcauguccugcuaacuguuguuuuuuuuaauuugagacaaggucucacuaucuagcccuggcuggcuuugaacucagagauccaccugccucugccucuccaguccugcaauuuaagaugcaagccaccacaccuggccccggguccuugucauuaaaggaaaagaaaauccuuauuaaagaccacuuuuccuacaaauuguuuuucacuuuacuaguauauauauauauauauauuuuuuaaaucuucagccuaaacuacacugagauacugauguguuacuguauuuuagugucacgaaguuccucaguugccaccuacuaagaauuaggagaggaggcgcgcuauguugaaaggcugcgguagcucugccagacggagcugagccuguucauaagagaucccccucucccacggcuuugaugaaucauagccugcguguugaacuuggccccuuaagauuuaccucuuuuauaggcucccugccaaauaaaaacuauuuucuuuuucauuccaucuggcaaagccugggcuaaaaauaacaggagaaaucucucaagauuuuucuuguauuucuaacucagagcagcuuaagaagaguuggggguggggcacgaaccuuuacuguagacccuugagaaguugguguacucuggaaggugaacacugaccuauagcugagcggcggcuggcuugggagaagcaaugagaaacgaggucaucagggacaaagcaaagaaaaagacaacgggaaaagaaacuagaagggaagaugagcuuagcauagaaggaagagcugucgacuuccgauuuuuguccguuuuacaauacuguaccagaauggguuaacgucagucaucauuuuagcaucuggguggcaauacucaguaguuaauuaacagaacaguaagccucugccaagcuggcuucuggaacaggaacugcaagaccccacacucagccgcucuugcagcuuccgucuccaguucucuuaauccuggccaagacagcagcccuggacacucucuuccggucguaagccaggcccaggagagccaugcaaucgaugaagaacguggugaaguugaugugccagcgguacucacuggcagaguagucguaggggaaggcguggugguaguuguggaagcccucgccugcaaauagaagcaaggagaacagagagggggcucagugcuuccuccucugcccacgccucuuacccagugggcuccucagacuuaggggaaucagggcugcaggugagugaauggcuaaacccaguuucauuuacucggaacagacagacaccaccaaaggcauugcaguuccauuuauacucugggaccuacacaucuugucuaagugacuccaucucuaagaggaucucagugcugcagaguuuagguaauuuauuucaaacauaaagagaacaugagcaguuuuuaaauguacuuuuaguauuuguaugaguuucugcauacgcacaaugagugccacagcgugcaggagucgguuuucuccuuccacgaggugggucucagggaucaaacucaggcugcucagguuuggcagguaagugcuuuuaccugcugacccuucaugacaacccaggaaaaauacuuuuaauaauauccaaaguuggagcuggagagauggcucagugguuaagagcacugacugcuguuccagagguccugaguucaauucccagcaaccacaugguggcucacaaugggaucugaugcccucuacuggugugucugaagacaguuacaguguacuuauaaguuaaauauauaauuauauauauauauauauauauguguguguguguauauauauauauauauauauccaucaaaauauauagauguguguguguguguguguguguguauagauauauagauauaucuagcuccauccaaacuggcuaaauugaguguuguaccaagauauacaagcaccaaucugaacagugucguuggcugaccaacagcucuuaucaguaagaaaaagaaaccacaggucugcauagggaaaacuaacuugaaagaacaggaaaaugugggcggcacagguggcagaggcaugcgugcaugcauccugacaacugggauuggauuuauagcuuggacccaacaauuacgaucaacugaucugguaggacucccagaucaacccugugcgaaggggagcuccagcacaaaacaggagaaaucagaaaaacagaggauaggugggcagaggguggcagggugacgaggaacaugugccaacgugcaccuacaggugucacuaauggauaagccacgcccaagcacucuagagauaaaaaugcuauccaggaacauacuugaaaugaauuguaacucuagcuuuuauacagcauggcuaaaucaacacaugaagcuuacacucauggagacgacucugcuuuucuauuaaugaucccugcccugagcugucagagguaaucaggaaacggaagaacuaacucaaaaggucccaucacaggcacauuuucacccuuuccaaagaaguuauggccucucaaaagaauucccuaauaaauuaccaucccccaucccccccccccaagucucacagugggaaauaucaaaaaucgcaucaucaucauuccucuggcucccggccaagaaucucuaagaagccagucaccagaugugguccugcuguggggacuuacccacagcucccauggaaaccaagauguucucccgagagcuaauguucuugucguaggggcgauauccguagaggugggcggcacuguucaccagccagguggcguugagcaccacggcguaucgcaagaaggugcuaacgcacaggcuguuuacaaaagucucgccccagcaguaccagggcaccagcgugggcaggacgaagcacaucagcaggaggccgggcuuguaguaccuacaaugagaugacauauuuuaggcuucauggagagagaacucucacacuccuugcaggcagggcugauuucuccccugucccaugaguaaagaccagaaggaaccagcccaaaaccugugguagaagauuugagagcaagugcuguuagcucucuguuuagauggggggagauggaugcaguagaugacccuguuaucccuauugcuuucugggcugccuuugucugucugucugucugucugucucucucucucucucucucucacauuauuuuauaugugaguauacuguugcuaucagaccccauuacagaugauugugagccaucgggugguugcugggaauugaacucagaaccucuggaagagcagucagugcucuucacagcggggccaucaucuuuccagccccugccuuuguuuccucucaugaccaccagaaucgucacuuagcaugugguggcaugccuccacuuccugcuaccaguguuccuagaucuguuccccaacccccaaacuguaagccucugacacagacaacagcacuaucccucggguacacaagaccacagauccuuccaagggaacugacucgccgcguccuucaauagccaccauuuuccucucacacccuaggaaguccccugcuuguaacuccuuguuucucugcuuaagucuuuccuaccaccuaacuugugcccuucccaagagugggcaacacuccugccucacgcugcuggagaagccuuuagugauucggcugcuaacuuaacuacuuaagucuguguggaggagucuguaggaagggaguuggcgauacgucuucaucaucgcucuuuuucucucucacaccugggauuucaagcagaggcugcaccccugaacacccacccuucagcucacugccggcaaggccucucccuggaaccuggaacccuccaugucucugugugcuguggcuucaaugccacuuucuccuaagccugcccccugcucuuugcagcuguccagucuagacagauccugacuugcauggugacucucaggcuccuugacuuaucacccccuuauaggaggccacuuaguccugcaagauaagcucucgauugcacucagggccguccugcaccgcuuaggacaaugagcaagguuuuuggguuuuuuuuugcaguuaacuggugccuauuauaagauaacacgcacggaggaaaauagguuucucucugugcccuacaggauguuaaaaauacguuuuaaaaaugaucugaacauguggacacaguaagucauggcuuuuacuuuauaauuccuaauaaaaaaugcagacaguguaaacuguacauucccgggggggggggggcacagccucagcuucaacccccacacccuacucaccuccucuggaacaucaccagcuucucggcuuucaggucagacauguccaguuuuccgcccuucucuuugacagccggguguuugcgcacaagcagccaacccacgugagagaaaaagaagccacggcgggaauugugagggucggcguguguuucugagaacuuguggugggcgcggugaucucgggcccauucauacacgucauucuggaagcacaggaaagaggaacccaguauugagaagagaggcccuccaaggagccugcaaggaccuagaugucugcaagggccugggacucucagcccaacucacaaaauccucaggacucuggcucaagaauacgcacaggguggaaggugaggggcuauccugugcuucauccuugccuuaggggcacauauagaaaaagcaauuuaaagucccagagcagaggaacagcacggucaccuccugagguuauacgaaagcaagcguggguaagucacaguccucaugcuucauuagcaagaagagucaauccuaaagcuaauuuuacguguguggguacaggugcacacgugucacggcccauguguggucagaggacaacuuucaggacucagaucucuccuuccagauuuaagaucaaacugucaggcuugcacagaaagcacuuuuaaccaaugagccauuuggagaaucccauagcagcuuuccaagcagggacuucggggcagggcucacauggagcgccuuauccuauggcucacagaguuaguuacaaggcaaguggccugacuccuggggugcuccucuguagaaacaguggagaaacccauucaccaaguggcagcccuuucugcccaggaucaaggccagcagguaacucccgagcacagguacaucacccaaggaccucugggccugucugcauccuggcuuaccucaagaguacaccacugucucuuccuccacacccccucugucccccaagaauacuagggaucuuugaaaaguaaaguugcuccaccagagaggauuuggcaaaucuggugagcaucucaaaucucgacacggcacagaggaccaauuugguuuccuaguuucaucuugcugcaaauuaaacccaccaguggcuacccuuguguccuuaagagcuuaggagccacgaggguccucuaccaagucucugucuuuucuccgguguaagcuccggcgcuuguagagggguagcaacaauugugucuacuuccucaaauggcuuugaggacuuaaaagagccccagggucuuacgacaccuguggguccguguccaucccacugugguagagucuaagacaguuacuuuaaaacgaacgguucacuuauggucuaagaaaccagagucagugcucagcucuugugugcccuuuauacuaaagacccacaacugccaagcugugugacaccccugggacucuaagaugaaaagugacccggcacauggggacccuuucuuguuucccuuuacaagugacucuaugguauauggacuucagcacugaucuucacucuaggggaccacauagcaguagaaacaauggcuguccuagucaacuauccagaccuugaucccugacuacccaccccugggcggagacacagccacagcacccacuucuuaccuggaacgccaugguguuggcaaugaugaggaagagccucaggggcagccgugccuuguauguucuguggcuccacaggcgaugagccccggcugugaugcccagggcgcugauuacauaguacaaauacgcuguaggaccagaaaguugggugucaccaacaagccaagauccauaagggaaguaugccaaagacagguuccuggcacccgucagcuucucaguuagccuuuggguaaaggccugguuuucccugcagcccuggggcgcacugauuuguagaaacuucauacauuuuaaacauuugguaccacuggucaucacgagucuggcuaucacuggguuucauucccagggccaauguucuuugaccucuagcaguccucuaaagauuucuggucaggaaacugcauuuccucaacuuagaacccauauccaagggcaguucugaagcaccagccagaacagcuugggcaauggcuaacuggaaaagacaagcaguggcauacugaauagcuaacucuacacaaggcuuuuagcaaaggugcauuucaacaccacagcagcauaacgggaagucagauuugcauaguggcgcaaacauuaccaaggguacuaauacucucauauucuccacacaccuugaacaagguacuacuaguuguaccaagcacuuuuauuaaagaaacagauucuggaaaaggucgucugucuacuguucgaaggugaguuuuccauccgccaucaccuguuuccguucuacuacucagccccuaagaucugcauauccacucccucgucuuguuucucucccuggccaugguccuguccuugcagaauguuagaugcucaaagcuggcagaaaaacacugcuucacuguccuugaagcagaaaggcucaagaagugacaguccugauaucucacugggacagagagcgguacagacaucugacacccucccccuauuugcagaacuagggagcaggggccuugguagaauaggcuaauacuggcucccucccaaggaacaccaagaaacaaaggaccuucacagacuacagaacuuaguugcuacuggaaacaccccacauugcaccaacugcugcguccuucugcagucagauaacauguuuccugagaccccucucuccuccuucccaacucccguaccuccuacaggaucccaggagaccagccacggaugaaaggccuuccuaucuggaaaaauccuaggguaaccagagcccugcaucacgggauggcuuugggcagagccaaagcccuucgcugagcaccaagggcuuaugcugcagaugacccaaguagacuggaucaaaacucagaugaugggguagaggggugugugugugugugugugugugugugugugugugugugguugugcgcacaaccacacaggacacacaaaccuaggcagucuuaggccucuucaguccaccucuccgucuagcaaacaggagacuuagaucccuccccugucugccagaaaaguguucacaaugguggguaggaacuaucucuuucuuagcuuuaacuucagaaucgggauggggagggggagggggaggggguggagcuuuguaaaaucucucugugcugucaaaagcaccuauucggcuccagaguuacggaguccacaaagguacaaaagacucuuaaagcagccgagucaggaaaaggcuggcagggcacacaacuauucuaaagaaguauuccauuccuacuuuugacaaagaugugaagacuaugagugggagcuggguggugguggcacacgccuuugauccccgaacucaggaaguagaggcaggccgaucuugcaguuggaggccagucuggucuaaagacccaguuccaggacagccagggcuacacagagaaaccuugucuugggagaaaaaguuugguaccuggaaaacucucaagaaucgaaucucaccacuuauaggaccuaggaggacugaggcagagagacagccaacaaugagacaaccagccuuucuauacacuguccugcaagagaccugccauuaguaccuacaugcagauacuguucuagaaaaucaauuguucuaaagaaacccuugcucuccgcuucucugagagcagcaagaggcccugacuauagaugcagucccuccuuccugguucaauguucaguuguguaaccacccgcaaagcacaugcgugucgcuagggggcagcacuacccauggcucccugggcagcugagcuaggcaggucaguggcacaggggcacacucaucacaguugggcuguggcugcuccaggcucucuuccugcucaggagguauguguuagguguggagagaaaagugccacagcacaauguggacaggaaaagaggggcagaaggcugaauagaagguaaaaccuuccugcaaucuuauuuuauucuaagaauggucuguugacuggcuuguaccaaaucgugguaccauacaccuuugaacuuggauauacaggagccuucgucaucuuucuccaggcaaaccagccuagucuggccaggcaggaaguccaaacaguuaggcuuauaaccuacccucuguucucucugccuaaaacagcaucccauggcuuuguccccucacuggacucaacagguuacccacuaggcccguggucuagcucuuggcucugacgucucugaggcaggcccugcuucucuuguggcaggcaaagcugggacaggugccaucaagugacucauacagaaaagccugcucagagaccucugcaucaauguuaugagacucucaagacucaaguuccccccuccccccauucuuaacaccacgagguucuuugcccaguccagcugguccaacaagaaccaaaaagaaagggccacugccuugggucagagaccagaggccaccucuuuaaagaucaaggagaaaucugaaguauuggcccaagacaaggggugcugcucaccgaagagacagguguagagcuugcaggagggaaccagugugaucccguacaaggcucccaaaugcagcagggccaugagaaugauguuccuccagacguacuccagcuugggcgggggccccucaucauccugauagguggggucauauagaucaucuuuuaguucagggcgaacaucugcuccccaguggugagaacucuuuucaaacuucucgccuccauucugcugucccccagaagguggcgcugugauuguggugguggcugaguaagcgccagagaucugcaaugagaggggguggagaauuagggacugcagacgcgugggggcagcagggguuacuuucccucuaauauaacugcgggagagaugcaauaacggccauaccccagugccaagguugcaugacuguagagcgcaccaauggaacacggaaaugugcaggccaucgggaauaagccuuaugaugaaggggcaggaaaggacgcuuuauuagcagcacccuuagcaacucacaaaggaaaaucugcgcauaucgaaaagaggucagguuuuacuuuaagaaacacaaguugggacaaucaacuguacugaguaaaaauccgguuaucacccgguccagaaacaaucuaucaagguugagcaauucggaaaugauggcuaaaugcucccagcugcucugaacucucuccaacccucaacagccacccaccuagaaguccaaucugcaaccgccaaccugaggaggggguggggggugggguguaagcucaccucuugcaguaugugggccggcaucuuggcgucggaugcuggggucacguucccagggaugagaacgugcagcgagcuucagaccucagcgacaaagggugcuaugacuaaguuucugcagcccgcugcgcgguacaagcucugggccagagcuggcagugggguauuaauguccuguauauccuuagguucguuauauugaucaaugaccagauaaaaaaucaaaaacuggcuggccagggcagccgcgggcggagauaaggauagaaaaugagaggacgccaaaaucgcagcuugcagccaccgguguccaggagucagaauacugcagacaccaacaccgcauugucccaucccuagccaagcggaggggggcgaugcuaaugaggccuucguaaacucuggcuagucauuggccgaugggaauuugguaccaccucguccugcugcucucauuggcucugcacaaucugcuguucccucugccuccagcuccgccccccccuccucccuucuuuuucugcuccuggcuucucacccaucccccgcugguccuccacccagcccccacccugccacgggggcgcuucagcgcuuucucuggaagagaagacccaaucuagcaguggggguuggcuaccggggcaggaagacgcggagagguacauaaagugggaaagccacuagagcgccgaccacuugcaacuccauccggucuuugcauuuccagaggcgcgugggaggggaaauggcuaccaccaacagagagcaaagcugagaggggccucccuccccaacaggcgccucuguagucccuuuuggaacaauggcucagccuugcccaccagcuccaggaugcuuaccagauaauaacucggagcucugguacuguaaucaaguuuucauagaucuguggcuugcccauucacacuggucugggucaccauggucacugugcacacuccgagagcacagccaaggucagucagcaguaucucaauccca

SEQ ID NO: 9299 - RNA, 10928 nt, Mus musculus
guacaaagucaccaaccagauuuauaccaaguuuugcaaaaaucuacagccuggacugacaguagguggggaauccaggugccugcguccacaggcccacccaaggcacccugacaguguagagagagggcaggcugcucacugugcuggauucugggauugauccauccacuccccaagcaggagucugauugguucggcucugcagucaaggauacagccgcaggagagccuuuaaaggucuuuaagcacacgagucucuugugagcuggauccguguucuaacgguucuccaagguagcaacccauuccuggaacaccgccugcuugccugaacuuugcaacaacugcuacccccgcccucuuuagucuguuuuauucuggguuauucuuuuccucuuuaguguucacuuguaucuugggaaugcaaugagcacuugcugacaagcagguuaaugaccauggcgacgcccaaacaucuggaagaaaaucaaaaaaaaaaaaaaaacuuuagucaaucaucuauguuagcuguccauaggaugccaaagaucuggugauuuagcauauccacaugguugauuggcuuucuccgguuucauuccggcacagaaccagccuacccgggaaacaccuauuucagaggaaaauauucuaggaagcaaaguguggugguuaggaaguaucuuagacacacuggguuugguuucugauuuaaaggggccaggcacagggguggaagcagugugugucuggacaagcucagccguuggcuacaauggaagaggcuccauccaaaugaccuucagcuguccacuaggccuggcuuccacuagggaaucugccaucugaaagcccuuaauagacaugagcaaucauucgcccacccucccaaucacccauucagaaauaucucucuaagcaccuccuguguacccggccagucaccuaaagcuucaugguacacaaugcaaugugaggggggggggcuccagggagaaaucgucauauuuugagucuggcuaaccuccuauccuuucuguaccucaguuucccuagucauauaagguggggauaaucacuuaacucuuuuauaggcucucacaaggguuaaaugaacacacccacacccacccaccacccgccauaaaucuacuuagaauugcaacuagccaauauuaaggaaucaauacauguacuauucuuauugcaauaguaauaaucaaguaugcauuuuuaguuuuagccuuugucaauaugugucuucggguuucuauguguauagcacugaagcauuuuaaauaagaagguuugaagggucgggucucucggcucacaucugugaucccagcacucaggaggcugaggcaguaguaucuugaaauuaaggccugcuuaggguuacauagagaaaccuugucuaaaaacaaacaauaaaugaaaaagaaaaaagaagagagcaugauuaacgagccagaagggucuuuacgagcagggcuaguaucucgagcacucaugagguucacgguauccugugaaccgagcuaaauucaggaagugagcugacucuuguguuuuucagccaguggagacucucugugacucaggucuuggaccacugaauagacuuagucaagggcuuaccucuuuguccacuuugaaagcccggccugucuccaugugugcauaugugcgugcauguuugcacacucaugugcacagccaugccgucuuccuggaugagcuggcuguuguucgaggacuuggagguuggcauuuuccuggcuccguggcauuuucccaaguugugcucuuuugcauuuguaauuuuuuuaaaagagauaaaugagacggcggugggcaaguaagucuucaggugauaguuuugaaggguuuuucugguuuuuaaaugccauagcggggagcgagaagggaggcaaccaggaagagugggggaagaaaggcaagaaaacgagauuaaggaugaaagagaggagcaagagaauagcugaacucaaaccauacccaucaagugugguccuugguagcugggugcucuggggaggguggggauccuguaaccacuacaguuagcaccaccacugagggaaaaguauuuuaagaaaagaauuuaggaagucaaauuacuucggguuuugucuacuugguacaaugguccaaaguaacuggauagugauauacucugagcccagcaagaacaaggugaaaaccaaaguuguccuaacucaggaugccgugucucuaugggaaaccccgugaaauggagcugagaccugguccugugcuuucccccuuggguucagugaccucugucaguucagugaacccugaaaagccacacucaagugccuaaccaguuacuucucagauaucuuaagaucucuuuuauuuuuaauuauguguguauaagugguugugggugugggugugggugugugcacaggaaugcaggugccccugguggccagagcuguuggguucccuagugcuggacuuacaagcuguugugagcuaccagacauauccaucagucaaauuagcuguuaaagggccauguauauauuuuuaauuauaaagguaacuuggggggggaguauggggggcaggaauugagccuagggcuuuguauaagcuagguaguuacuuaacacugaguuauaucccaagcccuaggaaaaauuuaaaauagguuaaguugaaauugugggggcuaagucacccucagaguguuuucaauucucugcaaaccuacaugagguugccaucuucccuuuuuccucgucauuagaauagagccagcuguugccuuuaucaacccccagucccugcacugucuaaacagacugggagagggagccccaucccaccucacagccagaggagugguacccaacugcaguuuuuauacuucuuuuccuuaaaacaccuugugauuuuauaugcauuggcauacuugcauacuuguuuacauuuggccgaucucauggcuguuuuacccagcaagcauuugaagucaucuccaucaccaucaccagcaucaucacuaucaucacauuccuagcuaaccaguccuugcuacaguaaggcaguguaaauaagauaauguauuaauugauguaagccuguugaacaacaacacaacgcuuugcagcaguguuuguagauguaguaacugucggaguauagagaagugaaauaacuugcccagagucacagacuagguugcagaucuagguuuugaacccacagaggaguggcacugaagcccaugugcuuauuauccaugugcuuauuacaucacgguucuuaucuacucugcaucagagacaacgaaaccagagugaucuauucuccgucuugggcccugcugcaaucuuuacuuaagcuuagagcauggacccggugcccugguggaaggaaggucacaacuauaauuguaaucuuuuuuuucugugacacuugucuucuacugggccacaucaucuggaaaugguggagaaaagaugccuugggagcaccacagaauggaaagggaggaccauggagaggaacagggacucugggagcucaaggucauggugguguguccacugggaugggagcuuuaugggagucuauccucccauccccagcugggauguacacuucacauagcgauaguguuuggccuucacucccuggauuaagcagauguagggaggguaagaccaagaccugaaccaguaugguuuagucagaacucucuggaccaagaguagacauguacacuuuaucaucaagaggauaguuguccugcaucucuagaauuuucucucuggaaagaaacaguacaaacgacaaggcuagaggaaggucaaaaaaaaaaaaaaaaaaaaaaaaaagcaggauugucgcucucacccauaacuauaaggaggaagccauuaaagcaauuacugaaucacacgaccaccauccagauccagcaucaucacucagcccacgucaccaaggagacaccaucagcaucaucucaccaaggagacacccauuaaccuaaucucugagacauacacuaugaauaaagaguugcagauaugaucaaugaacacaauaauucaaagcagaaacagacacugucacccaacaauagucaaauuccuccaacccagucuuacaggaagagcagucgccucaacacaauaccacaaagcaaaacaaaccucaggccaguugcugggaugcauccacacaaugucacacaugcuaacccacaaugcaauuccagcucuccauccuacaggguaucugcacacaaaggcaggggugagcuggcccuuggagcagugauaaauagugguaagacauacaaagguagggucagcauugaaacucccaacccucagcacacccugcagaauacagucagagauacaguguccccagcucaguacagcugccaggacggagcaccgccuccuguccagcagguggacauaucuagaccaucacuucugauaaggccucaaggcucugguugcuacuaaaagaguaaacuguccccagagccugcuucccgagacaggacaaaucagcuccauccuggcugggauuuaauaagaccucgcuguuaugggaaaugacagagcugcagggacggagaggacagguggggguugggggagcucuucaagcugggugcaggaauuccccucugacuccugccucuauggcuguuuggagcugaagcccucucuugcuggguguucacugaguaucgauucagucugcaagcaauuuuaauauuucuucagggacuuuccagcaacagcacaagucauuaauucacccucccaaauugcuuauucaauagcaggaacauggcuccugaauaaagucccagaauuuaugugacuugcacgagucaggaggucaaacaacuguuauggagcgaaguuaaaaauccaaauaaaauauugacacuuuuuuggggaggggaagagaggaggccaagguauuuaaaauagguuuuuguugcaaugccuccaggauaaagaauggaaggggacugaagacaaguuggaguuuauaaaaucaauggaauuuauugcacaucuacuuggcauuuaauaauucucucauuuccacaucccccacccccauaccauucuggccgcagacagggagauacacagguauacaaaugcacauuuaugcacaucaauacugcccgcacggacugauaugaaaacaggauugugaugugcgagacucaggcauccagaauagggaacaucaauggguuucgcuguagcugaguguguuuaacagaagcaggcauaacuuggcagauauucauuaagccacuuuugauaaguauauucacuguuauaaaucucggaucaaugcauuagauaugaauauaaagaugugcucaucaacagaaauaguuucgaaaauguagaugccgcgaaacaucuauaugcaggaucaucaugggacuguguacacgauuugcaaacuaugguuuguuuguaacauggacacgaugcuuauuaaauaagugaugguccaugcaugggagaggaaagcauguuucagaucacagccacaugcaaccccugcuagccaccuacagauguucgcucgguuguccaaaucauguaugugggaagacgaagaaaaucguuccugcucaaauagcuaauagacacaaagcauuauuaauauaggaguuuccagaggagaucauauuacacagcccucagauauugaagucacaggcuugggaccaaagcaaucugauauuaagaaugugaccuugggugagcugcuuagccgagcuguugacucuaagguagaauagagaacacaccuauuugauagagccgugguuaggauuugagugagaaagugcguuguguaccguguuucuuuuauagugaauucaaaauauaugauaggggccuguaaggugguuagguggguggagguaccuggcugaugaccugcguucaacccccaaacccuagucaaaaaaagagacacugguguaaagagauaacugacucugguagcugcucccucugacuuccacacuagcauuccacacaggaauaaauaaaaguaaagacuuuaaaacaaaugagagguaugacuuuagcugcuauucuauguagcucuucuagugaggucuagacuuggaucuugacuuguuuuugguaagacuaacuuuuucuaacaaguggcuaguggaguagacucuaacgugggacauccauguuuaaauucuggcucuguuagagugugacuuaggcaaguuagcuaauauuuccgaucucuaguuuccagauuaaaggguagggauaguaauauucguagguaccuacagguacuucacaggugcacaaagacuaauuuuuuaaauuauuauuauuuuuaagacaagauuucucuacauaguucuggcuguccuagaguucacuagguagacugggcuggccuugaacuuacagagauucgccugcgucugccuccugagugcagagauuaaaggcacauaccacaauacucugcaagaguuacauuuuaaacuccacauaaaguacuucugacaaugccugguacauacagagcauauguuagcccaccguagcccauaagcuucuucuguuccaauaauauuaauaaugugauaguuauuaaguucuuacauuauagcuggucuugcuuguugcuagaugguaagaaaaagaauuugugacauuugucuuugcugaacugagucucugggaggauucagcauaaacuggguaaggcacgaaagaguucaggucugugcugggcccugaggggacaaggggaacagacaaagguugacuggaaagcuaugggggcaggaggcaggugggaaagauuuugaaagcuagcugagaaacucagacucuauccauaacaggaagaagggguagguuuagcuacauccuauucuuucaagacagauauggauggauuuuuuuuuuuuuuuugaaucugugagugacaagagcuagaggcagagaggcccagguagucaccagaaagcccaaugucccugcaggcuuccuucuucuuacagagggaugucagcaugcuuauggaggagcagggaugauagacacgggcagaggggagacuuacuguacuagugagccuauaacuggaccaauuaccauuacaucaggcagucccugagccaccagccucuuccaggcaggaccauggggugaacagcugguagaccccagcuucagucagaagcccugacagaugagggaagggccagugacaggaggagguagucuggucacgcucuggcuuggcacgcacuacagacugguuuccaaaugguuaguuaagcacauugccccuuaauuuuuaaaccuaugcauaucuugaagugaaaucaauccauaugcuuaccguucaucacagaaaccaccacuauugcccccucgggccagccccguggcccaucuaaccugguaaauugugucuggccugagcucccagggacacacagugggaggguuauuacccacaaugccagucuuagaaggcuggugcagggaaucucauagugucuaggcaacagcuagaggucgaucauccuggaaaguacaagaacucuuuugaaaacuugaaauguuuuuauuuuuaaccuggaguuuagucucuacagagaauaugauaaguuucuggaauuuugguggcugcugguuggagucggauggugggcggugugcccugaaauuugaguaagggccaucuccaugcacuaggaucacuccugagucuccuacccccaacuagcaggugcuucccacacaucuuggcucaucuucucagaguauagaauucagaauguuuaauuuaccaagagcaaggagagacugaggggucugcauuuuagccaacagcccaggggauucugaugcacggagcuccagggccaucauuugagggcacccuucugcgcaauuucuggaagauuugccauucucagagcuuaagcauaacucccagccgaaugugccuacaguccaugcacuggggaagcugaggcaggaagaauaagaauaugagacaagccugagccacacauauauugaguuuaagaugugagccuggggccagguuugguggcacaugccuuuaguaccagcccuugggagguggagguagguggauuucugaguuugaggccagugugaggucuacagaguuaaguuccaggacagcuagggcuacacagggaaacccuguauugaaaaaccaaaaagaaaaacaaaacaaaacaaaaugugagucuggauuauaugagcaccaccacucuuugucucaauauauggauauauauguauacauauacauacauacauauacacauauguauauauauauguauauguauuuauauaugcaaaucuaagagcucuugacaucaugaaagggaagaccuucugcucuaguuggaguggccuguucucagcuauaaagaauggccugacucaccucacugguauccccauuguuuaaacuaaaacccacugaacgagccuggacaauaccucuaaacuauacaaauggcaggagagccuaccaagggagcgugugcauggagugccucaaaguggccacuggggaggccaggggcagaaugucgugagguccuuguguaaagagaaaguagaucucagucucugaucuauaugaaggggcuacucaguuccauuaggcccucuggggugagcacccuaucaggagagguagcagcucccuagaugaucuaugacaucucacuugagaaucugcuaggcaaagucccaggcuggcucaccucagggaugagcuggggauacuugcccaacacgagcacugcucaaagaguggagaugaagcaaucaccugcauuuguuggaaaagcuauccuuugcugaagcaaguauaguuuguuuuuuagaaugauccaacuuauaauagccaggcagcuuaaagucacuggcagagacccuacccucuuauugguuagcuggcucaguggccauacagcuuagcuagucugaaacauuccuacccugcuuuacagauugcaaccuggggauucaguauguucuguaagacucuggaguggagcagucuauacugguuuauacaugaacguagggcacgggugucaauacuugacauuuuacuaguaaggcucuuugagcaaagcaaugauaugaccaggcuugggggcagccugcuguuccuugaggaaacaauuccaaaguuggggggacagccggcuccaagccagugagcaagauuccaugaggacacucuuggagauccagucucuacauauucucagcagguggcuccaacagaugucauuguucccacauucuggugaggaauagugaguuucaggggaaccccuuaaccuuuguuucuaagagcagacuaccaaguacaggauauagaagcuggugagucagugguuucgaaaguuucccgggcagcaguagaccugaguaguugaugguaugggcucuaggauucgucuaguugaauucaaaucucugauuugccacauaugaauaaauggcuuaugaccaucuggaagauggguuccuggggggacggaacaaacaaaauguuugaaguacucagaccguugccucucacacaggaaagauucaguuccuaguguuuuuuaaucacucugaggaagcagcucucuugguaauccugaccaaccuaagcuuuccuacuuccaaggugagcugucugaggucaucucaaugcuaauaggacugcuuucuuguuuccaccugaggggaaguuuuugcacaccauuuauuaccauauaauauaauacaauauaguagcauacauaacauaacauaauaugauggguaggcuaacuuggaaacccugaggcagacuguggauggauggauagaugaauagauacauuuguacuaaguauacauacauuauaucauucuauugauuuguaaaaaguucccggucugccuggcuguaaugagauuuuugaacuuugcguggcgaucaaugagaggaauauuauuggccuagagaauugauauaccugcucucaguggcuuguucugcucccaggccaacccggccccccagguguacgauuccagcagacacuuaaccuuuuuuacagugucaucaggcuaaaaggaaucuaauagugacacaggacuugugcucagcacucugccacuauugcuuuccugucacaaauaauuuauagccuucuauuuccaucccugagcccugcaccccagcccugccucucccuuucccccagcucccaggaaucgauaaacucacagagccauagugggacuucagggugcaaggagacggacagauggacagagagagagagagagagagagagagagagagagagagagagagagagagaaaggggggcagagaaagacagagaugaagagacggagaagacaaacagaggaaacaaugggagaaggaggcagaaggaucaaguaggaucccgaguucccaguggaaggcugaacuaucucuuugccaauuuaaguggcuugcugugauacucacacacaccuuugucugucucacagaggccccugaggcugcucuguucuucccagugggaggaaguggaggucuccugggaauuuaacaaaaagaggaagugaccuuaccacuugcuucaucccccuuugcucuaaagcccucccaacacaccugccaccacccgaaaccucugugauccuuccaaagcaugcagguagaacuugguccaguccccagucugucuucccagaagucuuucugacugcaagcuccgugacccugcugguaugcuucccuccuccccu

SEQ ID NO: 9300 - RNA, 1039 nt, Mus musculus
aggcagacagcuucggccuccacaucguccccgucugaccgcccaccccagagggagggaggaccgaagcgacgcgcugccucucggccaccgucccugucccacccccaccucgagacauccucccccaagccccgcagcccuucucaucacccugucgauggccagacaggacagguggagccgcgggugggacccucaggccccagccccgcccgucgccccuccccgccugccuggaccgcggcgccguccggaagcccgcccgccucuggcccgcgcgccguuucugugacacacaaucagcguggcccacccaggggcagcccacuucggacgcccgggagucgggaggcuucgcuggagaagcugagcaagggaagcuaaggaaaggacuuugugcugaaggaggagccgccggggagacccuaggggggaaauccugccccauccccccugugccugccaagcugaccccgccuucugucugcgccccgccccagacgguggcacugggacgcaagggucggacucgagggacagcguuuggggcgacagcguuuuccaaggcugguacccaaggcgagcagacgccaacugagcucauccaccugaacugccuaguucccuugggccugcgaucuccuucugcagugacucuccucucggccccgccuugcccuuacgucagcgccucuuccaccugcuggccucucacuuuucccuccugugcuuccucggcucaucccacgacaccuuguguuuggucccaagcacgcagccacgucggggccaccgcgggaaccguguccucaggcugcggcugcgagcauugaucuuuucccaucaguaaugcgcugcccacccccacccucccaucccaaacucccaaccugcgggcgcaaaaagccuggaaggaacugacgaccgagccgccccagaugaaaauccgggucuccccgccccauuccccccaagcacccccuccccagccuucccuugggcaggagcugaacagagccucaaaaaaaaaaaaaag

SEQ ID NO: 9301 - RNA, 1039 nt, Mus musculus
cuuuuuuuuuuuuuugaggcucuguucagcuccugcccaagggaaggcuggggagggggugcuuggggggaauggggcggggagacccggauuuucaucuggggcggcucggucgucaguuccuuccaggcuuuuugcgcccgcagguugggaguuugggaugggagggugggggugggcagcgcauuacugaugggaaaagaucaaugcucgcagccgcagccugaggacacgguucccgcgguggccccgacguggcugcgugcuugggaccaaacacaaggugucgugggaugagccgaggaagcacaggagggaaaagugagaggccagcagguggaagaggcgcugacguaagggcaaggcggggccgagaggagagucacugcagaaggagaucgcaggcccaagggaacuaggcaguucagguggaugagcucaguuggcgucugcucgccuuggguaccagccuuggaaaacgcugucgccccaaacgcugucccucgaguccgacccuugcgucccagugccaccgucuggggcggggcgcagacagaaggcggggucagcuuggcaggcacaggggggauggggcaggauuuccccccuagggucuccccggcggcuccuccuucagcacaaaguccuuuccuuagcuucccuugcucagcuucuccagcgaagccucccgacucccgggcguccgaagugggcugccccugggugggccacgcugauugugugucacagaaacggcgcgcgggccagaggcgggcgggcuuccggacggcgccgcgguccaggcaggcggggaggggcgacgggcggggcuggggccugagggucccacccgcggcuccaccuguccugucuggccaucgacagggugaugagaagggcugcggggcuugggggaggaugucucgaggugggggugggacagggacgguggccgagaggcagcgcgucgcuucgguccucccucccucuggggugggcggucagacggggacgauguggaggccgaagcugucugccu

SEQ ID NO: 9302 - RNA, 23666 nt, Mus musculus
aaacaaaggcaauagaaauguuucauucaaacuggaaaaggcucuacaaaagaguccuagcuccagcugucagaggcagcagugaaaucggcacccacggggcaggcacugcaggcuuacagcuucuuuccaugguccagugggaagcagcuuccaucuuugaagcccuaagaguacaggaucagcaccucagaucaauucuucugccuggcucuacaaagcagagcagagaggcucggugccuaccgcaucagccuucggcucuggagcuucagcaaaccuccuguuucacggcagcuucaggggccuggccucuucaucugccuugcucauucccaccugagggucuggcguguuuccaucuggaucccuuucugcagagguucacaggcccaugucuaguucucccaugcacucuguucagacaccuuuucagacugacuaaucaaaacaagcugacgaggcaggcggauuucugaguucgaggccagccuggucuacaaagugaguuccaagacagccagggcuauacagagaagaaacccuaucuggaaaaacaaaaaacaaaaacccaaaacgagcugagucuagcauccuucccuuugcuucguuccuuucaccaaaacgcugguucuuuggaaacagccuuugucuuuccagugcuauacagaaaaccuauggggaaaaaacaaacacaaaccagcauacaggagauuccccaguagcugcucaauuaaaaauuuucaccauggaguccagcccugggcugggaaggguucuguagcucaggacuauauggaagagccccagcagaaggccugcuccaccaggcucauuucagcgagcagcagugcacugcuuucacccugaggacuuggagguaucuggcugggcggggcugggguccuggccuaagcaaaucucaggguucuggugcgcagccccuuuuuugccagaagaggauuuuuuggccacuaguccauugucguccuugaucuucuugagucgggcuuugcucuugggugggauggagaagguaagggaauucuuguugaacuccagugggaagacaccuacgucuccaucaaagcgauucuuggacaccugcagauaccguuucccaggcccagucaccaguuuccuauccuguaagaucagaacauugucugcuucuuggcuugccuaaaggagagggggcaggagaaaaaaaagacaugagugaaaggcugagggugcaggaaggaguggaaagagugggaaaaaugaggggcucaagagauggcccagcaguuaagaguacuggcugcucuuucagaggaccuacguucaauucccagcaccuccaugguagcuuacaaaugucuguaacuccagucccagggaauucaaugcuuucuucuggccuuuguggauaccaauaugcaugguggugcacagacauacaugcagguaaaacacccauacacauuaaauacauuuuauuuuuaaaaaaggaaacaguacccccuugucaccaagcucuuuaaacaucuaaucauaucagaugcuggagcugcugagucucccagcuguaacuaacucgcccgucucagacucugugcuguggcuccugcuuuccaugccucuccucauggugguccgucuuaccugcccaccuuacucucacuauucaugugucacuuccguagggccuccuuugacccccuacggugccuucugcauuacucuaguuccauguuuguuucagaguaauacaguuuuugcaacucagccuccacucugcuugccuagcugagaccuugcauggaaaaagaauugagcagaccgcuggagaccucaggacagggcuggcccuguggcucagaggccuccccauguguuugauaaccugacacuuacugucuggaauguuagcaugacuuugguugggaagucuccccgaggucacaggaugacucacuguccacuccucaagaaccugugcugccuaucucagcucaauccacggagcugcaaccaccagcucucacucucugcugcuagcaaagugaauccuaggccucaaggaaccaacuaccaucccugguaucccucacccauggccccagagcccacgucuuucuucuguucagggcagucaugagccucucaggccgaagaggacuguuucuggcuacaccucucuaacuccucagagccaacucacuuuggcugagccgaaaauggaugcugucugcaguuccuugucgucgucuucuuuccgagggugaaugaccagagucacguggcaacuguugucuguagcaaacuuccgaaaggcuccaacaauguagucuugagcugcaauccugcggcaacgaaguucagccacagaagagguuaucggguggaguauacaaacccuugagcaaggcacuccacacaaacugucccagccauuacacucgcuaccuaaggguuucccacucgagucugcacagcuucaagagaagacaaguguguuucaguuagacaagaagaacucaccugucagaggagagcugcucgugacccaucaugaacugcaaguugucaaugacuacaugacagacgucauagacguagacagcauguugcauugugucuaugacggaccuggggaagagaagcggccauuuaaauagucuucaaguagccucaggacacuccagaggaaagagcuugcauccugaaaacacugaugaagacccgcucuucugaccuccuguucucugaaaaccccaagccugucuaaaaagacuggcugggagucucacugaagcuggaaaaggaaucaaagauaugaugugaucucucaaaaugaaaggcaaggcuaggaauggugacacacaccaguuaaucccagcacucugaagacagaggcagguggagcucugugaacucaagggcagccuggucuacauaaugaaauccaggacagccagagcuaucaagagagaccugucucuaauuaauuaauuaucuccuuaaaaaguaacugggugggcuggugagauggcucaguggguaagagcacccgacugcucuuccgaagguccggaguucaaaucccagcaaccacaugguggcucacaaccaucuguaacaagaucugacgcccucuucuggugugucugaagacagcuacaguguacuuacauauaauaaauaaauaaauuuaaaaaaaaaaaaaaaaaaaaaaaguaacugggcucugagggucuuaccugaugcucuguuguccguggaaagucaugaaguagagaggcagguccucaaaacggucugcccacucuucauacuuguccaguugcucuuccagccgugucacagcaaacugggucagcaugacccgggcuagucucacguugcugaucucaaagcuaccccacaguguguucacucccuggguacacaaguccagggcauacucacugaugaauguugucuugccacugccuguuggcccuauagggggacggacaaagcucugaguuaagaggagagucuggcagcacaugagaggcagaagcaggagcgucucuuaguucaagaccagccucgucuauagaguuccagaacagccagggcuacacagagagacccugucucaaacaaccaaaaacaaaaacagagggcuggagagauggcucagcaguuaagcaugcugacugcuuuuccagagguccugaauucaauucccagcaaccaugcagugacucacacaaccaucuguauugaaaucugaugcucucuucuggugugucugaaaacaguuacagcguaaccauauauauauaauaaauacaucuuuaaaacaagaaacaaacaaaaaaggagaugaaagucuggucuuugaaccaagauuccagucaaaguugagaggggaagccuccuuuuaacacugccagcagggagcuggagagaugaagcgguaauugagagcacuuguugcucuugcagaagaccuggauuugauucccagcgcccacgugguggcucacaaccaucugcaaguccaguuccaagugauauacacacauaagcgaagcauucaugcacauagacacugccaauggccaaaccccacauacuuugucaccaucuugucuaauccuuuaccuaagucacugauauuuuuauaauacuacuuuauggauauggguguuuuagcugcaugugugucuauggauuacagguacgcuugguguccuuagaaggcaucaaauccccccagaacuggagcugcagacaguugugagccacuauaugggugauggaaauauaacuccaaguccucugcaaaagcagccaguacucuuaaucacugagccgucucuccagcuccgaagcagugaucuuauagagucaccuguaaagaccgucaacucgcccuuccgaugucccuucagcagacgauucaggucugggaagcggcuccaacggacaccagccgcuugcucuacauuugacaguucuccuaaaaccuccucucggagcugccgaaaagacacaauagacuugugccaggcagguagggcgguacgaagaauacggggaagacuuaagccuugguuuaaggccuccaggggacgaggcuguugguucccaggccucaccagagagcaucgcuugggguugaguuuucgagcaaacaguuuggcagcuucccaggaucgaaggucaucuccuaaccagaacacaauccgacggaacuguucaagguaaggcaguaaggcuggggguaagcagacugucccucgggguagggaaaggguuggcagccccgucgacuggcucaaggccaggcuguccaguucacgacuugucacaaccaccucaguaucucuccggcugaucagugguaauccaaauagguugugauagacaccaggccgggggaugguggucucuacauacuguacuccauuuuccugacccucagccccuaguagcuucaggccacguaauccugagcucccaggggugaaccaagggaagaccagacuucgagcagaucgaagauagcggacacugaaucgccugagugugucaucugucaccuugguaaggccaaacaucacacgagcuagcugggcuuccucagggucuggaagcucccaaagagguauggcucgguuccagauccucaagaccuccucccuaaccucagcuucugggccuucccuaaguaggacacccucuuuggccccauccccucgucccuccacacuggccugcaagucuucccagcucccuucugcuaggcuggucaugcaaagaaaguguccuguggucuugucaaugaagaggcagaaggaagugggagcguccuuuuucucauuuuugaugucugaggacaccacaaagggacuuggugcucgaaggcagcuguggccauccuggaaggggaucccaugugcacguaaauacuggcggauuucagucguagucaccggcgacacuggcaucucuaaggcugggagcgcuucuuuucuguaccuucugcggggagggccuggcgccaagcuucugggcaggccccuccuacccacccacucgccacgcaguggcagcaagauccggaggggauaugcacgucggagaagaagccacauuccuaauggagugggacgccacuacugcaaaagcuuuuguugucugguucagugccuucacuaaaccagacccuaggaaaccuucuacaaggcacucgcagaaaucacuccuacuggcuuuucucuuuaucccuccucaaacuucuucacgaacacaguucuuacuccccucgguugccuguguauugcuacuucaucccuacacaccuacacugcccuuucgcgucuacgccucucucugaggauucuccuaucucuagguccuuuacggauuucucuccaccagcucacuucuagauccuucuacggucccucgaucuaaacggcuucucuguaucaucucuucacgucuacuaccccucuacggacucuccuggcuaaccucaucucuaccgcuuucugcaucccgucugaaccccaacuccaggcgcuccgagcccccagcgcucacaggcacucuccacacugcuggaggucacgcgcuccggcccggcuuccucacuggcucccuugcucugcccuccacuucaaagcuccacgcucccgcccccagcuucgcgucaccacucuccuuucuaguguucuguccgcaacgugggucgcccgcucgcacgcgcuacucgcggugacuccggaagcaaaacucuccagggcgcccaugccacaaccccggaaccggaagucaccgguuagucccgccccccggcuccgcguccuggcucucuaaccguagccaugaccggucgcgggacuucgagccgcuuucugaccagcguccuccauaaugggcuagggcguuacgugcagcagcugcagcgccucagccucagccucagccgggaugcgcccucgucccgcggcgccaggugaggcacgcggaagcgggagcgccggaaagggaggcggggagcuauggggcuggguucgggccaccguacucaccuucgccgggucucgcagggaguucguggaacgcgaggugaccgacuucgcccgacggaacccaggagucguaguauacgugaacccgcgcccgugcgccaugccacgaauaguggccgaauaccgugaguggggccgagcuagggcgggggugggcggcgcgggaucccggcuugcccgcugcguucuguuugucugauuuccgaccuggcgccuuccacucauccccuccacgucccucucccaguuaauggggcugugcgcgaggaaaacgucaacagcaagucgguggaggagaucaagucguuggugcagaagcuggcagaccaguccggcuuggaugugauccgcauccgcaagcccuuccacacggacaacccgagcauccagggccaguggcaccccuucaccaacaaacggacugcccuccacgggcugcggcccagagaacuccgggauucugcuccagcuucgaugcaagcacaguaaagaaccaggcgcuuuggaccgugagagggauaggauugguuccucuuuuggauuucaagcucaggccgaguagguggguggagccuaccagccggggcguggccugagauaaagaagaaccuuuuccuuugcccacuuguagcuaggugcagugaccuugugaauacccuaauucugauucaauuggccuccuugcaagcugagaugugagaaguguacaacacuuguacaaggaccguguuuucugaaauacgaauaauaaugacuucaaaacacaugaaagagucuggaggcugucuucugaaggacacgggaugcccuguugcucuugcugguauggcauugggcaaggcaccuuauauccguguuugugugcaguuuaggaaguugaagaugagccuggcguugguagugcauaaccuuuaaucccagcauuugguuggcagaggcagaugaaucucugcguuuaaggccagcuuggucuacagagugaguuccaggacaacccagucucaaaaacuaaaaaugaaauaaaaaagaaaaagaaaacugaagucauuaagacuauauuugaaggggcuggugagauggcucagcagguaagagcacccgacugcucuuccaaagguccuuaguucaagucccggcaaccacaugguggcucacaaccaucuguaagaagaucugauucccucuucuggugugucugaagacagcugcaguguacuuacauauaauaaauaaaucuuuaaaaaaaaaagcaguguuuaaaaaaaaaagacuauauuugaagauugauuaucuaucauguguauaaauacaugccugcauguauuucugugcacggugcgcaugcaguguccauggaggccagaagacaguguaggguccccuggaacuggaguuacaggcaguugugagccaccauguuggugcugggaauugcacuugugucuuuuaaaagaacagucagucuuuuauccaccugagccaucucucuagccucucaaagucacaauucaaaaauuuguacuuuuucucaagauguagaucucacuauguagcucugguuguccaggaucacuauguagaccaggcuggcuucaaacucacagagaccugucugccucugcuucccaagugcugggacuaacggugugcgccacugugcucggcucacgguguaggcguaguuucagcauaagccagucuuuuaacuccaaacuagaagcagaacauaaaaccuuucaaugguuagugucaaaggcagugugacucagcaucucagagcagguccccucacagaacggagccaugucucucccuggauggaggagugggacgugcugaaaagcuuggggaggagcacagccagcaggaagcggcuuccagacuuacgguaaucaaggcaagggcugcaagguggcucagggguuaaaaccacuugcugcucuucuggaggccugggguucaaugcucagcaaccacacagcaaucagugaccgucuguuaugguucuggggaccuggaugguuccaggguucaugguguuuaaggguaucaggcaguggggagucagagagggaagggaaaggccuucauguggugguacagcuuuuaaucaccaacacuugaaaggcagaggcagccagauagaugaguucaaggccaaccuagucuacauagaggguucuaagccagugaggacuacacaguaagaccaugucuuuuuaaaaaaaaaaaaaaaaaaaaggcagagcuggguagauggcucaggauauaaaggcagagcuggguagauggcucgauauauaaaggcaaucccuggccacuugaguuuggucccccuagaucucacauagugagagaagcagcaaacagguucucuggccuuguccucugaccugcacauaugcacccuggcauggucaagcauaugugcacacacacaacaaggagcuguuauugugcaucaguaguugcacagaucuaggagcuggcaacagcucaaauaacagugagauucccugucugcaaagauacaggaggggggccaggagcaaacgcugggaauccuugugacuucuugagccgcucugauuuugucccccuuaacaucaucaucagggaguaaaaugagccccuaacucauggucccuguaccugcccgacucagcaaaggcagaagcagaucucauucccaaagcuaccccuagaugaagaaaucucuggagcaccuucuccauaagccagaaaucuguuucugguaaagccagucuagaccaagcagacacucaaagcuguggggaaagagggcauuuauuagccaaugucaggaggagcagagcccaggcuccccauuccaucacaugccuguuccacccaccugggugaugagugggggcauuccugaagaaguacagccauucucacaauaaauacauucauugugggguggaggugggagagguaugggugaaggacaguaaaaacucgugggguuccacguucucagcuacaaaaauaacagucauccucacccaagaggaauggggggcucagucaggguugauugucccaugugggccuggagacaucugaggcccuuggaccuugaaagugcccuggugagguaggacagggaugggagccaagcauccacacgcccagccucugcccuuugcauaguuccaggagugggcuucaugugccaggugagauagcagaucacuuccuccugcucuggccuaggagaagcaaucacuuggucccuaagagggaagcuggcucauugagugcaguguuggccacuuguccuaguucagugaggaccgauaaaugggaagggaaaucuuccuuugaaauauccauggaccaaaccuaguagacacaggucugacggaggcagcaagggggaaguucagaauguacauguggguggaaauguaagcacuugaucugggaaaggccaugccuggagcccuggcagccuuacaugugaaugagaggaggagggaggcugacuccagggcugcggaggaaggagagcacugaugcuucuccucccagucuccugccaggggguuaccacacggggcuggggcuggaaagagauagcaagguggcaauugagagggugcccugaaucuaggauaggugagacaagggugccccaggaggaagagugggacacugcagcccagcugauaaacauucuuccaugugcacaugugaauggaagcaggacucagguggcugguagagagaggucuugucugaauucaggacuacucagcacacagcugugcagaggguggugacauugaggccaucuggaccugcagagcccuaccugagaagaagaggaagguugggcagauaacgggauaagaagacaauucucuccucccaagucuuuaggucaagggauagaaacugggccuggguuugccgaguacuugguucugggggagcaccuaccuuugaggagcaccggugggccugggcugcucacaugugucuuggagacugaagaggggacuuuggcuaaccaugacuuuggccagcccuacagagacaucaaaaaguuggaaggaaauggaauugggaggauggaggaggguggagguguuggggaggcaguggcccagccuagggcagccaggcuggcuuggaagagcauuuguuuggcggggcuagacucagacagagcucucgucuaguugcucuacaagcugugugugcuuccucuucuccaggaugcggcugagcuccucugcaaaggagcaggguccugcuggcacuccauuguugcucugccucaggagcacauaacuguugccauucauccuucgcagccggcugggcagugccaccagcccauuggucagcucagcggguggggguggggguggugggggugguggggcuggggcuccuuccccgggaaugaucuggaggcagccacucuccagacccccaguuccuucuccaucaucaccuucaucuuccucuccaggacacuggccugagacagucugcagcugcacggccgagcccccugcccggccagcccgacccaaugaguauuuucgucuucgaccucgucugccucccuucagacaagccacauagaggagggaagaugccaagaugaggcagaggccaccaaguauagcaauggcuaccacauagaacauccucaugucaugugccagcugugccccagguguggcaggggcuuguggagcuggagcagggguggcuggccggacugugaggcuguaggacgccagcagcauacggaggccauucuccucggcauagcagccauaguugccacugugcuccaguugugugucaguuaccagcagcccauccacucccacgcgguagccauccugcccaucgcucaggcucuugcucccauugaguagccacaaagcccgggccagguuagacggcuggucacagggcaggaggacaucaucaccccggagcacagaucgggucuugaguggugguggugguccuggggaagaaggaucaauaccugccgaucccagacagcauuggaagauagacuguagacagcugucuagaggcacagaguccagaaugggggacaccugagcaagccuguguacgcaugccucccgggaugcccauuggcccauccuucauggggaguaagcagugucuugggcccuucuuuccuccucuggcagcuccucugcccugugcuuucaguuccuaccauuuaccgcaggccuccagaucuuaccuucagcacagcuucucuuucccgaacaccagacuugacuguuuaccaugugcugggcaucucauaaggccaacgucacccacaccagguccuuucuuugcaucgcuaccgccagcugcucuguaguuugcaucaggaaccugggaggcucccucgcaucucucccucgucucuaugucuacccucaugagacucucagaccuauuccuuucucuccuuccauggcggcaugcccucuagggcccuuguuuaaucucuugcaacuaaaggugaucccucgaaaacccaaaucuagacugagcagagagggcagcgagugugggggcuagcugcuaagcuugacugcugauuucagucccugggaaggagaaaaccgacuccuguaagcugucuuacacaugcgcauccacaucauacaugccugugagcaaaauaaauacaguuuuaaaauucugagggacaagagcuagagagcuggcucagugguuaagagcaguuguugcccuggcagaggaccugaguuuggcucccagcauuuauggggugguucacaagcauccaauuccagggacuacaacacucucacuuccacggacacgacgcaugcacguggugcacauacauucauggaggcaaaaugcacucauaauauauauauauuuuaaauauagggcggggaguccuuuaaucucagcacuugagaggcagagguacgcagaccucuggguucaaggucagccuggucuacaguacuaguuaggggacagccagagcuacacagagaaacccuaaaaaaaucugaucauacugcuuguugguguaaaacucucaagagguuuccuguaaggaccaacacugugaacauggucccugcucaccuugccagccucuuccuccuacgcucgcugacccccggcuuggugccagugcccuccucaugcccucccccugccugaugagcucggacauggcacuccuuagugaucaaaagcacaaacuugcaucugacugcuugaggccaggcugcuucugcaccugccauguaguagcugaguaaccaugaacaguuuccucacauggcccaugccucagaggggcugucccucagggggaugcuaauggugccgcucacacggaguguugugaaaauaaaugcacgcagcaggauuuagaccagugcugucaccugagugcucaguccaugucagcucugacagcugacuccucuuccuucagauaucagcucugcuacguggugauuuuguuugagagaaacacauuaaccuucugcaucuuguuguaguugcaacuauuaauaaucauaguuauuugugcuuauaccuccccacuuagacauauacuuuagaugugaucauauaaacauaacuaacucauuaguuccccuguccccccaccccguguauguguguguguguguguguguauguguguguguguguguuauggcgcuagagagcaaacccagggccuuuacacaguaagucaaggagaguuaucuaccaaugagccacacccccaccugucuccaagucuugagccuauuuccucauuuauacuuggggaauaaauaucugcccagcacucacucacucaccagaaccacucaagcacaccaagucagaaacaucgacccaaguccaugaguuccacuuaccugcaucccugcugcccucacagccucgauuuccucucucuauguccuguaucaauucuguccugcagaaagaaaaucaagagucaugaacacugggaaaugggcaucaggcucaccaacaauaccuuagaggcuggugggcuuucuuccuccacuuaaggcacaucuaccccaucccuauguccaaccucuacccugggaccuguuggcuacggugguggccaccaugcaggcauggaugcuggagucccagccacaguaggggucccgugccaggaugcagucauagcaggacugguagcgugagcagcuggacagaggaaacuggaggacuccacuugcagcccccacguagaggcugugcuggauucagagaggacagucagucagcaaccccugucucugcccagccuccccagucucuuuuccuguuagcauagugaggccagacuaccugcauuggugagauaacuagauuguccacagacuggggcucccugaacacuuguaucucuucaauuaugugcaucccagagcccaggacuacggccuuguggauccagccaucagcugaugugaaaagggcagaagucagaauccaacagugugauaugcucucaguacccaacaggaggccuaauggggacagcucaggaaucacaagguuagagacaaggaaucagccaccagcaguggucccucgggacaugggguacuccaagcuaauguggcaggaacaucaguaaccaaggccauuuagggaucagggauuugagucagaagcaccugugcccagaaagagcaggucauagguggguccagcaggugugcugacguguguuccugugagauguguguagcguacauugcgcuucagcagcaagggccgcccacgugugggcaccacaggccgagccaucaggggaugcaacuucacaaaguccagaaccagggauggcaagucuugggaugaguuguagccucggcugcgcaaugaaucugugaugcacuggguugggggauggguggugagacucaggacuccaccaccugccucccucguauaaggcugaaccccaccccgccccugagcuuuguccacuuaacguaggguccaggccugagugcucaccgagccaggccgggguucaggcaccccacccucauagcggccccagcgccgggcaccauccugguacuccauaaaagggccugugaagacagccugaaucucagccaggucauagcggcagauggcugaagccuccagcgucuuccuaagaaugagacauaguggaugauugaguggagccugccccagcccugugcuccaucuggaaccacuuuaccacgguccagcuccacuguaggccuauggacccaucuugugcaucaguggaccacaauguccucuggcccuaggcuagcuugacaugccugccugaccucauuuugcagccugccugcccucuccccagcucaucagugacgucaguuccuuuccuuucccaccaccucugugcucaccacuguugugcuuaccacuguguugucagugugaagacggcauagaaaugugugugggaugauguaucagcauucaggcugcagaccccacguagugucucauacugugggauguggcagaugagacgagccuucaggaaggauguccacuucuucuguaggaucuucuucccucccagaucucccuggagagguagggacacaggaucaggaucagaggucuagccuuuccccauacccugacugcaucauaugcaccuugcacacacgggcuacucuagccacacgguggcugcugcgacucugugugaagcugcuggagccuuccucacgcuccaugaagaagaaauaaaucuugucaucaucacccacugcgcuugucuugcucucccgcaccagcacagagaacacaaacucagcaucuguggggugaguauuuauuuggguggcuuaugaaacaggucaagcucucucccacacucucgacuucaagccacgcccccuagccacccacucccuccuucccucagcagccuucuuccauaauacacagguguggaauggacaggcucaccugcagacuuggaaaugggaugguuggcugcccaaacaaacaguaagaaauggacuccucccucccccccaaccccuugucauccugcaccucacucucuccuaaccauugagccagugcaugggugccuccucaguucucagagaguguggguggcggcuccggcggauaucaggaaugcuccggaauucauaccggguggcuguguagaggccuccaucuggggcagggacauccaggcaugagauauauggcaugugcaaucgggaacauggcaugcacaaacguuaaguccuuagcaacaggauccacauucagaucauagaauccugggacugagggcuggcugcaggcgugucugcucaccaaugauaaggccugugaagccccgggccgggucauaaggacauuucuccuuucccuccucgaaacuaguaggcaagaugaagguuucagcauccuggagaagaagggucccaaucggucaaugguccugaggacaggcaagggcugcagcucaaggucaggccagucugggguuagaagucagggcaaggggcaggcguacucacaauagcugcacagaggggcuggaaggcgugggucccacaugcauagaaguggguggcauugagccgcuguagaaaucgcacgugguugaaacacucggucuacagacagagggaggcagugauagaacucaucaacccagagacaagccaccuccauuagucuagcuuaucagauauacuuuccaagaugccgcugauuaccugacaccacucuuccagugacuccugugucugucuccugcuauccccuccaccuaacuuucaggcaccaucagagcucaaagauagaggagcauuucaggagaaugggggcuugacaugagcucaaaagugacuucugaggggcuggagagauggcucagcaguuaacauuguucuuccagaggacccaggcucaauucccagcacccacauggcagcucacaacugucuguaacucuaugauaugacauccucaaacacacacacacacaccacacacacacaccacacacacacaccacacauacacacacacacacacacacacacacacacacacacacacacacacacguagggcaaacaugagugaacaucgggaaaaaaguuacuucugagcaauguccccccccccccccaacccuggagcucccacaauccucucuguuaucucacaagcaacaucaaucucacguuauccuaaaggaagcuccauuuccccuggcccacaucaucccucuuaaaccuguuuauccagucuuucccuccuccagcuccacccaccccaccuugcucugguucaggagcaucuuggcugcagcccacucucucauccccacauucggucccgcuccaugagucacugggccaaguggugcuugaacuagaccacuauucucauccgguccagacaaccauuaccucuuccuuuggccuagcagucacccaacaugcuccuaaccuaugcuacucuucauaacaaccauuuacucugugagugaaagguauucacaguguaaaauucagacaaggggaucuguugucaacagccugucauguauuccugucucccagguggccugagaaggggaucguagauaccaugugcaaaguuucccuccagagaugguccaucugucagugcccucuugugcccguccaacccacucuccaaagcagccacagauguaauuuuuaauuuguauuuuuuuagaauuauuuauuuauuuguuauauguaaguacacuguagcugucugcagacacuccagaagagggugucagaucucauuacagaugguugugagccaccauguggcugcugggauuugaacucaggaucucuggaagagcagucagugcucuuaacugcugagccaucucuccagccccagcagcacagauguaaaaacagaccauggcauggccgcugcucaccaaugcucugaacacacuggaccacacagggcaacacaggcccacaugccccugucuucccuguccgcucacuccaucuacuccagccacacuggccuccucugucccucaggugcccuaggcugcuguccagcuuucucugcucauccucuugucuguuacccagagcuggaguccauggaagacuucucuccacuuauacgccgucaccugcugucacccaugucuguuccuuuuaucagccugcucaggccuuuuccucagcccuaggaugcccccauuccaccauucuuccugccucuagacucaucuauuuuaauucaucuggcaugcagggugaauguggggcgagacagacauuccuugaguagcucccugagacagaaaaaaaggcaguuugggaagaauucuguagucaacgagccugagaagcagucacaucugucuuuacugggugacuucucagagccuuaaggaugucacugugugggaugggaaugucaacccuuuccaaacaaauuagagcacuucagucccucuuuugaaaaugaguauccuucaggacaaugcuuugggaaauguucucugauaccuugcugcuuaaagaggucugggaaccagagauagcagcuuuaguuggcuuucaagggcagcaagcaacuuagggccuuuucagaccaacugaugcgcaaccugugauucacaugagggccucuaaggcaucaaacaguaugaguaucauugucacaauaaagucuaaacccuccacugggcauuuaugagaccuugugaccuggguucaccugucccacuagcucuguuuauuacccacaaugcacugagggagucucuccuagaaaauuuuagagggacauaccacagacuuguugaaucagaauuucuacauugguggaacuugggauguauacugcuuuuaguuugagacaaaaaucugauauagcccaggcuagccucaaacuuguuugaggacaaggcuuucuuugaacuucuaauccucuugccucuaacucccaacugcuggggucauaggcacaugccaccaucauguccagugugaauguguacuuuuuguuucauacacacacacacacacacaccccauacauauacauauacauaugcauauacauaugcauaugcauauauuuauccucaagggcuggaauuacagacauaugcuacuauaacuagcuuagaauauguauuuuuuuuuguuuuauaucuauuuauuuugugugucuaugugugugccuaugcugagccaugccauucuuuccaaaguguagucuuaaaaaucucuccaagccaggagcgguguuacacaccuuuaauucagcacucagaaggcacaggccggcaaaucgcuugugaguuggaggccagccuggucuacagagugaguuguaggccagccaaggauauacaguaagacucugucccaaaaacuccaaaguaaauaaguaaguacaaaaaaaccuaaaaagcucucuaaaugguuguuaccuaaccagacaugauccccacccccaacccagacacucugccuuuuaguuagaaaggacuaauauuugacuaaugucuuuccaugaacaccagguagacuagggguccggcaaagucucauuuuuccuagcuguaaaauggguauaacaaugcgucaucagauuauuuuagaacuaggucuaguugucgcuuauuagcaguuacuuaguguuaugauuauacuuugagaucucccgggaaagggauuaaguuucugugacaggccaagcuaucgaccacagauaguuggaguccaaggguuacccuaaggccagccacucauacuacucauugcaguugugcacuugaaugcacaucugucccacuccgucugugucccuccaacucugucaccccugguugaggaggaagaaaggagagcuggggacagggagaucacauaccugguuguuuuucccuuucugaugacacuugcuuugcaucucuggggaggccucccaguggaucuagugagaggaaagggacagacugcuauguugaccucaauaucuacuacccagagaaucaaacagugcugcuccagaguacuggggaaaacugaagugagguggauuucagaaugagcccugggauggaaaggacagugcuguccagaggucgggaaggcugggggcgggucaccagguaauugaggucccaggaagcuggagacccuguggucagaccaaaugccaggggcugaccucuuugugaguccuaucucuuaugucacgggcacugagagagaacagggcgccucgagcccccaccagcagccucucagaagccuccuccagcagcaguguugaauaguucuggguuuggcccuugaagugccgaaucugggagagcucuagaaacgagaggggcagugagccaccuggggacuacuuccuguccccagcucuggcagccauaguguuucaagguugggggagggguccuaaccuucauaggagauggucagccgugggguggcaucuagcucucgggauggucuccgcagugaggguccaggcacugcuguuacugugagaaagcugaagaggaggggccagagccucccccacaucuuccugcggaaguucagaccaacaagaccccgagggcagcccaggagagucacaggaggggaggggaagagcagucacuggguucaaaguccagggugugaucucaugggggucaggggucaugaggucaugggggucaaguagucauggggccauggaggaucauggaaugggggggacauggagccacaggguuguguggccauggaaucacagguaagaagucagagggaagggcgggucaccacgugccuuucuguaucaaaugcaaauuccauggagagugagcaguguagggucccaggaggacuguaggguucugaaggggucaccuugcccccagucucagggcaaguuccaggucucugucuguucucugaaggaggaaaaaaaaaaaaaaaaccaccaaaacaauaaauaaauauauaaucccuccaaaauggaaaaccuuugauuugugugugaauuaagagggacgauaccacccacacuucaggcggcccugaaagccagaggccggacauccacagaacucccacaccaggaaagacucacggcauccugcccagcucugcucggggcagaggcuguggcaaacucgcugucuucauaagacccuagacuacuguuaaccuaugccaugguaacagcucucuuccagucaggagacugcuugggcccauguugcuggagaggcccgauccuccaacaaugcugccugcugcgggggugccuucugcgggaaggccugggcagucaguuaaugggucuuuguugauuuuguucuguuuccccuuuguuuuuucuuucccucggccuaagagcucccucuggaauuucucuuuaauuagacacuucucucuggcauuuuucucuaagggguacacaucucugccuugcccgugcgaguccauacugcacccucuggcuggguaucuacacgaguccccgccugcuagaccuaccuccuggcagggagcaaaggcuugaggggcuggggggguggggaggugcagggaguugggucccugagcugcacaaguguaauuucugcugugcaggagacugcggugugaaagaccaguuaagacuuaaacaauauggagacagugaccuacgggauccugacacuugcagccaccuuucgugacacaccuuaaagacuagaaccgcgccugagguggaggccauugauaggccagggaacuuccggagauuuccuuggcugggccagauguggaggcugccugaucuacccaaugucaucagacagccauaggcagggucagagggugucacuggccucuccuuuuccuucugggucaaauauuaaccauccggcuguaaagagaggggagggaccuggagcuagucagaggaauagcaagaauuuggaggguuuguucaagagguaaagguuagcacugucacacgagggagagcgagagggucucugagccacagaaagggcaucaaguucuuguuuugagggcuagggcagcuggagguuucaggcugcccaagccguacccuccaugugaaagcacaccuguuuacacuggggggccuccuguuuccucagcacugaagggugaguccucccacuagggaaguguguccaggcggagacaggaggaagacauccuaggucagaggaaccgcucagugcggaguaaggggcauucgugggucucaaagacggugacacacuuguacacaguguagggccaagaacacaggcauuuauaggagucaugugcaugcacacacacauauacagagagaaagagacagagacagagucagagacagagagagagcgcacaaagggccaaggccacauaagguuguuuaccugucauccauccaguggaucauauauccucagaggugaacaagcagggcuagauauucaauaggacggucuuguucacacacauuuguaaagggggcauucacacagaauuguugcuauugggccaggcauagugcacacauguauucugaguccucaaacacaguuacauucgggcagagacaaguaaguacucaugacaugcauaaaggggucugacuugggcugcaggcuugguggcugacagugucugcuggggucagaugcacggcugaauccugucuccuuuccugaaaguccugcucucucucucucucucucucucucucucccucugccaccccaagggguguguguguguguguguguguguggugugugugugucuucugaccuggagugaaugccuguaauggagaauggcuaacccagggagguggaggaggaggaggagaggagauccucgaguuuagcaaauggaaggugaaaugcuaucuuagcagcccucuuccugccccgcuccacacgccccccuccccaucucccccagauugcauuucuagaucuggagaacugggcuaaagcguccagcuccauuuaaccuguugggagggccgaguuaauggccaggggguggagcaugccaccccuccccccaguacuaagcggguucaaggucuccaguucacaccccagacuucacuccaaguuuggguuccuucccaggguuugcccgcugaacucugaucaucuucuguuagauccuaggguggagaaaacuggggaggggaggaccccucccacaggaucaauaggcuuucaaccuucaucccugauguccgucugccugggguuagcgguauuugccucuguccacuaagauggagaucucuucagauuugagggugccucucccuugucuuccccacccuccaccauccuggacaguucgagguuuucuccuuugaacagaucuaaccucaguaucuacugcugcggcucgaggacaagcucuccuucgaucccgccggacgccaggagacaugacccagauccuggggaacacuguucuccacgcgggucccgggcacgcugggcgcccccgacuccgagaaggccggucugcgcccugcgcgacccgaggccuggcccgcgccccucuaaacccuuuuaugcgggauugggggucucggcggugaaaaaggccuggcuuagcuuggaggguggaauggaugcggacaaggcuuugcccggccgcagccccccgcaccgccaccgcccgcacuccccgccucccucaccuuugcgcugggauccggguccauagagacagcgacgugcggcucgcggccccacagcaccagcugcaggaggaaggggcugcggccggagcgaggcgggguggaggcggagccggggguggggcgggggccggaggcgggccagaggcgggggcggggaagggugcccgcccuccuuugcgacccccaccacgcacaauagacccgauuugugggagaugcucgaggcccacggcuccuggcguccccuuucuucca

SEQ ID NO: 9303 - RNA, 8886 nt, Mus musculus
caagaaccagacaggauugcaguuuauugacaccaugacgugacagcuguugucacuggaagaggagguuaguuuaaguggucuccguggaugucacuggggaccccauucaccuuuuagcuagaggucauggauuuggcguggagauauaauucuaugcccuggagucaguaucacccacaccauucccgaacucaucuucuauuugguccagcuauuagagccugggucccucuuccuuuugaaauuaagggcagagggagugcagugccaugucuuaagaaagagacgggcugcuggcaaugguggcacaugccuuuuaaucccagcacucacugccauaggcaagcagaucucugaguuucaggacagccagggcuacccagagaaaccauaacugaaaaacaaaaacaaacaaaaaaagaaagaaagacagacagacagaaagacagacagacacauucagacagaaaggaaggaaggaagggagagagagagagagagagagagagagagagagagagagagagaaagaaagaaaggaaagaaagaaagaaagaaagaaagaaagaaagaaagaaagaaagaaagaaagagagaaagaaaggaaaagagaaagagggcacuggggaugucgcucagugguagagcaguugcuuagcauauaugaagccuuggguucuuccagagacgggguagauggaaaggaaggagcugagggggggggggugugucuaagaagagucaaugaaacacagaauuaccugucuugauacuguacgcuugaggccuguguuuaagcaccggucccacaccagccccuacaaguggguacgggugguggcaguuccugaagggaaugcuugcucugccuguguuguguggcuuucugauugggggaggaauuggaagugugggauuucugaaucaugacaugacucaucagaacagacgaagaaugcucaagauggucucuaaaagcacccacaaugcaguguggagagcagugcaggcuacugacacccccaugguccaccagaagagaggaguggagccauucuagggugugggguccagcaagcaugagcccccugccucccugauuccacacugcuuccucuaccagcccacguccugaaccagcuuuuagagcugguucaaauagcuguauuugaaaccugaaggguuaagcucuggguggccuacgauguucuucagucccuguucugggauccuggggcuuaucuugggcacagaaggcuaagaugcuaucagaaaugacuuagcuagaggaacaguuuagggaaggaagucucacccauaaccaggcuugcuguuaggugggcaggagacugagaagagaagacaaauagcaggacauccuagaacagcauuucugcucuuagcuuccaggaugaaauguauaaacacaugugcugcauauguggcagugcacacacacaaacacaggagggauggguuuugugacuugcucuuugaaaccagagaggagcggagaggcuuauaggagugccucccccagucuaagguugcuggucucaguggcugcuccccacaucaagcccccuugcccaguacccagaagauaaacaggugguagcauugcaagguggcaucagagaagcagccuaaggagguaaggacagggacagaggccgacuccccucaaagccccuuguuguaguaaaccacaucgaugcugggguuuugugcuuggaucugagcucucagcuccggcuccagccuggucacauguauggagcugcaauagaacaacacaggcuagguaaauauacuccgggcucagugucucagacccaggagcuggcuucccuccacuccccggugaagaaucuucccugcuuucagaagggcuggcucacuguuaccccacccccaccccaccccccaccccgggcucccagaugcuccugucagaccucccgggaacacacugcgggccugagaugcagagucccgggcagagauucuggucagguccagcggugucacucaccuucucugagggaacagagcgcagcacagggguguggcaaauaccaagcuagagaagaagagcacaggaaaugucugugacacugacuuuuguguccccucccuguaccccaccucacaggaauagccccaggagugaagccuuauuuguuuguuuguuuguuuguuuguuuguuuguuuguuuuugagcucuaucccagccauaaagguuggaaaauggagucaaaggaccauucagggauguuaaacucaguccugauauuagauccugucuggggaaagagccucuugagcaucaacccaaagccccaggaucagagagcaacaggaucagggguaaaaugggaugcaacuccuggauuguacccuagagucuacuuguaugggguccucuggugagugaaggcugaaccccucaacuaaacucuugacuuucaaaggcaagaaccccuagagguccccccacccuuccaacacaugcgcgcacacagauuuugcacuauggguauccauuggaacuggauauaugaacaauguuauguaagcaucucaaagauagugcgcgcccacccacacccaaaaugauaauggcuuucccaugugccccuacugaacccuuugcaaacuuaccagaagccuaccagucccaccugcaggggcgcccccagccagggacggcgcuguggggagacagagacaacagaauggcuugugucccauuuuuuccuaacuccaucuaccuuucugcaccaugguucuagcucggcagcccuuguuucuccucagccaaugaggggcugggaccugcacagggcaaccccuaccccaaccagaccugcugccuaugcaguuguacacucuugccucucagaaucgguuuccaugguacucgcugaucaucuuucucuuaccucacuuucuacagggagccucccuugagccucuucucacuuccugucgucccaguagcauaaauaugucccucuccacacccuccuacauccucuucagccaugacgaccauuacucuguccuucaaauguaucaggccauccugucccuggcccuuugaacuagcugcucugucugaaacacucaccucauuccuuggaucucccaaggccugugcuugacuaaacuguccccccggauagucucaguuacacugccccacuggauuccuacaaaacacacaucguaacuuacgauauguuugauuuuuguuuguuuuguuuugagaaaagucucacuguguagcucugucuggccuggaacuugcuauguagaccgggcuggccucaaacucagagauccacuugccucugcuuccagagcacugggauuaaagaugugagccaccacauccagcccuauuguuggcuccuuuauugguuucuguacuugacuggaagccuugugggggcaggguccacagccauguuuguucuguuuagcaugucuggugugcagucagcgcuuacuacugacuggugaauaaaugacuugaugaaugagcuggagacuguauuccugagccuugcuucccaaacucguuggugcauucaugaguaugugugugcaccuguuaguagggauacagugcgugacaucaugaguaugccaucaagccuguggaugacagucaucuuguguaugucagagaccucuggaguuaaucuaguuuccuccagauggacuccaucuucuuccuucugucucccccucacuguuccuucccuccagcccagucuuuccuagugaaugaauggaggcagggaaggaccacaagucuuagacuucagucaggcuggacaaaggacuggggacaggucauuucucccugacgacaaccguucugggacagaauagguaaaaggugaguuguuuaccuucaggaagucuuucuucuccagaguguucaugaucaccgggggaauggcuggggggagaacagugcagugagagagauccuagagcaaacugcaggagccugagggaaggccuccuucccagcucuuccccuucuccccagacuugcugacugaguuaucaggaaacccugagacccaccccccccaagcccucuucucuccaagccuccugagcuccacccagccaugccucacccauggcgggaaucgccauuccgauucuugauaucaccaccuggaagauucccuguuuggcagcagucaccgaguggccaagccucugaccagccucaucagucacugggaugcccaccugcagcucccuaagaagagaaagaggcuggggucagauuauaggcagcagaucuugggagcccuuuaccuuccccacucaaaggcugguucugaacucccaggguguaggguagaucccagaaagaauagauagaugccugugcuagcccuggccaaccacgagacagggguaaguuuugggucauuuaguugguugaagaagagguauuggagaggagccaggguguaggauaauuuccaagguaguaggauccagcaugacaggaacaaacuaccuugaguccaagauacaccaggaugccccggaguagcccaggugggguuucuccacacggcaucccaaauaaacaaaacuggggcuggagagauggaucagauggcuuagcaguuaaaaucacugauugcucugccagagauccugaguucaauucccaacaaccauacuguugcucacaaccaucuguaaugggaucugacgcccucuucuggugugucugaagacagagacaguguacucacauauauaaaauaacaaacaaacaaacaaacaaacaaaacuauuaagaauauugugugagccaaguauuuaauccaagcacacagaaggcaaaggcagacaagaucucugaauucaaggccagccuggucuacauaguuaguucuaggccuauacagagaaacccugucucaaaacaaaacaaacaaacaggcacauaagaguuuuauaaccaaaacacugauaucaauacugcccgaaaugugauuuccuugaugguggcauaagacaagucaggguacauuugagcuuacugaaagucaccuucaaccugacuaucaaaugcaguguuccuucucauucaagucauagggagccgguuuugcugcugacccacaccuuggcccuaucagcaaguucccgguaaagugcccuugcuaaaacccuguacccuucagucucaccucaccucaggacaaauucucacagaaugggaacugacuguucucaaacacauggucaguauaagccagggcccagccgcucgcauccgcugauggagaagacugcuccugcccccagcuggucugcaggaccauguaugcccuggacagucggaccugugccaggagccaggaccacucaccucugccucaucagggggauguugaugcaguuggcagcggccacagcugcaaagggcacgaaucgaccgacuagcgggggcaggugcuaggggaggaaagggggguucagugacucuggggaccauggguagagaggaacucaggauggauauggagagccucuugagagggcaucaaggaggaagacaauggguaaaggauucaugagaggccaauagugguagggagacuuuaccuuggugagagacuugagucccagagcaguagccacagccccagugguggcacucacauaggcuguccccaacugccuguggaggaaagccuaggucacagggagagaugaguccagcccgaguuuccuuuagggacauuacagguuuccagugcagggggugucagaggguaaccuccauugaaagcccucccccgcugcaguaaacgucugugaaagccuucuuccuucuuuaaaagggcaauggauccccaacacagauaaguuaaggacaaaauaacaaaaggacugagugcccucaaggggggaggugaacagaacucgaagcugaaaggagagcggagccacuggcacaggggucguggggaccaggaauggcuggggaugggggacacucacugcacagugaugggagcaucgccgcugcgauuagaguaauucacaauagcauugaaggacugauugacccacugccagaacaccacagucggagucuuccugagggugcaaagauggacuacuuauacugucccuccacaauauucccccauccuugaacccccaauauuaaaacccucaaaauuccuuaacuccucaagugagacuuagcucaugguccccaaacuggcccucaucgaccuugcgggaacaccuuacacagauggaggcuggguccugagaagcagaaaggaugcucaaguauucucccacccacuguccuugaccgaaaaagguguagaaaggagacuuauagucacccaggcaugcucugggcauagcgcucaggaaggggacacaggauaagguuuaccuguagaaggugagcaugcagccaguaauggucauguucaugggcaccugggcugacauacggccaaucaagaccaccuucucccccguguccggauggaaugcugagucauacacguauuuggcucgccauagcugguccucagugagacccgggguugccacaccagcccuguagaaauuggcaagaaaccaggaggcuguggcaggggucagaccugcccuucuugucucugcugcuugccucggggaacucugggcaaaggaucaggaaguuuggcacccaaccucugaguaaaggaccucucuguccccuggggaugucagagcgucuuguaggugugccuacucuauuuucacauccuugguggccccacauuuucuccggggucacagugauggugguuugaaugacuggaggacauuccaagaguuaaaccucccaaggaggauuccuuuucuaucugcgugggacucucuuuguccuugcacagugaacagcacugggaagugucauuacuaaggaucugugaccugcagagcugccaccuacccauaacacacagugcuguccccucagcccaaauguccucagauccgcugagcuaaagugcugcgucacaguggcgugauuugaggcagguucaccuguaauucugcacgauguuccgggaagcuuccagcuguuccccggacagcagcagauuucggggaucagugacugugaagaaaugccgggcucugccuagaaaugugcuuuggucccaccgagguuccuggauguugauauuuaagggcaggucacccaucuucugcaagguagcaagaauaagggucagguccaaggacuuccuucacuugggagacacuuugguggcucugccuuggccccagaaacugaccagugcuugcaggugcucaaggucacuccagauccauaaacaagggugggggaggaguuguucccuagguaguguuuuagccaggaacauacagccacuuaagagccggagggaagaccagaaccaagaauauagcuuuccugacgcuguggccugaugccagauuuacgugugugugagugugugugugugugugugugugugugugugugugugugugugugugauuccccagcagcagcuaaucuggggcagcuaucuugagcuccugcuauaggagcacagaacauggauaacacacccaagcccuuuccagcuucaggccccagcugccccaagacuuagauaaaaacuuccaaggcuguuuggaaaaaugacagaaggcagcccacacucaagccccugauuggaggagacauuaggcaccugagggcugauccguaccagaucucaaacagcacuggaguggcagccauuugugaacaugugagcacccacauagccuccucaaacccacuugcuuccacuccuacacaauaacuccgggcucucccugguccuggguugaauagaacugacgcaggcacccacccaacucucucugagccucagaaaaaccucaggaaagggcgagauucaauggaugccccuccgcccagcacaaaaaggaaugccaagaacagccaucuggcuguguuaggcaaaaauccugcagagugacuaauacccuccaaccccacuuccucccucacaguagacaccguccccacccgacuuucacauacuuauacacaaagacaggcacgcccuccccagcacacaaacagguuagagucacacuguauacacuagucaaccaaccagaguaccguuacacacacacacacacacacacacacacacacacacacacacgcucagccauaucuaucaguugcagacauuugaaagcaugccuaacacacagccucaaccaaccccuccuugugcccuacagauccuaacagaccacgcaauauggaauucccauaagagagagcaccucucucaaggcaagccuucuguucugagcccaagcccucaccccuccacuuugcugauucccaaggcagcaggcacucacgcuuuccgggguuuucagccucuagaagcucucagacccgccuuccucaccgcucuccgcuuuccucccagccaucaccgagacgucacgcgugacgcugagcagcagggaagggcgggggcucccugagcucguucgccugacccacccccccucuuggcagaguuccgagacaguggauguccagagugauucucccagaccaggccguugagaccaaacccgacccaguccugggaagcaauucuggccuccuucccaaccagggagaaaaggggaggagccgccccacuugccuccuucgcuugcagucccuuagcuugccucuggaggcacccacccccgcagcacccagucuaggugcacugggugcgggugagcggcgugga

SEQ ID NO: 9304 - RNA, 3130 nt, Mus musculus
auucuaguaaaauggcaaagacuuuauuuaucggaggaagaggccuuggguacagucgaagaaagagagggcaaggcaggagcugggaaagggcacccggaacccacccucccugggccacccucgaauggccaacuugagacgggagagagauguugacagacggacccagagcuacagaggaggugaggguuagcgcuugggucauccuucuuuaggucucugucacaugcaaaaagaaaaaaauuuuaaagaguaaaaaauaauuccuagggcuuuggguucuguuuuccaugacugguugggugcuucccugcuuuuucccuaagagccagacuucagcaaucaguccgagaaaaugcaggaagauuuggaggaauuuuaaaaaauagugggccucgggaggcagacacgccaucgaaagcagacuucucucgcuggggaaagaaaagaucgauuuugaaacuugcaagucagggcccggcucccccccccccuucucacggagggaaaaaaaggcagaaggaaauuaaaagucaacuguaauaggccgagagaggugagcggaccggugcauucgccacaugcagaaaaaaauuaaaacagcuucuagaccgcaggaguuaguaguguucgccgcucucgaguccgccucaccgucagccgacccggcagcacccgggcuuugaaaacaucgaaaucucugagauuaaaaaaaaauaauaaucauaauaaaagaaagaaaauaaucaagcuguggugggaggaacccacuauauaggcuuaaauauuuauacagaagccauacagaauugcacggcgagggcuuccggggcggcggaggccucguguggcggccggccccgccggccggcccggauuuauugcuucgaaaaggaagaggcggcuaucaggggccaagcccggccccgggacaaggguggaggcgggaggugcagaggaggucccagcuccccuuagcgguccgauccgggaggcggcgggcaugcgggcacugggggcccgggcggcaggagguccagggcgcagcucaaucguccacgucgaucucuucaucuuccucauccucugagcaguccuggcugcuggcccgcugguccgugaguggagaggcgggcgagagcugcaaggguccuccgcccggggccugcggggcgccugggggcagcgcaggagaacccggccuagacuuagcccugccgcagccaccgccgccgccaccgcccgaagccuccgaguucugcucgaguucggccagcgccacgauguccaucugcccgcuggggcccaguuucuuggcagacuccacgucggccuucaucuccucuaggucccgcuugagcuuggcgcgccgguucuggaaccaggugaugaccugugcauuggugaggcccagcugcugcgcaauuuggucgcgaucugccggggacagguacuucugguauagaaagcguuucuccaacucguagaucuggugguuggugaaggccgugcgugauuuucgccguuucuugggcgucugccucugcccaaagauggucaucccaucgcggccuggaaagaaaugacaguguaugcucgcgacgagagagucaagaccccacccagacucucucccauaacucuccaaccgacucaggcccggggucccgcucuuguuucuucuccaauucgauuccacucucuaaaccugagcaaacugggccaugggacaccuccugucucuggucuccugaaaguccuaggaaaaaaauguuuuaauuucugcucccuaacaguuggucugaaagagcuaaagucucacagagugcaaggaaaccacacagagacucccuaaauguguugugaacaccgauucuccaccccuuuccaauggccggacuccacccuacccaggaguugucaggggaaaaaaaauuucgcccucuucccaguccaggaguaagucuaggagaguccaagcggacgggaagccuagguagccggccagacuccgggaagagcuuggguucucacaccucucucagaucaccucagaggucccuaggaacuaggcuccugcgccccuguccccagucucagcugcagaagccaggacuggaggggccuggcagccggcgugggcagaggcaggggguacgaagggcaggacacugcgugugggcgacugggcgcaggggaaucuagacuugugccuaccuucggcugccugcaggacgcugaccuccagccccuuaaaggucuugcuggcgagcuccuccaaggcgcagagaggcgaggucugcgagagcagagcgcggcccgccaggggcaagccgcccggcgcgugcuuguccgcggccgccagcaggugcgccgccccacacagcgaguaacuucuccgcacggacggcuuguugaggauguccucgaugcugaacggcgucagcggcuuguuggaguuggcgggcggcggcaggugguccagagggcugcgucgccgcuccuccccuggcgccgccuugccguccuccuuggaagucaucucggccucguuugggggcccggccggggcggcucgggccggggggacccagcccgcgggcagcucggacgcuggacggugcgagaggaaggcgagaggcgggcaggaggccgcgccgggcagggcgcggaugggcaagcggccgauuagcgcggcgacccgggcgagcggaguggcgcggggccccgggaggaaagcgcugacgcgggcgccgccacugccaccgccgccgccgccgccaccgccgggguuuccagcaagcccgggccggagccgggaagcgccgcgccgggcuccaguuucgccagccccggugcuauuuaaaggugucagguggcuccgccgcggcggcuccuggcccgggguccuggcggcggcaguuggaagaaccgaggcgagggcgccgaucccggacugcgaggggaggcggagagacggggcaauugacuauugcuaacaaguuagccuugaucgaggaguaaucaauuaucugcagcugaacuucucuuucuucgcucucccuucuuucuccucucccuucuuucucucuguucucucuccucccuguccucucucucucucucc

SEQ ID NO: 9305 - RNA, 3130 nt, Mus musculus
ggagagagagagagaggacagggaggagagagaacagagagaaagaagggagaggagaaagaagggagagcgaagaaagagaaguucagcugcagauaauugauuacuccucgaucaaggcuaacuuguuagcaauagucaauugccccgucucuccgccuccccucgcaguccgggaucggcgcccucgccucgguucuuccaacugccgccgccaggaccccgggccaggagccgccgcggcggagccaccugacaccuuuaaauagcaccggggcuggcgaaacuggagcccggcgcggcgcuucccggcuccggcccgggcuugcuggaaaccccggcgguggcggcggcggcggcgguggcaguggcggcgcccgcgucagcgcuuuccucccggggccccgcgccacuccgcucgcccgggucgccgcgcuaaucggccgcuugcccauccgcgcccugcccggcgcggccuccugcccgccucucgccuuccucucgcaccguccagcguccgagcugcccgcgggcuggguccccccggcccgagccgccccggccgggcccccaaacgaggccgagaugacuuccaaggaggacggcaaggcggcgccaggggaggagcggcgacgcagcccucuggaccaccugccgccgcccgccaacuccaacaagccgcugacgccguucagcaucgaggacauccucaacaagccguccgugcggagaaguuacucgcuguguggggcggcgcaccugcuggcggccgcggacaagcacgcgccgggcggcuugccccuggcgggccgcgcucugcucucgcagaccucgccucucugcgccuuggaggagcucgccagcaagaccuuuaaggggcuggaggucagcguccugcaggcagccgaagguaggcacaagucuagauuccccugcgcccagucgcccacacgcaguguccugcccuucguacccccugccucugcccacgccggcugccaggccccuccaguccuggcuucugcagcugagacuggggacaggggcgcaggagccuaguuccuagggaccucugaggugaucugagagaggugugagaacccaagcucuucccggagucuggccggcuaccuaggcuucccguccgcuuggacucuccuagacuuacuccuggacugggaagagggcgaaauuuuuuuuccccugacaacuccuggguaggguggaguccggccauuggaaagggguggagaaucgguguucacaacacauuuagggagucucugugugguuuccuugcacucugugagacuuuagcucuuucagaccaacuguuagggagcagaaauuaaaacauuuuuuuccuaggacuuucaggagaccagagacaggaggugucccauggcccaguuugcucagguuuagagaguggaaucgaauuggagaagaaacaagagcgggaccccgggccugagucgguuggagaguuaugggagagagucuggguggggucuugacucucucgucgcgagcauacacugucauuucuuuccaggccgcgaugggaugaccaucuuugggcagaggcagacgcccaagaaacggcgaaaaucacgcacggccuucaccaaccaccagaucuacgaguuggagaaacgcuuucuauaccagaaguaccuguccccggcagaucgcgaccaaauugcgcagcagcugggccucaccaaugcacaggucaucaccugguuccagaaccggcgcgccaagcucaagcgggaccuagaggagaugaaggccgacguggagucugccaagaaacugggccccagcgggcagauggacaucguggcgcuggccgaacucgagcagaacucggaggcuucgggcgguggcggcggcgguggcugcggcagggcuaagucuaggccggguucuccugcgcugcccccaggcgccccgcaggccccgggcggaggacccuugcagcucucgcccgccucuccacucacggaccagcgggccagcagccaggacugcucagaggaugaggaagaugaagagaucgacguggacgauugagcugcgcccuggaccuccugccgcccgggcccccagugcccgcaugcccgccgccucccggaucggaccgcuaaggggagcugggaccuccucugcaccucccgccuccacccuugucccggggccgggcuuggccccugauagccgccucuuccuuuucgaagcaauaaauccgggccggccggcggggccggccgccacacgaggccuccgccgccccggaagcccucgccgugcaauucuguauggcuucuguauaaauauuuaagccuauauaguggguuccucccaccacagcuugauuauuuucuuucuuuuauuaugauuauuauuuuuuuuuaaucucagagauuucgauguuuucaaagcccgggugcugccgggucggcugacggugaggcggacucgagagcggcgaacacuacuaacuccugcggucuagaagcuguuuuaauuuuuuucugcauguggcgaaugcaccgguccgcucaccucucucggccuauuacaguugacuuuuaauuuccuucugccuuuuuuucccuccgugagaagggggggggggagccgggcccugacuugcaaguuucaaaaucgaucuuuucuuuccccagcgagagaagucugcuuucgauggcgugucugccucccgaggcccacuauuuuuuaaaauuccuccaaaucuuccugcauuuucucggacugauugcugaagucuggcucuuagggaaaaagcagggaagcacccaaccagucauggaaaacagaacccaaagcccuaggaauuauuuuuuacucuuuaaaauuuuuuucuuuuugcaugugacagagaccuaaagaaggaugacccaagcgcuaacccucaccuccucuguagcucuggguccgucugucaacaucucucucccgucucaaguuggccauucgaggguggcccagggaggguggguuccgggugcccuuucccagcuccugccuugcccucucuuucuucgacuguacccaaggccucuuccuccgauaaauaaagucuuugccauuuuacuagaau

SEQ ID NO: 9306 - RNA, 10560 nt, Mus musculus
caacgcaucaguagugguucucuuuagguaauacguggaauuguaucagaauuaaaugggggagcucugacaaagguacaugauuccagaacccccugcuggcacaugcacaccuuuuacaguuaaggaaugugaguaaaucuauuuguguuaaaggagcuucaucaagcaauucugauggaaacagaggcugggaaucauugaugagcuucuaccguugggcucuccucuucccaaugguacagcuuguuggcagggaggucgggcuauauguucuuuucacaguccaggaggggacagguuacaagcugaugaaaagaaaggggugaugugucagugaccaagagauuagguggucagacaguucccaggaaacgaaggaguuaaaacugggcuucaugccauugauccuuagcaaccuuggcuggacugcuuagcgccuuauucagcgcguugaaggaccccucuugugggggacauuucuaggauuccauauaucgccgucaggaugugacggcccaaauggcauacccaggucuagcugacaguaaccauuggcuagccccaggcucuuugggcaauaaacugcuccagggucccagggaaaccagcccaauacuagugaaagucaacggcuccuccuauuccugggcaggggcacugcccuucucccaccccagcugcaugcaccuuaaggccucugggagaggguagaggucguuggccaugcaaggaccaggcauuggaagcgacaggucacagacagccucgacgaggaagcacggagauccccuuggcgaccaacagggucgcgccgcccccuggcgguuccacaacacaguugaggucggagaagccagcaguuugggggucgcacagcucagagacugguuccuccuuccucaauucuagggguugaaggaugggaugcuaaagcaaugcccccauaaggaccuccuguaccguccuucccuuugacccucccccguccccuucuuuuucuccucucccccuccuucccucuccaucuccacucuucuuccuuccuccucuccucucccucccuccccgccguccuucgcccaccccucccgcccccgccaggcagcgccucggugcgccagcuuggcaguuagcccauuagaucucguacuauugauccgcuucugagccgaagcugacagugccccccuucccgaucccccccccccguccccauuccccgcggcccccucucuucuccccucccucccaucuucaggcaguccuggccugagaucaccccaacacccccucucccgccccccagcccucagcgggcugugcggaagucucgcccucacgaaggacaggaacaaauguaauuaaagcgaucugcaagggggguacguccuagcaagcaagcgcaagcgggggucccagcggcccgcgcggggcccgccaccuccuuucuuccccgucccuuccucgcgcaccccacccccggccccccggagcgggagcauuuggguugagcggcgccuguccuauaaauccacauauaauucucgccuuuccuguucagcuaaggaaaauaaacguguaaggcuguuucugggagcccagcucggggaccgcucuaaauucuccucuuauugagucgaggcuggaaaucauucagcucggcggcgcgccccagaucccccccgcccccccgcaggucgcugggguccgggcccgcgccugccgcgcacacgcacgcgcgcacacagaaggcaggcgcuggguauauaaauaucuccagcucuccccauagccgggcagauuuauuccgcugccaagccugcagaaaauugacuuguucauggaggcggcuauugacacaucaccggggggaggguuaggggagaaagcaguggagccggcgccccuccauuauacguuaauguaaucagcagugugcgaaaugacugcgcggaaaauagcaucacugacauuuauauuagaggauauugauggcaggagcugugaccgcaucacucugccucccguuuccacggauugacacaggagccucuuguuggcuccauccacgcuugccuccccucccccucccccuccuucccuucucucuuccucucuccgcccacucugugucucuccggcucuccccuucucuuacccccacucugcuuguucccucuucugaucauucauuuuccaaacaacucuugaguaccuacugggugccccucucaaggaucuuugcucgugaauuugccuagguuuaucccucucuucccacccacccccuuucugcuuuugcccgcucucucccgccuccccagcucagcuuccccucccccuuccugccuuggcucgauggcuggaccgcugcugucacagcagauagauaauugaaaaaugguccucaccuuugcagccagcaggagugguucaggcgguaaccgccgggguuaccuaacuccaucucucaggcccaggcuccaaaagagauucugaggaaauuggauuuuacauggcuguuuuaucugggcagagguuuuaguguauauaaauacaggcaaggacgccuuggcgggaaggaugagugaggccagauguucuguucuaccuacaccaccuccagguucagaggaggcgggcaggccuugggcucugcucugagucccagaccugaacauccgugcauugcccgucauuauuagggacagaaagagguuaaugccuaucagcagcuccuccaaggcugucuugggaauacaagugucuuugucagggcguugcaaagcacgaugcugagaagaaagaaaggaaaaagaccggagaaguuugaaggcuaauucucucaggaaauauuuauggaaacuuuaccucugaguauuguuuugaggauacaagaguaagugguuuaggcauagcuguugccuucagaaauagucugcuuagggcauugugggagcucaggcuagagagagagagggaaaaaaaaggccaagaguggggaaaaaguaauguuaagauuucuuccuugggaccugaucaagaggggagcuuggaaaaagaaggaaacagagcccgcugggagauggagauacccuccgggguacucuggccucaaaauaucuaagagcacuuaguucucagcagucacugaaccugugggcuagcucacuccaagaugggagucucuggagggcuaaagugcuguaccaucaaggauccaaacucggggugagaaaaguacccgagugaggagugcuuugggggaggucuaaaugggaggcacaaggccaccuaggaacaccagaagaagccaaacaugugagaccauccguauauaaagggaagauauuuaccuuggcuuacaguuuuuggacaauacaguuugugaucaauuagcucuguuguuuugagacccaaggcaagacagaaaauuauggcaggcgucuguggcaaagcaaaaaucacucccuucaucgucgggaagcaagagaaagaacuaaguccuggaggugcagugcuuguccagcaugcaaaaggcucuggguucaauuccaagcacggaaggaagaaugaaacgaagaucaggaaucgggugagaagaaagaaggggaggcgguggauggauagagaaaaaagaaaaccaaaucuccuuuguagucaagacaccccccacccccaauuccacuggaugucauaucuccuaggacuaaaucuuuaauacaugggccuucugagggcuugagauacaaacuacagcaggaaggagcuuuggguggggauagggcggggcggcaggggcggggcggggcgggggugugugcuuagagaggauucuccagcaccugaagccucaguugcggucacaagcagguuuuugguuuuuuuuuuuuuuuuuuuuuuuuuuuuuuuuuccacguguugccugaucucugauaugaauccaagaaacugagggaucauugcuauuguuaagaagaggagaucgcuugagcccggagauugcuugagcccuuggcugaagggcuggaauugagugguggaccccgacacagacugcucacugaaaagcuccuccugagcacaggacagagagcagcugucucaccauagccacaucacugaaagcuggaccgucugccccccgcccccagagcaacacccccgaagcccccuguucucgaccacaucguuauguuguuacaucaucagcuuuggggcaggacaggugcgggauggaucauagccauccucccagcugcucccacacaucccaggcacucccagauggcauccugggaacgccaguccagcuguauggugggaguagucugggguaacuagacuccuucucugaacucuccccaccugauccuugucagcauuuucuuccuccucuaaagauuacauccaucugccagcuccgugcaaaggaguuucuuuucagcuguccaugaguccuuuucuccuugccuucauuaccugugccucccucagccucugcccucaagagaaccacagggaagcauauucucacucuccagcuccccccauccaaccacuguuuuuuuuauuuucucuuccugugacuccuuugacauacggacccuaagauuccaauuuaggagguugaauguuuguaccccucuaaaauccuuguugaaauuuaaccuucacuacaauaaacaguauuaagagcugucugugagguuguaagaaccugccuucaugucuguuaggggccagagagauggcucagugguuaagagcacugguugcacuuccaaagguccugaguucaaucccuagcacugacauggaggcucacaaacaucucuaaugaaaccugauucccuccucugcugugcaugaaaacagagcacucauguacauaaaagaaaaaaaucuaaaaaauaaaauuaauguccuucuaaagggcugggaggaagccaggugguggugaugcacaccuuuaaucccagcacuuggaaggcagaggcagguggaucucugucugaguuugcggccaaccuggucuacaaagcgaguuccaggacagccaggacuacaaugagaaacccugucuuaaaaacagggcuggagagauggcucagugguuaagagcaccgacugcucuuccgaagguccugaguucaaaucccagcaaccacaugguggcucacaaccauccauaaugagaccugaugcccacuucuggugcaucugaagacagcuacaguguacuuagauauaauaauaaauaaaaaaagaaacaaacaaaaaacaaaaaaacaagaagggguuugggggagccuaucugucuauacccuacuauuugagggugcagcaagauguaccaucuaugaagcagagagggagccuugaccagacccugagucuucugcuagccuugaacaguguggggaauaauuuuuagugacuuacauuuuguuauagcagcaggagcagacuaagaccucucaaacagacuggggcugagagcacagugcauauguacagugagugugugcacaucuaggacacaggugcuaucacuuuuaaagcaguuuugguuuuucugugccaaucaaauuaggaaacucgggguuggggcuguaacuuaguuaauagagggcuuggcuagcacacaugaagaccuagguuggauacuaacacaaaugcacacuugcucaucucaggugaaggucggagaucagaaguucaaggauaucuuugggugcacagugcuuucggggccagccuggacuacauaaaauccugacucaaaaauaaacaaauuaggaacuugacauuuuggaggagaaagagcggagucccacaggggagagauaacucccauuucuccaggccuuaugaagauagacuuccaggaugugauucaggaucaucugcccaacaagcuaucagaugauucagggaaugggcuuuggaaagagcuggaagcagagaaacauacauucacauucacagaagcucagaaccccucucuucccuuucccugcuuaaguggacggacggcgggagacuggguucagaggauaagggacccaugaaagcagcuaugcuguuucucgggaugaaagaaaguugccaggagcugggagguugaaggucuggauaaagaucccagcuuuacagagaaauacucccagccugggcaugagccuugucaucaaggaugcuguuagcuguuucacugugauuggcacugagccucucugcuuuuagguucuuuaccuggaaaaggaaaauacuacauuccaguucuaauuucuucguaguccugguuguccuggaacaugcucuguagaccagguuuguccuugauccaccugccucugccucucaaguucuggaacuaagggagugugccaccacugucuggccuguucuaauuucuauaguguuuggagagcuggacuugggaaggaguaaagcuauuucagggcugaauauucagacuucugagauggacaaagacaguuaauuguacugaaagugagugaagccugaaaucucucaagggacacuuggagucgaggaacugcugugaccaggacaagugcagagcaguaaaucagcccagcugugggacugaagaaaggcaggcuagaaucaccaagcagugccaccuaaauugucucugcccugggauccagcgccaaagcccaggagugaugggaagaaacuccaauuaacaaggcagcugucagucaaucucaauggcaggaaaucugugugcuauuaugaucuguacuugggcaaggaauauuggcuaggaagugagauucuguguuuccuuucuccaguuuucuuaguaaguugccugccugagagcauuaacaucccuuccgcuguuagagcagaggaggaauccgggcaccccuggugguagagcugugguuagcaggggcaacaccuuuuuagacuuguuagaggaacuggguacagaguaugaagcagguggaaggagccagcaugugaguguuggggcggggguagugagaguaauggagacaccccaccguccucuugacuugccaagaugaaaccgaacaagccaguagggagacuuggagcggaaaaucgccuuggaugauauuccccagagagaaaggacuagaagcccagagucaugggcagccagaagccagcagucaggggaagagaggugaagagagaagcuaucccuuuccacggaugugccuuggccccugaccaagcgaagaggggcagauuuucugucuugucccaagccccugcaucugccaccuuguuuacuucaugucuauuuauagucacaggcucuaagccugguaugggacucugcgauuuauaugacuauaaacuuccaaagggcacugagaacuggcagggcaaagauagggacagaggcaggccucccacggucaacgcaucuacccucccaccuacucugaccuuaaaugcuaccaaaggacaagagguucuaagaccagacucagaacaccaagccaggggcaggaagccacaucacugguuugacccuucuuccccugaguccuggauguggggugagguacagauguuuuagucugaucuccuucacacacuugggagcguguagcgaacuucugugugguagcgugguuucaucagacaaugacugagucugagcgacucuagacuucagaagaggaaguggaagugaagaccugcagcccaggcucugccugcccuauccacugaccaacaggaagaaagaugaaccauucucauggccuccuucucagggugcccuuggaggccugagccagcccaccccucacucagaucagagaugguuaaggccugacuauaggauucugagaggagcuccuugcccugucuuuccccccuaggaggcccccuguucagacucucuacuuaauaagucucccucuuuaugcuugcccacucucuugcuccucaaguguuuuuaagacuuugaacgagugucuagacugaguucucccugcccaauccauaccaaccucccacggugcacuccaccuuccaacccccacccuccacuagucccuacuccaggaucugucauaugagcauuaaggcuggguauaucuaaguucucugucugucucgucugugugugugaugugacaaaaaaaaaaauaaauaaaauguuauuucuggauaugucugugaggguguucccaggagaauguucacuuuuggucauucggcuucuagaaggaagaucugccaucacucaggugaggggcagcauccaauccacugaacaaagagcagaagaccaagcucugcuuguccuccugcccuaggagguggcauugcugguucagccucccaccaggacucccaccugucguucucaggacuaagacuaugcucuacugugacagcuccuagcgacagaucuugguacuucucagcuuccaugaucugugagccaauccuucacagcaauaaaucaaugccucucuccuucccuuucuuuccuucugcccucucaucucaaucaugucugcuucucuggcgauccuuaauccagugucugaacuccaggagcuggguggggcagguaugaggaagagaaagcaagcugcauccggcuggaaggagggcagaacucccuuccugcccucuccagggggaggcagcagaggaccaugggaacugccccauccagcuauaagcacaagguuccuucagguccucuauccacuguggaguccauauggaggcacucgccacucgcguggucugaaguuuucacacuugcagcccauuucucuggugcaaagauaccuugggaaagcuagccuguuuucaacuuagucuccugccccuucuguucauucuuuuuuuuuuuuuuuuaaagauuuauuuauuuauuaugugcaaguacauuguagcaaucuucaggcacuccagaagagggugucagaucucauuacagaugguugugagccaccaugugguugcugggauuugaacucaggaccuuuggaagagcagucagugcucuuaaccacuaagccauauccccaaccccuuccauucauucuugagcagugauuucuuacauaaauaagcaaaccaagccaaaacacuuuuuuuuuuuuuuuuuuuuuuuuuuuuuuuuuuuuuuggagacagggucucucuguauagcucuggcuguccuggaacucacuuuguagacuaggcuggccucgaacucagaaauccgccugccucugcccagugcugggauuaaaggcaugcgccaccacgcaaaacacacuuuugucugcagcuccugccgcucuuuauaccucucagcucucaucacugugggccgaaugugacaucagccugcauagagccagucuggcugguuuaguuucucuguguucccugggucaucacuacgaugacuacuuuuagguagaacauacccaaucuucccuggugucucuucuucuccacuccuauccaaacacuuggcagacucacuuucuuggguacagggacugggucuggcccuggagaugacgaggaagacaguccugugucagccagcauugggcagugaugauuuggaggaucuaaaugccucagccuagaaaucacacccucccccgggcaugggacucuggucccucagucugauaggaaauuggccuugggaagaucaaagacagguggaggaggaagguuaggagagaagaggacaagggcauuucagcuguugacauaguuuaggagcuaaaaggcuuggaaguuagaccuuggggcagagaucaucuccgguucaaggcuggagugggguugggacagguggccuugcuuggaggccaagagggacauaagaaugaucaaguuuuagagagccaaggaggaacuuugaacucugaacugggcagaguggccaggacugggggucugaccuuggcuuaguagaguugaaaccucagcagaccagaauccugugccagccagugaccagcaugaccacagcuggaaaggcagcuggggaguugggaguggaccgaccuuaucucuccccacugagucaucugucguuuguucaagauuccaagauggaagguaggcagacauuuccccaaucaucuaaccuagcacaauuucacagcuagagaaagggaaauguggagaaggcccuuagucccugccgcugccaccaccucaucugccagccagccucguucucagacccagccugaccucaucccauagcgcucccagcugaucugccugccugccugccccaaaaguuugucagagauuggaucucacugugcauuuugcucuaugcccaguccugccagggcuuuaugauaggcugggaacaccccuccuuuuuccuuccccagacuggggcuucugugggguggguuggggcuccguugcuuuccauuacaaugccuuuucacugugccucucugccagucugucuuucuccuucaaccacuguccccucucuucuuacccccuccuggaacugcugagauggaucucugaagcuucacg

SEQ ID NO: 9307 - RNA, 8292 nt, Mus musculus
aguauucugggaacugauuuuuuuuuuuuuuuuuccccucuaccccuuccucccccaauccguuuucauuggcucccauggugaguuuauuucucuuugccgggagauucuaaccuacuuuggaccgguccuggggccgggugggguggggaugcucccagaacuuuuagggauccagcaccaacucucuucuggccccagcugggagucccugguucacaccagcugcucacaguggauguggcacgucugcuucggucuugcccaccuccagcugugagggcucccuacaucugcugcggcugcacuccaccucccugcagcugcggggcucagacccgcgcgauggggcugcugcgacagggacaggugcgcagcgugcccacaacuuucccugaagccucacuccccagguuuucuucugcgaaugcacauugaggcuagagaaagaugaugcgagguuuaugugacaugucccuuagacuccaauucguuggggagaugaagacucuccuaaagauguaguccgguucccaaacccgucaucauuuuggaaaagucucuuggaaggggacgcagaggcugacucugcgcuauauuccuccccccacccccaccccauguuguuuccuuucgauccacaccuccccuacacccacaagaaucccaaccuuucccuggcuucccucaguacgacuaggguugaaaggcugguauguguguguggcacucggauuaaaucacuuaaguuuaacugggguuuccgagaccucugagaaagggaccuguuaccccuaaaccccaccucuaugccaaauuauuaagggcuggcucucaauccuuuaacagaaaggccaggauccagcgcccuucaauggacccucagggcaucgugaaggccuuucccaagcggaagaaaagucaugcagaucuaucuucaaaagcacuugcaaagauucccaaaagggaggugggagaagcuagaggugagccgguccacccucacacacuggaacguucagccuucuuguuuucagcuagagucagauuaacagaagugaccuaaccuguggccaagaucagguuggccucaaacucgaaaagcaaaacaaaacaacaaaaaaggaaguuugcugaaaaaaacaaaacaaaacaaaagcaaaaacaaaaacaaaaaaccccugggggguaucgcuagcaagcaagccuuuagccuuuaaucccagcacuugggaagcagaggcaggcagauuucugaguucgaggccagccuggucuacagagugaguuccagaacagccagggcuacacagagaaacccugucuugaaacuaaccacccccccccaaaaaaaggaaguuuguuguacguuugcgguagaauucuuugaagguauuuuguucucuggauggcaggaaaaggaagggagguggcuucgaacaguucauuauagcucugaccuacaacuguaaucccagcucuuagaggucaaggcaggagaaucagaaacucaagguuauccucugcuacauagucaguuugaggccagccugggcuacaugagacccuaucucaaauaauagugcaauaaaauuaauaauaauaauaauagcuauggugauaccacuugaauauccucuccacaggauggcugagcucccugagagcccacauuaugcccgcuggcauuggacgugcccgggcugaacucuuugagaagcagauuauccaccauggcggccaggugugcucugcccaggccccaggagucacucacauugugguggaugaagacauggacuaugagcgggcucuccggcuccucagguugccccagcuacccccuggugcccagcuggugaaguccaccuggcugagcuugugccugcaggagggaaggcugacagacacggaaggauucagccuucccaugcccaagagguuggcagcucuuagccuuucucagguguuuguugaugauguuugaguuuccaucuugaguuauugaaaaaaaaaacacucguacuuuuuaaauuggacauauuuggaaaccaagguuucuguauagagaaagauuggggugggggugggggacagagacagguaagaauuugauacccuaacucucugugaccuccccugcccucuagguccuuggaugaaccacagcccagcaagucaggccaagaugcuucugcuccuggcacccagcgggauuuacccaggaccacccuuucucuuuccccuccucacaccagagcuguaucuccucccccaacggcagaaaagccaucaagaacccaagcccaggugaggagccucccagcccagggugcugaucacagaaauggaaggaccuggagguuagacagaaaauucuaggucucucucaauuaugcaccuguccaucucuucccaacauuuuucaguucugcauucaacuaguuaugucugccccaggcuggggucuuuuccuugagucaaagcaggagacgccuccccaccagacagcgcucucuucuucuauuugcagcucagcucagaggaugaaaccagcgauggagaagggccccagguuagcucagcagaucugcaagccuugaucacugggcacuaccccacucccccugaggaagauggugggccugacccagcaccagaagcucuggauaaaugggucugugcacagcccucgagccagaaggcaacuaacuacaaucugcacaucacagagaagcuggaagugcuggcuaaagccuacaguguccagggagacaaguggagggcccugggcuaugcaaaggccaucaaugcucucaagagcuuccacaagccugucagcuccuaccagguacgugggggaaggggguuguuucuucuuuacucaguacugguuacagcagcacuagucauuaacuagugguuaacuguaguuaccaguggguauccgacuuagugcuuaagaguuuauaaugagccgagcgugguggcacacgccuuuaaucccagcacucuggaggcagaggcaggcggauuucugaguucaaggccagcuuggucuacaaagugaguuccaggacagccaggacuauacagagaaacccugucucaaaaaaacaaaacaaaacaaaacaaaaaaaaaaacaaaaacaaaaaaaagaguuuguaauggcugggaucuacauacagagacaaacugauagaagggggaggggaggaaaacagaccagcauuaggacuagaaaaugggugcuuaggggcuuauuacauacacuguuuccucuacaucugaguguuuuauaugauaaguuuaaagccaggcguggugguucauacguuagacucugggguccauugauuauggacucuaggcaaguuaguuacucugucaguuuuccaaucacuggaaaggaaugaacaacuauaggccauucacagggguuuuguaagguuggaagaugaucucaguagcacagaaugacauagaguaagcccucaggcaguguggugcagggagccuucagucaggcaguguggugcagugaguccccagucaggcagugcugugaccccaacaggcagugucaugcagugagccccacccaggucaggcagugcugugacuccccccaacccccgccccaggcagugagguauagugagcccucagguagugugaugcagugggcucccagucagguagugcugugacccccucccccaggcaguguggugcagugagccugcagucaggcagugugguacagggagccccuaggcaagcagugcagcgagaccccccccacacacacacacacacacauacacacacacacacacacacacacgcugcaggcaauacagugggcccgcagggagugugcaugcagaguugugauguggugguggcaguggugguggugaugagcacugucauuuucucuaccucuuuuugugguuauuuuguuuuauuuuuucuuuuagagacaagagucucucuccacagcccugacugggcuggaacucacagauccucucucugccucugccucugccuccucugccucugccuuucugccucugccucugccucugccucugccucugccucugccucugccucugccucugccucugccucugccucucugccucugccucugccucugccucugccucugccucugccucugccucugccucucugccucucugccucucugccucugccucugccucugccucugccucugccucugccuuucugccuccaggaguucugggauuuaaggccugccaggccauuuucucuacuucuuauugcuggucucugggaaccaaaggacaagcuccauaugguugcugggcuaccuuuggggcagauauucugcugaaggagccacauuccccucuucuggcucucccuuccuagccucuuccucauccuccucugugccacuuccucccuaggaggccuguagcaucccgggaauuggcaagcggauggcggagaaggucauggagauccuggagagugggcaucugcggaagcuagaccacaucagugacagugugccugucuuggagcucuucuccaacaucuggggagcugggacgaagacugcccagaugugguaccaucaggucaugccagcccgccugccucuuaaaguauugcuguuacagagucucugcccacaccccuuccuguucaccugcaggaaucugggucccucuguuuucccacccugggcccucaugggagugaaauccaacuacaaggaugccagaguucacauuggucccccuccuguccccagaacagccauguagcuuaguguccuugaccuguggacagaaacaauaaauacauuacucugucccacacaccagcagggauuugcuguuguuauguuuguguguguguguguguguguguguguguguguuuguguguguguguguguguuuguuuuaaaaacuauaugucaccauguagcccuggcuaaccuagaacuuacuauguagaccaggcugaucugccuggcuucagcaagggacuuucucaggagcccaggcuuugggcuccaugucucgaacaguggcucucaaacuuggccaugccaagaaugaucuugggaguuagugagcgugaagcccugacccauuuuagaccgaggaaugagggaccagcaugcccagaucacgucccacugaauagaggcuggacuugauugguccugccuucugucuuccauggcagcugcugugacagccacccaugacuucuggccuguuuauuaguccuggguccucauagccucuuuucugguugcuuucuuccagggcuuccgaaaccuagaagaucuccaaagccugggcucccugaccgcucagcaggccauuggcuugaagcacuacgaugacuuccuggaccgcaugcccagggaggaggcugcggaaauugagcagacgguaggcacagcucgagccaacagcuccugaagcccuagcugggcaaccccacaggcagcggaaguuaagaggucgacagagauugugucuaccagagcuguagguccaggaaccccagguggggugggcacugcaguggcagcccucuggucucagggucacuaagcaugaacucugggcacuagucgccuagcauggggcaagcacagccucaaggccugaguacaaucaaggccugaguaugucguucagagguagcgcuccugagcaugccuaagacccugcccauccucagcaucacagaaagggggaaaaaaaaaacaaacaaaaaacaucuaguuggccaagaaaucagguuuagccaaguuaaagguucagcuuagagcuaggggcugagucuguaaguucaugugcaggguugagucaagagagacgggguauaccagaugucugcuauuuguauaguggcauugggagcaggcugguacaugggcaggggucuuggugagugacagaugaaccagucuguuagcagaaggaucggagagaccuagugaggaagaauaagccuccaccagcgcccacagauggaacuaugggaccggugcuggauggauagacccaucacagagcugcggugcuaaugcggaccccugcacucagcuacgguguccgggcacagagaaugcccuggucagccgccagcuccuagcccaucagaagagaccggcuuccccacugcaggcugccugcaagcagggcuccagcuguagggauuccggugggauugcucaaccagacggccucuucccauucuccugggagguccaagaagggauugaagggaccagcagaacuaugucagggcaauugggguguccuggcugugagcacccagggccccugaaacugcaguguccugcagagggggcgggcuaggucucucagguccuucuuuaacaggccggccucaccccuccaagaacggugugggcagcuccuggccuccccuucccacaggugcagugguauuucgugcuucauuuucucccagccggguuggaggcugucugccagccaccugcucaggccucgacccugagcuuccacacagccaucagcuacaggcugcuugagcugcaugggcguggccuuugugauuggcaggccuuucacaggccuggccacuggaugugagucgggggccagaacccacggagugucacucggcucuugcacaggagccuucugcugaggcagagccaauguccucaggccucuaacaggcuugccucuccagugccccggcacguccccucagcuuaauaugaaucccgggggaaggcuggggcgaaggcugggugcuguccugggagaggccucagacucucaccccucccuguucuuccccagguccggauaucagcccaggccuucaacccugggcugcuguguguggcuuguggcucuuaccgacgggggaagaugacgugcggggauguggauguacucauuacucaccccgauggccgaucccaccggggcaucuucagcugccuccuugauagccuucggcagcaagguauccauuuugacuuugggugagcaggcuaccagugggcagccaccuccuagcagucacuuccaaguucucgauuugagacagacugggugggaaagggcucugcaagaauccuaccucuccuggggccaaagacaauaaaacaggggcagaucucaccugaugacacugcccgcuuuccacagaugaggaauugggcccagaggggcgaggccacucaacucaacacacaaauaggcacaggguaugcugggaauaaagauccuuaggcaaccugagaaggugagacuaucaggccuggcucccugcccuaccagacaucccuuguguuggaccaggguuccucacagaugacuuggugagccaggaggagaacggccaacagcagaaauaccugggugugugccggcucccagggcccgggaagcgccaccggcgacuggacaucaucgugguacccuacugugaguuugccugugcccugcucuacuucaccggcucugcccacuucaaccgguccaugagagcucuggccaagaccaagggcaugagccugucggagcaugcgcucagugcagcuguaguccggaacagccaaggugucaagguggggccuggacaagugcugcccacccccacggagaaggacgucuucaagcacuuaggccugcccuaccgggagccagcugaacgggacuggugaccuaggacuuggagcaaggggaaccauguugaaugaacugacucauguagccaucucccacccucuuagcugugccucgcuuuguagguuacgcuugcccugagugaccaagcuaggagcuuugggccugcggggaagagccagucugauucugagagcccgcaagcucucucuccuggacaggauuuaugcugcuguccccucuccucccagugacagguuuucacacggccccuucccuguucaagcagaacagguggcugguuucaaggcgguuuccugcacugaaggcccgagcuucccuuuccaccccaagacugauguagcuguguggggucagcaggggcugcaggagagggaagcagcugugggcucagcgucuuccgugagccuucacaguagagaaagccauguggauucucucacccgcucacuuccugugcagcuggagcugcuggggguggccuguccagaccaugaggguggcuucuaagggcccuggggccuaauaaagugcuucugacauucaaau

SEQ ID NO: 9308 - RNA, 19181 nt, Mus musculus
ugaucaucggucggguaguugccauggcaguggcccggcgcguuccugggcggagggaagauggcggugacuagcugguuggagguuuugcggucggccgagaagacggcacugcugcaggaugguaacucgagaccccucguccuuccccccagggcgggcucuaugcgcccgcucccccagggagggccucagccugggugggcagagcuggaccugucgcagcagccuacagccaugccagcuuccugcuuuugcagaggaaaccggcccagggagaugacccgaguggaacccaagucuuuggucacccaccucaagaguuccuuauaucaucucuccccgcucagaguuuuguugguauuucccaauaauucauuuuacauucaucaucgucccucagggcuguaccaagaggcuaauucugcaccccauuugacugacgaggaaacugaaacccaggaagguuuuagaccaaacccagguuuugcagauaaucagguauaauucgucaucugggauccaugcagcucaauuuggggguccuauugaugacagcagccccaauggcauagaaaggagacaccaggguuuuagaucaacucuaacaucgauucaccucuucaguuguuaggaccccauuuucuucaauuauaaaaugaagugggugggcuaccaguguuguuucuaagguccuuguuuucuuuuucuuuucuuucuuuuuuuuauuuuaaagauuuauuuauuuuuuuauuauauguaaguacacuguagcugucuucagacacaccagaagagggagucagaucucguuacggaugguugugagccaccaugugguugccgggauuugaacucaggaccuucagaagagcagucgggugcucuuaccuguugagccaucucaccagcccagguccuuguuuucuaacuauguuuuguuuaugauguggauuuuaaauugcccccugaucuuuaggggagauagagcaagggcuaaggucuaaaugacuaagaacaggagcuugagaugucagcuuuuccucauccugcaaguggccaguuuaagugcccugugccccugaggucuuucacagacccacccaccuggcagccagggugccuuaggucugaauuccugaggcuuuaaagcuaacagcuagcuuuaaaacauccacaggcaggugccugaaguuuacagaaauuaaaaucagguuucauuugcuccuacccuacagcauuuagggaacccauugccaugugccaaauucugugcuagagcagauagaaaaaacagacaauagcaaaguuaaaacaaacaagaagacgacaaccauggcuuaugcuuuccugggaucauaaaauuaucaagaaaaaaauauguaaggaaauagcagcuuguauuaaauagagguugggaucuuagaaaggcaaggauagccccaugccugccaucucugcacucaggaggucaaggcaggagacucaggaaggaaugaaggaaggaaggaagggagggaggagggagggaggaagucaggcagacagacaggaaggaaggaaagauugagauagucugugaaaugcuaagaaagcacagaggugaaaauaauuuucucuuuggauaaucacuaaauagaagaggugauauucuagccccuaaggaauuuuuaauaguuacuugguaaguggagaugaaggaaucacacauagagacaaaagaagugugcacauguauaagugugagaguguauggcaaaaugucaaguauuaggaaagaaggcaccauucggggacugccugcacagcauccggggccagauacagggaaaauaggcuguaagaggaagugggagaaaauggagagaugcagacugauggccaugugucacagccacacaguaugcagcuuugggacacacuuuacaagacagaggucuuuuucuuugagacagggucucacuauguagucuuggcugcucugagcuggccuugaauacauuccggccuaagccauguacugucaugccugacccaguuuugguuuuuugguuuuucgagacaggguuucucuguauagcccuggcuguccuggaacucccuuuguagaccaggcuggccucgaacucagaaauucgccuuccucugccucccgagugcgccaccacaccuggcucccaguuuuuguuuuuauuuuauauaacacacacauacauacauacagcacaaaauguacugucacaaucaauuuuagguguguaguuaggggucacuaaggacgguccugcuguuugcaccugucaccaauaucuagcuccaaaaguuuucauucucaaagccaauacucugcacccagaaaacacaacuccacaccccucuuccucagccccuagcuacuuuguauuucaauuaaauugacuaagagauuuauguaaauggaaucaaauaauauuuaauuaugucacagagcaaaagguuuucagaguucaucaaugucaucauguguauccaaauuuccuuuuuaauuuuuuuuuuuuuuuuugugugugcuuauguggaggccagaugucagacuagggugucuuuccucacaguugccacggugguuuuuacucuuuaaacauuugugugugugugugugugugugugugugugcgugcgugugugugugugcugcgucugcgucccccaguggaggaauuauauguucaugucacugccccagucuauggaugcuggggauccaucaggcccucaaacuugaauggcaagcucucugcugacugcauuccaccccugcccugcccccaacaucauccuucuguuuucaagcuauuccacuguagguguguacuccugaucucuguuccuucgucuauggacgggugcuuggguagcuccugccauuugauuguugugaauagugcugcuuugaacgugaacaugccagugcguguaaaaucugcuucugcugcuuugggucaugagguaguauuuguggggugugugaugcucucaugugaguugcaggagcacaaagacagggugucacgugugugaaguccaggccuuugcuuuaauccucuguuacucucugccuagggcagccuuucacugaagcagcagcuccguuuuggcuuuggggaccugccugucucugcccaccaaugcugggguuacaggcaugcacugccacaccuagcuauguagggugcugaugaguccaacucaguuccucaugccugcagagcaaguacucguaucugugaaucagauuuuuaagggugcugaaacguagggucugccaagagaccuugcaaguuuggggucaguggacugaaauaccaguuagcaaugacucggggaacuguguccuagaagagugaguuacacaggacaaagccaccucaggguuccuguucuugaagcugauggaggguacacguccacugccuaggaagacccuuugucagucuucccgaggaggcugccuguauccauuuaccugccuguaagaaaaagaagaaauuacacagcucugcccuugagcgagugcuugugggcugggggacuccccugaguucccuuaucuuuuagugguugguacauuaaugcuuuuucauucuuguggagagcauuugaguuccuguuauaacagguacaguggcugaccucgggaaaccaugggcaccaaacacaucccguccaauagaagagacaaacaauaaccaaagacucacacaagagacauagaaaucauaaaccaagcguguggggggaagaaaauacacgaugguauuuucuugggcucugccaggaauggccaugagaugugucaaggaaggcuggguggcaguguggccaggaagaauugccugucaggggacccagcucgcaucagagcauggagcccugguugcagaagugcagagagaaaugcacuugucucagaugcugguaacacuaucgugguggguagacgcucugcugugagcuagacuccaacccugaggggcacaggggaagaagcccucgcuaugcuuguagcugcaaggaaggggugacggggacuucccagggaaagugacauuugaacuggguuuuaaagagugagccaaguuccacaguugggaagaagcagccauguccagaaaaaggaagggagucuggggcccauguaaagcaagccuugguggccacgagucagcuucugguagacauucuuggggccgcugcuguuucacaguguacgggggcagacaucucagugugcaggggacaaggcagaggaaggccugagguaaggugcucuccucucugugugcagggaagaggauggugcacuauuuguucccagacgggaaggaaauggcagaagaauaugacgagaagaccagugaacuccuugguaagugugggccugggaggggugugugugugugugggggggugagacugagauaaguugaacgcaucuggccuuaggcuugaggugggaucucagcaugcagugugcaugguaggaaaauggaggucguugggggcaagacugucucugagaacagugugaacgucagaagcccaguggaguuguuuaccugguauagccugucccccaccuccagacaaaugagaggaccagugagccucuugcucaggccgagcguuauagaaacaacuggaaaagcauaucacggaggaggcuguguagaaggggacgggagggaggcaaggcuugcacuucaagcguuuugcuggcuuguucuuuugcuuccugaagccauaccaucagagguggcaagcucugaccuugccuccuagacgucaccaugacaccguauuaaauaugacccucaucuugaaaauggaugagaacugggugggaguggugcguuugcggcuccgaugcuuuuguuccugcagguucccccuccuucugaguaggcucauaaguaggagccccagcucggauuucaggggauuauuugauuugcucggucuguucccagguacaaacggcagcaguaacugacuucccagagcuggugaccagcucugugacccagggcccaaagcuggccgccacgagagcuggucucuuuauuaaguugcaccugaaaugcuaagaccaaugacggaaucaugggcugggauauuuucaugucuuuauucuugacuuuucauuucuuccuggggucugaucgacagguaguauuggugagggaauuucguuuucccuucuccugacagcucauaaaugucuccagcugacaacgugggguauacugguuugcauauucucucauucuccagucuuaaggugugugugcccugcgcaugcucaguugcagucaaaguauugagccuuacuuauuaugagcugcuugggcuccaaucccaauugguuuagucuggcgcuauuaaaaaucuugauguguuuagcauaugacacugauucguuggaaagcaauacaguaguaauauccucacaaugcauuguaauuuauagugcucccaggggggugacagccuuggaaugccagacaggggagaccuuaugaaagcagaggucacgugagcuagccacagccaccaccaccaccacucgcccacccguccagccacagcucuugcccagaccugcacaucaguucuuuuuuuuccauacagcaaacaaagcaggcagagcugccgaggcuacagaagcgcacagacaaacccagcccuugccgugguuguugugauauuacaaugaagaacaagacugccugccugcucuguugucccacaucuccuucaguucugguggugguggguuuggcuagaccuucaaaguuccuucgcuuuagcagcaaggauggaggaaggcuacaauucaccauuuggcugcuuaaccuaacgaugacauuugcacguuaacugggcuucaugccaggggcuccacauggaucaccuccgcugacaucuuccuuaaagccccacaauguagacacuguuggcccccauuucucaguggagggaguaggcucagaggaggugagugccacgcugagaaccccaaagucagaugguaucuuagucagccuggagcuuggcccugaccccgcggcagagcuggaguguuuaaauccugcucacuuugguuggcuuucuuuacucaagaugugccucuccucugcagccuggggcuuccugugcauccugggcagggccagcccucccaaaagagccucccagagcugagguuaaagugugcgccugcaggcccagcccugagacccguuucuuacuuucuaucuccccuagccuucaccuagcuaucaugcaaaaauacucuccaauauuaguucuuguuuguuuguuuguuuguuuuugagauaggaucucuaugcauugccuagacuagccuuaaacucgugggcucaagugcccucuggccuccuuucccacguagcugggaccgcaggcacaugccacaaugccugguuacuaauguauaaauaucaucucggggccggagcuagcucugugcuugcgcauacugugaaguaaaauauggauaugguuuuuguggcaguaaguaaaauaguuuccauuuuuuuuccccagcuaauauacaaauuugauaauuggucaaacagguuuucuauuagaaaaaaaaaaaagcucagaaaguaauuuacagaguagcacuugcugguaggugugcaucugucugggacgaaguuccuccagccgguguuaauaaacauguuagugucaucuuuuuuucuacccucccggggcuguucauucccaccccccacaaugaacgcuguauguauucauagaggaaagagcugaagggccuuguaacaaugaucggaacaucaaaccaacccccagaagaacacagcauguccagggggccgcggcugaagggcagaccgucccccggcgauuacauuuggauuaccucuuaaucugcuuugguauuugaccgccagccugaccaccgcaggccgcauucggaggauauggagcacuuucauccccaggcacuugagcgccuuuauaaaugacccacucgaaucccuccagccuccucagggaugggccaggcagcuguuuaauagccacggagcaguguugcaguguuuuagggcagaaaagaagaauccugcauccaguuuaagcugcagggaguauuuaggaaaggggaauguaauuauccguauuggaagagggccaggccuuggagcuuuggggaaagaggccuuuuaggaucuccacuucccagcccaccugaaagauggggcugcuuucagcagucuggggcgucagccugcuuccugcugacuugggaaaggcccccgggcacugucuccuucauccauccugcagucagacccuuacagggucauuggaagucuucuuuccaaagaccggcccugacucaguccagaagagaggacggagucccagggagcugccuuguacacaccaguuuggguuuaacauauaaucaaaucaggacgacaucagguggagcaguccuccgcugccugccuuaggagcuguccuugaguucgggaacaaagacgggaccagaaagcccaagacugugugugcacacgugcacaugcguacccgaaccacggaacaaguaaggaguucagaaucuuucauuagaucuuuccgcuugaaaggcuggaaaggaaacgugucacauucuuacauagaugugauucccuagggcguuuuacaaaaaugagagccaagagcaccaagcugccacagcccgaggaacauugaaaggagagagaagagagccagcgggucugugcuuuccccuucuuagggugcguuucugaggaagacugaguuggccguccuuaaagaggaggaccaggugggaaguccugcagugguucucgccucuagggcccauacuggugauguccccagggcaaagaguguaacagagcccaugauuaucuugcuuuuccagcccaggucuauaaaaauucaucauauugcuccuucagauaaccaaaccuggccuuuaaauacagaacuagaagcuggguauggagagggccaccuuuagucccaguacccaggagguugaggcaggaugaucucaaaguaucuuugucuauuuuaagacgggauuuuguuaucuagcccaggauagcauauaaccuccauccuaccagccuaagugugcauguguagcacugugaucuguagaccuggaucuuaacugucacguuuggaucucauuuuuccucaguaauucuaccggguccccuggagaauagaggugaaggaagggggcaggugaggaagaaaugccuucuucucaauaaacaaauaaaaauagagccguuagacuagcuguguccuaagugacugccuccuuaggccagugaugacuaugcucugccauucagugucgccagggugacacagggccaggcgguggugacacacaccuuugaccucaggacuugggaggcagaggcaggcgaaucugugaguucacagccugccuucucuacacaguguguucuagaacuuucagaguuacauaguaagacccuaucuuaaagacaccaaauggugcaugggugguuguauccugcccugugagcuguccucugauacuacugucagugugucgggggcgggggggaggacguacuuucccgccucauuuuucuauaugcagcugcugcugggcuucccuggcccuucuccuucugagugcugagggucaaacccauggccucaugcaugcuaggugcaggcucuaccacuaagcugcaccccaggcugcagagcauuuuauacauggcuugaggauccagggugauccuugcucucauggggaguagguuucaucaucaugacauggugagcugcugcuaggaggugucuguuacuuguuuguagcugugacggagaccccagaggcuggcuuccaguugucugagguauuaccguggcuagguuugcauauacuccuggucacaguccauucacuuaaggaaguauuuguggguguaagaaguugccuagaaagcguauuucuaaguuuuacucuuccuuauuaauuuucauuauaaacuugcagauguguuucuagggagaaucuuggcccugagauguaauaaaaccacagugcagagugcagcagaccuuauaaaaagcccacguucaagggaaaguucuaaguuuacaugaggcuucuguguucggcuuuugugcucacaguggucccagcugaugaaaagcccccaggccugaugcugccccaccccggaaacggccguggcccccaccaggccuuucagaguugcucagcuccuagaguggcugcaggaggcugcaggaguuuagcgcugacugcucagcucuugcagcaggacgcccaaacuccacagcccccaucuucuuaacagagcaggaauggaaggguggaagguggagggagaggguggagggcggagguuacuccucagcagagccccucugccacuggcaggugacacugcagccaccagcacagcacucaguggggcucauucccagugcugccgacaggacucccgucuggauuuaugacuuccauaaaauaugugccuugguuuaaaagacaacgagaaaaacuagaccugguagcacaggucuguaaaccgagcacccaugaugcuaagccaggaagauagccguaagaucagcaguagccuaggcuacugaaugauuuucaucaaaagcaaaccuaaagggguguagggcagaggcuaaaaacaauaucaucaacaacaaaagaacccuuucacaaauaucugccuuauaaaaccugggaaacugaaaaucauuauuugcauuaucaaguuauaaauguaaggaucuauuauuauuuuacaaaaaacuccacauuuauaauccguacauuguaggcuaauauuuuugugcacuguguauaagguuguccuuguguuauuuaaauacugauuucucugcccucaugucuuguuucaaucuggacgcagcauugaaauguguacaccaagaaucuccugucucaaguuuguguaagcaguucuuaccaucuauucucugccuugucacuaaaugcugaccacccaguggcugggcagaagggagaauagggugggaugucugccaaccagacgaaggagagaaaggagagagagggggagauucagaucggcuggagggaggauuugaagccaugaggaagggaucuggagagagaucauggaaacacuccuggagcccagagagcgagaguuguaaucacauacaaauaucgugggguggggugggaggccgcagguuagcaaggcgguuacugcuaaccugagagugaugcgcaguucuugguaaagcaauacgguugucagaucuuuucacuuguuuacauuuauauuaaaaacaguucacuuagaguccguuuaaaauguaguguacaaaugcagaccaagcacauaaaacaaacauaaacaaaucuaagaauccaguguaugccgaagacuuuauguguucauugcgaugcuggaggucagcccuaguacuugggaaacugucagugagucccacuccagccugagacuacauuuaaauacaacguuggugcuaucaggguuuuuguuguuggucguuguuuuaaggcagauguaccugaaauaagugaaugucuugauuuggacuuuaugaaucaugaagcaaaaacagcuuucacucaauucauuuuuuucuuugcauggcauucuagaggggggaaaaugcacccaaaggugggugugcagguucaaggaugugcuggugugugggugugugggugcaaggauguguugguguggaggugugcaggcacacucugaaauacaagcaccugaggccaagacacaaggaauaguuugaaaacagccuuggcuaucuaguacaacugugucucaagaaauaacagcaaagcacaacuagaauuccaucuggagaccuagaugucccguuuccagaaauggcuguuaucgccucuuugccuucuuccgggugcucucggagcuucaucccugguccaguugugugcccgccuuugaaauggacuuugcaaguuaccugcugcuggaaugccccaugugauuuccccagguuugugaugauuccuggcucaaauacacaaggcccggcauugagaccaaagccugggcuucucccguuccaguuauccaacgucuugucagcuuuggcagcagcgagcuuuaauccauuacauguuucucuuugcagugaggaaguggcgugugaaaaaugcccugggagccuugggccaguggcagcuugaagugggagagccagugcccucaggagcugggagccugggauccgagcucaucaaagaaaguaaugccaauguaugucuguuuguccagggucuuacggggauugggaggagacuccugaccccuaagggcagggucuauaauuuguucaccuuauauauacuaugcccaccuagccacaguagguuuguguguacaucugaagggucugucacagccucagcagcugcuucagguggggggccauggagaagagcagaggagcuuccuguuugacucugggaggaguuuagggauggggaggagccaagccuuuguaccuuuccccaugaaugguccuugauaggcugggcaucauaccacaagccuauaaucccagcacuggggagguggaggcuggagagccaaaaggucaucuuccuacacagugaguccaaggccaaccugggcugauuugcuuuucauagcccaucuucaugcgcaaggacaccaaaacaaguuuccaguggcggauucgaaaucuccccuacccgaaggauguguauagugugucuguggcccagaaggagcgcugcgucauuguuagaacgacaaacaaaaagugaguaggguggugggcgccuguuuacugugugcggagaggaguggauuggagugagcgcucaggcugcuccguaucugggaggcgggugcucagaguaaccagcuaacugugcggcuccaucgaggcagcagaacucagccagugucugauuuccuagguggcauaugcugggccucacaagacuguuguugaacaacgagugaggaguaaucacauagccauuacuuguagucucugguaguuuuacucuaagguuguuauguccuuggucuggugagcuuggcuuggugacaucacugcauuggcagggagucacguccuggaagguacaccugcuugccuugguggcaauuugagacuuuaagucucagacaaugagguaguaaacccccgucccuccccagacugagagaaagugggcagacguugggcucuccgaaaucucugcgauggcguuucagauucucucuguggucugcugggugaaggcaguggguggucagguuugagaggagauggccggggugggaucacauuuuguuucugccgcucuggcucaucacaguggaagagccuggcaaugaaucuguuucagccugaucgagaaagaggguguggccaccuccacccuggggcuucauuuuguuucuguuuuaucuucuuauccacaagcugccaaacuggccagcuugaugcucgggugcagagccuagccccaugggccacuguaucauuuaccacacucuccuucagguggugugguagguacagucuccguuccccuaagaggccugccuacagggaaguggggaguguggugguggggaaccuccacccaccuccagcgcagcccugaguccuguccuccucuuagcaccccacacccugucauuuuggcaggguuaaagggacaagggaaagggagagaugaaugaauuaauuucaggauuauugcuguacacgcagccagcagccccuguaguggaccuugucuauaaauacagagucauaauaauaaggguuuacguuuauaaagugcgcugaaguccuaagauaaaaggccguuuauucccguuauuguucucaucauuaacaggagucagugccuaaaguggaauuuagcaauuucagacaacagagaaauugccuguaggaaaacaaacuccaugcuucagcaagcauucccuggcgggagaggcccuggguccaaacugggaacaaaagugcuucugauagcacuugaaucugcggcuuagcacuuuguggagcuggcugcugccuccuuuucaucccccagaggucacugucgaauacagauaucagacagaaaugugauuacaagcgagugcuacaagaaaggcuagcuagcucaccaaaaaaauucaucugugagcagauccucugggccccaucuccugcacacauauaccguauauaccguagguggcgcuguuggccaggggcucuguagcuaguggggcauuccagcacccaguggcacccaguggcggggacuggggacauugcagagaugcugguggaggcaagguaggaugggagugcuauccuggaggggugggcuucccacaaaggggaaugguauuuuagugcucacuuugagacugaguuucugagcccuaaccaggcucagcccugcccccugcagguccaucagauaggaagcuagagaggcggccagaugugaccuaugcuuucaacaaagcacaauaguguuuuuauaugugcagggucuaauuuuuuuucagaauacuuuaaaaaucucuuuccuggucaucauaucauccacagcagacaugcaguguaugaauagauguagaaaggcauguaagaagucggcaccacaugaccugugcagagaagaauguggccuccuugcugagcaccugggcaucuguaacacaccccaccauggcacuuuccuuccccuggcgcugugcccucauuuuaguauuccagcaugcaguucccagccaaagcugcagcugccuugcugguaucugccuggccccuggagaaugugguuagccacuuguuuaaagaagugauuucaggguccuguggugguccuccgccucaguauugcuaggaugggcuggggaaggaaggaacuguuucuacaugauucuggugugguacaucuggucccgauaagaccucagccuggaagcuggcagcuguuaaggggaaagauggagugugcuggacuaggaagaugcuggcuuaaaucuagccucugccaugugacugugguauuuaggccagcuucucacguaggagaacggugcuuauacuaccucaacgauuguuugaggaauuugacaauaucagauaccugcgugcucccuguccuguggucaaggugccaaagcaugggaucugaagaaagccuggcuaacugcacucacuguauggugaugaugcugugacagcccuagaagccaggacucgguggucagauaacuugcacaccgccagacucacuugagugugggccuguacauuaugacucugggaguggcaggaaguagggcugccaugugcccgggacaggaaguagggcugcagcagcucucgggcugaagcccucuuugguuacccgccaagcccuugugcaggcuggaggagcguggggcagcgcgcauggaccuuuccucagcagccccgcucuugccucagcccucccucagggauguucacugagccugcaaagggaagggaccggugagggggucacagggaauacaagcaaagcaggccgagaaggcacucugacugugucagaagcacgguggguuccucucauccaggcccuggggacaguucaaguucaguuauuguugcagcaaacccugaguaggugaggugggguggcugugcaugggggaacccggaagguacugcacuuuaaggaguuguugaaccucacccaguguuugcgcugcuggcacuggcugccuccgcuucccagacucguggcagggguagguuaaggaaggggucgacguccccgggauccugagguugccugggauggggacaaaccuugggcugcuucuccuucauuggccccuccugggaguggguguggaaggcgcuucucuguugguucugcuuucuguguauauuugccaggaagauguuaacacuuccuacccggccuuuguguucaccuaaucucugcuguuuaaccuuugacccucugcuauuaucagcgucugccaccuuugcuggccagaccagggccccaggaaaagcccucgcucagccuguuggcuaggaagaggaugaagcaggcauuccacccuguugcaggcagauggaucgccuuucccuggggcagagcuuuggaaaggaaagaaacuugcgguaccauuagggucccccgcccccacuccuuuugaacugucagucuuuaaguaaacauucuuuuccugcguugggucccagcacuuguggggagaggggaaccugggaagagacccccccccccaagccucuucugaacugagggauuugggcagggaggacaggccagaagugcugcauugaugucaacucucugagucccuggggcaucagggcuuuugaaguggacucaguguagcugucaccacaagggccaggacccucugaaguauugaaagccauucucucugggcccagcucuuaagcauguuguaccugccuaaggcauuucccuccuuggcccacacagccucucccucugcaaaaaagggaccccuuguccaagugaaggcuccggcagccccuggccagugcccagcccacacagccaccaaggagacugccaaaugagacuguuugagaggaagggccuuuccuuaggcucuggucuaauaaguguguggggaaaucuccgaccuccccccagccucccccauccccaccucacccuaacuccuacagcacugacaacugaccagggcagcagcagcagcgccucaccccacucugcugcauuuccuccagggaagccugggaucugugcuugguugguuuggguuuuacucuaugugaaaauggaaggcuggaguacugagggcaggaaaaggguccaggucugggauccaggguccuuuagcgucauagcucgucucccuggggagauagauggcucugugugcugugcuuucccucugagaaggcccccugaggcuuggggugcucuuuguguaguugggaguucccgcccugcauggggagccccucugccccugguucugcucaccguuggcucugaggccacuaccguucuuuuagaaccucagacucaaccaggccuuucugcaggcucucccuguuuccucucgagcuuuacagaaaaugggggagagcuguggagggccuagugucucccgacugucggggucgcugugcugguuccucagcagccucuuguguccccacagguacuacaagaaguucuccaucccugaccuagacagacaccagcuuccucuagaggauucugcguugagcuuugcgcacgccaacugcacccugauaaucucuguaagguuugcccagacuuggcaucaggaagaaguuucucaucccucucccacgucccaggauccaagcaucccaaacacuuagugugcuuguuagagaaccggcaucuccuauucaucuggggggggggggugcaggaggagaccaagagagagccacaccccaaagcucucgagguggggcaguggugguaaucacaagccuuaaguugucaccuuggucuuccccuccccagccacaggagcugaggaaguccuucagacccggcacgccuagguuuccucccauacaaggaggcucuuggagagccagagugagaguguggagggagaaucuaguaacugaguuaugguuucucccugguucccuccacaguaucagaagccaaaggaggucauggcggcugagucagaguuacagaaggaguuaaagaagguaaagacggcccacggcagugcuggggacuguaagacgcaguagcuguccugagccuugcaccuccagugaggaggaaacugugagacuuccggcguggguuuuauggcgcgggcagccucuucucuucuaagaacuacagagccccuagaacuggcucguggggaacagcuugcuuccaccuguggcucuguuccugaguaaagucauuugcaguugcucuagaaggacugacugccccuuucucuacuucuguguauugcccgcuccuggauacccugccuucuuagggaagaugguggugugacaacccaccccaccuucccauccuggggaccuuccagcuaacgggggagcagagugggaacaggcugggcaucuuggaacuccugugugcuggcuugccuuauacaagagacucaggaaaaacuccucugaggcaggggugggcaaaagggaaguuuaaacauccagcuaucuuggaaacagcacagaacguuaagacacuaugguuaaaagaacaugguuacaguacugucaaagguguguguaugguaggacagaggcgaaaggucaccauagcucaacagccuagaguccuccgacaguuccuugucuacccccugaggagguucuuggggacacagagccauaguuuuguccuuucccuguacacugccuuccuggagccacuuagaaugaccuaaccaccaaagaaccagauuugucaacaauuaaauuuuauuuuuauaaaaauuacaaugguagcauguuucccauagcaggacugaggaacagcuaguccggaaccccaagcugacaggcuuucuuuguccuuccuucguuucaaagcaaagcagacugguaccucaggcacgagcccagcuccaagauguuggccagaguuaccaucugacugaggagguggcugggaccagcacaaguucuagcaacugcaucucuuucuguccgggauggugagagcccucauuucacucuguaggcugcaguagugcugggaagggcucaggagaaggccugacccuacuguaaacaccuaaguucagguacauucuccuaagagcacaggagggcccacgucagagucagcccagcguccaggacucagugcuucaggugccagggcaugguggccagagaccuaggagcucacucagcagggcugggaagaagagugagguauccccucaccugccaggcaggagaggucccugaguagcugacuugcccagcccccuaagcagggcugcucugucauggguucugaaagucuaagacguggagguuguaagacagcgcagcauagagaugccuaguggugaaccgcaggcaguacacagggcugcugaguggggucgacgucaaugagaaggccugcaagggagacacaggagugaugagaaccucucaagugggagauggggugcucuugcuagggaggaguuuagaccagugaaacuuaaugacgacagccggcuuuagguacaccuugggcucgucacccgcucucagaugcaacccacaaugaaucuugccaucccagaggcauacacugggcagaacacuuacaugcaggcaagcccgcuggcgucggucccacagccgcacgagaccguaguaggaggagccuguggccagcaggugguugccgucugucuguaggcaguagaagguacugucaugaggcuccucccacuccaugacacauuuccuguccaggaagagagagugauacagguagguuuggacgcccucuaccuagcccagcucagggauagagacugguuagggaccccuaaugggcucaagugaugugaagccuuacucaaccaaaccuaacggagccuugggccaccgaggcagcacauccucaucuguguuucccggcagacgaccugauagaggacccauuguagaggcucuaagaaaugucugcuuuuucagucucccuggccacagugaccagagcugccgaaggguagggaaucugaccuugauauggccuugcuggcacggagucucugugcccugggcugacucaagacuaaaaagagccugcacccaugccaggccccucuccccccacccccagcacacucaccguguacuugugcggaggucccaauagcgaacauaggugucauaaccacaggacagcaguguagagggggacucauacaugacaucuagcaccccagccccugggggaaagu

SEQ ID NO: 9309 - RNA, 6120 nt, Mus musculus
ccucccgccugcucgggcuccugagcagccagcggccaccggcuccagcagcggcucagagggguucggcgcgcgcggcgagcacgacauuccacgagccgcgucgggauagccgcuggccucccgcaccccgaccucccucagccuccgcaccuucggcuuguccccccgcggccuccagugggacggcgugaccccgcucgggcucucagugcucccggggccgcgcgccaugggcagcccccgcuccgcgcugagcugccugugaguaccgcggucgcccccgcguccccgucggccagcgcccgccgagcccucuccgcucaccccgcgccucuuuccugcccgcuuuugucucccacaggcuguugcacuugcugguucucugccuccaagcccagguaaggagcgcugcgcagaagcgggggccgggcgcggggaacccagcugacacucucgggcagggacacgaggaccgacccuucggccagcgcagcagggcuggaaagaacuuuacaaauccagccccaaacuaccccgaggagggaucuaaggaacagagagacaguguccugccuaaagucacacagcgagugaguggagagacuagaacccaagggucuugagcccagcgacuggccaguucggguggaugggaaggcuaccuguagccacaccuggccuccuaggaaggcgggagcuggagucagcggguguuccuugucaaggguaguugggauguaguugcagcgaauauccucgccgcugcucucuggggagaccuguggccgguuugggccaacgaucguguuaaccuaggcccuuugcauucucaacauuugcuccguaaauuugucuuuauaaaugucacgggucggguagcguugccucgcuacuuaaaagcacccugcuccucuaggaaggcccgggcggggggccugcgcugggcagggagcccacuucccugcuccgagcuggccgggagccccaggguguuucccaacagguggguccagacucccucauucccggguucauccauccauccugggcugggucugcgcgacuuccccgaggggguugguggccugagccggcauguuguggggaugcccccaguccccgcuggcugccuggcgcggcgggaggcggguacaagggcaauggggaccaacucggggccccugggcggaguagcguuauaauggcgugcuguguauuuuucaauuuccuaaagguaacuguucaguccucaccuaauuuuacacagcaugugagggagcagagccuggugacggaucagcucagccgccgccucauccggaccuaccagcucuacagccgcaccagcgggaagcacgugcagguccuggccaacaagcgcaucaacgccauggcagaagacggagaccccuucgguaaggugcauucccggacccuggagaggagagguagcuuggaccucgccgccccuugccagccccagcugcaucagccagaaaggccugcgggcucuccaccugagaagggaaggaguuaagacgaaaaggugccuuggggucagcuggagagaauaguggggaagggacccuggggaggacgaggccaacaggugcccucucuucccugcuccgcaaaugaaugaauccaggagucucccuuacaaucuucacacaccucuacccggcugcagguggaggcagaggguucagaggagaggcccaaauuuaaggggaguucuugaaagaggauaugucgccagggcccacaaaaggagagugggaaaaagaaaguagagaaaucccccaguucgcccaguuugaaaaagggacagaacugcuaacugaucagaagggucaauugcacagggagacucggccugcaaguuagacuccgggcuccacuguggauaccccaggggacugagucggcuggcggcuucccgcagggcugcugaguacagggagcuacuggggcaggggcugagaacugauugauuucuacaacauucaauauucuugucuugaaauggggccaauuuccagacuccuuggauguaccacaaggaagccaaacccucaggguggcugguguuguuuuuagagagugggauauuguaaguuuaaaaaccuuuaaauaaugaccaacuuaagcgagcaugaaaggagaaaggaaaacucuauuaaaauguaauaaaaaggugaggcauuuuaagagcuaagaagaaaaauggagaaugauauaaaacagaaaaagaaccaggcguuuucuuuuucagauguagaguuugaaaggaguugcaagucuguaaauguuaaaaagagagagagagagaggcucaggauuguucucugcgaaucucuggagagacccccgcgucuggcagagcgauuaaaacuauucuuacuuucaccuuuuuuaacguuuccugaauacuuucuccucuucucgagccaguuugggggaucgaguaugucucgcugcauuuuuuuuucagcaucgacauagcugacuucccuucaaagcuagaggaggagacauaauuuuccugggauaaaucugucacugggguggaagaauagguucgaaaauguuaagcuuuccaaaagccugcuugggaaagucucuguaaacuacacggccaggcuccccugaucgauccgaggagaccagagggggggacucuuugggugggggugggggcagccugccugguggccgagcuccccccgcugggcuggcagagcuggccuucaggcccuuugucccuccaaauuggcugcuugcugcccuucucggcuucccaacaagaaaaaggaaagaaugccgagcuccuccagaguuuacucuacuggagcaaauggccuagcauccuuggguuuuggggugggaaggagaaacuaggcuggcagugaugaucuucaggcauuagcggggucagaugcccacuuacucucuucagacccagaggaggcucucaggauuccuuggucucugccugaagggcagaaauuugagucuggggcuccaaaaagcccauaaaagaggcauuaaggcauauggacugaagagagcagaggagaggucccaauugcuguguuaggaccccaaaaaugggcagagguauucauucugcaauaugacacuuggcugcaauccccagagcaggguccuauaagcccccucuagccggcauccuucuauggccaugaagcaauugcuucuugcucuacaaagcaggcaugagaggaaugaacaguuugccuggagagguggucaggaggagagguauacaguuguaccucccagcugacuuggggacagacugaggacuucagcuucuggguugcacuuuugugucucagugaaauaggcggucagaggcgaggcagugaggacuucacugauggcccugguaccccuuuuaccccugguauugguuaucuauagagagagccacaugucaagauagaauugcuuucucaaggaggaaagagucugggcuuuguaguggggcaggcaggagauccagucucuucugcccugucaucuaauucagcucucucucucuucuggggaacagccucuaagagagcaauuauauaaagagguggucaggacccgcuucuggggcgaguuggcuguccuaugcgaacaggaaguagaggagggcacagcccaagcuuauaccaccuuugaaagcucuggccagugccugagaaacccugcuauaagggaggcgaaggagagaagacgaugaguuguuggagacuguguguuggagcuggacucugaagauugggaagcagggagagggaucagagucugguuccagaaaaggccgugugcuaaagucagcgcguagggagaaacacccucuuccuccucgucucugauucucuuauuuuaaauuauauauguggugugugugcgcuaguaugugcgugcaugcucguacaggugcccacagaggguauuugaucccuuagaaauggaguuucaggcaguugugaaccacccuaugcagguccugaaaacugaacgcugguccucucuacaggagcaguaugcugagccauuucuccaaccccgcucugucacuucuugcagaacagggcugccuaaggggagaaggcuggccggggcugguaauuagaacugccugggcagggacagagcaggauauuuuuuuaccuuuagcuucaugauaggaggucaccacuguucccggauguccuuaauggucugugggguaggagcucacgauagucuaaguuggaaagcuauucagagaucucuccaauagcuauggaaucuacacagcuuaaauuuuacuuggcaccuugaccuuaaaaaaccaaaccaaaugcuucuggcaugagaaggggucuaagggaacagagauuugaugcagccaaacauuucucugaaacuuauccuguaaacugucauuugucucagaauuuuuauaagcccagagguggagucucagguccugaaaagagaguggucuuucuuagggcuauccaacccauccgcaaaugagcugggcugcagccugugcuuucugcuccuucccccuggagcaacuguaccagggauaggacacauccuuggaccccacugagguaaagcuguagaacauagaggccacagauguacugacuguccaucccauaacuucccugacagcgaagcucauuguggagaccgauacuuuuggaagcagaguccgaguucgcggcgcagagacaggucucuacaucugcaugaacaagaaggggaagcuaauugccaaggugagcuccaggagggaagugggccuugagaggugguguggacugccugagccucucuuguacacuuuaaucccaagaagguggguggagaggcacgguaccuugguuaccgcagggcuugcccaaugauuagauggaggaauaagagaaagaaacaaccagagagaguaaaaccuaugaagaugaaggcuagggaagggguuggggguggugauggcaaauuccauauaucuuuuuaacaaaucgccaaauugcuuugcuauuauguccaauuacaugguaccagcauuuggaauguucaguaagccgcaggcccagccccucggccuagcucugaaauggccccauuagucacggcuccucucgagucucgagcgccucacuuccuaggcuucugggcuugggccucagagugccuucuaggcuuccccucccccgcagagggugucuguccugggagcugauccuaaauccagagaugcuggaggguugggggugggggggcagguggagaaacucccggagcccaggccagacuggugggcaguaggccagaacaggcaggcuuugggccccucugcuucgggcccagccccuccguggagagccaugugucacugcugcccaggaggacaggaaguugccgggugggcuguggguuugugagggauuagagagcgggugcccggguaggggguggggccgggcucaggcuccccucgccaucugcuggggugcccaccugcugucuggggccgcuggcccucugccucacaaggagggaggcuccauaacaccucgucugccccccucaccucuacucccaacuaccugcagagcaacggcaaaggcaaggacugcguauucacagagaucgugcuggagaacaacuacacggcgcugcagaacgccaaguacgagggcugguacauggccuuuacccgcaagggccggccccgcaagggcuccaagacgcgccagcaucagcgcgaggugcacuucaugaagcgccugccgcggggccaccacaccaccgagcagagccugcgcuucgaguuccucaacuacccgcccuucacgcgcagccugcgcggcagccagaggacuugggccccggagccccgauaggcgcucgcccagcuccuccccacccagccggccgaggaauccagcgggagcucggcggcacagcaaaggggaggggcuggggagcugccuucuaguugugcauauuguuugcuguuggguuuuuuuguuuuuuguuuuuuguuuuuguuuuuuguuuuuuaaacaaaagagaggcucuauuuuuguauuccac

SEQ ID NO: 9310 - RNA, 4082 nt, Mus musculus
cgcgagcgggcugguuagcagcgcacgugccaggcuccggggcccuucugcuuauacacaauuucuuucuguccuggguuucuucgucccugagacccacuccaucuucuacuucuuuggcucucgcccagcucccuaccccaagcucuguaacucgucgucugcaaaaucgaaauggacacauccaugaauuucucacgcggguuaaaaauggaccugaugcaacccuaugacuucgagacguuucaggacuuaaggcccuuuuuggaggaguacuggugagaccuggugauggggaaggaccaacugcuuugagggaaauggagacagggaaugaaugccuguaaagucuccgacgacgcgcccgccccgguacuagcuccgauuccccugccccgcccccucuuuuaagauaccccuuuaagagauuagcucuagaagaaagggcucagaaaugagaaguuggagagagggaugugggaggagacaaaaacaaagggaaaaaaugggaacuauagcugaggagagauugaccggaaugaagcgguuuuuuuaguugacucucagagagagacagagaggcacacacagacacagacacacagacacauacacagacacacacacacacacacacacacacacacagagagagagagagagagagagagagagagagagagagagagagagagagagagcccgagagcccaagcgagccuuccugugugggcaccuaggauuagcgugucccacacacaauuaucauguucccuuagugugucaucuucucugaugucaagauaacacaaaaaugggaacccugucaaagcuuuccugaggcuuucugucuuagcccuaaaucgucccagacguguuugguggggugacuuuguuguucaaucucgucuugccauaagucagucagauguugcuacacuaucuuacaccacagguuuggacagaguaguucuuggcugggggcagacaacugucaccuucauugagaccucauugacaaagucauaauuacagaaaucucaaaugugcccugugcuagguacuuuagaucugugaauacugccaaggcaccccacuaccccauaaagauaaggaaaccaaagcaucauacugcugaagcucuaguauaaaggagccccuuugggagaugagcgggcauucuuuuaagcaacgcccacugugaauccaucuguuuucugcccuccaggguaagcucauuucucauaguggucgucuaucuguugcucaucguuguuggccagaccuacaugagaacgcggaagagcuucagcuugcagaggccucucauccucugguccuucuuccuggcaauauucagguaaguuaguccuccaccccaugcucucugccuguucuuuaguccuuacaucuccauuuuacccugaggguuucucaaauccucagccacgucgacuucuuuuccauaguaccuggguuuucucucuuccuugagcccaaggcuauggucucuguucuguuccaccccucuuuaaaauguuuacuuuaaaagauagucucuuaaucugcaccccagacugcucuaauagcccacuguguaaccuaggcuagccucaaauaccacaaccguccugccucaguccccugaguucugggaauacagauguuaggcucuaccccauuccucuugugcucgggaaaucuauacggccgacaaaauugucuagccuuaaauaucucaguucccaaauugcucuuccaaagcaaucgaagagcaucaaguuccccagccccuccuuuaccacguccuucugucucuugccacuuuuuccuucugacuggcaacccacuucaagaacccugugcuuaacuuugacuuucaccucucccccuguauccacuggcuuuuucuuaacccauaucucauggagaauacuuguuagaucuaccagauuggccccgggagcucaaaagcuguagccacacuccccucggaagggugaggaggugauagagaguugguuccgacguggaugugguugggucagguucacgccuggccauccccuaaucccuucauaccuuugugcauggucucacuccaguauccuggguacucugaggauguggaaguuuauggcaacagugauguuuacagugggccucaagcaaaccgugugcuuugccaucuacacggaugacgccguagucagauucugguccuuucucuuucuucucagcaagguuguugaacugggugagugcaggggcuuugucuccggugcccagugacuugaauccuuccccagcgcucuucccuuacccaucacauggagagucccggcccuacuccugggucuuagugagauauccccaccccacacccacaccgugagauuuccagauguguucacacaccccggggagggagugguaccagcacuggguggccugacgacuaugaucccucaccucucaggagacacggccuucaucauccugcguaagcguccacucaucuuuguccacugguaccaccacagcacagugcuacuguucacaagcuuuggauacaagaacaaagugccuucggguggcugguucaugaccaugaacuuuggcguccauucugucauguacacuuacuacacuaugaaggcugccaaacugaagcauccuaaucuucuccccauggucaucaccagccugcagauucugcagaugguucugggcaccaucuuuggcauacugaauuacaucuggaggcaggagaaaggaugccacacaacaacggaacacuucuucuggucuuuuaugcuauaugggaccuauuucauccuauucgcucacuucuuccaccgagccuaccucaggcccaagggcaaaguugcauccaagagccaaugagaguaggaaagaaagauggagccucagccguuccuccguggcacuaaggguaugggagaaugauuaggguaccucccuguaugguuucccccaugggauauguacccucaaaguugcaggaagcuaugacaaccaagaaaugucacccuuggggauagggggugugugguuugguacuuugauguuucugucuuuaaugugaaggaaaaccaagcccuaggaaggagauaggacugagguccuuaaaauggaguuauuuauauuuauauuuagaaaucuuucucuucuugcucuauuuuuaaaagaggucaacaugaucuugaggauuuguggacuuggaggggaggggagaguggacugacucugugguaggaggaggcugacucuggggagugagugaucugcagggggggagccugaggguguguggaaggacagaggcacacacaaacacucaauaagaauucuaggccugguaggcgcuuaauaaaugucuuuuacagacuagaaguuuauugcuguuagagacccaagccucugaaaggaacagugagaaacaaguccuaaaaucauaggcuaaacugcagaagagaucgcugcguggaagcacgggugaccagaccuaccggcuguccucccagagaccaccagguggcgucgcagcaccagcagagaacgaucccugucagcuagcuggucacaccaagcuucauacuccuuuuacuccaggagacccugcuucccuauccuggaggaaaggagugagacggcaaccuuagaagccuggacgcucacucgguuccuguacauccagcuguccuuuuggacaaugggaaggaugaagggaaggagggcucaaccgcaagucugaaucaucaggccuuugacaguccgcgcacguuuauuucauugaucuuugaaaaugggauagggggagucuggagaaggcggggugagccaagggugaauuggcccugggggagcuggucccuguuccuggccuuaguccuaggggcgcggucuccgcauaggggucagaccaccgcucgggggcugcgagggaaaaggcccucuucgaagcccgcggccucuucccgggugcucuggcaccccuuucagacccugggacgagggcaagccagucuaggcgaccccuguccggagaggcugugaau

SEQ ID NO: 9311 - RNA, 134005 nt, Mus musculus
cgcaguuaccaggcagcgggcuagacugaggcuaguuaccacgucagugagcugacagggaagguagccggcaccaccgagcgucccggcccacuuacuccagccugcagugaggucucacccugaaguuaggguugccuuccagaagacaggauccuucccuucucucacucgccgccggcgccgggagagcggccgggagacgccuccggggccaggcuggacaugagcugcggcugccgccgguucugggacuaggccccgccauuuuggauccgcugacaggucagcgaagucucuucuuagaguuccagcgucgugagggccuccugacguugccaucaagaauaaggaggaaggguccuucgguugggcgaagcggccugggcgaugggcuuagugggaagaaguaaacccagaggacugaugugagagggaguugggaggugugcaggggccaaaggucagacccuuguccccgagggguguuucagcuccaccugugacucgguggaugcuagaaucuguuuuuguuuuuguuuguuuguuuguuuguuuucccuaggcauaaucuggccugcagcucuucuuuuucagacccuucugcacccuaaaguccucaacaucugaaagcaaaauuaaggaugguuucaggguuuagagagugaaucuuuucagauucuguacaucugucacuucggggugacugcguccuagcacaacugaagcgccccauuaauccugaaagaugagccagcucaguuuggauuagguagucagaaggcauagaagacuggaggcagccgccugagaaccuggccuguaagaucuugcuuuuacaggauagcucagcugucaccaggggucugcauguaaacaccuuucuuucuuuuugagucagguucuuucuguguagcucugguuuuucuggaauucacuauguagaccaggcuggccuuggauuuacaaagauccaccuccuucugccuuaaacucuuuagguguguguuauggguaggcauuuacccacuguaacucccuucuuuuuaaggauaugagguuugaucccaaggcagccacucuuuugugacacauuugauugagaguuaagagggguuugaauacugauaaggcuugguccugguggucuauuuauuuuuaguaggugaaaaaucaugaaaagggcuggagggagacguagcugguugaguguuugccuugcauguauggaguccuugaguucagucccuagcacuucauaaacugggcauguugguccacaucuguaauuauucccuacuugggagauggaaacacgaggguuagcccugacauucaagguuauccucagcuacuucuugaguuagaggccagccugggccaagugagacacugucuuuagcaaagagacaaguuaggagaguuguucugcuccuugugguagggucagggaaacagagugaaugguagggcacaacccgaaagaguguaguuuauggcccaguagugaccuuugacauugcugugucauaaacuggugaaguccuucgaagguaaagaguacguuagagaugagagacaauguaguguuuccugagugcagaagcucauaucaagaacccuagguacaaguaagccuuauggaguauauaaacgggaaaaccugcucugggaucgcucaguuuacacagagucuugcaguaguggggaugggacccuagggucccauaugguauagucaggcagucuaccaccgagcuauacccagagcuagugcgcucucucucucucucucucucaguuguccugacuggucuagaauuugcucuguagcccuugaacuugugauccuuccugagcugcuggguuuacaggccuacaguccuagaucuuccuguauauuucugaaaaguagugacauaugcuagguguagugacagacauuuguaaucucaguacuuucaggaaguccuuccuaugaggaaggacauuuugaguuuaagaccagucuuccuacauaacgagggcaaaaaaaaaaaaaaaaaaaaaaaaaaaaaagccaaguuaaaaguaagagugugccuaauuccuuuuagcagugauggggcccagcaugugccguccaucccugggguuaguguagugugugguuagccuuuguguccuggucuggcccggggagucagcuguacauuugcauggugaguagugacaagguggggcacucuuaucagguauuggaagacagaucaucuaagauguuacuacuugaaccaaguuucucuuacuuaauucucucugcccucuuaagaauggcuguguuagacuauguaaccuguguguguguauguguauaagagaaguaauaguguuuaugguuuauuuguauagauguaaaacaaaugggugggaaugguacagaacacuguuuuguuuuguuuuuuguuuuuauuguuguuugggggggguaucuuuucaacacagggucucucuguguagcccuggcuggccuggaacuugauuuguagacuaggcuggccuugaacucacagagaucugccugcuucugccuccccagugcuggaauuaaaggcaugcaccaccacugcccugcuaauaguggguuuuguaggaugcagaaucuagacaguaguuaauuugacagguuucagaaugguagcccagcaaacacccagguuaggugccuauaacucugccaaguugaaagcgcucugcauaauuggcagucucuugauagguagucugacagcaucuuuucaguuuuuggccuaaaggugacuacagagacuucagagaaaaaucuuuuuuuuuuuuuuuuguacuuaagucauuuucugagcuggugguauaucucagugauaaaggauuuaccuagaugugagaggaggcccuggauuugaucgucagugauguggggcagaaauguaaauuucuacauaggaauaauuccacuaacauaaauuucuuuaagguuguacuuaaacuucuuuuacuagugucuguauguucuagucuuaauggugauguucauuggcacaguaggaauuaaaguuguggacacauuuuaguagcugguugaguuucagcucaacacagucuuucccuccccuguguucuagaagucaggaugacugcugcuuuaaaauaaucacacucagugauagguuguuuauucuagcugcagugggcagcuagagaggaagaaaacauaguucuugcuugugaggagauacuauuuauaaacagcaucuggaaaggccauugauugaucacauucuagugacugaguguggcugauuagcgugauuggauguuggguucauggugggguugggucgaagggagaaggagagauucauuuuaccuuuaugcuggaaaagcucugaaauaaauaauaaauuguuguuaaucuuuuauugcuccucuuuuguaacauuucaccugcauuuauuuaacuaaaggaagauacaguagaguggaaugcugcacuagaacuccgcuagcaguggaaauggucaugaaagugaugacuuauucccaauaauaguggaugugaucauagaagcaauaguauaaauugagggagugugagagcaagccuuauaaacaaggacuauaaguucgaaugcacgucagguagcuacuguuagugccugaaguuagucuugggaguggaggguaguagagccugugauaugcaggcccugguuggaaggggcagcugcuucuuacuccgcaggugguuacuguuugaggaccuaagcaagggugacuagccuuccuguucuuuaguauaugaugaucccucagugggaagauaggcaggcugugugggacugucacugcugccccccagugugccaucacucaagccgguuucuuuguuccacucugccgcuggucaccuaauguccuggguguucugagugguuagugaugugggauagagagaagcuuuguuucguuuucaucucuaagauggcagcuuuggacaggucaguggcuuacccuacauacgguucuagagaucgucucagcagucuucacaaaggaggagauggcguccagagcuaagguacacuggucaccugacuagcagguuugagaggauuuuccagccguggcuggucagaucagaguagcagcuuuuucuugauucuacuuuaacucccacucuuuguguaauuuucuuguguuuaguaagguuuuuguauguucuuccuccauauugguagugcauuuugauugcauguaugugugugcuagugugucuggugcagguggaaguuagaagagggaguugaauccccuggaacuggagauacaaaugauugugaaccacagugugggugcuggggacacuggggaccaaaccugggucuucuguaggagcaacaggugauccaucucuccagccccucauuuuuuugagagagggucucaacugugcagcccagacuggccuugugcuugugguuuuccagccuuggccucccagugcugggaauacagguguguagcgcuguccacgcugagguugguuaaaaagcgcuguggacacaguguuaugugcuggccaaagagaugugcucauacuguguaggagagugaguuagcugaggacgacucuugaggagacacugucauaaaaacaguguucaggagauguuggcaacguucagugccaugcuggguacucccagcacacccaagcgcaagcgucuucauuuugcgguggagaauuguaggauuuuguaugguuuuguuuuguuuuguuuugcuuuuggacaagaucucaauguguagcccaagcuagcucugaauacuuaauucucccaucuaauuaccacaucuagcuacuguggaaaacuguaaagcaaggcucagaaagauuaggaaacuugguuaagaguuauaaguuugugguacagugcuuaguuaaccuucauguagcccugugugcagucuccaacaugggaugagaggggggaaaagcaagaaagcaagaaagcaaaugccugacuguaaucagucaacuagaaguagggaacacagucaagucugucuugcauaacucuacuauugacuuuuaaaaauuuuuuuugguccuggaacuugcuuuguagacuaagcuagaacucacagagaucugccugccgcugccucccaagugcugagauuaaaagugggagccacuacaucuggcucaacuauugacuuuuaaugugaaaugagcaagaguuuacaaaaauggacaagaggaaagcugaacauucauucagcacagaaugggguagcauuucagaggcacagagggagcaaaccaugaccuggagcuugguguguuugcacaccuguacaucccaucaccacuugggacacuugaggcacgaaaauuugaguuucaggcucucuggguuauacagcaagauccucauuaaaaaacaaacaaaauaccaaccaagacuaccacccagagugaguuugcauuugcccacccucugccuuacuagucucaccacccuuacccuugccagcuuuuguuucucugagaacuagacccagaaguagaauugcugagaugaagaauaagaaguucuuuaacuuggcaugaugauaucgaauuguuauucaaacagauuguaucuguuuagauacucucuagccauuugauuuuuacuaaaguauggucagauuuaaauuucaucauuauuauuguuuuguauuuuugagauaguaucuuauucuauaguuaguccaguuuguuuuauaacucauuauguagcccaagcuggccuugaaccccugacagaccucuugccccagccuccuaauugcugggauuacauuucauuauuauaaaauuauuaucuguugucauuauuacuauuauggaggucuaaaaugguuucucacuauaaucuuuuuaaauuuaauauuuuaaacaggaucucacucuguuguucugauuaaccuagaacuuacuguguaagucagauuggcuuuaaacucaaugaaaucugcuugccuuugcuucugaagugcugagaucaaaggugugcaucacuaucccugguuuauuauaaucugcucauuuugcugauuauaaaugaagcuaauaaucuuuacuauuaauuuguuauuuguauuuucaugaagugcauguucuacucauauuucuugcuaacuuuuucuauuuuuuuucuuuuuuuacuucaguuuuuugagauaggguuucucuguguaacagcccugccuguccuggccucgauuuauagaccaggcuggcuuugaauuuacagagaucuuccuaccucugccuccugagugcugggauuaaagaugugugccaccaugccaaaggcuaacucuuuccauuuucauguguguaugguguuguaugcauguuuccguguuugugcaugugcacauguauguguguguauguguaauuccaagguugauauucauaaucuauaaucuuccauauuguuacuaaggcaggguuucuuaaucaaaucuagagcuugccuauaguauugcuagccaucuugcuuuaagaauccuauuucuaagccgggcacuuuaaucucagcacucgggaggcagaggcacacggauuucugaguucgaggccagccuggucuaaagugaguuccaggacagccagggccacagagaaacccugucucgaaaaaaaccaaaaaaacaacaacaacaaauaaauccuguuucugcccucugaggcuggaguuacagguggguuaccaugcccaccuggcauuuauguggagucaggacauuugaacucuggacuucacacuugcauggcaagugcuucaaguaccuauccauuuccugaggcuucucuugcuaaugaaaaaaauuacaauuauuuaccuuguguauuuguguguaugugccauggugugaauguggaggucagaggacaucuucagaagcugguucucaggguugacuguguaagccuugggcaucacacuugaguugucaggguuggcagcuugaagcacuccuuaaggguaaauacccaggagugaaagagcaggcgaucuguucuuaguguauugagaaccuccauauugccuucuauguagcuagacuaguuuacacacuaccagcaaggcauaaggaagaacucccuuuugaccacauucuuaucagcauuuuucauuauuuguuuucuuaaugacugcccuucugauuggaggaagaugauucucaguguugauuugcguucucugaugacugguaaaggugaacauuuuucuuaggcuuauuggccacuuguaguucauccuuugagaagugucugcccacuuacugauuggauuguuugagaccguuuuuccuucuuugugcgugagcauguaugcuguaccugcuugugugguacauaggcacaagugccuuuggagaggauaggucagggucaaguguccuucuccagcucucuccaccuggcuuuuugggauaagggucuuucacuggaugggcucaccugugugaggagacuggcuuggccagcaagcccuagggauccuccuguccacuugcccagcacgcagguuacagguaccugcugccaugccuuuuauuuggcauccuuuuuauuuuacuugcauuuuaucugugaaucugaacucagaucuucaugcuuuucugacugugccaucucccuggcucggcuguuuauuucuuguauauuuuagauguagucuuuugccagauguuuagcuaguaaauauucucuucuagucguaggcugugucuuuacucaguugacugguuccuuugcuguucagaggguuuucucaaugagcucucaucuguccauuauuggccucauuucuugugugacgagagccccgucgaaaguuccuguauauaccucuaucuugaacucuuuuccucuaacagaguuugaggcuuuaugguaagguuuugguuuguuuggaguuggguguuuuauuuuguuuuguuuugugggauauaggagaugggguuuuaguuucuuuauucuguauguggauaucugguugguuuucuuuuauucuguaugauaucugguugguuuucuuuucucucucuuccucccuuccccucccucccuccugccaguccuccuuccuucccuucccuccuucuuuucucccuaucuccuuccuuccuuucuguggauaauugguugguuuuucuuuucuucucuucucuucuauuuucuuuucuuuuccuuucuuuuuucccucccaagauaggguuucucuguguagcccuggcuuacucuauagaucaggcuggccucaaacucagagaucugccugccucugccucucaaggcugacuugucacuguguugaacuuggugguuuucaggacuuucaguuuuuguauaagaaaucuuacaaaaaacaugcaaauuuagcuucuuuaagaaguucauuuuauguguguggguguuuuacauacauguauauauaccaugacuaccuagugcccuuggaggccagaagagggugccacauccccaguuauagaugguuguuaacugccacaugggugcugggaaucaaaccuguguccucugaacaaggagccugugcugugaccugccaaaccagcuuuccagcacuccaagcugaaagcagguuucuccucagugacuuucuguguuggaguguuuuuuuuuuuuuaaagauuuauuuauuuauuuauuuauuuauuauauauaaguacacuguagcuguuuucagacaccccagaagcgggcaucagaucucauuauggaugguugugagccaucaugugguugcugggauaugaacucaggaccuuuggaagagcagucagugcucuuaaaccgcugagccaucucuccagcccuguuuuuguuuuguuuuguuuuguuuuguuuuuuauacuauugaacuguaaaauuucucaauggaaguaauagaucucuuauuacuaguguuuaauuuauauugguaauaugcuaaaauauucuucugaaagaaaucaaagcaguacagauaaagguuugauuauacccuaauuuccaagcacuuucucuuuagauagcagacugugaguuuguauauacuugccuagacccuuuauuuacuuggauuaaaauuaaaacaacugcugggcauaguggcucacaccuuuagucccagcacugggagacagaaucaaguggaucucuuaguuuaaggccagccuggucuacagagugaguucuaggacagccaggcuauacagagaaacucugucucaaaaaaaccgaacaaaacaaaaaauuuaaauuuauuuauuuaauuuuauguguaugaguguuuugccuacaugucugucuguguaccuugugugcuuauggacggcugugagccacugugggguccugggagcugaaucauuucuccagcuccucaguuauuuauuuauuuauuuauuuauuuauuuaugacuuuugagacagaguuucucuguguaacccuggcuacucuggaacucacucuguuggccaaacuguccuuucccucugccucugccuccuauguguugggauugaagguguagaccaccauacccaacuuuagauacuguacuugggauauguuuaucuauauauguaucuguacaaaauauauuaacugugcuucuauuacuuaaagguacauauaaaugaaaugagaguuaaaaaguuaauaaacgucaguuuugcaguaguaggaguuauggacaaaagcaagcuuuguuugggaaguagagccuucaguuguuccacuaaucuggaugcuggcuauuauacgacucuguauccuuuuuaugcuaaauauuacauauuuaaaaaacaaaaaugucauguuucauaugggugguuuguuuauacacacacaguagucagguaaguagucauacacuaugauacuuucuuuuuacuuuguaguaguugugaacuauuuuucucuuccuuccuuccuuccuuccuuccuuccuuccuuccuuccuucuccacccgugucccccccccccccccccccgagagucacuacauagauaagucuggcuucuucacgaguacuaguguuucuuggguuaacuauacugucucuaaggaguuuuuaaacaauggaaaguggcaaauuuguuguuacauacuucuaggauauacucucugcuaagaagauauuuucugggaaaaagugucgugugucuagguugucuccaguuugcguuugugaaagaugacuucacccuuucugcuuugucugccuguaccuacuguggggcuuagauuccaggugcucaucaccaugccugucuucuguaaguggggcugggcacugaacuuagagcuuugugcgugcuaggcaagcacucuaccauaugaacuacaucccuagucuuccaagagaaauuccguuuuucaauauuuucaccuugagaaauaauuaaauaagugcuauucugggcagcaaagacaauccuguaguaguuccuuugggagcauuuacaauaauaaauuaguuccucugccucagccugucucguggcuagaauuacagguguauaccaccauacauggcugucauuuaaauaaucccccaucuugggguugaagagauugcucauugguuaagagaacugguugcucuucuacaggauccagguuugauuuccagcacccacaugguggcucauauacuugcaggcucaacauuuguauacaugaaauagaagggaaaaggcaggcguugccaugugagccuuuaaucccggcacuugggauggaucucugaguuugaggccaaccuggucuacagagugaguucuaagacaaccagggcugcacacagaggaaacccuguuucaaaaugaaaccaaucaaccaaucaaccaaccaaccaaacagcugugaaaaggaaaaauauuaaccaaucuuuucucuucaacuguucugguagguuugucaggaugguggauaagaauauuuacaucauucaaggagaaauuaacauuguuguuggugccaucaaacgaaaugcccgauggagcacccauauaccacugguaaguggggaaugggcagacaggucacugaauuauggacaucucauccuugguuaaaaugaucaacuaaggggggagggaggaguguguguguguguguguguauguguauguguguaugugugugugugugugcauguugaaagaagaaaggggauguaaaaggaaaggaauagguccugugguggauugaauagguaugaccucuaagacucauauguucuaaugcuuggcucauagggaguagcccaauuaggagguauggcuuaguuggaguagguguggccuuguuguaggaaauaugucauuguggagugucucacugugugagacuuugaggucuuauagaagcucaagcuacggccagugugacagucuucugcugccuguggauagagguauagagcucuugguuccuccagcaccuugcuugccugcacaauaaccaugcuucccaccaugauaauaauggacuuaacuuuggaaacuguaagccagccccaaugaaauguuuucuuuuauaagaguugcccugauugucucuucacaucagugaaacccuaauaagacagguccugauagaaggagggagaaaagagaacaauagaauccaugugacaugaaagcacagagggaacaagcuggcuguagugguauauuccuguaauccuagcacuuagaaguagaagcaaaaggaucauacauucaaggcuagcuuuggcuacauaguacguucaaagccaaccugagauguuugagacccuguguuaaaaaccaaaaauaaaggaguggguggguguuuaggucuguaaaaauggcucuguagaaauuuuccaguagaccaaauuugguucggaguacucauauugggcaacucacaacucuaucuucaguucugggugauccuauacccucuucuagccuccuuggguaccuauacacuauacuguauacucaugaagacauacacacaaacacaauaaaaauaaaucuuaaaagggcauaggcuagggagauggcuagcaguuaaacacccuugcugcacaagcaauaggccuagagguuggauccccagcacucaugugaaggauuagugguuaucuagagcuggugaagugacugaguggguaaagcuuguaaucugagccuugaaaggcagaggcaggaauaccuggagcaagcuagcuaguagacuagucauacuaguaagcucugggguuguuugagagcuuagccucugaggauaaggugggagaaugauggagguagaugcccaauguuaacuucaggccuccacaugucugugaacauguauauauacacaugcauaccacacacauauccaaauggaaaagaagaauuaaaaauaacaaccauaaaaacaguggcugguaagauggcuuaguggaugaaauccugauaaccugaguuugaucccugaaaccuacauuaaaaauaagcagagaaacaguucuacaaaguucuccucugacuucgacaugugcaugugaaguacacauauuauacaugauaaaaaaacaaaccaagcccaaaagaaagagaaggcagucuacuugaggggaguagaggaucagcuagaguggcuaggaggaugggagagggcaguggggauuaauguguaggcgaggcuggcugucuuuaaacugaucuugcccccauuucccaaguguuaagauugcaggaaugcauccccaccacccucuaguugaaauccguuauuuuguaggcuaucugaaaaauauuugcaggcuaacaacaaccuagggcuggcaaggugggagaguggcuaaaaccuaauguaugaaucccuguuccauugcugugaagagacuucaugaccaaagcaggucuuaggaaagaaagcauuuaauauuggguguauaguuagucuguuaucaugguggucuacagagugagcagacaugguagcagacuuaguucuagagcaguggcugagggcuacauccugguccuuaggcagcagacagagagaaacugcacauuuucauucagacuccauaccugaccaccuggguucaagucauggaacucacaugguggaagaaaagaacugacucccacagguugucaucugacuacuauaugagugugccuuuacauauagguacacacaaauaaaauacaggugaaaaaacucccccauuaaaacaguagucauguuucugguaauaaugguaauaaugaaaguaaucggaauccagaaguguuauugguaugcaagaacacuuguguuuuuuguuuuauuccagcuggcaucagauuuacagguuuaacccacaagauguccacauuguauacacacacacacauguauagaauguauauauacaugaagugaaaauagagacacauuauuaagaaagggaaaccacuccuuuuuggagacagguuucucugugcaguccuggauauccuagaacuugcuuuguuggccucaaacucacagaaauccaccugccucugccucucaagugcugagauuagaggugugcgccacgcccagcacucuugauacugggagugggcuggugcauuagucacuugucugcugcugugacagagcacuaagcagggauguagacguggcucacuguuucagaacacuuguugcuuuucagaggacccagauugauuccuaggacccacaccaguuccagggaaucuaaugcccacuuuuggucucaugggcacuaggcacaugugugcacagauauacacgcaggcaaaauacccauacauacaauagaaguuuaaaacagaaaagcaaaaaaacccaaaacuccaugucuagggcuggagagauggcucagggguuaagaguacugccugcucuuccagaggaccuggcugagauuccuagcacccauauggaggcuuacaacugucuguaacuccaauuucaggaauccaauacucuuuucuuuuaaaauuaaaaaaaaaaccccuauuuauguaaauggauauuuugucugcuucugugucucuaugugccacauaugccugauauuuuuguaaauuaaauugacauuugggacuuuagcauaccuggaaacauuagaaagauuaccgucuaugauaagaagaaaacacauuucuugggauuggaguuagagaugguuuugaagugcccuguggauggccgagccaucucuccagucccugauuccucuuuugacuugugggcacugagggcacaaacagugcacauacauacaugcaagcaagacacguugucacacacaauguaaaccaaaacaaaggagacucaggaaggagucuccuuugucuuacuuccugggaaagaguuccauauggugggguuggaguguggcaauacaugaccagagcaagaggcuaagagagagauuuuuagcuacaagcaugaagcagagagugggacaugaauucucagaaccuagugacuaacuuccuguaacacuaucuucccaaacagugccacuaacucuggaccaccgguuuaaauaucugagcuuuugagacauucucagucaaauccucacagguagugagcuagagaaagcucucaaaagcuuuauuugaaaauuuaaaaauguuuauuuaucuuuauuuuaugugaauuggugucuuucuugccugcauguauuucuguaugaaaguuccagguccccugaaccuggaguaacaaacaauugugagcugucacagcugagaauugaacgcagguccucuggaugaguagccagugcucuuuuuuuuuuuuuuuuuuuuuuuuuaguuuuuuuuuuuuuuuuaagauuuauuuauuuauuauauguaaguacacuguagcugucuucagacacuccagaagagggcgucagaucuuguuacagaugguugugagccaccaugugguugcugggauuugaacucuggaccuucagaagagcagucgggugcucuuacccacugagccaucucaccagcccuagccagugcucuuaacugugagccagcucuucagucccaccucauuuuuauaauuuuuuguuuuguuuuguuugucugagacaugguuucuccauguagcuuugauuguccuggaacucauucaguagaccaggcuggcccugaacucagagaucugccugcuuuuguuucccaggugcuggaaauaaaagaguguggcauggccacccaguuauaaaucuauuuuuuauuuauguauauguauauauauguguguguguacaugcccacacauacgcaugcccaugugcauacagugcuugaaguaccugaggaggccagaggaagguguccgcucuucuagagcuggagcuacagguaguuauaagcagcuggaugugggugcugggaguccaacucagcugcuguacuguuucucugucuccuuuauaaauuaaguucauauuugggacuacuuuagaauuccuagaaacaccagaaagacuuaaauuuccuagggcuaaguaaucaaauucauucaaauuagguuaguuauugauaauacauaaaguacagcugggugaucccaauucuaugcaguggagucugcaggcuuccacauauggagcagaccuuaucuuacaaucagauggguaagaaacuuaguuauuauuaggucucaggaaguccauaugcccauaaugagcucaggcugaccuauagaaggauuucuggcuauuagauaaaagccagcauucuuaaggaguuuauaaagugauuuacuuguuuugguuuguuuugauuugguuugguuuucguccccaaaaggagcuccuucccccaacuacuccccuuucuccuauacucugcaugguuugcccaccccugcuauccuaagcucccgugcucucuugcugugucuguuuugcuaucuccacuauucucucccauccuccagcacccuagcccugccauguccaguauguuucucuuuucucuggcucuggacucuuccagaugucuauggauauucacuuucucuuauucaaauacaaacucuccuccucaaagagugguuaugucugcaguuucuuuauuguaccucucacauacaguuauaaaguuagcuuguuguuguguguauguauguauauguguguguguguguguauauauauauauacacauacauauacacauauguauuguguaucuauguauauuuaauggaauugguguaaaaaauuuuggcacaauuauaaaaacaaguuuagugcuuucugacuagcauuuuacccacuaacccaucucucuagccccccuaauuaauauuuuugaauugacauaggaacauuucaaacauacucaccaaauaguuuauauauucuuaucaaguuagaaaguucaaauauauuuuuaucauguguauauauggaauaaaaguacagacauguggauuuguauauacaaacacuuagauaaauaauguuggccauuuuuuaaaaugucagucccuuuuugugugagaaaauuuaaaacacccuggggcuucuagauauguaaucaggcagacaaauaaaacauauacugauaguacaucauaaagaaauuuauuuaaaaauaauucugagauggcuuagaguguagaguugccugccacucugccuggugacccaaccuugauccccagaacgcaguggaaggagagaagcaaguccugcaggcugggcucaaggcaugaguggcugugugcauacaugcauguacaaaacaaagaagugcucuaaaaacauucuuugcuauacguauaaucuuacuguuuauuaaagauuaaagcagauuugcauacuaaugaggucuauguacuuauauauucuuacauaaagaauuaaaccauggcugagucuuugguacaggaggauguagaacguugucacugcucuucagaguugauaguuauuuugauuuuauuuuguaauuuuuaaugcugacagugcaauuuugcauaaauauguaguacacaaaggcagaagaaguauguuaaggaacauuucagaaauuguuggaaauccuuuugucaucuuaagccaagauucauuucaugaucuuuuuuuuucuuuuuucugguuuuucaaaauaguccuggcuggcuggccuuacuuuguagaccaggcuggccucgaacucagauacaacugccucuguuucuggagugcugggacuaaaggggugcuggcucgugauuuuuuuuuuuuuuuaaaugaagcuuguuaguaacacaaacggcaauuuuaaaaccaaacauucuaaaauauaauacaaagacauacuaauuugauaccuacauccugaggagugacaguagaaaauauuuuuaaagucuuuuuuuccauaacuaaacuuacauuaugcuucuagaagggcagaacauuuuguauguacagugaaaguacugcagcucaucaaacaucccgguuugaaaucugaggugauguguuucaggcaugcucauuguaaugcaagguguggcaugugcaaugcaaaguauaugcugauuagagcaguggcugccaguggugaaguagggaaaggcagcuugggggauagagcugaaacaccaugcauucaucauucugggauuuugaauuaaaauuuggucauucuguauucagaaacauugcuguugcuaaaaacuucaagaccucucacauuuaguuaggugacucccauaugggaugugauucacaggagaagcuggguugaggccgaccauggcgugccaccuccacccuauaugcacaugcauacaaaguaaauaaacuguaagaaauauuaaagagaauaaaagaaacuggguucuaggcuagcacugaagaacuuauuuucgguaaacucccagugccucugaaagaagagaguaaggagcuauggcuaaguuucuucucucagagggaaacuuacuagauguucugguuggauuuagagaaagaguuuugaucuuuuguuuucucuuuccuaucuuggacuaaucauuuuuuucuugaccuaugauuuccuaggaugaagaacgggauccccuucugcacaguuucaguaaccugaaagaggucuuaaacagugugacagguaaggcccacguguaggaaacaguguaacgggaggaauacaugaauuugauuuacugcagggacagauaaaauuuucauauaacagaucauaugggacaaauaaauggaacaaagacaacaagaccauauaguaaacacuucaggcuuuacaaagguugugugcagcucagcugcucaccucugccuguugagcucacuagucauagauaagauguauaggagaaguguauaauuucuuuuuuaaaaaguagcgagucagauuuggcuccuggguaaagcuugccaaucuuuuagucuuccuauguucuccgguccuuugauuuuuauuuuccuagucaaaucaacuuuauguaauacucacauuuagaguuuucaaagccgcuuccauauuuauuauccucgcuaaguuuuccccaggugugugaagaaggcaaucauaauguugucuccuuuuaugaaagaaagcaaaucgauguagcuaaagggcuagugguguagcucaguuuguagaguguucaucucucacaaauaagcccuagaugcaguccugaugcccaucaaacuggguaugggaugcccauaucagcauggaccuguaaucucaggucuugagaggagucaagagguugggaaauucaauaucauccuuuagcuacauacuaguuuuaggccagccuaagcuguaagaagagaccuaucucaaaugaaacaggcagauagacagacagacagacagacaaauaaacaaacgauacaccuaaagugacuuagcuaauuuauucucagagguggaauggaguaaguuuuaggcugcugacaccugguuuagugcucuuuuccauguuuuccauugcccugguacauuuaauuagaggagacuguauguauaaaaggucuuuuauugugugugggagaagaggguaauaaaaggaaaacaaucaguuccugugaguuuguuguuguuaguuauuguucuuauuuuacucuugugguuuucccccaauacagauugaaagggagugucuuagaacugugguuuuguaauguagcccuggaauccuguuagcuggugguauaucucagaccauaauugaauaguauuuagacuucaacaaacuaaacaaacaauaaaugaaaaauguccucauuuuaugagaaacacaagagaaaguuuggagaacaauucuuaguuguuuucccaagauggaagucacuauaaaggaacaccuuuuacuuugaaaggcuuuagaucuauaagccaggucugguggcuaacaccuguaaucuaagcacucaggaggcugagacaggaauaccaugagauugaggccagccugggccacauagugaagaauaaggagcauacacagggcugaggcuuccuuccucuguuacuuugaauacacaguacaagggacuuuguguauauacugaguuccacgagagucugggcuauaaaaugaggcccuguccuaaacaaguaagcaaauaaacaauacaggcauggugguacaggccuagggcaggaggauugaauuuuuuuuuuuuuuuuuuuuaguuuuucgagacaggguuucucuuuaguccuggcuguccuggaacucacuuuguagaccaggcuggccucgaacucagaaauccgccugccucugccucccaagugcugggauuaaaggcgugucccaccgcuuggcuaggauugaaaauuuaagaccuguuuaggcuguagaaugaguucagggccagcagagacucugucuuaaaacaaaaaaaaaaaaaaaaaaaaaaaaaaauucaaauggaucagagauacagcucaauggcaguacauuugccucacauucacgagauccuggguucaaucccuaguggcaaacaaacaaacaaacaaaccaaaaagaaugaucuugaaacaucaaauauaggcaguggcuuagugguuaacccgaguucuauucccaauacucaugucaacaagcagcucaggucacauggaauucuugagugacgacuuuaccaguucuggcucaaaacuuucccuuuuuuuugguaagcauagaaacuuuugcauauauacaacacacguacauuuccugucuaaggaaauaaccgugucuccagugaaguugguugaguccaaaccacuuacucucacagauguaucuuuagaaaauauuugugucaggagucacacaaacugggaugacuaaauacccuacaauuaaaaguacagaauuuuuauauuuuuauuuugacuaaaaaaaugucagugguggggaccugacuguucccucagucauuacaggcuccuggggugcuuccuguuucaggaaguucuucugaaagcagagguaugcucucuaggacugugagugguuuuuuaaggggcaaagaaaguguuuuaugguuccauaacucugaaauuguauacugaauuguauacuuuauaaggauagauuucauaguaugugaauucuagcucaaaacuuguuuuuuaaacuguagucagcguccugcugugcuccccagcugugcuccucagguucgcuuuggauucuggacucaagugaugcugugcuaaguuccucaguggcugggacuguggguguggaccaccccgcuucauaguucauuuaaaacaaaucaaacguaagcuaaaacacugaugaguucacaugucucagggcucagaaugcuggagggaagccuuugaguguagucauggccgagcuuuggacccauugcccagcaaaggcagcauaaggcucuguucagccucuuggcccacuuuguccuuuuaugucucucucauuaacucaaggaagcacauggcuuuuauauuuaaauuuauucaagcuguaaucuuugacauuugaguuagcuuuuaguacaguuuugcauuuauaguaauauauauuauguauuuucucuauccccaaagaaucccuuuuaaucuuuuccggaugcaaauuucaggcugucuugucccaucuccccucucuugcucucuuuccccuccccccacagaguauguuugaucagguguggcaggaauauccacugucaagcugcgcccuuuauauuagucaauauuauccuucuccccccucccugucugucugcuccuuugggcuuucccaguugauuuauaauuuuggaauucucaucggagucuguaauacaguuuguucauuauuuaaccaaaaccuguuuaaugagcagagagaggcaauguaaauguuagacauguugcagugauguaccuuugugcuucuuagagcugguggguaguuaacucugugcugccugcagggcuggggguauccugggcuuaggggcuaaagggccacugugggagugggagugggaguggcccuuuugccccuaugugaccuuuaaaucugcccaaacacugccauagcuucacauuccaguaauacauuuccuuuuaccauucuaguaaucuuauggggcucuggcaaaauacuagaguuaugcucaaacuagaaccugugguaagaucuguggcauggaaugggccguaacagaaaggucaggugucagggcuucugguacugcucuugguuuuaggucugaaaaaagaugacaguugagaacagugauucuagcugacgugguuugugaucuuuggguaauuuuuugccagacuagguaagucuuuguaagucuuaauaccuucauggaauacuuuuauggaaugaauuuuauucaguuaugauuugugguguuuggcugugcuuauuuguauccacauuuagguuguccuuuuucuuggucuucaagcaucuccucuguauguuuguguucauguguguccacaaauuaguaaauuacaucuacaaagggauucuuugcuagaaaaaucuuggauuuucaucagaaagaaauauucuaaaauuuauaacaaaaauuucuuacaagauuucuuuuuugaggaagacuucucauauauauauguguguguguauaaauauauaucuccaaauauauauauguauauauauauaaaccauauaugcauguaauauaugaauguauguauauaaaauaacugagagagcgugagaaccgagguguuuguguauggugaaccaaauguuguguuuuuguagccucugguguuacaagacuaauggcugucaaaccacucugaaacgacuugagaucucugaucuguucccuauaauaaugcuuccaagguguggagaggaugacagugaaugaggacagcuggcggccaccuucccuccuucucucacucuuugacuuggucucacuauuuauuuagcacaggguuauuuucccaugugcuugguuacagguuucuguugccaugucuagcuugcugccauuuuuguuguuguuguuguuguugaucugaguaacaagucaaggagaaugaauaaagguuguguuuuucaagguggcuuucucauguaaagcuguuauaggccacaauuuagauguuucuaaaggcuucaguggauugcauagaauacaucucagggauaggcuaucucuuuacugagcuaacugggauagcaggaacucugacauacuugaguuuuaagagggagaggcaggugccuggagaaagugaauguuggaguuuauuuaaauauaguuuaucuuggacaaacacaccuguaggguacagccugccucaagcuugcugaauucagcaucugagcaggagguuugaguacaucuacccuccagagguuucagagaacauuuaaacagagucuggaagccaaucugggaggaacuaugacuuaacaccugucuggcccagaccucuuagaaauagcugccuagguagaaaagagcuucucaaggaugccugauuacccuaggaguaagugucaggaaaaggauugaacacauuauauuagaucacuagauuuauuuccuguagagauugaauguauauauucauuuuuucuauaggugucucuaguuuggggaauagcagaguaauagaucauuagauagccccugaagagccaugagugagccauugacuuuccuucacuuggaacugaaguaaacuuuuuguuuugcuuuguuuugaggcagggucucacuauguagguguggcugguggaauucacuauguagaucaggcuacccuggaaugcagaugucuuucuaccucugucuucugagugcugagauuaaaaguguauaucacuaugucuggcaagaauugaacuuuuaaaauuucaagguauaacagaaaacuauuuuuguuucuuuuuagaggaaauuaaaagaaccaaguuugucagauaaauuuauauaaaugacugaauauuggaaggggcaaaguuggccaaauauauguauuuccuauaccacuuauuuacuuucuugguuuauaauaaacauaagaugauauauauaaauguaguauauauuuacaugcauacauacauacauacacacacagagacaaaacauaagauugaugagcauguuagaguguggcuugauuacugggcacaguaacuauauuuccagcuguuugcgaaguagaggcaggauugcugaggcucagcaguucaaaucaugauggagcaacaaaaugagaccuuguuaaaaaaagguuacaagauccugccucaaaauuaaggugaagaauaauagaagauggccaauggugaccuuugguucaaugaucaugagcucauguagacacaaacaugcauacauaugaugggguaauaaagacucuugagacuagauagcugggugugguggugcgugccuguuauaacaugggagacugacgcggcugcaucaugaguuugagaccagccuggauuauacagguccaggaagggaugagcauagugagacccugucuccgaaggaggaagggaaagggaaggagaggguucuguauagcguugcuucuugggguacacucugccuuuacucgcgguaauacccagucacacagccuacagaagcaagucugccuggcaggaauauuuguuuuuugugguuuuuuacuauaucuaauuauaaaggggaauaauaauaauaauaauacaaaggguauuguuaauauauuaguucucaaacuaaaaaaaauaaaaauaaaaauaaaagguagcagaggcaccugagcacuuccuagcauagucuguaggcacuguagcgggauggccucaggugcuaggugucagacuccuuaggguugcuuuuauugccuuugcugccuucuuuuuuuuucagacuuuaucccagucuacccuccgacuauuccacacccauaacuccuuuccuccaucuccacgaggauguccccaacccccaucccccagaccuccccacucccugggccucagucucuugaggguuagguacaucuucucuguucuuuagcacuguuucucucucgugagggcugagugucgcccuggguauaugcccaacuugcugugucagcagucagucgcauaaaggagggaaagccagcugcucuuuuguuuuuaaccaggagguaguaaacucuuucuucuacacccacucaaacucugggcaaaugccaaaaggauuuacagaaagccaaauguuugaaauccaaucaauguguaguuuuaagcaggaaagauaaugaaagguuuguuuuaacucuacccuucucuaccugccucauguucauaggacgguaacuaaucacccuaguuucugaaauaguauaggguauguuuguggaaagaaugaauaccucucuccuccuccuuagaaccauuaaaagagaguuagauauauagcaaaauacaaaauagaacccuuuagcucagaccacuuuagaaauucacgguagguggugagaagcucugacuuguuuguggucucacuucugccucaggaaguccacaggcagugauuccccuuuucuguagccuuugucuuauaaccucugggacuuggauggacaagggcugcuggaugccuucuggcuagcuucucauggaaagucucuucuggaacaccagccuucuguuagccaccgcugccacuguaggucauguucugaagggcugccacaugugcacagagcacacugacauucccuuguuucaugcuuccugagccauuacuugucagcuguggaguucacauuauugccuccagugugaacuguggguguuuuggaaggagucugagagacugcaucagagggaaauaaaccaucacuggguuggagggaagagccagaugugcuguaggaggaaggacuuucugucgucacccaugcacuugcuuccacauguuccauaucccggaaagcagcuuaagaaauggaggauaaggguagcuggggacaugaugggauaggcaaaggaccaagagggcuucaguguuaucuaggauuggccuuggauugagaaaaguccuuuaaaaauaggaauaaauaagauuucccugauauugguguuuuccauuaguuauuuuuguuuuuaaauaauuaauuggcagaaaaauaaaacaaaacuggaaaacaccucauuccacaugaauguucuuuuucuuugaauaaacagcagguuuaaggaaacuggcaccugaggcgguuaagagcacuggcugcuacugugcucuagagcucaccuuccacacucaguccccucauggccgcucacagcugucuguaacucagugccaggagauccauggcaccaagcacucacauggugcacauauguaucuaugcaggcaaaaugcacauacacauaaaaaauaaaaauaaucuuaaaaaaaagcuggcacuaaauugacuuaacaaaacaggaacugaggugauaucaugacugucuuacagugagcuaaaauaauauuuucagauugcuucccauagugaauuauaguguaacagugaggugugugacaucucuuacgcaauuuuaauuaaugaauuauuuuuauuguuacuuuguauggauguagagugauuuuuuuauaccuuuaccuggauuccagggaccaaaugcagguugucagaguuugcagcaagugcucuuuaccgagcagcucguuuuuccagcucaccuccuaauuacuacuuuuuauuuuauuaaaacuguuuuaauuuauauuuauuuaguagaucauagauaguuaugauuuucuaacucuaucauucauuuugcauuuacuacuuggcguucucugugaacaguugcuuuccucuuuaccuggagaauaagccaaaaauuuuucccuagaaaggcaugguaaaccuuuaauucuugguuuuaauaaguguucaaaacagaaaguucauauaaauaaugaccauuauugaugucaaauuuauuuuuuucuuauuugacuuauaauuagucaaugcugauaaguaaucagguauuacuaauauuuaaguuguuucaagcuugaccagugaaaccaucuuuagacugguuaguuacuuuguucuauuaacaugccucuuuugaguacuucaugcuuucugguaaagcagguaacauuaauggagaggugggaaaauaaaguagaagcuacugguguaucauauguuaguaauaaaggcaaauauuacuuuauuucauucagagccuggguuauggucauuugguaaagugcuugccaugcaagucugagucucugagcucggauccuaggacucagguagaaggcuagacacaguggcguggucgguaaucucagcucgagaugugggaacaggaugccuggguggaagggccagccaguuuagccaguuggugagcuucagguucagugagagacuuuuuccagaaaauaaagaagagaucaaggaagauaccuaguauaaacuuccgauacacacacacacacacacacacacacacacacacacacacacguguuaaaaaauagaaagaaaggaaggaggaaggaaaggguuauagucaagcugcguuuuuguugaugauacucauaacaguuagaagccuggcagaguuaauucccugcucccagaacuguuuuggauuugcaguauuauuucuuggacaaggaauccaaaagaguguugucaggaugucccuccuacuauuuauuuaucuucuccuccucuuccucuucuaacccccuuccuccuccucuucuuccucccccuucuuccuccucuccuuccuucucccccucuuccuccuccucuuuuucuuccucuuccuccuucucuucuuccuccuucucuuccuauuuuuuucucuucccccaucacccuccucugguauaaaucuacauccgugguucauuguuaguacucacuguaaguaaacacauuuuaugaacagaccugaugacuuuggugaaggauccuaguuaccauugcccaggaaaaaaaguacuuggcucagcucaccuggacagagauuguagggaaaacauuugcagggaaaauggacuucuguugucagaauccaaauaaggcucauuaauccucccaguugagcaccagcuuagcaucuuaaucaguuuccuuucaggguuuaaagacucauucuguuuucuacauucuaugaagaaaaaaaugaauagugccugcuuugauggaauuguuauauagguauggaaugggagauauuuccaggguucuugguagacuacaggcucaaguaauaacauaaaacuggauuguguguggacuaaggaagauaagggaaauguuuauguugguauaauuuuucuccaaagaccagagguaaagaggaaguuggcuuguuucuacaccagagauuauuucaccccuauuuaccuaguugauguuuuuaagacauuuuuaucagaccaaccgauaguaauauguaguuuuuagaaucaugcuuugaaauuuuuguuuguuuguuuuguuguuuauugagacguauagugccuaaugcuggccuagaacuuacucuguagcuuaggucagccuuaaacucacggcaauucucuaccuuguccuucccaugcugggguaacaggcuuguaccaccaugcccaaccaguaauuucaaacuugcaagaaagcuguaaaauuaauacugaugucucccauaugcccuuuugcuaguugauuuuauugucuucuuucucacuauacaguuauuuuuucuaaauuauuugagaaauuaaucauaugcaccuugacacuucaguguguguuuccuaagaacaaagauauuucccuuaaucuaaguaaaaugaucaaguuuaagaaguuuaaugauucaguaauuuaccauuaauguuugucuaaguuaagguuucuauugcugugauaaagccccaugaccaaaagcaaauuagggaggaaagggguuauuucaucuugcaacucugaggucacauucaucauugcaagaaugaugaauuauuauuauuuuuuuaagauuuauuuauuuauuauauguaaguacacuguagcugucuucagacacuccagaagagggagucagaucauguuacagaugguugugagccaccaugugguugcugggauuugaacuucggaccuucggaagagcagucgggugcucuuacccacugagccaucucaccagcccagaaugaugaauuauuaauuccugccuuauucaaggcaggaaccuggaggcaggagcugaagcagaggacaugaaagaauguuuccuauuggcuugcuccugguggcuugcucagggccacacgccuagggguagcauugcccacaguggacugggccuucccauaucaaucuuaauaaagaaaaugccacacagauuugcucccaggaaauucuauggaggcauuuucucuuaauugauuuuuucuacccaguugacagaaagcaaccaggacaguugacacuugucaguuugacccacaaacacauuacuguuaacuucuccuuccuuccuugucccuaagaugccauauuuauauuaauaucacaauauaaaacauuccaacugugugggugaucagagggagggggaaggggauaggaguuuucggaggggaaaccagaaaaggggauaacauuugaaauguaaauaaagaaaauaucuaauaaaaauaaauucuagcuuuuaaagucccacagucuuuaaaaauucacuuuaaaauuucagugucucuaaaauauccaaaaauaucugguaguaguggagcacaccuuaaucccagcacuugagggggagaggcaggcagaucucugaauuugaagucagucuggucuacagagugaauucaggacagccagaacuauauagagaaaccauguccaauaauaauggugaugauaaauaaaauauccaacauuucccuaaaacgccacaguuuucagagagacucugaaaguucacaguuucucaacugugggcuccuguaaaauaaaaaauaaguuacauguuuucuuauuccaagacuuaagaaccaggauacagcuacauugaaaucagagcaaaacuucaaauucaagugugcaaaguucagugcuugaugucugggacccagucaagguccucugggcuccacagaaucuugccuaagucugcuucucuagcucugucauccacagcacauacagcuugucuccuaggcgaagguugguucuacgccacaauugcugcuguccuugguguuccuucugugguauuggcaucuucaaaaugaugcaacucugcugagccuucacuaaaagcuucuucugagcucucuucagggacuuugacccugccacuggcugccaagccuuaccuucucuccaugaccacuucaucgcugcugcuuucacugcagcugagccugcacauucacaguguuaagucucagcuauucucuucaaucuucaaaagcaguaccaccugggaaacucuuaccaaggucagcuuccagcuguccacugacccugaagagacacuuuccagaagaguuugcaucaauaauacuggucucuucuuaaucacagcugauucuucagccccaggugaccauuaucaauugucccagcaaagcaaagauuucacucuaguuguuuuggccucuuguuagucacagccucagauaaccagaauaacagauucuuaauucaaaauaucaguuucucaaauagucuuuaaggaccugugaaaauuuccauuaaaauuucacaagccaggcuccguugucugcaggcuuuguuucuaccaucaucucauuaagcuccaaacacgcauucaguggcuuuucuagcccaaaguucuaaacuccuccauaaucaccccaaaacaacaaguuuaguucugucacgcagugccucuccugguucugguuuauguguuaguuacaugucuauggcugugauaaaccgcugcaaccaaagcaauguggggagaagaggguugucuuuccuugcagcucucaguccaucauugagggaagugagggcaggaacuuagggcaggaaccaaacagaagcuauggaggaagacuucuuccuggucugcucagccagagcaggugcugcguauacuuuccaggaucccagggguggcauuuuaaacagugggcaggcuggccucaaacuaauagagauucucuugcucuguuucccaaguguuugggauuacauacgugugccucuacacuggcuaugacauugauaauuucuauaaucacagauaagguucauagaucuauuguccaucuauuuguucuucccucucacuuucucucauuuuuuaauguuuauucauaauuagauucggguuauguuauuuggcaugaaucuacagaucacugcuaauacaguaaugcuuuuauguugucauagccauaguugucauuuauaagugauacuaguuuuaaucaucuaaguauugcauggauucuuuauuauauggguacuacuugcuacuuagaaccaauaagccauuuauaggagugaauuuugaguagucuuuuuuuuuuuuuuuuuuuuuuuuggugggcaggggagaggaucuaauauagucaagacuagcuucaaacuuacuucauaguugaggaugaccuuauauuucugauccuccuguuucugagugucgggauuacaggcauguaccacaaaaccuguuuuauguauugcuggggauugaacccaggacuuuuugcaugauaagcaagcacuuugccauuugaacuaaauccuuagccccuuuguuuuuuuuuuuuuuuuuuguuugcucuuuggggagauuuacuaugcuguucagguugguuuugaacucaugauccuccugccuuagacuuccaaguacugggauuaucacagugcaccaacauacccagcuguaaugcuguucuuuuuugaggaaaauaaguuacugacugagcagcaagguuuuauaacacuguuguucuuaaaacacugggcagaaccuuacaaaauguuuuguuguuguuguuuguuuguuuuuaaacaaaugauaagacaacauuagaagcagccagaguaaagguagaugaagaauuuaaaucauaaaaguaagacuucacuagagaaaauagaagagcugaugaaaauaagcuccagugucaaacuauugcucagaacaucuguuaaagaaguguucacacugcccacacggcaccggagcuggucuccaggagagagucuuauagaaugugccguacugugaugugucaaucagaagcacugaagcuuccugagugaagccuggcuuugcaccuuuugccuuuagauauauaacucgcaaaggucuuagaaaugccgauguuuuucugugaacugauauguugaaaaugagccacgggcuaagagcugcacagcaccacacaguauuaugcugacuguucucaccgacaaccucuagaucaugacugaguaauugggaagaugggacauucuccccucuuuuccuuugauagguagaacaaaagcuauuugccaaugaagcacuucaccaaauuggugacuuuucaguaauccacugcuaaguauacagugcuacaucgacuugcuguuuagucuccaaaauauuaaaaaauuuaguguguaauccuagcagugggaaguggguuggauaaggcugcccccagcuauauaauauguuugaggcuagccuagcuauuugagacuuugucacagaaaaaaaaaaaaaaaaaaaaaaaaaccauaguuuugauguuuccaaaaagauuugucuugaggcuagggagauggcuccagugauuaagagcacugucugcuuuuccagaggacccaguuugauucccucacaaccacuucagucauaggggaucacacaccuucuucaggccucuacaggcgcuuuacacacauggugcacagguguacaugcaggcagaauacccauacauaaaaacauaaauuuauuuagaaaaagauuugucucaaugaggcuugacuggguggggucuugaucauuuccuagaauuaugcuagcaucacccaguggcgauuuuuuucuccacucaaccaaaagcacaaauacuuguuuuuuuaggucagauggcagccauauaaaucuuuucuuuauuuauuuaucuaucuaucuaucuaucuaucuaucuaucuaucuaucuuuggucguaguggauuaaaccuggcagccuugcccaagcuaaaagcauacaagugucugcuacugagauguauacccucaggcccccuguguuuuauaauaaguggaauuggcuuuaaauucauccuccuauuucuacuuuuaaucucagaacauuuaaaaguauguggggugggguggaaagauggcccauuggugaagggugcuuacugcucuuguagaggacuuggguuuagcucucagcucccaugugacagguuccaauuuucagacuuuuaugggcacugugcacauaugguacacauacaaacauaaaauuaaaggaguguuuuaaccaggcaguggugguguacuuuaaccccagcacuugggaggcagaagugggcagauuucugaauuuaaggccagccuggucuacagagccaguuccaaaacagcuagggcacagacaaagaaacccuguuucaaaaaaaaaaaaaaauuccacucccccaaaaagaacauuuaaaaggguuuaguugaguucauugagaaauuguccauaagcuuuuaaaaccuauaagguuuggaaauaccccugucccuugaagaugauugaaugauuagaaaaucguucccuauucucuuuuucugucaccuuuccuuccaucuuaccuacauuuccccuguacuuucuuauauuaccuuuacggaucucauuaacauacuguacaucuuagaaaagagauacaggauugcuuuugacuaucuuugcuaucaacaauagguuacagauaugagggugacuuuuguaacccuugucagguauuggucauauuuucuuaagaaaacccuguccauuuaaaagcaagaaaaagauagauaaggacagaaaagcagauagagauguagauaguaaggaagaacagauagaggcaaaagcaaaggacuugggauaggagaccugcagugggagagaagcacugagaaugcagagcccugaaccaggaagcaggagucaggucuaguuuggguuuucccuuucaguaguguguuauaagguaggaugaaguggggcgcaugaaacauucccaugaguuauucauuggaucugccuacucagaacugaagagaucccucuauaauacagugacuugacagacugauccuaguggguuaagguggaagaaaauauuaagugaugugucuuggcuggcuagcaucaacaagguuauuuuuaacuuuccuuuucagucuuuucauuguucgugcucccucacuagcuacuaugagagcagucaaaauuagcaacuacauaaaaugaaguuccucuugucuccccagucacuuccaaaauaaacagggaguaguaauacuguccguauuuugucucacuuuacucugagggcuagcaauagaggaagcauggauuaguguguagugauuucuaggcucuguccucuggacgaauuccccuuugagagcucuagcugagugacaggaccauguggcaggcaggagugcagcuggaggucuaucacgggcacauuuggguuggguaaauauaguaggagcaggaugucagugugggagauggauuguucugggaaaggaaguguugucuuuccucugagaaacaauuuccuguacuucugggaauuuugcuuucuucuucuucuucuucuucuucuucuucuucuucuucuucuucuucuucuucuucuucuucuucuucuucuucuuguucuucuucuuguucuucuucuucuucuucuucuucuucuucuucuucuucuucuucuuccuuuugagggcagaagaagaguuggcagggguuggauacacuugcugaauucugucucuggcugucugucucuuccuacauuugaaauuggguguaaaaaucagaucuauuucaaaaguuaggaaauagacccaauaaauagccauaauuuuuuuuacaguuauacaaacccuuaccugcuuaaauucucuuuuaaaaaguaaccauucuuuccucaaaccagacagguugagaggcaaaaauaaccauacaaagaaaaugaacucuauugaaagucagacaugaagcagcagcuggcaggaaacagcugggguguuucugggcgcuagacucuaccccagaccuuaacucuucaagcucuucguuaucugagcugcuuagaaggcugccuaccuagcaacacucugcauaaaaaaccuaaaucuaugagagauuauauauuacaauuaaauagaauuucaugaauuauaaaucauuuuugcaucuaaaaauucuuugacugggggcagggcuuaguugguaaagugcuugccuagcaugcauugaacccuuguuuccauucucagcaccacaauagaacacugguacaccccuauaauccuaaugccugggaggugaagggaggagggucagaaguucaaagucauccuuugcuauaauagcaaauucaaggccaaccucggcuaugggagccuugccucaaaucacaaaauguaugaguaguguugcuaagaauguaugcauauguggguuuuaguaccuguuuucaguuuuuuuuggguauguacuuuggaauggaauggcuaggucauguggcaauucuauguuugccaaaugauuuuccuucuuuuccuuuacauucucagaaguacagaaggauuccaauuucucuauauuuuugccaauacuuguuguuuuaaguaugcuggauguggugguuugaauagguguggcuuccauagacucauguguuugagugcuugguccauagggaacagcgcuauuagaaggcaaggucucguuggagaaagugugguuuuggaggaaguuugucacuguggggaugggcuuugaggucuccuaugcucaggcuacaccuaguguagcacacaguccccuucuguuuggcucaagauguagaauucuuggcuccucuagaaccaugucuaccuggaugcugccaugcuucccaccaugaugauaauggaccaaacuuaugaaaccauaagcuagccaaaauuaaauguuuuccuuucuaagaguuaccuugguuccagcaacaaaagccugagacaauagacaagcacucuaccccugaguuaugucccaaaccuuuuuuaaaaaauuacuaucauaacuucaaaagcuuuugagaccuaauuagacuucgauaauaaagcucguuccaguuuuguuaucuuggcaacaucuuuccugaaguaacugggcuggcuguucuuuggggcccaauguuuuaagguuuuaguuuuugugcuuaagaauuaagaauguggagggcuggagagauggcucagcaguuaagagcacugucugcucuuccagagguccugaguucaaaucccagcaacuacauguuggcucacgaccaucuguaaugugauuggaaucccucuucuggugugucugaagauagcuacaguguacuuacauauaauaaauaaaucuuaaaaaaggaguuagaauguguuuugaguuaggguguggcuccuuugguagacuaccugccuguuaggcuugagacccugggcucaaucgcuugcacugaaaaacaauaacaacaaaagacuuucccacaauuugcaacaaauauagugauuauagcuuagaggaaauguucagagaggguugaaaucugacuugcaaaaaguagaaaaaguugcugaacuugauggccacccuuuugaucccagcacuugggaggcagaggcagguggaucucuguaaguucaaggccagccuggucuaaauaugacauccgggccagccaagucuauauaguugagacccuguuuaaaaaaaaaaaaaaagguaaaaauuaucguuuguuucugggauggguauuauuucugguuuauucugccauuagauuccuugaccacaucaaaggccaaaucuugcuauacuguaaucucaguuugcuuguagauagauugccacuuuuucugccugcuuauaaaaucaaucucuuucucucauugguaauagugauggggaucaaacaaacucagggucuugcacaugcacugaacuaacauguacugucuuagcccuagaauagccuaaagagggaguuuuaacuccuucacugaagugugauugguaccauauuucaguuguuacuacugucuggggguggugguggugguggugguggugguggugguggugguggugguggcggcggcggcgguguguguauugucaaaggucaagccuaugaccuaacauauuggguuagugcagucuugccacucugcuauuagguuauauacucugcccuuccgccacuacuuauauuaaaacucuagccagguguaguguugcaugccuacaguucuagcacuugggaagcugaggcaagaagauuguaacagguucaaggcuagccugauuuagacuagucagagcuacauagugaaaccuugucuccaaaaagagagagagagugacgagggaggaaaaggaaggaaggaagggggcauacuggaacuacugauuccuugcuuuucuuuagaaauauguuuuuccuuuuuuucuuagcaguguucuuuccaguuuacauguugagugauagauuuuucuaaccuuuagaaagauguuuuuuuuaaguacuuaguguuuguuauguacauccuuaaaauacuguaaaucagaauauauucacguauuuaaugccacuauugguugcuuuuuuuguuguucaguaaauuugagccaguuucaaaguacacagaugguagucacuguaauaucccuccaccaucaguacauuugguguuagguuacgaauguauucuaaccacuugaucaaagucaggcuuugaguaagucagguguggugaaugacaggugcgucuggauuuggucuugagagauuuggggacguggaaagcuuaagaaccacugccccuccacccccguaauguaccguggucuguaauagguugaguuguaacagucauuaaaccacuccucacagucccuguuuucaaagcuuaucaggaugaguuugauuuaguuauuuggaaccaaaaaggcaguugguggagcuagguucggagcuccguagcuguaauauaucagagaucagacuugggucccagugggauuauucccugggcuuuuauuugccuggaaauauacgcaggagccaagcgguauguauggcgagcuuugcuggaaugcaaauuggacacauuuuguuggaaccuguaggggauuuucacugcuucauaauuuuucaaagguuuguuauacagcagacagcuacugccucuucuuuaaaucuguaaaucccccucuuuuuccuguucuaaaggucagauuuuuuuugacaacugugugcaggaacaagauuuguuaaaucccuucauuuuuauucauacaaauaucagaauucagugaacaucaguuauacagcauuuagagguaaggaaaacucagggagaauccugugacucucaacuuagugucaggcguaugucucuggggauacauuugcugccucaacuuuaacccauaacugaucugauaagagacagccuucucauuguggcuuccauguuugcaaaaccuaucuuuaauuaaucccaugucuggagagguagaagacagguaaucuaauuagcaagaggauauuguuuugggcuuuucucauggaggcucuuugacucugacagugcuuagauuaguauugggaaagauagguaauuccuuccaaugaagccaucuuuuuauucuuacuuuucacuuuuagugauaccuuaggcauugcucauuuuuaguuugaggaugauuauuucuaauuccauuuauuugugcguguguguguguuugcaacagugcaugcauggaugucaaaggacgacuugugagaugcaguucucucuuuccauuuggaucccaagaauugaacucagguugucaggcuuggaggcaggcacuuacucgcugaggcgucuccccagaccagaugguucuuucuuacuuacuagcucaucagauagucauguuaucauacaggacagguuuccaucacacuugaguuugauauuauacugucuauugcuguauagcagauuacccaaaaauauggcagcuuaaaaaaaaaccaauucaggaaguuuuugggggucaggaauuugggggcuacuuagcuaguagguagguucuuuuaagauaagucggggagacagccauuugaaggcagagcugaacuggaaggcuuguuuccaagcucaccauggccauuugccagaggccucaguucuucauaguguaggcuucucaggacugcuacccacauggaagguggcucacuccuagguagauagucuaggagugacagagugaaaacauaugugugugugucacuggaagugucaugccuccaugcuaagcacaugcuuuaucacuaagcuauauccccaguccagaaucgauaccuuuuuauuguuugcuaauucaugcaugcauauaauguuuugauuaaaugacccccccuuucucccuuauuccccacuacuucucccucccaacuuuauguucucuucuuguuuguuuuugacacaggaucuuacuguguaguccuggauaaccgggagcuuauagagaugcaccugccuuugcuucccaugugcugggauuaaaggccugugccaccauaccuggugcucuuuuaaaaaagauucauuuauuuuuauuuuauaugucucugugcaugccugaguguauguauguacacuacuuguguacaguugcccucagaggcuggaagagagcauuagaucccuggaacuggaguuaauggguggauguaagccaccugauaucaaugcuaggaaugugggcucuggaagaacagcaauugcucuuaauagaugagucauuucuccaacccaugggcccuuuuuaaagaaacauugaguccaguuagugcugccguggguguaacgcugucuucuggagcauggggagcauuuccagggccacaucccugaagagaaccaacugucucucucccagcagccgucauuggccaauaacuccuuaucuaggagugggccuuuguuugaccuucccucacccaugcuagggucuuggugcauacagucaaaacugauguaaguucacgugucaggaaaaguuucacuaccucugguucgugcaacccucuuaaagauccuggagccugguaggaggaagucauaauuuuuuuucuuuaaaaaauauuuuuguuucaggcacauacauuuaaucccugcacucaggaggcagaggcugagagaucucuguaaguucaaggccagccuggucuacugaaguuccaggacagccagggcuacacagguccuucucucucauguguguguguguaugugcgcguguguguguguguuuguguauugugugcgcacauauuuauguuuacuuauuuuauguguaugauuguuuuguucauguguauaucuuuguaccacaugugugcuuggugccuguggaggucagaagagggaauuagaucggcuggaacuagauuaggagucuccauguuggugcugggaauugaacccaaauccuugcaagagcaacaaguuuucuuaaacacugagacaucuauccugcccccauacuuucuuuuuauauucuacuuaaaaaguaauguauuauccuuucugccuuaaguuuggucacacagacuaacugacccugacauaucugagaauggaucacccaggaucacuagaaguccacaguaagauaaauugaaaauuauguauguuuacugggauuuaaaaauuguucuauuuuuguggauuauuuauuugucuaguguguguauauagcugaguacauguaugccaugguagguguguguggagucaguucugucuucccaucauguggaucccagggucacccagcuuggcucacuuuacccacugaacuaucuugcacguccuggaguuuuuugguuuuuguuuuuuguaaauguuauuuauuuauuuuauguaaauuaauacacugucccugucuucagacacaaacagaagagggcgucagaucccauuacagaugguugugagccaccaugugguugcugggaauugaacucaggaccucuggaagagcagucagugcucuuaaccgcugagccaucucaccagcccucuggaauuuuauuauaugaaaauuacauccaccuuguacuucccucuuucuguaaccaggugccucuuccacuauuucaugucucugaaauuagccauggugcuuauugcaaauguguauguaaauauugcuucauguuucaguugcuuccucccucuuguaauuccagccuuguucuuuaauauaagacuaauaaacauuaucuguccauuucccuccucccuuuuggugggccuucauggcaacuagacaaagaaaccuucagcccuuaagaggcauauauuuggauuuaaguaaucguuagcaccucuucaaaacauuugccacugagccuuuagauuuuggugcaaaugaaguaaacugaacaguuaugggggacacuauggcucuuuuagacuaagauagaugugacaguuuuguuuguuuguuuuugagacagucuccuguaucccaagcugcccuugagcucaauauguagcugggcuaaccuugacauuuugugucuguguaugguguauguauccauuuuugggugugcacauguuuacguaaauguguuuguauauaauggaaaccagagguugacuucuggugcguuccuugauugugugcguguguguugccccaggaauugagucuggggccucauuuaugccugguaagcacuauacaaguugaacuuuaccuucagccugcugugggguguuuugaguucuuacagagaggugcccaugcaucaccuaguuuauugaaguauagaaacaggucagggugcucaugguagcagugagugugaagaauaggcaauccaagauguaagaaggguagaugaggacaaggcugacacaagaccuauaaauaccuuaaggucucauuuagugcuuugaaauaguaauuaggucauuuuuauugucuucuccaaguuauuuauugguuggcucugaaaacaaggcauuagaacuuuuggagaaaaugcuacugucagugacucacagagaccggauagagggcugggguauagcucagguaguagagugcuuuccuacuaccugaugcacaaggccaugcagucccuagaaccucacagaccaggugcauuacgcuuuuaaucucagcacucagaagcuggagguagaggaggcaggagguuaggaguuuguuguagucaggguuucuauuccugcacaaacaucaugaccaagaagcaaguuggggaggaaaggguuuauucagcuuacacuuccacauugcuguucaucaccaaaggaagucaggacuggaacucaagcaggucgggaagcaggagcugaugcagaagccauguuacuuuacuggcuugcuuuucuggcuugcucagcuugcucucuuauagaacgcaagacuaccagcccagagaugguaccaccuacaaggggcccucucacccuugaucagcaacugagaaaacgccccacagcugcaucucauggaggcauuuccccaacugaaguuccuuucucugugauaacuccagccugugucaaguugacacaaaaccagccaguacagaguucaaggucauuuacugcuauauagcaaauucagagucaguuugggauauaccaccccacacccccaaucuaaaaagugcagauucuggucagccuucucuuuuuuguuuguuuuauuuuuguuuauugagacaggucuuacuguguagucagacuagucuguaacucagcuggccacagcuucccaagugcuaagauuacaagcuugcacuaccaggcagagcucuguccugccggucacagacagcucugucccagugaguugaugagguguagacacugagggcugggaccuagcuggagauaauacccagcuuccugagcaagaagugggguucugagcagugagaggaccugaccuugucaucauggcuccuuacugacuggccacaugacaugggagcaagcuggugaguguugcucucgccauacugcaccauuagcccgucugucacacucagacgccuagaaugcuuucuuuaaaauuaauaaaaaauuuuauauguguaugucuuuuuguguaggagcugucagaguccggaagggucauuaggucacucuggagcuaggguuaguugcaggugguugagagccacuggacauggguacuugggacugaaccugagucuucugcaaaaguuccaaacugcugauccgcaucuccagccucuccuccuaguuuuguuuuuguguuuguuuuuuuaaaaugagguucuaguuuuuaauauucuuuuuuggggaguggggauaagggucuucuuguuuucuucucuaaaauaagaaaauuggaccaaaugauuucuaaaaucccuaaagcuauaagauucugaggcucuguuguccucucucaugcaacuuuugaaauauuuucaagaggauucuauuccauauaaauaucauuaugguauauuuguaaugaaauuuuugcuguugaaauauuacagaguauaauuuaaaggagaaauauguacagucugugcuucucagccuuuggaggcagccugaaacccaguuuccuuuuguauuucuauuguguguguugagcaucuugaaucaggaaauccaaaauaaaaaaugcugugaaaucuaaaaauguuagagcaaugacaugccucauauagaaaaguauccacaucauuucauguugcagaaaaaauacaugaaguauuauaaauguuguauaaaauuagcugcagcauauauacauauauauaugcauauauauaauauauuggaacauaacugaauuucguauuuagacuugugucccaucccgagguaucuuaccaugucaauuaaaguauuccaaaaucugaaaaaaauugaaagauuucuagucucaaauauuuugaauuaaaagguauuuaaucuguaacaauguuuuaaaauaugguuucaguuauucuuaguaaacuaauguauugcuauuaaaaagaaguaaauauauaccaaguaggauagcugacuuucagucugugcuucuuuauucuguucugguuagucugaccaauagaagaagaauaaggccagcgagaucaugguuugagcaagauuacauaguuuauuagcugggaaagcuagaauuuaggucuaccaauucuuugucaguuguugaugcuucugagaaaauuguugaucugacucaaaugagaaaauggggcuuggcggcuggagagguaacucagagugaagagcacuugcugcucguaccauucccggcaccacauuggugucugacuaccauuggcaacuccaguuccagagaguuugacaccuuuuucuggucucgacaggcacccagcaugcauauguuuuacagauacauauaaacaaaacagucauacacauaaaauaaaauaaaauagguuguuuuuguuuuuaaaagaaaaugaggcguggcaguuuuuuuuuuuucccuuaauuagguauuuuaaacguuguuguuugcuugaguaguucuagggaucaaaccauagucuagggcauguuaugcucaugcuguacuauugagccacaucccuagcccgucugacuuuagcuguuuauuuuuagaacacuggcuagaaauuuggcuuuucucuuuuauguaaggugauagagauaagacauuccguuuuaaagccuaguagaaaucccuucccagugaugauagcuuuaguucuucagaugacaaagacuugcugauggguaaguuauaaguauaaaaguuaaaguuaggcaaagaaaagauuggugugugugugugugugugugugugugagagagagagagagagagagagagagagcauacaaauguauaugcauguauauagaagcaaaagagaaaccuugguguuccuuaggcaacccauauuguuuuuugagauagggucucucacgagccugaaaugugucaaguaaguuggcuggccagugauucuccagggucuaccuaucucugccuccuuaggcuuggguuauagccacaugccaacauacccagcuuccuuuacauugguuccaaggaucaaaccaaguccuccuguuugcaaagccagugcuuuguugacugagcucuccuccuagggcuucucuccacccccuacuauuuuguaggcagagacuccuguguaucccaggguagucuugaacuuacuagggcgccaagugcuccuucucccucuaacucaguuguucucaaccuuccuaaugcugugagccucuaauucaguuccccauguuguggugaccuugacccauaaggacaccacaagaaaacccacagaaucaacuaaccuggucucauagagggucccugagacugaacuagagaccagggacccugcauggaucugaccuaggcccucuguauauauguuaugguuguguaguuugguuuucuugugguacuccucugacagugggagcaggggcugucccugacucuuuugccugauuuuggaacccuuuuccuccuacuggguugccuuguccagccuuaauaugaggggaggugccuagucuuauuguagcuuuauaugccguguuuggcugauauccccuggaggccugcccuuuucugaagggaaaggagaaggaauggaugggagagagugucugggaggagaggagacgggaaacugugcuugggguguaauguaugagagaagaauaaguaagaaaaauuguuuugguugcuacuuuauaucuguaauuuugcgacuguucugaaucauaauguaaacgucuguguuuugugauggccuuaggugugaccccugugagagaaucauuugauccagaagggaauugagauuaggaaccaucgcucuuaccucuugagcccugagauuacaggugcauguccuuaugccucauuuguguggugcaggagagcagacacagggcguugaguguacuaggaaaguacaguaugaacugagcuacaaucccagcccucugauugcagguggacuuuaacuuuuguuuaaaacuuucauucucucuuccaaguccaaaguacuaagcaagcagcauaauuuauaacuugccagcuaugcagaacgguuacuuguauguguguauguguuguuugugcauaugugugcauguguauacauauauauguacaggcugaaggcaggcaucaagugccauccucaguuuucuccaucugaccaggcuggccucaaauucaacagagauuucccugaugcugccuccugaguucugggauuaaacaugugugacacuauacugguccucguuuuguuuguuuguuugauuuuuuuauuuaagauuuaaaaaacugaauauguguauuuauguuuauauuggugauuguauguaagugcaauugaaucccuuggagcuagaguuacaggcaguugugagcccccugguauggauguugggaacugaacucugguccucugcaggcggugguauugagagcagcugagucauccagcucuuuuacaauuaguucuuugaaacaggguucacugaacuuggaagcucacugauugggcuagccuggcuagccgagugaacaccgggguuccgccugugguuaaccaacacuaggcuuagagacuuguaucaccgcaccuguuuuuuacauuaggacugggcauccaaacucaagcucucaacuugcaugcuaagcacauuaucaacugggcuauccuuccucccaugacagauccucuguaaggugcuuugcuauaaaguuauggcuagauuuugcuuccagagcaaguuagaaaaucaggauuugagcaguauaauuuuauauauuuuauuugcagccuuaauuuaaaaguugacuuuguauuucugugacaaaguacuccaaagaaaccagaaaaggagggaauauugacucauaguuucaaauauuuuaggccauggucguuuggcuuuuguguuucugagccuguauggaggcaaaggaucauaguggagaagggaugguagagcagaacuguuugucucauggcagcaaguaagcagagagagugaggaggagccuguggacaaucuuucaaggcacugcacuucccggugacuuacuuacuuuuacuaggucccaccuccuaacaggccauguagcuaugaacccguuaguggacuaauccauuggucagguucgcucccuugugguccaguuaccucucauuaacaccagcagcugaggaccaagucuucaucacauaggaggguuugagaacuacagagccaaucuguaacaccuacuaaacuagaccuggcuaucaaagagcuaguucuguacugacguagguucacaagaguaaauaucauuugaagcaagauauauagaaagcaccagaagaaaguagauugagucuugaggauggauuugaauagucuuucuacaauucuagucucuagaguccuuuuuuuuuuuaaccuuccuaucuuccuccuaaauacuuauauauuuuccuguuuagacccaauggaugucaaagagaaagaaaugaccuuauaaaauucauuuguguggagaacuugaaguuacuucggaacuugauaacuuuuagaaccauacucuguuucccuaaagaaccuccuaauuuuuuuaagccugauagugguggugcaugccuuuaaucccagcacucaggagucagagacagguggaucuuugauuugaggcuagccuggucuacagaucaaguucaaggacagccagagagcuacacagagaaacccugucucaaaaucaaaacaagugaaaaagaauucuccucuaauuuuuuguuuuguuugguuucugaaacaaggucuugcuuuauaagcccagcuuuccugaaauucacucuguggcacaaguuggccgugaacucaguccuauugguucccccucuagaguuguggaguuacaggcauaugccaauaucuggguguaagaacaccaacauuuuguaaagaaauuacucaagaaaaccacugaagggcuggugagauggcucaguggguaagagcaccugacugcucuuccaaagguccggaguucaaaucccagcaaccacaugguggcucacaaccauccguaacgagaucugacgcccucuucuggugugucugaagacagcuacaguguacuuacauauaauaaauaaacaaaucuuuaaaaaaaaaagaaaaccacugaagucuuauuauguauauuaauauuuacauguaauauaaaguacauaauuuaaaaauauuuuccucuagguaucuaaauuauuggaacaaauacugccuuaaauugcguugaguagggcugaagagaugguucagcaguuaugaauauuugcuucucuuuuagaggacuugaauuugauucccagcacccacauugagcagcucagcacagggucagaaacacaaaagccaagugauccugccauccaguuccaggggauccacuacuccuuucuggcccccacaguaccugcacacaugugguacacuguuacaucaacacaaaguaaaaaaaaaauugaguuggguaccugaaaucaaagaguugagaccaauaguuuuaaaauauauucuaggggcuggaaagauggcucaauguuuaagagcacugacugcucuugcagaggaccaugguuugauuuuccagcaccuacauaguggcucacaaccaacuguaauuccaauuccaaaggaucagauacccucuucugguaucugugugcauuguacacauguugugcacagauauacauccaggcaaaacacucuuacacauaaaauaaaaauaaauaaauucuuaugauuuuuaaaaauguaaauauuucuaggcucagcaugguaauauaugccgguaauccugugauuugauagacaaggggcaggaggaugaguucaagcccagucuggacuguauugagagacucugucucaaaaauagaaagguaaagcuauuaucuaaaauuaacuaugaguuuaucucuauuuacuauuuauagauccaacuauacagguuggcaccaugucguauaauagcaucaaaucucuuuuuaauaaaaugucuuuuauacucuuagcagggaucaggccaucuaauaacuuaauuaaguacuaacauauuuuuaguuaggcacuuuauuuggcaagauuuuauuggucuuauguaauauagauggcaauauuaugucaggcacuuugcauauaucaucucauuuaaucuuuucaagaauauuucaaagaccagaaaggugucuuaacaagugaauacauuugccauguaaaccugacaggcuuaguugucacaugggugggucccaugguugaaggcugugugauugacucccuaaaauugccuucugaccuccaugcucaagcucugucuccacacacuccucaacaaccauauuuguuuacaaagaaaguauuucaagauaugcugugaacauuuuauguaagagaaauaggguccaaagcagggagaaccuuuaggucgcauacuuaguaaguggcagaauggguacucuaaguaugggccuuuucacauacaguuccugcacuugccccugccucuugagggccugaaauuacagaagauaaacaagucucagccuuauuuuuggcaaauacaaaacucuuauucuuugguuccacaagagugcuugauguuuccaucgagauccuaggcugcucucucuuccgagagccuuggagaauacgugcaaacuggcagagcaaguaagaguauagguucuagauuagaggugugcagaucugguuuugaaucgcagucuccucucgaugacuuccagcacacuaguuagcuaauguuagccucggugccucgucuguaaaauaggggccguguggaguacaacuuagcaauaaggaggaaugaagguugauauauguuuaaucuuggauagagcucagauccaaucugagugacugauucuggccauaugguacucugaccaggcaaagcuauagaaaagggaacagcacucagcaggaaaaggggcuucccaugaagcccaccuucagucccaugauggaaggagaggagccuguggcaagcuguccucugaccuccacauauaugcacgucacacaaauaaauugaauucaaaaauugaaaaaucuaaacaauaaauaaguaaacaaacaaaaaaaaaaccagguuaacuuguauuuaaaaagcaacauugugcuauagucagcagcagguagcaaacauaucauugucugcuuacacuuguccacaacagcuuuccugacuucuucccugcacagauguagaagugagaucuguugugauucuuuuuuuaugacaggguucuccauagacccugaaauguguguauuaacucaacuuuaaccucacagccuauauuuugauagauauaggauaaggauagguaaaagauaaugacuaccaagggaugaugaagggacuuuugagguaaugaaacuguucuacagcuucacuuugguaguguuuacaugaaacuauauguguuaaaauuaacagaaaaucuguuccacccuucaaaucaauuuacuguguauuaauuuauaaagcaaauuaagcaagaugugguaguauggucccagcuacucaagugacuaagaugggaauaucucuugaucccagaaauuuaaaacuagucuaggaaacagugagaucucaucucauuaagaaaauagcuggaugugguaguguucaucuguaauugcgacucucagaugguggagguagaaagaugaggagcucagaguuauccuugguuacauaaugaguucaaaggcagccuauguuacuugaaagcaggucucaaaaaucaaaaaucacaaaagggcuggagauguagcucaguugguaauuugccuuauauguuugaaguucuggguucaauuuuuuaaaaaagauuuuauuuauuuauuuauuuauuuauuuuaucuauaugaguacacuguugcugucuucagacacaccagaagaggacaucagaugcuauuacagaugauugugagccaccaugugguugcugggaauugaacucaagaccucuggaagagcagucagugagugcucuuaacugcuaagccaccucuccagcuuccuggguuuaauucuuaauaagacacaaacuagauauggagguguuagcauguaauucuagcacuugggagguagacugguggaucacaaguucaaagucaugcuuggcuacauagaaaauuugggguuugcucuaaaauuuuuuaaauauaaaaauaaucgacuuauccaugaaaaugaguauauucaaauagugauagcauuuuuacuuuuuuuuuuuaccuuuuuagauuuauuauuuuauuuguauauauauuuugacaguauguaugucuguguacucugugggugccugauaccugugggggucagaagaagguguuagagccccugaaauuuacuggaguuacaaaugguugugagccaucauguggguacuggggaccuggagcuuugaaagagcacuaagugcucuaaaccgcagucucaucuuuccagccuuuauacuuauuuauuuuuuaagaaauauuuuauaucuauuuguuuuauaguuaaauuuuuauaaggucauuauaaaaaauaaaaauaagauaguguaaguagaauaguaucacagugccuaccuaguagguaguauauguuaaguauuuuuguucuuuuugacauuauuggaaguauuuuaaauguagcgacauucauugaaaggauggcggaauaaaguuccaucccauccacaugaguagagucagagaacagaacccgaggaacaugaguccaggggagcgaguuuucacaugacuuggcaaaggccuugagcucuggacgguuacguguagcacuucugcaaugacaguuggcuucucauuguucuucaacaaaauaguaaaauaguuuuggucucagaaguuucagcuucuuucccuggauucagacuagucugcaguguggauugaacaaauugauuagagaaggagccggaaguguuucucauacuuagaaguauaacuggcuuauauaacagcugcagcuccaaugucugucugcuagccacagccuuuggauuagauggggacaacaguaggagagcauagcucaaagcucucucucucuuuuaaguuaaggucauagugacauuauaguuauaccagcaaugaaaaagagguuguaagguaaauuuuaaaaauacuuaaaaaaaauuaugucuguauauguaugucugugugugggcaugagcacauggcuacucugugagaucagaggugucuaagucuccuggacuuggaauuacagacaauuguuagccacucaguauggguacugguaacugaacuuggguacucugcaagaccaguacuuagucuuaaguacuaagagccaucucuucaguuccauaaaguaaaaucuugacuuauucauccaguaguaugguugucuuguauagaagcucagauucugaaucagaaaagcugaacuaacagcaugugaguuauagaaucaaguaagcaccugcuggccacacucugggggauucuucauagucuuugucugggcacuauuuucauuuuuuuuauuuuuuuuuaacuaaaagagcugaugauuuuauuuuuacauuucacaauauuaagugaaaacugcacuuuuuuuguauucuuucucccuccaaaaauauucaguuaggaagggaauuuuccuuuccaugcaucuaguaaacacucgggcucagcaccaagagcuccugguggaacagaacaagaaauacaaaaccaucaagagcgcuucugcucuuaucugucuggccgggucaugccaggccgggugggcaccaucuuagggcgggcaggaggucucaucaugggaggcccgggcaucaugggcauguggccucccauggguggucucaucccaggagcuggucccacgggcaucauucuggacggaggggggcccaucauuggcaucaugggagggccucccaugugggacgcaggcaucaugccaggcugaggagggccagggagacuggggggaggugggaucauggccccugcaggcagaggagcagagaacggagcggagggaucuucccuuguugaaaugcagccguugucuugucaaucaggcucugggccugcucuuccauccauuucugguaauagucuuuuacauucucuuuguguuuccgaccacugcagugugucuuccucacagacggagaauuguggguaagauauguaucacaguagucacaauaaaacuugggcaugaugcuccacaagccguaggcuaccccgauccccgccaccaggaacucuuauuuuuuccuuauagguucuacacauauaauauguuuuuaaguguuauauuuuuauaggguuucugugugugugaacacaagggucccuguaucuauauguguuucuugugcuuuuuuugcuuuuuuguuucauucuauucuaauuuguuuuuauuuuaucuuauuuuuaaaaaauauuagaaauuauuauuaaaauuauuauuagauaagugcuugguuguaaucagaaaggaagaaagaaagaaagaaagaaagaaagaaagaaagaaagaaagaaagaaagaaagagggaaagggagagggaaagggaaaggaaaggaaaggaaaggaaagaaagagaauauggauuuggagaauuauugaguaaggaucugguagaaguuggugggggaaccauaauuggaauuuauuauaugaaaaaaaagaaauccauaccaaagagaauuaugcuaauauauauguccuuuuaauggaaggagcuggauuaaagacuuuugaagauaguucucuuggcuguuguuguauugguuguggggcacacaugagugggauaugcugaggggcagaagcagaagggucacaaguuugaggcuuagccugcacuucaccuuuaaaaugggagccugcgagguggcucagcaguuaaaggaccuugcugcaaagccugucagcuugaguuggauccucagaacccucaagguagaaggagaaagccaacaucagaggauugucuucucacuucuacaugugcacuuccaccuaccaacacacgagaaaauaacauuucuugaaugguuuuguuggcugguagacuagguuuaagauuauccccaaaugauggaauauuuaauauaucugaaagacaucauaguauuuuucugcuuaggaaauaaaaucaucaguaauucugccagggagguggucagagucaggacaugcacuagaggcagagguaggcagaucuaugaguuugaggccagccagcacaggcuaaauagcgagugccccgccccccaagaaaaacucaaaaaacaaacaaacaauccaaauccaaaacucaaucucagcuaggagaucuuugcucccauccgucuaccaggacauccagcacugucuauaaacaauuuugauugccacaacucaaggagaaguguguagguucacaugugccacauauguguguguaggccagaaaacagcuuacaggagccaguucuuuccuucaauacaauaaaaaaauuuuuuucaagaacuugauauuuuaaauuuucacauuuugaucuuuuuuuacccauuugaguuaauuuugacaucuuuacuguuaaauuuauagaauuuuauaaauguauagaauuuuauuauuucuagauuauauguuuaacuuuuuuauuuuaucauuuuauguguggaagugcuuuaccugugugcaguguaugugcaguguccucaaaagccagagcacagcauuugauccucuggaacuggagguacacagaugguugugagcuccugugugauggguacugggaaucgaaccuagguucucuggaaagcauuuagugcucuuaacugcuaagccaucacuccagccccaaauuguaucuuaauaacuguuuauauagaaaauccagggaagccaaacauggaggaugauuccaguaauguccuucucuugcacaugaauaucuaguugccucuggcucuugacugaaauaacuucucuuuucuccugacagucuuagcaucuuugucagaaucaauugaccauaauggcccuggugugaaacugcuuuaauugugacauagucucaccguauuucccaggcuggccugcaacuugaaaucuuacugcuccagccucugaagugcugggauuauaggagugagguaccaugccugaauaaaaaaucuuauauuuguuuccuuguuuguuugacaugagguuucauauaguucaggcuggcugcaaacuauucagccaagggugaucuuaaacuugugguccucccaccuugaccuuucggguuugggguuaccaaaguucugucaccugguuuccuggcuagaaaaucuugaugacuuucuacuauuacagcucccuaaagacugauucaguguuuccauaugaaugcugcugugccugaggaagaacaugccaagcucuaaggugccccuaagacaacucuuggcauacacuucggccacucacagcaugcacaaaccuauauccccagcuauuaggucauuagugauucaguaacuaccucacugaacucuguaucuaguacucugaauucuagccagcauuguuuuuugauaugguaccagacauggaacucaaggccccagcaauugucugucugucuucucucucucucucucucucucucucucucucucucucucucuuucuuucauucauucuuccuugguuuuucgagacaggguuucucuguauagcccuggcuguccugguacucacuuuguagaccaggcuggccuugaacucagaaauccgccugccucugacucucgagugcugggauuaaaggcaugcgccaccacgcccagcguccauccgucugucugucugucuuucuuucuuucuuucuuucuuucuuucuuucuuucuuucuuucuuuccuuccuuccuuccuuccuuccuuccuuccuuccuuccuuccuuccuuccuucuuucuuucugucuuucugucuuucuuucugucuuucucucucucuuucuuucucucucucucucuuccuuuucuuucuuucuuuuuuuuucuguguagccuugggugugcugagacuugcuuuguagaucagguugaugguguucaaccauuuucaaaaauuuguguaacuauaccuggguacuuucuacuuguguuauguaauuuuuaaauaaguuuaugagguagggcugguuuuuuuuucuuuuguuacagauguggaaauaaaggcuuaaaaaguuuuuaauucccuauuaucucauuagaacuaagauuugaaucuuaauuuuucugacuucuaagucacuaccuuuagagaauauaauuagaucuccaccuggauauaugauugaguuccuuuuuauuuaauuuuauuuuuuuuacuuacucauuuuauauuccacucauugccuccacccagucaccuccucccagaaaccuucccccauucuccuuucccuugaguggguggaggcccccuggguaaugauugaguuauaaaagaaacuaugggacuggagagauagcucauggguuaauuaagggcacugauuuccccuacagaggacuuagauucaauucucagcauccacauggugcuuuauaacugucaguaauuccaguccuagggggauacaauacccuuuucuggccuccauggcaccagccaaaaugcucuuacacauaauuuuugaaaaagaaauaagcuaaguucaacauagugguacaugcccuuaaucaaagcacugggagucagaagcagguguaucuuugaguuuuaggccaguuuggucuauagggcaaguuccaggacagccagggcuccacagagaaauccucucucaauaaguuaaauaaauaaauaaauaaauaaauaaauaaauaaauaaguacugauuguaaauauauacaaauagagcaccaaguuuuaggccaguauauacuugaggguagaguuguaagcuacauuucagauuugacuuuuccuaguauauauuacaaccuagaaagggguauauacuguuuucugaauacuugcuuuacaacuaauagccucacaauuauagucauuaucauaugagacuuuugaagauaaaaucaucggauugccaaaaaucagaguaaaaauuauagcucuguaugguaacauacaucuguaauugcagccccagggagacugaagcaggacuguccaccuguaucacauaaugaguuaaagaccagccucagccacugugugagacccuaucugaaaacaagaaacaaaacaaacaaaacccccaaauuccuaaccaagaagaccuugccugcuguugacuacugauggguggggggugugguggcacaccuuuaauccuagcacucagaagcagaggcaggccaaaacagccagagcuauacagacaaaacaaaaacaaaaaaagcuggucaggcagaugugauccaugccuuuaaucucugcauucuugagaaacccugucucaaaaaucuaaaaaaaaaaaucaaaaaacacauacacaccgaccccacuucccccaucuugauuacuguguaugguuccaguucuagcuagaaacuuuuuguuuuaacuugaaaaaauuuuuucuuuuaccuugaaaaauuaugaucuggcaguguagcucagugauaaaagauuugccuagcauauguuugauuccucugcaccacaacauuuaaaacccugaaaauuuucagagaaucauuacuucuuuuuuuuuuuuuuuuuuuuuuuuauauauguaaguacacuguagcugucuuccgacacuccagaagagaaagucagaucucauuacagaugguugugagccaccaugugguugcugggauuugaacuccggaccuucggaagagcagucgggugcucuuacccacugagccaucucaccagcccucagagaaucauaaguuuuagaacauuguaauucaagaucaucuuugucgcauauuuuaauuuuuaaauuauauggugcagugggguggggauggauugcaucucaugguaugaauauaaaggucacaguucccgccuucucccauguggaccccaggguaacucaggucaucagguuugggagcgagcaccuuuaucugcugaaccuucucagcaacccaguauggguuuuuuuucccuaaaauauuuauuuaguuauuuuuauguguauggguguuugcuugcauguauguauguguaccauguauguaccugguauccuuggaaaucagaaaaggguuuuagaucccacaaaacuggaauuacagacuauuucuaucugcuauauggaugcugggaauugaaccugguccuuuaagagaacuuccuaggccaccaauccagcccccaggcuuauauucuugaauuagaucuaaagcuagucuuguuucuucauuuaguaagucacugaccugcaaacuggaccacaugucugaaguguggacagcagguaagugcugacauuuugauggccacaucauauuucaaggaucuaugagaaggccuauaaugaccacacaaaacuagccaagacucuccuugccauggacaaaugggagauguuacuaaguuuagcugacauuaagcuguaaaugauuugagagguggaaguggauucuccucccaggcuguguagacuuuucauuuagugucaagcacaugugcuguaggugguuuuguccuaggaaauggguuaccaucucucuucuuuucuuacauauuuuucuacuauauuggaaaauacauauguauaaaauauguuuucccuauauaguagaaauauagaaaauauagcuacuauauuuucccaauauaguagaaauacauagaaauuauauauaguguauagaaauuauaugaaaaucuaauauauuuuccaauauagcuacuauauuauaauaauacaguugccauagcucuauuuggaccuguacauuaguaguuccuguuggucuuagguaucaaagccuuauuuacccaaaguaauacaucugcuuaugacaaagucuggucuguaagcucaguaccucagaugucuuuuuaacauaccuaaugacacuccucaguuagugguuaaaacccuucacacugugaaucaaccuacauacuuauuccucucuuccacugguuuccuaccuuuuacccauccugagcuauucagcccuuaccagaugugaauguauugguguuccauaaaacacccaaaaaugucuagcauauaaaagauucagguguuaaacugcuguuugaaaacuagaauucaagcuucaggcuggagagauggcucaguggguaagaguacugacugcuuuuccaaaggucaugaguuuaaaucccagcaaccacaugguagcucacaaccauccuuaauaagaucugauguccucuucuggugugucugaagacagcuacaguguacuuagauauaauaauaaauaaaucuuuaaaaaaaaaagaauucaagcuucauuugaguuuguauccagaguaugcuaauauagcauaugaguauaaaauauagcaguuuugacuuuugaggggaauaggggaacugagaguauagucaaguguuagagaacuugugcagcauucagaggcccuggguuugguacccaaaacuacaaaaaaaugaaaggaggguggaaauauugcucagugguugauacuugacuagcacgugagcuugcguucaauuuccagcacagcaaagaagagagaagaccaggaggaugggagggauacagacagacagacagacagagcaggagacugaaacaggacugcaaguucccaggcagccugcauugacuugaauugaaggaucauauggugagaaucuguccuuuaaagaaaggaacgaagagagggaggagagaaagaaagaaagagggaauucuagugacagucacaaacuugguguugugugacaaaacacacacacacacacacacacacacacacacacacacacaccccagguaggaaucccgugacagucuggauaucaucugcccuggcuaguuuuaugucaacuuaacccaaacuagagucaucugaaaggagggaaucucaauagagaagaugccuccauaaaaucuggcuguaggguauuucuuaauuagugauugauggggaagagaggggaggagaggggaaggcccaccccaccccauugugggugguaccauugugggcugguaguccuguuccuauaagaaagcagucugaacaagccaugaugagcaagccaguaagcagcacuucuucauggccucugcaucaucuacugccuccaaguuccugcccuguuugaguuucuauccugacuuccuucauuaauggacuacuauguggagguguaagccaaguaaacgauccccaaguugcuuuuggucgugguauuucaucacagcaaugguaauccuaaacuaagacaccagcaauguucaguuuggugagccaaugaguuuuauuggaguuacuuacaggauacgggugaggggguacuuauaggaguagaaaugacucaaagacagcugcaucacaaauuucaacccagcaugggugacagcucacaaacuggagcacacuccauacccugcaggagcucaacagguuggagaugguucuuucuuggugccucaguugguccaaaccucuuguaggcaccucagcagguuucugcuucuuccgggagcugcccuggucugagagucuucucuggagcuuugcugcucagcuuuucuuucuuuuagagggacucuccgcuucuguugcuuacucuggcagggagcggcugagugaauguggucagguucaggggcuuccugaaguuucugugauuaguuuacuauccuucaggaacuuccccgcaggaugcaauguuucaaucucauaggaaacuguuacuauccccauagaaauuauauuuauaccaauguuuuuuugcacuggagagauggcucaacuguuaaaggcuaggcucacagaaaguacaaacaguacuaagugauaacagaauguggauggccagcugagaugcucacauucugagggugaauuguaaauuggaaaguaaauuguaaguuggcuacuucuguuagagaugaacugcuaugagaugaauuacuuugaaccagcaaauucugugucuaagaguaugccuaagaguaauuuguacauacguucaccaaaagauguguaugaaaauguuuauagcaguauuguuuauaagagcuucaaaaaauuauccaaauguccaucagaaauaaaagaaauaaaaugcaauggauucuuacaguacaauacuucacagcaauaagaauuaauauggacuguaucauauaauacacaugaauuuuuucuguguugguaaauguuuucaguauggagugaaagaaaaccaaaccaaaaacaaauuguaugauacuguucacauagauuagggcuaaggauacagcuuagugguacagguacgagucuguggguugacccucuaacgcuaaacaaacugaagaacuguuuauauaguguagucaaagauauccugagguguuagaagucacaauugugguuucuuuuagaggcuuuucaaguagaagaaaucaugauuagguuuuuuugguucaguaguuuaaauuugaaaaguaaaagugaaaauuuauugagcuuaggacauuauauacuucaacuuaaacauguucuuaaaggaacuggagcaacggcucaaugguuaagagcacucacugcucuugcagaggacccagguuugguuccagcaucauugaacauggcagcuccuaauugucuguggugccaguuccagagaauccaauccucuagaggcaccuaaacacacaugacacacacauguacacucagauuaaaauagaauccaauccucuagaggcaccuaaacacacaugacacacacauguacacucagauuaaaauucccuuuugagauagaguuucucuguguagccuuagcugcccuggguuuuguucuguagaccaugcuggcucagagguccaccugcuucuuccucccacggguugggauugcacccaugcuccaccaccaccuaggugaauggagcuuccucuggguguugugggaccagcuucggaguucuugcccaaggucugcucagggcaugggcccagaccggaaggaaccugugucacugguugggcggaguuccugggugccucagcucuuauuuuuuuaugucagaauaaaaagugucaauggcuaaaaagaacguugacaaagugggaagagguguuuuucaugcuuucuguucccagagagguuacauuuuuaagcuagcuuucuaagaugaaacugaagcuguacccgccugcuuguuuuucuuagcccucauuuuuguuguuagaucuucuuguucauaggauaugcugcguuaauauuuccugucugccaugccuguauuagcugagauuccuauuaaucuguguuagcuuucucuggugggucauuucuauuacuggcaucccccaaauagagauaugcauaucgauuuguguucggugguagagcaaaguuucugaggacugguaaaccccugcagcaguguuagucucggggaugcuggagaucuggacagaacuauguggagcuacugcucagcuguggucuuuaaaccaaggcuuuucuuuaaugacccagagccacauuugcagugaggcugaggaaggagcugcuuuucuguuuauuagaggugacaugggcagcggggcaguggcaaagaggccauguugcucuuguuaaauauacaucccugacaguuggauaauagguuccaggaaguucaguggaaaauuaaaacaaagcaacauuuauagcugauugaacuugaaaagccauuuugguguugaauggcaaauauguggacuucagcauuccuagagccugaugcauccugcuggauggcccugucucguguacacgagggcugggcacucagcagugugcagggugcuuagggggaaaagaaagcuuucugccagaagucuucuuugcauagaguuauggaacacaaauuucccccuaucagggaacaugguuccucugaugguuagaggccuaucuuguuagaaggacuggaaugucuggcaagagucaggggaucucuuauguacuauaaauacuccuagucuccuacugaggcuggaucuucaagcagauuauuguaguguauucacaugacuuuagcguggaaacacuuugauauugucccaguuuuguccuaagauguuaagauuagaaggcuuuggauucaugugugagaugauugguuuacuuagaagaaaaaaaaaagcaguaggagaugggaagugaaggaagaguuucaggaaauaagugaagagagacuugagccuuuuuaacugucaaggaaaguauuuugcuuucaguugcauccauuauaagggaaucaugguggcugaccuguagucuaugcauguuuaaggaucuuauuuggaauaaacuuauuuugccucccaaaugaugaugcuggugcuguaaguagagacaacuguuucaguuuagcuuuccuggcagauucaccucuguccauucagcucugagccugguauuugccccaaaaucacagaggaagacaggucuuccagugaucugacuuaguuauauccuaaugcuuucucaaucugcauauuauacuggcacuugaauuugcuucugagccagaucaaauuuuaagcuaugccuuguucuguagggaucucaagcuugcuuugguagucucuaaguggugaaauuaggaucaggguauaaagaaaggcugguuagcucugucccuucuuaccgauacaguucuuccuagugugugcucacuuuggcagaccaagaaagcaguuaugaauguggaucaaagagucacagagcuggcuuagcauuuuguguacacuaacaaagaacugagcagugaacaacagguuucauaacuugaaagcacauuccauguaugauauaaguuggguuauuuauccauuuuuauggaaggguuacuacugugaaaagcuuuguguucugaguacacacaaguaaauccauauugcaguuaguacucuucuuucccugaaaugggaaagugauuuaugaggugugggcucuuaugugaaagaaaacagaacugguugcugugugggcccauaaaguuccugugccaucucaguggugugguuuacaagaaagagaagaugagcaagcuggcuggcccucccucacuugggcucagcugccccaaauacuugugauauugaagguuauuuaugagcucuucuggacuggcauucaguacucuccauccugguaggugaagauuugcaagcagaauguagaaacucccauuaaucuuuuuggucuuguugaggauuucuugccgacuggagcuaccauugaagaauggauuggccuuuuccacugaacugcaauggcucagauuaauauuaaucccuuuaaugccguaguucaugauauagucauuggugacuuggaacuaauccuauccuccuaacuagugugauuuauuaaauacacauagaaaucgagucugaauacagcuaggcagaaucagcagcaaauaaauaccucugugcaucuguauuaaugcuggaugauuggggcacaauugcagucuggcuggggagaaacagggcaaaaggaagcugaacucucagaaucaguaguauuuacccaugcauagcccuuaauuuacauagcaaaacugauauaaacucuuauacaagagaauaaguaucaguaacaauuuaaaaaggaaaaaaaaguuuauuuauuuuauaugugaguacacuguugcugucuucagacauaccagaagagggcaucagaucucauuacagaugguugugagccagcaugugguugcugggauuugaacucaggaccuguggaagagcagucauugcuccaucucuccagcccagucacaagaauuuuuaauuaauucuguggaugugaaaucaaaaaagaaaaauccuacauaaauacuugaaaauuuugaagacaggcuuaaauuaagaaaaaaaauuccuuaaaguuaauuauuugaaugacgaaugauuucucuucuauguugcugcugcuuuuccuccuccuccucccucccuuccccuucucugucucuuucugucugucucugucucugucucugucucugugugugugugaaguugucucuguagcccuggcuggccucaaacucauaauacucacaauuuuccugcuuaagugcuaggaaaaaaauuaagaaaaauaaauuauuauuugaaugauuucucuucuauguugcugcuacuuuuccuccuccucccccuccuccuccuucucucucucuucccccccccccaggugugggccaucacuuuuggcuucuuuuuuuuuuuuuuuuuuuuuuuuuuuuuuuuuuuuuuagauuuauuuauuuauuauauguaaguacacuguagcugucuucagacacuccagaagagggagucagaucucauuacgggugguugugagccaccaugugguugcugggauuugaacuccggaccuuuggaagagcagucgggugcucuuacccgcugagccaucucaccagccccuuggcuucuuuuaauauuuaagaguaacuauuuaagccagaacucaauacugguaauacaggacuguaccuccagcauaggaagcaagaaaaauccugaguuugaggucagcauaagcuacauagagagacuagugagguggcauaguaguuaagaacauuugcuguucuugaaaggaucccuccaggcagugguggcgcacgccuuuaaucccagcacuugagaggcagaggcagguggauuucugaguuugaggccagccuggucuacagagugaguuccaggacagccagggcuacacagagaaacccugucucgaaacacacacacacacacacacacacacacacacacacacacacacacacaaaucccaguucaauuuccaacaccauguguuagcucacaaguuuugagguuuuguugguugcgauguacuguaaugcuaaauacaggcucugguugccucagagacaggggaauccucauuuaucccuagugaaacuauguaaccuugcuccuuaauuuaaaacuauuggucaaguaaagaugccuacagccugaaucugggcagaggagagguaggggcuuggggucugaggcaaagacuaggagaagagagaggugaagagaggagaagauaacacaggguaggugaauugugagaacauggccgugagggcuggccaguuggaguaagagcagcccaaguggaacauggcaaauuaucacuuguggcaauagaggggaauagaaaaaguagcuuagaggguagauaucugcccagcgcuagugcauuuaaggcuaauuauaaauauaaagguuuugugccuuucauuugggaacugaaugaucacaggugggguagaaacuccaguuaacuuucacuauuacauuuuggcgcccauguuaggcaccauuucuagaaguuaugcuuggugcuuccccuagccccaugcucccagaaauaagacucaggcucagaauauauuuacaaauaccuuggccauauugcuaggcuuuucucuuacuaaaucauuacuuaaauuaucccauuuauucuaaucuauuuaugcaauguggcugauugccucugcucagguaccaugugucuaucuucuguguggaucucccgagccuggcuauaucccacaauucucucugccuccugauggcauacuuucuacucuauccuuuccuauaggccaugcgucuuuuaaauugccagguuaugcauccauacagaucucuccacacaaguguccauaauuccaguucuagaagaucugaaaccauacucggaccuucucgagcaccaggcacaugcauggugcacuuagagauauccagauaaaacacuuauacacauaaauaaaucugaaaaaaaaaauccuuuuuuuuuuuuuuuuuuuuuuuuuuugcuguuguuuuguuuacccuggcuggucuggaacuugcuauguagaccaaccuagcuuuaaacucaauaaucugccuguuucugccucccgagugcuggaaucaaagguaugugccacucuacaauuucugaguucuuaguaguaguaggcccaggcacuggcugcacugggcuuacauagucucucaccuuuuauagcuucaaagcuuacauuuuuuuuucuucuugaaaggagcaagaaaguagaacaaccaguccuacuuuaugauaacaauucucucugauauccuuggccaagcuagcagaaucauaauuucuuuuguaaauaauugagguuuaucauuuuucuuucucaaaccuccuuuucuucccccucuuugcucuuucagcagagauggcauuaauauggaaaacaucuaccuagcuggcuucguuuaaucaggcaagucugacauuugugaaaccucucauuaacauuuuccccaaagagcacaaaauggccuccucucaguauacagccaccucaaaguuuaggcugauuuccauagccauuggcaggcagcucucagagauguuacuucuucaaacucucauuucuggccaacagccacuggucacauauguggggaccuucuguuucggugcugcccuauuccuuguaaacauugcuuuuuaccaguuuagccugggaauaaccaggugucuauacaugaaugggaccaggguauagauucuucagggcguccgugcuuccuuuccgcuaauucagaagcuguugaaugcuucucacucuguuccacacugagcuaacaaaagcagagugcuccuugucccucucuguccuccaggagcuuauaaacaucaauuagguauacauuagacuauacuguagcauuuuagacuaaagcaagagcacuguauggaaauacaagaaaaaagagauuaguucuggaaauaagaugucaaggcuggucccuucauugaaacugagaacaugagcuguaggaaagccaggcuuagauucugaggccaucaguuuuauuaccauggaaacaagaccugguauguuacugacuuuuucauagcuugaccaagauaccuaagagaagaucacagggggcuggagagaugguucagugguuaagagcacugacugcucuucuagagguccugaguucaauucccagcaaccacacgguggcucacaaccaucuguaaugggagccaaugccuucuucuggugucugaagacagcgacaguguacucauauauaaaauaaauaaauaaaucuuuuuuuuuuuuaaggagaagauuauagaggggaaaaaggauuuauuuuuauuguaaagauuucuagcccuugucuuugaguccuuaguuaggugaaaccuuacaguaguggggagacauggaggcggaaaacuauucaccuaauagcugauaggaagcagagaagggcuaagagacugagaauuagauaaauucaaagccucacugcuuccuccagcuaugucucaccuccugagcuugucaaagaagcacuguccucaggagcaagcagucaacagaugaaacugugcuucucauucacaccauuauaaaccuuuguaccauggacuaauuuacaauaggggugauggcacauuaugguaacaauaauauguccucuuuuacuagaagguagcgcuagccuccuuuucuucauuccuuuuaucuaauucauucaaagacaaagucccuuguuucugugguuuuauuuauuuuucuugaggcaagaucucauauaguucaguuugguggugagauugucauucagccuagauuagacuugagcuucuagucuuggugcccucucccaagugcugggauuacaagugugcaucacuguaaccaacuuguguguuuagguuauacuccuaaaauuaaauucaagccucuuuuccuucccucuggauuuuuguuuguuuuucaguucuuuagcuuuugacuaaagacauagacagcuuauauguaguaauuuuaucucuuucuuuuacauuuuuaucacauugcuagugaguauucaaaaaguauuagaaacagaaccaucaguuagguuaugagugagccaguuuuaaaacugugagacuggggauggagcucaggguuagggcacaagcaccaagcaaaaugccaaacuuuaauuagccacauauggaggcacagccuucaccagauaguuguaagauugagacaagagagucacgugaguggagauccagccugggcaacaguuuuaauaaaacugugagcucagggcccagugaaagacugucucaaaaacaaaacaaaacaaaacaaucaagguggcaguucuuccccauuuaugucuauuucuaauuaagcuuuuucaaauauaugccuaugcuuguauguaugagugcaggcacagagucggcagagggcaucagaucucaugaaauuggagugacaggcuguugugagcuaucugaugugggggcugggaaucaaagucagguccuuuggaagagcaggaagcacuuguaacugcugagccauccccccaaucccugugguguguguguguguguguguguguguguguguguguaauuuugguggccaauacaaauaacauuuucuccauuauaauuuuauuuucuuuguuuacuuugagaugauugcauccagcuaaauuucuucuugcuuuacuacuacuggcuaccuucuccuguauuccuguaguuguuuuauuauaugcucauaauaguucagucuuuggagcuuuuucccuuauggugucuuuuuccagcagggucaacuuuguacaugacaauucauaucuccagacuggggaaacaaaagcuucaaggcauuuuuaguacauaggcaugaaaugcuaaauccugucaauuccagauccaaggucugcuuccuaucagguagcauaauauagauuaggcuuuggaaacucccaaaauagcauuugcuaauuugcccuuuccuucuuccuuuuauuuuuccugguaucuguguagauccuaccauagucuagauuccuguaagacucugucaucuggucaacugcuacuaccaaauagcuauauuuauuguuaugagcaaaaaucuguuugaaaaaggcagcaaaggaagacuuuuuaguguaucauuuucccauugcuguccugggugaagcauaacucccauggacagaaauacagaguucauuugaguauaaaauagcaggcaaggaaacagguguagaugggcuuuguugugagaucugccuacucuccaggaagacagccucccccucaccuccccaacagaagucucuccccuuccuucauuacagaucaucguaagacuuccauccuaugcuggucuacguagaaaugagagaguacauacuuuuucuuuuaacacaucguacuuuuuccuccccugagcuugcuaaccuucagcuuaagugugcaccaagugcagauguauagucuuccucccuuccugucccucacuuauucugaaggaaggcagcaggugaggggaugcggaaagcauggggugggaggcugggagggaggaguuuuucucacacgcacuauggauguugcucaaccaaauggugugaaauugagucagagccacagcauguguuucaauuuuccagggaauuuccucuuccuaacuguagguuuaacccuuucuuuuguuuaaugccaagaguuaccuaaaaacauaaaaugaguuaaauauaagaagaaaaaaaaaaugcuaagauuccacaaggccucucuuugagcucuggagcuccagcucauuugcugccagauggcuguagagaaggguauagacuuugaagucagguagacguagguucaaauccaaucucuagcaagcaugccuucuauaguucuuuugagaguuaaaugagauaauguauaaaaugccuaccauaguauauacuuugcacauagugcauacuugauacauguuuguuucaucuacaaucuaccuucuggaauuuuugucagauagucuugcuguguuucccaggcugauguugaacuuucagccuuccucagccucccaaaugcugaaaguauagguguacaucucacuuggcuacuuacuacauuuuacagggaaaccaggucacaucagugcaggccagagcuugacauacucaucaguguaaguuagggguuuucuuuuuuuaaagauauucuaacuacauucgcuuauuauguguauaggucuuaggcaugcaugcuaaggugagagggaagcuugcuaggguugauucacccuuacaaguauguuccagggguaguacugaggucauuagucuuggcaaguacccuuacccacugagccuaucgucaggugguacaggcacacaggccuguaaucccagacacucuagaggcagagacugaaggcucacagcuugggcucaugcuaggccuuaggcagcuggaggccuccugagcuacuuuagauugucucaaacaacaaacgauaaguuaagaguccaagggauucaaagcuuucuucuggacuucaugaguaccuguguucauaauacauacaauuaaaaagaauuaaaaauuuuuuaacauuuauuuauuuauuuauuauauauaaguacacuguagcugucuucagacauuccagaagagggcaucagauuucguuauggaugguugugagccacuaugugguugcuggaauuugaacucaggaccuuuggaagagcagucggcacuuuuaaccgcugagccaucucaccagccccaaaauuaauuuuaaaaagaaagaaaaucacuuauuuuccccaaaauguuaaaggggcagcuauugaaccuaugcuaccaggaugguggguugggaggcaaauuugucucucuucugucuuuauucuuauuccaacuagggagacucaccccaaugcuccugauacuuauuaaugaauuaauuaguuaacgaauuuguuguuguuaggggaagggcaaaccaaaaucuaacuuguguuagacaaguucucuaccaacaacccacacacacacacacauacacacaaacacauaccauucucuuuuuguuuuuuuuuuagguguaauuaacauacaaugaaaucuacaaaauuucaacauucaguuaauaaguuuugguaucguauaaaccauauaacuacuaaacagaaguuaaaauuuuaagaaaaguuacagcuggacaugaugaugcagaccuggcuuggaauuccaacacuuggagacugaaguggcaggauuccaaguuugagaugagcuuaggcuaauaguaaauuccuggcuaaucuuggcaacauaaagagacuuugacucaaaaaugguaucagaaagaagacacagaacauguucaucacuccccaagguucccucaugcccucuuugagucacacuguacacccuauauuaaaacgauuuauguccugucacaauagauuaguuuuguuuugagauuucaugcagauggaauucauggguggcuuguauuucauuucuucaaguuuagcauaguuuuggacuuuagaucuguuacuagaucaguauuucuuuugcuuuuuugccccuagacaguauuuaauaauuauauggcuagauauaucaaaagaaaguauaucuaaucucuuacugaaagacuuuuccauuguuuccaguuuaggauuaugaccacuauaaauauuucucuuuguuagcuguuuuaguuucucuuggauaaacagguaagaguagaaucaucgccucauaaggagcaucuguuuaguucaaaaaagaaacaauucuucauggcuccucccacccccaagcucuucuuuuucuucccggagggacugggcucuuuaauuugaggacuuggcaggagagaagcagccacaucaccagggucccuguugccagagcacaguggccugaacuggacacuuaaaaaacugaaacagguguuugaaacccuacuccagcuucugcauuugaugccaacccccugagaggcugagacuuugccaggagaacucaggacgaaucauauguaugcuggauuagagacuuuuaugaguccaggacgcuaaguguguauacauaguagccugauuauuuaaagcagauuaaaaaauguuuuuauguagcaaauacuauuuaaugaggggcaggaggcuaugugcagguaaaaagucuuuccuuacaguugauucuaccucucuaccuuuuauccuccagcaauugagucaguauguuccuuaguaaaguuaauauugccaaaggcucugagccagguaaauuugguacccugugugucaaacauggggcuacauuaugcccuguaaauuuuuuauuauuauuauuuuguuuugucccgguuuuuugagacuauauagcucuggcugcccuggaacuugcuauguagacuaggcuagccuucaacacacaguuccuccugcugugccucuugagugcuggauuaauucuuggcccaguucuauuuuuuggauacuuuuguuuuaacuaagccauaggauuuuuaauccucauaugcuagcagcuaaagcaggaaacugaaggucugaaugucugaagcuagaggacucaguacucuguguucagcccaauugaaaccaauacaaguauaaucuuacguuuucucucucuccuucccucccuuucuccucucaucccucuccuuucaacagaaucuuacuguguauguguagccuuggccgccugcaacggaacucuguagauaaggcuggccuggaacucacagagacucagcugccucugccuuuuaagugcugacuuuguaaucugcuugcuuauguuuuguuuuguuuuguuuguuuguuuguuuuuccagacagggucucuuucucuaucucugucuguccuggaacucaucauguagacuaggauggccucaaacucacagagaucuaccugccucugccugccaagugcuuggauuaaagguguauaucacuacacccagcuauaauuuguuucuucaagggcagcuucaacugaagauuucaaaaggaaguuuccaacucugaaucuuuucuuauacgugauuuaaaaagcccaagaaagagaggaauuuagacuuuccaugcaugccagcuuggccuuuccacaaacucuugagagaaaaagcauuuuugaauugaguuccacuuucauauucagacauucaccuuagagcuugcuacugggccauaucacguggaugcuggccuuggacacuaggcaagaguuaaaaggcuaagauuaucucaaccugaccuuuuuuuucauuuaauuuaguaaaaaaaaaauuugugggcuggugagauggcucaguggguaagagcacccgacugcucuuccgaaggucggaaguucaaaucccagcaaccacaugguggcucacaaccacccguaaugagaucugaugcccucuucuggugcaucugaagacagcuacaguguacuuuacauauaauaaauaaauaaauaaaucuuuaaaaaaaaaaaauuuguauaauucaaaaaaaauuuuuugauacauacauacagcugugaaauuuaacaauggauuuauguaacugccacuacagacgggaucuaaaauagcagacuuccucugccuucccucuucagccacuagucugcuguccuucacgugguuuuaucaauaagcucauaugaagggaaucauauacaguguguaaucuucugaaccugcuucauuauuuaccaugaugcccuugggauuuacaugggcuacugugugucagcaguucccuuuuuacugcugagucauaguccacucuguguaugcagcauacuuuauccacccaacaaggauacuuggacgcuccaguuuacuacuagaauugcuaugaacauugguguggguuuguauuugaaacaaggucuugccauguaucccagccuagcguggaugaaaccuaacauccuccugccuuagcacucuugaaugcugacauuacaaacgugcuccaccauaccuagcuugauuguucuuguuggguuuuuuuuuuuuuuuuuuuuuuuuaaauacagggucccuuguaacuacagcuggcuucaaacuucuuuauaaccagagauuaaauugaauuuccuuuuaaaaauuauaaacuugauauguacagguauuuugccugcauguauaucuguguaccauguucauguagugcccuuggcauccagaugagaguauuagauccccugggacugaagucacagaugguugugagcugccaugugggugcugaaaaugcaaccuaaggucuauagcagaguagccagugaguucucuuaaccacugagcaagcaauggcuucagcucauuacuuugaacuucuaaucccccugccucuaccucuugagugaguauuaggauuacaagugugcaacaccacaccuuguuuaugugauacugaggaucaaacccagggcuguaugcaugguaggcaaguauucuaccaauugggcuacauccccuaugucuaauuuauguaugucucugugugaugugcuuguauaagcauguuuauucauauguaugagcacauguguguggacgccaaaggcugacgucagguaaagacagcuucuugaguugcucuccaccuuauauguuagggcaggucucucacuagaacccagaauuugcugauuuggcuaggcuagccagccagcuuggucuggggauccccugugguugacuccugaguauugugacuacaggcagacuuccacacucgcccgaagugcugauguccaaacucagguucucacccuuauauaggaaguguuuuacuaacggagccaucucuuuauccuuuguguuugucugguuuugguuuuguguuuguuuguuuguuuguuuugagacagggucuuauagccucaguaaagcuggaauuuacuguauagacugggcuggucccagacuuacggacccuugcuugccucugccuccuaaguccuguuauacaaaugagcaccaucacauccagcuguuacacaagugagcucuaucacauccagcuguuacacaagugagcaccaucacauccagcuguacacaagugagcaccaucacauccagcuguacacaagugagcaccaucacauccaucuguuacacaagugagcuccaucacauccaucuguuacacaagugagcuccaucacauccaucuguuacacaagugagcuccaucacauccagcuguacacaagugagcuccaucacauccagcuguuacacaagugagcuccaucacauccagcuguuacacaagugagcuccaucacauccagcuguuacacaagugagcuccaucacauccagcuguuacacaagugagcuccaucacauccaucuguuacacuagugagcaccaucacauccagcuguuacacaagugagcaccaucacauccagcuguuacacaagugagcuccaucacauccagcuguacacaaguggugagcuccaucacauccagcuguuacacaagugagcuccaucacauccagcuguuacacaagugagcuccaucacauccaucuguuauacuagugagcaccaucacauccagcuguuacacaagugagcaccaucacauccagcuguuacacaagugagcaccaucacauccagcuguacacaacugagcuccaucacauccagcuguuacacaagugagcuccaucacauccagcuguuacacaagugagcuccaucacauccagcuguacacaaguggugagcuccaucacauccagcuguacacaagugagcuccaucacauccagcuguuacacaagugagcuccaucacauccagcuguacacaagugagcuccaucacauccaucuguuacacaagugagcaccaucacauccagcuguuacacaagugagcaccaucacauccagcuguuacacaagugagcaccaucacauccagcuguacacaagugagcuccaucacauccagcuguacacaagugagcaccaucacauccagcuguuacacaagugagcaccaucacauccagcuguuuuuauuuuugaacaaguuuaguuuaugaauauuuaucuguguguuuguuuguuuccuuguuucaagacaaggucuuacuauguagcuuuguuagaccuggaucucacuauauagaccagcuggucuugaacucagaaauuaaaggcacagauuauguuuugauuuaauaucugaguucacuugaccuuuuccccaucccauuuucuuuuuuuuuuuuugaaauauuuauagauguguaguuuuuaacuucugaucuuuuuguuguuuugagacaagaucuugucauguagucugcgcuguccuuaaccuggcuauguagccuaugcugucuagacugugcugccucugccucccaagugcuggaauuauagccaugagucaucaugcucaguucuuaccaagaucucugcuuaacugguguugguuggaauggaagguuuaaauauuuuguauuuggauguucuguuccaacauuucucauugagggguuuuuuuguaauguaacauaaucuuuuuauuaaucauuuuauuccuuuacauuuaaaaugauguucuccuuccugguuaccccuccacaccccccccaucucauuccucucucccuccuccucuuugccucuaugagggugcaccuccacccauucaucuaccccaccucaccccucuagcauccccuuaugcaggggcaucacgccuccacaggaccaagggccuccccucccgucgaugcuagcuaaggccauccucuacuacacaugcaucuggagccauguauacucuuugguuggugguuuagucccugggagcucuggggaguucaguuaguugauauuguucuucuugugggguugcgauccccuucagcuccuucaguccuugcccuaguucuuccauugggguccccaggcucagucugaugguuggguauaacugucugcaucuguacuugucaggcucuggcagagccucucagggaacagccauaccaugcuccugucagcaagugcuucuuagugucagcaauaguguggggguuuggugucugcagaugagguggaucccaagguggggccgaucagucucuauuccauuuuuuugucccugucuuuccuuugcaaacaggaacauuucuggguuuaagauuuugagaugaguggguggccccaucccucaacugggagccgugccuaucuacuggagauggucacuacagguucuuucuccucauuguuggguauuucugcuuaagucaucaccauuagguccugggagccuccugcuucccuggcaucugggacuuucuaguggcuaccuccaguuccccaucccccacugcuacauauuucuauucaguaguauaauuaacuuuuucuuuuuuaguauuacucaguauucuaauucuuuagucuuucuauuucaauuuuaauaugcccuugucuauauuacaaauaaucuguuuuggaauuuuaaagaaauacacuggcugugcagaugaguuuaggggaauagcaucuuuccuaugcugugccuucucaucuuugagcaugguguggcugcucauguguuuagaaucuuauuuccuuuaucaggcuauuguggguucagcauucagauuuuaugaguguuuuuggacucacacuuacuauuagacuuccacuuaaauaauugcuguuucuuuucuuuuccuuuuuuuuuuaaagacaaagucuuaccauauagcccuggcugucuuacagguauugagacaaaagguguguacuaccacaacuggcucuaaguguuuauuuuggaguaguuaguuaauuguuagcauguaaaaacaagguccaguuuuguuauguugaucuuauguccugucaccaugcucaacuugcuuauucugagagauauggggacgugugugugugggggggggggguguaugugugcacacacacuaaaagaguuuuauuucuuuucuuuuaaauuauauuuucuuuuuucuuuuuuuuuuuuucgguuuuucgagacaggguuucucugugcagcucuggcuauccuggaacucacucuguagaccaggcuggccucgaacucagaaauccaccugccucugccucccaagugcugggauuaaaggcguguaccaccacugcccggcuuauuuacuuuucuuguugcauaggccaguacuucuagaucuaugagaauggacaaguuucuauucucaccucuaggccgaauauauucaguacuuuaaaguauaguaaauaucaacuuuuuguggguguuaauuauaaugaauggagguuaugcuuugucaguuaccuuccuucaucaguugacauaaucagguauuuuucuucucgagaauguugauaugauaaaaugauuuucagauacugacuccaccuuguagucucaggauagccucaguuaaucuuggcauaguguuuuuguggaauauuguuacauugaguuggcuaaccuuaaaugaaagcucagagugacauugaaagaagcaagagugguacuguccagaggcuuagacaaguccugggacauucaggaagcucuggauaugcuccugaggaagaccacagauaguuaucaaaucagagaugaaguaguauacuuuuaacacauuccucaucugucaaaugaaguaguuaaacucuaugacugcuaaaauauauuuauuccagcauuuuauucuguaaaucauggcuucauaggaacuuagacaguagaaaaauauaaaggcuagauuuuauuuguuuguuugguuuuaguuuuuccagacaggguuucucuguguagccuuggcuguccuagaacucaccuuguagacucuguuucccaagugcugaacuaaaggcauaagcugcugcuaccaccaauaccaccaccggcaauuuuauuuuuuuuaaugagcccacaggaaucuucacugucacccagcuccaucgcuuucuacaagacaaagaagaauccuggugugugcaguuaacuuucccacaggagcuucuccuugauggaaguggagguguaagcgccagauucagguccugauggccaggggcaucggagaggcuuagcaggggcaccgucugccacuggaugugcagggcggggugucagggaggacuucacugauugaaagguuacaucuuuguacaugugcaauuaauagacagauuagaacaucaauaauuaaucccagugaaguguucagaugaacuuccaaaguagagcuucuuaaaguaucugcugaagggcuagugguucugucuucaugguuuuuugucaaugcauugcaccugcagaguuuuaaaaaacauaauaauauuaauuaugagauuuaaaucauauuuuuaaaaauauaaacuugguuugguuuaagacaggaccuuccuguguaauucaaaauacacaauuaugccuuaccuaggauuauagacauaaaccaucauaccuagccuauuacuaaaugcuaaucugucaaauuguuaauaccaucucucaauuucugucuuucucauuguauaacaagcaauaguuuguagccuguacugguuuauaauaugcuagaaaaaaauauaauuuucaauugacauuguaguaaauauuccaaauccuauaauauuauaggaaaacuaggcccuaaaauauuuuuaaaaugagauaacugagauggaguaacuuguauaaugacacaagccuguuaguguuagaacuaagacuagaauaaggaucugguagagucaggguaggacguagccuuaaguucugcaacuuaguagaugugucacuucaguuauuuaacuucucuaagugucucauuuuaucaaaugaauaaaugaagacagaugugguuguguaaaccuuuaauucuagcacucaggaggcaagagcagauggaucucugaauuagaggccagccuggucuacauaguguauuccaagccagccaaggaucuauaaugagacuaucuaaaaaaacauuucaaauucauggggcuggaaaggcggcucagugguuaagggcacuugcugcucuucgagaggacucaaguuuggguucuaacauccaaaucaggcagcuuagaacaaccuggagauagauagauagauagauagauagauagauagauagauagauagauagauagauagauagauagauagauagauguguguguguguacauauguguguacauauacacacauguacucacacauaaacaaaaguaaaaacauggauuguuuuaaauacacaaacacacacagauuuaggaaagguagaaagggcuacuuuuuaaaaaaaaauguuuguuuugguuugguuugguuuuuuucaaggcagaauuucucuguguagcucuggcuguccugguaagaggccaaaccuacuccaucuugggaugggccuccaccuuaagagaaaguucaccuauaacugaacccaggcuguacccaaguaccaggaaggaccccauaacuuguccuuugcccauaugccagaguuacucccuagcuacuuucuagcaacugucaaagauaguuuguuucugaaauacauucagaccaucugugaucauucaggguuuuacuucaggauacccccugucgcauacaguagucacacaacuaggugcuugccagacuuacaguagucacacaacuggaugccugccaggcuggaaccccccacuugcucaccauuuccuauaagccugucccacugagagcuugggccugcacccucccauucuacuguguuagagacagcuguguggcccaagcuguagcuuguaaacaaaggcccuagauugcaucagagucggcuccuuggugaucuuuugggauucaugagcacuuccuggcacaacacuggaacuuacuuuguaaaucaggcuggacuugaacuuggagaucugccugccucugccucccaagugaugagacuaaaggcaugugccaccaccauccugcuaauaauaaauuuuaaaaauuuauuuauuuacuuauuuauuuugguuuuuugagacaagguuucuuuguguagcaccgagugaccuggaacuagcacuauagacuaggcuggccucaaauucacagagaucugucuaccucugcuuccugagugccgggauuaagguguauacuaccacugcccacuuuuuuuauauuuacuuaaaacuuaaaaaauaaguucuuuaacaguauagagaacuuuggacucggacucuaggguuaaaaaccccuaaauaauaauaucuuauuguacuuacuguauacuuuauuucaugcauuaugcccuguauauacacaaaaugagaaaauggguauaagucgccuaucauagggccuaguacauaguaguauuuauaauaaauguuagcugguauuauugauguuuaguuaacuuuaauacuguguuuguuagccgggcgugguggcacacaccuuuaaucccaguacucuguaggcagaggcagguggauuucugaguacgaggccagccuggucuacagagugagugccaggacagccagggcuacacagagaaacccugucugggaaaaaaaauacugugucuguuucuuauuuuguuauauaggguuuuacuaugcagcucauucugguucugaacuccauguucuccugucucauccaugaucuuaaaaggaauagaaguuaaagauaaauuccaagauaccagauaacuuguggcccuuuuaauuccuauccacuucaagguauccauauagcagagaaaggagcugggcguuuguuucuugucuagaucguuagucuugugagaauacugauuucucacuccuuggcgggauuguauuuaacuugagggcuguauccagggcacuccagagcuguucaugguacguaacuucuugauuggacuguucauggccuuuuuagaggagagaaagauaauaagaacagccacuauuuaguacuuugugccaugccacacacccuauaccuacccaauaaccuaucuuuuucucuuuguaagcuucauuuuuguagauuaaaaaugaaacuccaaaaaaauacggagacauacuuauaguuaagauuauaaaacuaaugagugccaaaagcuggagucaaguccugguccaucugacuccaagagcucucuaugccacuuagucacucaacuuuauugcuuccuaugaaacuacagcagaaagaaagguuucuggugaucuacucucaacauuggccuuccucaagacuagauuuacuuagauacuuuucagaguccuucugaagacaaguaucaugacgcugcucauaguaggcguacugaauaauuucacaaccaaggagauacgugacaccauagaggagcagacagaguuccagcccuggaaaguggcaacguaaggcacaaacaguccaguaaacaaagagugcuacggauuagguguaggguucucugaaggugacuggugcguguucuuggauuggagaaacaguuuuaaggaggaaaauccuagcccugcuggugaaagaaguagugggguucucuuaaaaucaacugcagguucaauuucugacuagucaaggccacagauuguagagucucuaaggucagauuaauccagggcagaaggcaaccuucuugaggugacuuauuacauuguccuuagcacuugcucaacacuagugaacaggaagcuuggcucccuguauuaggacguuaaaacagagaagucacacuuugccccccuaguauaaaucugagaacugcccgugcccaccaacucuccuguccucucaaaugaugggugaccugaccaaaggggagaugaaucugacagucuucucaggucagagccugcaugugacuucaagcauugcccuuugacaaaagaggacagacacuccuagccugcucuccuagugcauacuacccucccaggaaggguguucucagcugcaguagccuuuucucauguggccagcaucgggcugacacauuccugaacugaaaugcacacauaagcugcuuucccuggucgcgaagcucuucacuccugagugacucuuaucaggggcaguugggcauucucaaugggauuacgcugacaaggaaaaaggccugggggauguuauuucaacaccauuuagcuucagaaaugccugccucaacccuuuugcccucggagucuacuucucucuuccugcuuucuauagggucaucagccugccuucaucauagcucuucauccuacagagauugacuaagguuucuagaggcggaaucauucacaagauggaucacacugacgacaucauguaaaucaccccaugauagaaacacacguuguucauuuaacccucuuuaaucauguguucauuucauguaugugaguacacuguagcugucuucagacacaccagaagagggcaucagaucccauuacugaugguugugagccaccaugugguugcugggaauugaacucaggaccuguggaagagcagucagugcucuuagccucugagccaucucugcagccccuccccccugacauuucuauauccagaggcauagggcaaaauuauuugagcacaauuccuguuugguuuuucugucucuccugacauacucaaacuuagcagggauuguuaggucaccauauucuacuuuucgcacuauuguauauacuuuuuauucaagauuauauuucuucugaaagucagagcuugagaguauucuacaaaagaaauuucugaagugcuggaaguuuaguaguuaggagcuaugagguuuuugaucaccaggggacauaaagaguagugggacaagccugguaugaugacacacaccuuuaaucccaaugcuugggaagcaaaggcaggcagaucugugaauuucaagucagccagggcuauauaguaaaacaauaucuuuuuaaaaaaagagguguggggacaggcaccaggcaguggugacguaugccuuuaaucccagcacugggaggcagaggagauggaucuaugugaccuuggucuauaaaguaaguuccaggacagccagggcuauacagaggaacccugucucaaaaacaaacagaguuguguuugaaagcuggccaugauaacacguaccugagauagcagauugccaugagaucaaggccaacaagugcgccaaccuggaugacauaacauuuaaaaaaaaagugauccacucuuaacauucaggaggcugaaacaggagaaucugcaaguuggacccuaucuuguggugguccauaacaaguguaaggccagccuuagccauaugggaugccccugucuucagaauguaugcugcuaaagcaagcacaggagcaacucugucuuuaaaacaaaacaaaacaaacaacaacaacaaaaacacccaaaccaucaugguaaaggaggagccaugcagugucuuuuccucugauuguuagcuuuaaaguuauccagaccugugaauggucacgugggcacauaggcuugguuuuacaaacuaguuaauuucagggggaaaaaauugccagaggcaacuuccacuaaccuguaauuccugauccuaaacugauggaucaaagcuagauaggccuggcaacugugcucuagucuaugagagaaaugaaauaaagaaacgcacuaggccaagucuugguucagguacuaacccugugaccagguacaaaaaugcuuuacuuuucugauccauagugucuucaucgacagggauuuccuaaugaagggcagaggagagcuggugauuaucuuugcuauugugauuauuuaggagugaagccauggaacuggagacaugacuuagugguuagaacacuugcucuuucagaggacccaagcuugguucucaccagucacaucaggcagcucacaacuaucuguaacuccaauuccaguugcuccaacaccucuggcccagaagacagcugugcucagacaugcucacaugucgccacgcauaccuucacagaauuaauaauaagaaaauaagccugcuggcauaugccuuuaaucccagcacuggggaggcagaggcaaguggaucuaugacuuugaggccagccuggucuacagagugaguuccaggacagccaaggcuacacagagaaacccugucuugaaaaggaaaauaauaauaauaauuuuuuaagaaugaagauaagucagguggugguggugcaugcugguucucuaugaguuugaagccagccuguccauagagcgaguuucaggacagccagggcuacauagagaaaucuugacucaaaaagaaaaaaaaaaaagagugaagccauugugaugguguaugucuuuaucucagcacucaggagguggaggcaaacaguucucgaugagucugagagcugaccugguauauguagggaguccagacaauguagggcuauauaaagaaacuguuucucaaaacacauauauaaugauuaauguuuuuauuaaauuaaaauuuaaaaaaugauuucagggcuggagagauggcucaguaguucagagcaugagcaucaggcacacauaugguacacagacauacaugcagacaaauauacauguaaaauagaacuaaauaaaucuuuuaacaggaaauuaaaagagaggcaaguuaggggcuugcccucagaccuacacgagagcauguguacacacacacacucgugcaugcacauuugcuuggguguaaaugcuaccugugugcauuuauacucauagaagccagaagaggacaucagaaccccuggagcuggaguuacaucucuuaagccuccaaggcaaauauuuuuauaaagugaaaauaaaaauauuuuggaaaguauucacuuauuaguccgccaacugacccaacuuggguuuuguuuuuaaacacuuauguuauuuuaggaauucuacuuuuuaguuaagauaauguguuuauugguugguacuggggguugaagccaggaccuugcagguauuagguaagggcucuaccacugagcuucaucagccuuaacucaguguugaaacggggucucacuaaauuccucuggcugaucuugaacuccaucuguagcucaaccaggcuuugaaucuauaaaccucuuaccuccgucucuuaagcaacugagaugacaggcaugagcuacacagcugccucuaauuugguugaguggcuagacucugauuaaacacgagugauucaucagcuugcacauuuaaggguuaauguccaaaagccugaggauuagaaaucauaaacuuacauuuccuucuaacugucuugauaguuugcaggccauguucacaaguacccagagaugauagagucaaaaaugacauaaaaacucauccuucguagauaucugccacaaaaaguuucaagaccaccagugaagaaaggggcucuuguaugugcucucuggcuggaccaccuugucaaacaaagucuccaccaucuuucuguccuugcagcacaguuuccccuaugggggagauuagaggaugugaaacacagcccaaccacacaugggccaauaaccgacugcuuuccauaaaccucugugccugaggggcuugaacuguuuucugcaguuaaguaggguuaaccugucuugcuugagaucacauuucacuuccccuuuaaaaagguaaaacgugcuggagagauggcucuaugguuagaaguacuuguuucucuugcagaagacccagauucaguuuccauaacccacauaguggaucuaagccaucuguaauuccaguggcaggggaucugacacccucuucagaccucugagggcaucaggcucacacaugguaugcagucauacauguaggcaaaacacuuauacauaaagugagauuagcuuaaggguaggguacagaaggaaaauccuuuacugucugucaguacagugcguggcuccugguuggaacagcaguaaagguuggcucacuuagggcaucccugcuagauggcuaggguagcuugcuacuaaaggugcuaccuauuacuucaugcaaauccuauugcuauuguguugccugggaaaagaacuugaaugccucucuccucaacaguaaacugcaugguaauuguggugcgguauauccuguaaucugagcuucaggagguugagaccagccugggcaacauuagugagacaggccauacuuagaccauuuuauucucucaguaacucuaagaaaccauaccaccaucuucauuuuucacuaauaaagaagugaagacuuccacaaauucugauacucaaggucauacaauaaaaggaaaacagaauuugaauguaggucuuguuaacuccaaagccaggguguauaaacucugcauuacauucuuuaaaaauauaccaaacuauuucuuuuucuuuaaggagcaaguuuaaaggguuuguuuauuuauuuauuuuuuuuauguacauugauguuuugccuccaugucuuacuguguuugggugccagauccccuggaacuggaguuacagacaguuguaaccugcuuuguggaugcugggaauugaacccagauccacuggaagaacaggcaguaguccuaacugcuaagcucucucuccagccucaguaccaaguuauuucuauagggugacuaacuaugacuaaaaugacaaauaaaauguuauagcucaacuauccuaggauuuaguuucuucuguuccucuucuccugccaguggcucaacacuguauugauuggaauacugcccucuaaauuaagccuuagguuuguccagguucgcuccuaauccaggagggagagccaggccccuuuaacaaggccagcagucuaaaugaggcccguagggacuguccucaaauaucggcuugaggacagacugagccaucuuccucccuggagcacaaguuugaugugugagcuuuaaacacuagguuuuuugguuuuuuuuuuuuuuuuuuuccuagagggaaccggugagcaauucgucuguagcauacaggcaagcuaaaucugcuguaguucuuacucugcaugcacuauuaccaccaagcccagacucaagcaggcaguuucaaagcccaggagaaauuaaaaacuaguguugcccuacuuuauagcauguuggugcaccccagcuucacgcagccauugcacuuggagcagcuuuuucaaucagaauuccucuuauccaguaaaaaguuucauucuccaauagcaucaagaagagaagauacuuuauaaguucauuaucaauuaaugcccugucagguaucuacagaggacuuaaauagaaaauacaaaaagaaaacuccaaacugauauuaguaaaauuucuagcuaaugagccuaagaggucaguagccaaagccaagaaucuccacaucccguaagcaucaacaaccagaaccguuacuacagcuccuugugcugccaguacugaggggucuugagugcuucugcuacccucuuguaagaccuuugugauacagggacauuuccauuuuaccuguggagggcaaaagcaucagaccugugcugcaggagcucaccgacucugccugcgaggaaacaggaaacuccacaggaaacaguccacggagcaacaguccuuugaauggucacaugucacucugcaaagugcucagaaaagugcccaaggcagcugaaccuaaauauacaaucuugaaagguuugaagaacaaugccacaaaacaaggagcaguagccaggcugcuagcacauguccuaucaacaguguccaucugucugucucucuuaucccaacucugucggcaauacagagcugcauuucugguaauguugcauucuaggccaaagugaaugguuaauauuuuugacaguuacauucgagagauaaugaguuuuuaagaaaauucuuuauguuugggucuugagagauggcucagagcaaagagcacuugugucucugcagaggacccaguucugucccagcaccuacaugguggcucacagucaucccuaacuccaguuucaaggaacuugaucccugcuucuuaccuccacaggcaccaggcaugcacauggugcacguacauacacaggcaaaacacccauacacuaaaauaaauaaauaaauccaaaaaauauuaaaaaguauuuuuaguuccaguuugcuuaaugagaccuguccccucucucucucucucucucucucucucccucucucucuuucucucucucucucacacacacacacacauacacacacacacacacacacacacacacacgacaaaaaagagcccgauaugguuccacacccccaucauucuagcacuuaggaguuagaaacaagaggauaaggaguucaagaauagucuaagcuacauaaaaucuuguuucaaaggggggggggaaucuaaaaaugccuaagguucaauaaagugacucuaagcaucaaaccaaaauacaauagauaaaauaaauauugauaauuggguuucacaggaagguggugauacacaccuuuaacuccaacucucagaagucagaggcagguggagcucugagugaguuugaggccagccuagucuacagagugaauucuagaauagucaggauuuuacagagaaacccugcuuaaaauaaauaaauaaaaagaaaauaugucugcuguauaauauauaaaggauggaaaagacugaauucagaugagauaagaagugucuuauagcgggcggugguggcgcacaccuuugaucccagcacuugggagguagaggcaggcggauuucugaguuugaggccagccuggucuacagagcgaguuccaggacagccagggcuacacagagaaacccugucucgaaaaacaaaaaacaaaacaaaaagaagugucauagagcagaggugcucagccuuccuaacaccucguccguuaacacaguugcauuccucgugccaugcugaccccaaccacaaagugauuuucuguguuacuuuauaacuguaauuaugaauuguaauauaaauaucauuguuuucuaaugguuguaggcaaccccuguaaaaggguuguuuuaccuauaaaggggucacgaccuacaggcugagaaccauugcuuaaauggacaggugauaguaaacuggagaaacugauguccuucagccaguggauggcuacagaaacuauagaacauacaaggagaauagaauaguauucagcaguaaguagggacaaaccauugauaugcagcagcucggguaaauaucucaaguauaccuaccaaacauggucauguuuuagaugacugacagacaugguacauuguuuuccuaaagcagcaagagaagaugguuuuaauuuuuguguguguggucacuuguucaugcagaugugcauacagaacaucagacauuuuccuccauugcugucuaccuuauuuuuggggacggaauuucucauugaaccuggaauucaccuugucagcuaggagcccccccacacacacacacacacacacacacacacacaggaguuagagacuuuuuuuacccaggugcuggaggucugaacccaggcccacguucuuaugcagcaagcaccuuacucagccauuccccggucucaugguacauuucuuaaugagccuuuaaaaaguguuauguauuucacccuuccuaacuguauucucucuaccuuaaugucuguuaacacacaugugcaugcucucacacacgcacacauuucucuuuauuuuuuuucuguaagucaucaaucucuagguggauccaguggggaaugagaagcagguuuuguacagcugaugugaucacuauacagacagccuuggaaaauacuacccaaucugccaguuaauuaaagcguuaaucugggaagcagccggcccagaaaauguuuacucagagaggaggaaagguagggacugaguagggagugcccuacauuugcaugaaaaugaagcgcucgcucacgcacucagcccuacagcccuacuuucccuccccucagucucuaaggugggauagccuugaucauaucccugaaagauucuggccuguuugggaaaacucaaaaggaaacuagcucugaaaacucaaaccacaguagaguagaaagaagcaauuuaacugucagcaaagucagguaggcaggaaguccagaguagugugucuuacccuggacugagaucugcuacaguagacauaugugcuggcagugagguaggguagaugugugguuugggaauuguaaaaccauguaaaucucagcucugcuuauugugugauucaaggccaaucaugaucuuaucuaaaccauacuuuuucucaaagacugugaugcuccuucaucucaggacaguuagcuaccugugugcucugggaaagaggggggaaagagggagggaagaagguggguuaagaccuugcaagauuacaaacugucgcuaugacuggaggcugcucagccuuugcuuauuccaggcuuccuuuccaucagggaacuaaaaucagguuucccucucucccaggaaugucuuuaguuaacaagguaaagaucaccuguguaucacuaaagaaaugaugaaaugaguguagaaaauugacuaaauaaguauuguugguuucuuuccuuuuuuauuuuuguuuguauuuugaagcaagaguagccugcuauguaguccugguugcccuggaacuagcucuguagauaaggcucccuucaaacauguagugauuuuccuacugcugccuccugaaaacugggguuagaauaugaacugucacaccugauguccagcuuuguuaauuuuuuugauugugcucaagggcugagaauguagcucauuggaagaauaguugcauaugcaguguccugaacucaaucucaagcauacagacaacaguaaugaaacaauauucuguaugacaaaaaaacucacccuuuuaauaaucuuacuauuaacuuucuaaauguucuuuuuaaaaaauauuaaucuuuuagagcuaaauccuaaaccuuuuacagauaaaaagguugugucaggaacuuaauucaagguauuuuagggggaagaagauugacccaaacaaggagcccucuaacuucauucaacagacaaaaaugaccuuuugccaggauuaauuuuuguuagugucuuuucauuuuugauuugugggucuuuuuuuuuucuucuuguuuuacuugcagaacucucagagauugagccaaauguauuccuucguccauuucuggaagucauucgcucugaagacaccacugguccuaucaccggccuggcacucaccucugucaacaaguuccuguccuacgcacucauagguaagcacuuaggcuuugguggcaucugcagcacuccaucuccugcugcacaggccuuaaaccagcugguuugcccagcugucccuuuccuaguagagacauaggccuacuuauucucaggaugcugauuggcuggguuauccauggagggagagaagagagaagauugccugggacucuaguuuccaccacacuuuggagaguuaagagugugguucccuuguagguuuaguuugccuuuuuugaaaacuaccuuuauuuauuuauaugcaaaggaacaagcauguuucuaaaauuacacaaaacaggaagcagggaaaagggacaugcacacagacagguccccaauggaggucagaggacagucuguggcauagguuuucuucucccaucaugugggucccaagaauaaaacucagucauuaagcuugacagcaaguuccuuuaugcacugagcuaucucucccucuggcugguuugccuuauuuuccaauuuugugcugauuuuaagaaaacuauguagagacgucugaaagaaaagaagucucuccucucugucuuagcgccaaaaucucuucuuuaaguaaaugguguuagugacauggcuugacugcuuuuaucuuuuucuugaugcauauaaauaugaacacacgcacaccccuccacauuuacacacucaucuuaagacaggucuuucuguguagcuuggaaguugaaguccuccugccucagccucccaaguacuggauauagacaguauuaucuuuuuuaaaaaauauuuauuuagccaggcaugguggcacaccccuuugaucccagcacuugagaggcagaggcaggcagauuucugaguucgaggccaaccuggucuacaaagugaguuccaggacagccagggcuauacagagaaacccuguccaaaaaaaaaaaaaaaaaagauuuauuuauucauuuuauuuuaugugaauaugcgugucccuauauauauagauagauagauauagaugugaucuaucucucucucucucucucucucuauauauauauauauauauauauauguauauguauauauacaccacaugcaugcagauacccacagaagccagaagagggcgucagacucuccuaacacuguaguuacugcguuuaugagcaaucccagcuaggugcuaggaacugaaccugaguuuucuagaagagcagaguauucuuaacugaugagccaucucgucagccugauuauccccccuuuuuuuuuaggugggagggaggggauuuguauuauauauuuucuguauuucacauaauaguguuuauuugauguauacacauaauuauauaguugauuuauuccuuucuuuguaggaaaacacacacacauaccccuauaauuuuaccuuuuaaccuuuuuuuuuuuuuuuaagauagagcacaagguggccucagauucauuauauagaauggauacuguggauuucaggucuuccugccuuucccuuccauacugggauaauaacccuuuugcucccacauccaguuuuaugaaguguuaggaucaaaacagugacuucaugcauucuaggcaagcagccuacauccacagcccccuuuaaucaauugaagaaaauaauuucauaguuuuagucauguccacagcauuguacaacuauuccuaacaaauguuucucaaacuuuuucaugccccaacagaaauuuaauuaugaaauaauuccccauuuuccuccucauuccuccuugauauaaugguguauuuuuauuuaauguuuacauuauucucuuuuuaaagccauuauaaauaagcugaaauaaaccccuguguuccuacggccauauuuacuaauuuuaucucugugugaaguguuauagguuacauuuuauagauggcuucccuaguagguuagagcauuuucaucccuaccagcaaugcccugggcguuuccauuucuccuugcugucuucagcccuuaggauuaccaguuuucuguuuuaugugugugccacuuuggugggcaaaaaucugaauguuguuuuauuuccuugagguugaagcauugaguuucuuuugucucuauuuuggauuuguuuuaacaguuguaaaaucucuuuguauaggcagcuacaguaaggcaugaagcugaggcucccgugccuggagaaguggagaccuuacccacucacgaccuggaugcuaggaggucgcagaaacucaggguuccuuagcuugagcucaucagaccuuguauccugccaaacucccucagguccucgucuucuagucagccagcuucagagagacuugccagccucggugucuguugagagcccauuaucuauuuauuguauuguaaaguucuguucucaguuuauaccucuuauugcacucagucuagaguggaucucugguuuuuguuuguuugucugucuguccucacuagaagggcuugaagccagggccucacaccugcuaagcagggaguccaccuccgaguugugucucccucagucaguuugagaagguguguauuuggguuccuuuuuaguuggucuugucacuuagaauuuuaaauuuaucccccuauuacaacccauguaaaaagugaagagcaaagaaaacaggcagcuguuuuuguuccaaaauggagagacaaggugagaugaggcucagguucgagccagccaaaagcaaaugaaugaaugaccuuuaaguucaggaagagaaaacucuuuaucuucucuagaaaauuggauuuguuuagcuaaugcauucaggauucugagcaggagucuugggugucagccaggucgugaguggguaaggucuccacuucuccaggcacgggagccucagcuucaugucuuacuguagcugccagccucgaccugagcaccaccugcaggucaugucucuucacagccucccgcagcugcccuucugcgucuuucccuuugaucuuuucuccuuccucuguccccuuccuggacuuggcaaagaggcuggucauuggagaccugaggccagcuggucaaugggguuuccuguggugggaaaggagaauguugggggugaugaucauuauaggcaugcgaaacagacacugaggcugccaagucucucugaagcuggcugacuagaagacgaggaccugagggaguuuggcaggauacaaggucugaugagcucaagcuaaggaacccugaguuucugcgaccuccuagcagaaaccacccccugcccucuggauccugcagcccaaggcuucugagauuauuuucugcuccacaaacugaccuuuaguuucgucccauguaccugcaggucaugaguuguagcacugacuggcaguagcuugcuggcaggcucuaccugugauucuaaggacccaucacuauuaccugccuucuugaaaaauggacuuugcuacuuuguucaaguuaaaggaaugaaaauacaaaaagaucaaaauaauuuaaaccacuuuaucacuaaauuacugaaagagagaaagaaacagacucccaggauccuugagaugugagcaaggcugcuauucacugaaaucugacaugucuucuaacacaagaaagaccuagcuuuccuguggcccugaaggccucaauaaggacuuucaagcagggcugcaagaguguuuagacaggggccauaaagaauaggauuuccccugcugauugagggagccgggagggugauaggggagagagagagaggcuggaucaucacuggcucugaguccucaaacuccuccccuuugcaugucucucuagaagccacuuaguacuuaaaauaagacagagucuuggacaugucagaggcuagugccaagaagacaguagagaaaagacaacagaaguacucacaguuaacagaagucuucuggcucauuguugaaagagaaaugcucagguuucuuggcaaucccccaagcuuuaggcucaggaacucuguuaauuucagguaccaaaaaggggaaaauugccaggugugguggcacagaccuugaaagcccagcacucuggagcagaggcagagggacgaagguuagccuggucuagugaguuucaggcaagccagggaccuugucucacaaaugaaaaaaaggagggagggguggcaagagcugacuccuaccaccccgucgggagggcucuugcucuccgcgcugccucagccucagcacagccugagcuucaucaggccuuucuuccugcuuuucuccgugagcucacuuuucaagacuaagcagcagaauggacucuugagagcaagcagccuucugcaggacucucagcaucgcuggaggcagcuucuuagccugcuucugguggcuauuugccacaagaguaaaagcagaguuucucucuccacagaacuuaccaucagcuucucaccucuuuuccacagcugaaauccugccugcucccaguccccagccuccagccccauuccgauuguuucguuuuccuccuacagccugguuaguuaaaggacaagaguuuuguuuaagcuggguguguucagcacaugcuuuauaauuccagcacuugggaggcagaggaaggaggauaaggaauucagggccacacuuagcuucauagugaguucaagacauaccuagacuucguccugucuuaagaaacaaaucuaaguaaguagaugaaaacaaguuaauuggaguagguggcaaggucuuucuauauuauaguccugguuggcuucaaacuccuaauucuccugccucagccuggcaaguucugggauuccaaguguauagcacuacaccuggccuuaguaccaugauucuugcugaguguuguuuucaaugagaaugaauauacagagccuuggaucugcuauaguaugccacccaaagagcagcacugguagcucaaaccaucuguuuccccucauucccuuaauucaauugcaccagaacacacaaccaaaacaaccaaagagaagucauguuaaagaugagaagagaaaagcuguaaccuuggcauucaaaggucugacucagccugcuccuuuuucaagacccuuauacuacaaaaugaguagcuuaccacuagugauuccucaggugugucccuagaccagcagaaucaacuaccugagaucuuagaaaugcaggcucuuaggccucacuguacccuacaaaaucaaagcuucuagggccucaguugguaaagcauuugccacacaaacaugaggggcuugaguuuggagcccuacuaccuacccagagaaaagcugagcacuguaacaccagcucuggagagcugaagaaagggggcucacuguggcuggauggccucaucacugcgcuccacggggugugugugugugugugugugugugugugagagagagagagagagagagagagagagacacaagagcagcagaagaagcuucuagaagugagccaggcugugugugugcuuaacaaacacuacagguaauuuugauacauaggaagugcuuuuuugaguugguggagaauuucucuuuuucuuuucuuucuuuuuuuuuuuuuuuuucuuuuugugacaaguuuucucugcauaacccuggcuguccuggaacuugcucuguagaccaggauggccuugaacucacagagacccaccugccucuaccuccuaagugcugggcuuaaagacauguacuaccaccacuaguauaauggguaaaauuuuuagguugcuaaaaaaaaucauaaaagcaaaucaaaacaauagguuaggagacucaugagaaggccagggucuucuccaagcaauuauagacaggcuaucuucccuuuccugucuucuugacauaauuuaaucuguucuuuugccggagcagauccaacucaugagggcacagcagagggcauggagaacauggcagaugcugucacucacgcccguuuugugggcacagauccugccagugaugaaguuguccugaugaaaauccuucagguaagugggaggggagaacaaccaggcuaauggccaagagcucguaggccggcucuacuugcugggucagccggcagcagugugaagcucguaggccggcucuacuugcugggucagccggcagcagcgugaagcugugcuuugauuccacugaggcuuuagagacucacuguuuccaaacaaggagcucgguacccaaaguaaaagcuuuuucuaagggaaauaguuaagagcuuuaaaugaauugguaucaaauaccagaaacccuuacuccaucuugugccucugguagacugugucugugucguuuaucuguuaggccugugggcuagagauccagugaguuaugaacuaugucaggacugugcgaagcaaagagaggacucccaggucagguacaugggaguagcuauuuugaguuuuuguuuugggguuuuuguuguuguuguuguuguuguugcuguuguuuugacucaggguuucucuguguagcccuggcuguccaggaacucacucuguagaauaggcugcccucaaacucaagaucugccugcuucugccuccagagugcugggauuaaaggugugcaccaccacacuuguuuuaauuuuuuuaauuuuuuguuuuuguuuugguggggcagggucucauauaacuaaggaugaccuugaauucuuauuccuguuuugacuucccaagugcuugugacauuuuaccuagcuuuaaggucagcuuacuucuugcuaacuuaaaaaagaaaaagaaaaagaaacccugaaauugggcauggucaugcauacuuguaauuggaacucguaggagacugaagcuggagaccacaaguucaaccuaaccuggacuaaauagcgugaucuuaucucagacaaaacaggcaguaaggagaaccucaccccuaagcugggcauguugcucacugguagagcacuggccuagcauaugugaguuugaucuccugagaaguuagcucaguuagugaacuuugugccuuauaggcaugaagagaagugugagauuccccaauacuuauguaaauccccaggcauaguggugagagucccagagaagcauagccaagaggauccuggguauugcuggucaaccagucuagccuaaucaaugaguucuaggucagugagagacccagccuuaagggaaguugguccacauuucugauguugauauccauguacuaguguauccuccacauccccaaacuacacacauaaacacacaugaacaugcacauagcacaagcaaugaugaugacgaugaggaggaggaagaggaagggaggggaggagaaagggaggaagaggaggaggaggaggaagaggaggaggaggaggaagaagaagaagaagaagaagaagaagaagaagaagaagaagaagaagaagaagaagaagaagaagaagaggaagaagaagaagaagaagaagaagaagaagaagaagaaaaagaagaagaagaagaaagaagaaagagaagaaagaagaagaaauuauuuaaaauuuacuuuuccauuuuguuguuuuuucguugguugguugauuuuucaaaacaagauuucucuguguagcuguccuaaaacucgcucuguagaccagacagucuuccaagucagagauccacuugccucugcuucccaaggaaagcccagcucucuagguguguuuacaaaucagcuguacucacccugcuuuguucaucagugucuucuuucuuccuuguagguucuccgaacucuguugcuaaccccaguggguacccacuuaacaaaugaaucuguaugugagauuaugcagucuugcuuccggauuugcuuugaaaugagacucagugguagguccuugaauacuaugucuuucauccuccugggguauauggggaugcugucucugaagcccagagaaacaggauuuauccaucguccaccuuggguaaccuuagggggguuguucugaagcuagaauagaguucucaacccacuauuguagggcaggaguugggaugaaucuuagucagacucgcuuccagaaccaaaucuucucccuuaggguuucuggaauugacaccaauugauaacccaagaaaacccuucuaguguguccccuuuuuccugacuccguaguaccaccuaguggucugguaacguuauagcuccaggcugagcucgagcugguuuuaauaaguuuggcauaauccuugguaaacacaguuuggaggggagucugcucugagaggucuccugauaauagcacagcaaguaaugacaccuguguuauuuguuuuugccugugcagaguuauugagaaaauccgcagagcacacucugguagacauggugcagcugcucuucacaagguaaaccugcugcuguuugcuucugcccggcugcccaggccuccugagucugccugcuuccacacagccacuuuagggaccuggccaaccccacaaccacaucagaggccacugggacuguagauagcaauaguucucugggcccaggguuacugagcaagggagaaggaagagagaacucccguggccucagggaagcggaggguuauuuaaucucugcuucccaaacuugugucuguuucugugcagguagcaucugggaaagggagcacagagaagaugccaaauuuaagcagccuagaacagguugcugagcucccuaaacuuagccugauuuuguacaagaaggccaaggcuuggguaaccaacaauuguaaaagcugacuuaauuggccuuuaucuuggcuugccugggacuuccugauguuagcacucaaaaguuccauauccuggcagacccuuuaguuccagggaaaccuugaucuuugauuucccuaagaaggacucccucauuuggagcccaggaaaccuuucuguccuagaucacauugccuauucuauacuuccuuuccaaagauacacugagggaagaaucaaagccaugacuuuucaaccaaugagauuucuuuuugcuuucagacuuaaucccuauuaucuguacauuaaacuguucucggauucugcuacugagaguuucuuacaccacggauucaaugccuuugaaacaccaaccugcuuuuacuuucuaggccugacuaccucuuggcuuuuagcagcgcuuuucagugaugaaaagagccuucgaacuccaagggugcuuagucacucugucccagugacuacuuugucaauaucuuacauauuacaauuccuauagcuccaaaguuccaaagggggugaaauuagcucuuauaagaagcuuguuucuaacuaagagacaagauacugugugccaaugcaccauuacuggaucaggucuagagaagaacauugucauuauccccagugacggucauacuauucucugucuuauagguuaccucaguuuaaagaagaacccaagagcuaugugggaaccaacaugaagaagguggggucugaaaguucgucugcuguccccuguccaaaccaccuuaacuucugaacuucaguacuacuauugcuuaguagcaaagacaugcuuucacuuagaugggucuacuuguaaucuacaaauaacugucacuccuuuaagucagaaauacaccuccugugugcgucuccuuucuccaccuuuccucucugaccuaccugucuuuguugaccaaccacauuugcuagugagucaauccuuaaggaaacuggacacagcuuaccaagcugggguaaagaugcauguugacaaaaugaaaaucuggccaucccauuuggcucagucuugucagcaaguaagaguccuagagaggcugugccccaaauccccuccucgugcugauuaagacucggcuugugcuuacgauggucucuguugaagagaccaaaucaagcugugcuuuggaucaaaggguucccagauuucugagaaaagaauggugaucgggauggccuuuuucuuucuugagcugaaacucuggacaucucagaccucugaugagguucugcccauggcaaugacccuuggcuauuuggugcaugcaccugaccugcccguguucccucccauucauccccauucccgcccugugcccugcuggcgcgugucugaguuuguuuuacucuguuuaaaucgugcauuugccugucuuucacagaugucuccaugucuccucagcaaacuggagcuaaguaguggggagcagaccaaagcccugaaccaguuagagaggguacuacucuuuaagaaccucaaggucucucucccucucccuuuccuccccccuuuugguuuauuuauuuaaauuuuuuuuuauauguaacacuggguuccauuucuguuguucagagcacaacuuacccgcucuauaacagcuuggcuuuugaaaguugcauguguuuauaguuuugcaguacugggaauucuccugggauuucugguugcuuggaagcagcaugaagccuuaaacaucacaaaaugagccuagaaaacguggguccugcuguuaucgugugggaaagacccaccauuucuggggaaacuacagggaccucaagcgagauccuucuccccucccuugucucagagcuggaguagagagcgugauaguccuuguguaaaucugaauacauggcuauguuggugggaaaagguguuucauccugugagaaguguuguuguuguuguuacauaaaagggaucauugcaaaguuuagaucucuaggucgauaguaaggaacuagggaccaggacacugggaauuuucuagaaucuguccuuuaaaauucaaaauguaggugaguuuagggaaggagugugagcucaagauugccuggcccuuaagauacccuugccuuuaaaagaugagacaaguaggggauaaaggacguccacgugaccaugacaaggcuguacacgccagaggugauuucgagcauucagucacugcggaugaauuaacucugugagucaggguucccuagcaaggggucucuguccuauuugauugcauugucucaauuuuuuguguuugcguaguuaccaauuucagcucucuucacugacugauuagccugcauguugucaugacuauuagccuaagaucugcgcuauucuuauaaagccacuguugucuuucagaauguagaauuguacagauaaagugguauaggguucuguggacaccugcugccuacuaugcaccuuagagccuugggacacagaacauagcagcagugaaaccuucaugaaaacuaccggccuucaggcuccuggaccagucaaaaggccaggaacacucacugaaauaaccuaguugaagcuagauuugcaaaacguaaaguagaagauaggcgauaccaacucguauuuggaaaggaugcccauuacugacugucauucuuacuagaaguggggcucauagaguggaaaggagagguagcuuaugaagcuuuagucguuuagacuuuuugaagcuuagugauaaucaccaauaaagccaaaugguccucguuuucuuuccuuggucuuuuggguuucuugccuccuguuuggcuuguucucuuagaucuuuuucuaccaugagugugaucuaccugaacuccuagguuacuuacugacgagagcauccuggucccugucuagucacagaagcucauauuuaggcauaggacuccagguguuuuagagaugggagaacaagaauaugaauccaauaagaagcugguaccguguuaaaaacugggagaaaguucaguuugggggccuccuuuauuaugaggagauuuggggaaggaaggaagaauuauccuagcaggugaucagaggcuaucaaagcuuugagagagagagagcuugaagaaggaauuuuaucaccaaauaucagaagaaaaugaauagauccuuuuaaauuguaucuaguggugcuaggaauguaacucaguugcaagagucuuugccuagcauauacaaagcccugagguugaaccccaguaccacguaaguggaguggaggggggaggggcacauaccuguaaucccagcucuugggaaguagaagcagaaugcaaagcucaaggucauccuuggcuacacagugaguuugagaccugcucaggguacaugaggcucugucuacgaaaggaauaacauaauaaaguaaaauaacguguaccuaggaagaacaacuguaagaagagcaagacguuuuauugcuguaucaaaauuaggaguagcagcauggcaaagccuccauucuuaacucaacaaaucaauuggcgugucacucuuuucucuaaaaaaauaacuuugaccauccauuuuaauacaggauuuccagaaaaagaguuauccuuauggucuaagucccagucuguaccuuagugggaaagcuuugaaucuuucuugauagggagggguagguaggugcucauaccuagacaagaacuggaacuaggagcugcccugcagcugacuguggaagaaaguccgugcacaggucuguagucugaggcucugggcaaagccugccuuacguuuucagcaagagguucgugcaucauauacagcaccagggacccaggaagcagagugauaagugugccagcuggcuaugucaaugacuagucaaaaugcaagguguaaccuuccauguggaagccucuguguccauccgaaaagcuguaaauggaaaggacuaaguguauauucugaugguuuagauuauuuaguacugaugugggguguaagugguuuuuuagggaccagcggacugaauaaugagauauuuuaggaguaacaucuuaguuuaaauacucuuuuagucuggauacuaauuauacaugauauuuccagcugaaaaugagagcaggaggcaugagugacucguccaaguggaagaaacagaaaagaucuccucgaccuccacgucauacaaccaaagucacaccagguucagagcugcccaccccaaauggagccacauuacccucuaaccuuacuggugagugcccugggucacuucuuauuaaaacacacagagaagauccuuucuuuaucagggauuugaaauggagagcugguuaacugagggguuuuggucuuucugcagagaacagaaaggguaacgccaaaucaaaucagacuaugaccauuuaaugacccugcaucaaacaacuucaguucauucacuuuucauagauucuuauuacucuagaggcguuuauacaugagcauucagucugagcaagacccugguacuguagaggauguguuacucacaaacggucucuuugccuucaaguuucaugcuuuucuuugucagguggugugcccuucauugaugcacccacauccaucuccucugcaaguucagaagcugccucgacaguagucagucccuguacagauaguggccuggaauuauccucccagacuaccuccaaggaggaccucacugaccuggagcaagcuggcuccccaagggagaucaccaccagugagccugggagcagugagaugggcgcuucugaucagcuugacccucagguaggacugacuccugaaggccccucuucagaucuacaugucacuguaggaaccugagccugggccaaguauggugguacauaucuuuaaucccagcacucaggaggcaaagacugauggaucaaggccagccuaaucuacagagagaguuccaaggcagcuagagcuacauagugaaacccugucuauuuaaaaaaaaaaaaaugaagaaggaagguugguaaagguaguucuucccugugucauaguuagaguuuccaucuuugugaagagacaccaggaccaaggcagcucuuaugaaggacaacauuaaauugggcuggcuuacagguuuagaauuugagucuauuaucuucaaggcaggcaacaugcauccaggcagccaugucacuggaggaccugagaguucuacaucuuguucugaaagcaacgaaaagacugucauaggcagcuagaaggagggucucaaagcaaaccccacagugacacacuuccuccaacaaggccacaccuacucuagugccacucccugggccaaguauauucaaaccacugcauacuguuuccuagaauuauuuuugcugaccagaaaaccuacaguaugacugugaagaggagcucaggagauuuaucauugucauuauaggcagcaucugaaaaaaaagggagguggcgacuuuugcaggaugguaaucaucuaaauucuaagccuugugagaguuuugcacccauagagucugucaucuuagacaaugguuccucagguggcccugggccaucuucuauugauguauaaaucaaugagcuguaguccauuugaagacagcuuggaagccauaaaauucaggggaauaaauuuuaagugguuuuuugccuccuuuuuguucaucugucugacugcucuugguccuagcaggaaggggcccauguagagaaggcccagucagcaucgguggaguccaucccugaaguguuagaggaaugcacauccccugcugaccacucugacucggccucuguccaugauauggacuacgucaauccucggggcgugcgcuuuacccaguccucccagaaagaagguagguacucucuggaaggcucugccuauucaucucccccauccuaccagauagauauucugucugagccuagagcagcuuagaugaagucaucugucaccugugaauccauuuucuagacagaaaauggaaucaagccauaaaacucuuagcauauauagaacuuuucccuaagucauucagagagcuagagcgacaauuggaggagagcgggagcaauauaaagcuuaggacuuuuaagaaaaauccuugguucugauuuuauccauuaagagauagguaguagagccuuuuccuuggaggaaauuaauauccugaaauugccacagauaagggcuggagaugacucagugggugagauugcuucucugcaagugugaggaccagaacucaaaucccucguacccauguaaagagucaggcauggcugcaggugccuguaaucccauuuuugggguuuucagacaugugagucgggagaguuugcugaaacaaugaguuuccaggucagugagagaccuguuuaaggcaauaaaacagagcaauaagaggaaggcauuugacauccuuugugucuuccaugugcacauguucgggcacauacauuuguacaccauaccacaccuacacaugcaugcaccaaacacauauaacacacaaacacaacaaacaaguuuuugccauagacaacacagaccuaugugguaucaaacagcugggguaugucuucccaccuuuucaggcacagcuuugguuccuuauggucuuccuugcauccgugagcucuuccgcuuccuuaucucccucacaaauccacacgaccgccauaacucugaggugaugauccacaugggacugcauuugcugacaguggcucuugagucagcgccuguggcccagugccagacccucuugggucucauuaaggaugagaugugccgacacuuauuccagguaagacuagacuugguuguuuuuugagauugagaagccaccagaauuccaugaccugcacacuuuaaguuggccagaagccacaguaaaagcucaguaagcuaaggacuugaggaaggaauggcuaaaucaaaauccaguuguggugguacauaccuguaauccagcacuugggagguagaggcaggaagauaaggaauccgagguaacuuucaucuacguagugaggucaagaccaaccugaacgacaugagcuccuagcucagaaaaacaaaaccaagacagcaagacagcucaguggguaaaaguauguccaucaagccuggcgugcuggguuugaucccuggcacccagaaggcagagagagaggaacgucucucuugggacacaccuuuucauaugugucccugcuccccuccuacacacaaauaaacaaauguaaaauaaaguuugcuuuuaaaacaaaugacaagaaaaaaaaagaguucccuuagaauguaggccuucugaagcagccuuacuggucugcucuccuguaucuucguugguugaguuacacucgaccucagaaaccuaauggcuuccuacucucugaccccagcuacucagcguagagcgccugaaccuuuaugcugcuucccuacgagugugcuucuuacucuucgagagcaugcgggaacaccucaaguuccaguuagagguaaguguuugaccuuggaaaguaaaacaagaaacaggagacuacauggcauuaucaauggggccagcucaaugaaucaugcuuaagauagacuuuuuuaaauuuuuauuuauuauucuuucauacaauacaucucaaccacagcuuccccuccuucaugccucccagugccccucacuuucccucuccccaccuccccacucccaucucagaaagagcaggccucccagggacaucaacugaacgugguacaauaagacacaauaagagcagauacaaggcugggcgaggcaacccacuaggaggaaaagggucccaaaagcagacagaagagucagagacgcccccgcucccacucucaggagucauccuaaaauaccauauaugcagacucucuaaugcagaccuauacaggccuuaagauugccacuucagucucugugagccccuguguguccugcugaguucugcuuuccagguauccucuaccccucuggcucccacaguuccuccucuagucuuccacugcauuucccaucucagggagggacccaguggaaaaccugggcucucucuccacccauuuggcugugggucucuguaucugcucugagccagggacagaacugugcuagguaccagucaaugauaucugcguauagauuaucaauaggagucauuucauugacuuuuuuuggcuaguguuuaguuccaccauaggucucuggacuauccagccuccaguuccuaaucauccaggcaguauuaggcaugggcucccucucaugggauaggccucaaauuaaauaagucauugguaggccauuuccacaaguucuuugucaccauugccccugcauaucuugcaggcaggacagauuguagguagaagguuuuauggcuggguugguaucccagucccgccacuagaagccuugccugguaagagaagauggacaguucaggaucugugccccccauuacuaggaguccucacuagggucacucucauagauuccagggaguuuuugcuacacuggguuuccauaucaccaccaccaccaccaccccccaugcccuacugcuccagucaucucucccuguacugucuccaucuacccccacaugaucccuccuauucccauccccaccuacccccaauccacacacaaacucuauuuccacuucccagagagagccaguugcacccucccuuccccgcacccccaccccagcgcccucuuuguuacuuagccucucugggucuguagauuguagcaugaguauccuuuacuuaacagcuaauacucacaagugauuacugccagaguuauggacuggacuucuggcagcuggcaugaccucugguccaaguggaggcgggacaaggagaggugggggguuggggagaggaugggaggaguaccgggaaaguuugugggaggauccaggaauaggcagccuaccuggcuuucugguggcuggagcauccuccgguugagcaaggcucugcccacauugggaguugcaaugccauguugaggaagggaaggauuauugggcauaaggugggggacucugagagagugggggaggucuaccaguggguggucuaucacaagauagagauuuuuaugagcuuccuauagaaggcauuuuuggccucccuacuuuguaucauugccuagccuucauaguagaauaguuaagaggaucccagacaaaaguguuugacuauaauguaggagagcccauaacugggcaugacagcucaugccaguaauccaagcacuuagaggcugagacaagaagauuccugugaauugaaggccagucugggcuacagagcaaaagugucuccaaaaaagggguaguggggggaauccaaauaugaggacuggcagaucuuaccacaaauagggcagcuuuucugccuaggaguucuucuaagucaaaccagcauugcugcuaaauugccaaaaagaagucucaauaagacuaggguaggcuuuauagacaacacauuuuuaaaaggacaguagacaacuucuuugagacuggaaauaggaaugagagccuuaugggagacaaagcggggaauauauuacugagaaggggcucuuucgguaucucccaauacaugccuccugagugggcuuuugccuccuguuugguguuguuccuauccaauuuucuguugccgucuuuccucaaccaaauggcugucgcuggauugcuguugacagauguacaucaaaaagcucauggagaucaucacuguugaaaaccccaagaugccuuaugagaugaaggagauggcgcuggaggccguuguucagcucuggcguauccccagcuucgucacugagcucuacaucaacuaugauugugacuacuauugcuccaaccucuuugaagaccucaccaagcugcuguccaaggugcugagcacuauugcuaccucuaggaacugugaagaaaucucuauugauaguagagaaaguggggcgcuucagcggugggaacaggacugaggaaggcauuuguaagggcgaugagaaaucauuaguguuuggguuuggggggaaaauaaucaggugaaguauauuccuaccucaagucuaauggcucuguuuucuuuccagaaugccuuuccugugucuggucagcuuuauacaacacaccugcugucucuugaugcccuuuugacaguuauugacagcacugagucucauugucaggccaaaguccucaacacccucaaccagcaagagaagaaagagacagccagaccuggcuuugaggcaguggauggcaacccagaaacuaacaagugugagaagcgucuuauauuguucuuuuucucuuuuucuuuuuugucuuuccucccaccccuucacuugcccuccuuacucucucuugaauuuuuccuaucagagcuagcuaguguccuauauaagaacaugcagcucuuuuuuggcuugggacucaaccucuuugacaauacugcuugacuuccugcccauaagucuucauaucuuucccuguuaccagcugagagagcaaccagugaugggaaauccacagguguggccuuagaugcccgaggccuucauuuuccaaguggaggaugguugucaacagaacauggaaagccagggugcagagaucuggaggaagcuggugacucuggggguagguacccaguguccaugacucuaaacuuccucaacaagagggcuuagagagaaggaacaugggagguuugggaauacagaguggccuaaggccauaccuggcagagcccuagcacuucaccuugucuuaaaccccagagaaaggaaagaaaacaauuagagcccuagaagguaggauuuccagcagguaggaggucaaaggcaagaacauguaugagauuacuugguuuugcuggggagagcaucaguaacuguacaaaggucuuguguguuuauccucuuccuuccauccuagcugacaaaaaguucaccaggaagccaccucgauuuuccugucuucugccagauccacgggaacuaauugaaauuaaaaacaaaaaaaagguacaugaauccauacacucccccaguguguuuagcaacugcccacccuuauguagguguccucuguagaacuuauuugucucagcgaaugcacauggggugauuuuaacagcuccuuauauagcuuccaagacuagccucuagguuuuucugggacugcacaacuucucccucuccuugaaaagcauuuccuuacaccugaccugugcuguuguuggccccugagcaaagcuacuucagccaacagccagaaccuaguaguggugacagaaguucuggaagcugcugucauuugggucagcaaagguuauugaucaucuccagguccagcauagugacugguaagaaaggguauugauauuuauucugguacuuuaguaaagcucaaauaaugguuaguuuauguauuuuuccuucaguuggaaagucaggggaagucagaccaucauagaccuccccacauucuucccuugucuuccuuuccuuuucucggcaggagcagguaucaaugucagguaaauagcuuccugacuaggacagggauauuuuugguuuucuuaacauaaaaacuuguaguuaacccuuucuuauugucagagauacgcauuugauugcaagucugugacuagggagcaaagagaucaguuuauucugcuuuguccuucaaacccaagcaggaccugaaaagcaagaccuucugaaaagggagggcaucucaccccagccuggcacggugcugggccugacaugguguuggcuggcuguagacgcccuggguggcuauagaauugaagagaacucacuaaucuguuuccuccaucuuccccaucauucacuagaggaggggagguugcccuguacaucuguagcccucaaaaaggagugggaaggcacucccauucacugccagugagaugggaagacaggaaaagcuuaggccaguacaaccuagucuuagccauggaauuaauuagaaccacguucagagaacucauuaggugaauagcuauaggcuacgauagacuguggccugucuugucugacuuaagagcauagcaacuuuugauaccucuaguuuuugucuucuagcugcugaucacugguacagagcaguucaaccaaaaaccaaagaaggggauccaauuucugcaggagaaaggccuccucaccaucccaauggauaacacggagguagcccaauggcuccgagaaaacccucgguuagacaaaaaaaugauuggagaguuugugagugaccgcaaaaacauggaccuguuggagaguuuugugaggugaggaagaaguaagcgguguggggacugagaugucacucagugauggugugcucccuuagcaugcaugagugucacacucauggaugucacucagugaugguugcucccuuagcaugcgugagugucacaaaaaaagaaagagauaugggggagugcagggaaagaagagaggaagaaggagauguccggggacagaggaaguccccagucccugcugcugaccagcucacauagcggacgcucuugccucucucuuccuaugauagaugucuguuggacugaaagggacuaaggcuuuaggaguaccccaacccccacccccuggguuccaauggaaagcaucacagaguaggauagagcaggguucugaggggugaggugucuagaauuuuacuaauguaguaaguacuaaaguuaggaauucugcuagaaauggccaggauguacuugccacuccagugccagagccaucagccugcucuguuccaguaagagaauauuaugacgacugugacgaacagccuaaacuuaucuauacaguuuuaaugucuucagccuuuuccuucugucuucuuucucuguagcaccuucagcuuucagggucugcggcuugaugaagcucuccgacucuaccuggaagccuuccguuugccuggggaagcacccguuauucacagguugcuggagguauucacugagcacuggaggguaagucuuagugucagaaacugagucacggaucccugaucagauugagggauucuuuguucccuuagcuaaaaaaaaccuuaucaauugccuccuaagaagguugagagccacagcaguggacuuccaauggaguaccuucuauuaaggaguuggccauuuucugggaaguucaccccuuguauaccaacucuguauaccaguggguugguaauaguaagaacuuaguugccagaaaaggacauuaacacagauggagucuuugcuuuuucagaguuguaauggcuccccauuugcuaauagugaugccugcuuugcccuggccuaugcugucaucaugcuuaacacugaccaacauaaccacaauguucgaaagcagaaugcacccaugacccuggagguaagcuuggguuccaaccaaaacagaagauccaauacagcuuugaaaguaucaagaaagacaaggaaaguuuccaguaugugagggagacagguucugucaaggggaucagggagggaugaccaauucagaagaaggacugggauggagaagggguucuuucacucaauuguuuccaaaguccuauuugucauaaacuuaaggaguuccuugggugguauacagcuuugauacaagggaaaacauacuggccuaucucuaggaauuucgcaaaaaccuaaaaggugugaauggaggcaaggacuuugagcaagacauccuggaagacauguaccaugccaucaagugaguauauguggagaguaaugcagugucucugcuaaagagaaacucauugcuuccuuuuccuguuucuagagucaugacagacuuuagugacucccacacccuggauuuagcuuugagacuuaagcuggguauccauccuuaccugugacaacagcucaugucuuacuuaaagaagccugagcaacaaugggcgucuaguauuccaagcuuagggucuguucacaucggccucucauguuagauguuuaaguauguguuuauacuagggaguagacccagguccucaugcaggcuaagaauauguuucauuacagagcuacaucuccaguccaaacugugccucuuaaaugagguaucugacccugucuccugagcccaaauuaccuggcuuccuggagagcucacaaaauccauuuucugguugguagagaacucaagaucagcacuagaggguaaggccugagucagagauaggauacagaguuguuuuguuuugaucuugagacagagccucauacagcucaagguugccucagacuugcuuuguaucugagucaccuccuugucuuggguacuaagugcuaaaauuauggguaugugccgccucccucagcuuacuccuuauaguaagucagaaaaagugguccuacccggaaagaaggugagauuucagcccagaccuguacguuugagaugagacuuugagauugugaauguauucaugcucucccuggccccagugcuagggugcaaacacaucacuuagcugcagcugugauagccucagaggagugcaagcugccucuauaggugaaaccccauucuuaguuuaggagcaguguucacggagugugccgagcuuuucucuucccucuggcaggaaugaggagauugugaugccugaggagcagacaggucugguccgugagaacuauguguggagcgugcugcuucaccgaggugcuagcccugagggcguguuccuucgagugccuccuggcagcuacgaucuugaccucuucacuaugaccuggggccccacgaucgcugcucucucuuaugucuucgauaaaagccuugaggagaccaucauccagaaagccaucucaggcuucagguaggccagcuuuggccuguuuccauauccuugcaucucgcuaaguuaauguguugcccccaugccucuuugacuccuguuuacuuucaucaaaaugggauuuccccugauacucuggagggaggcuggagccugggaaaucucaaucuuaaacaugcugggguuagagguuuccuuccgugacccacugggggagaaccaauggaaggcugcuaggaacugagaagggcugaguggccuuucagugacuguuucugugauggggugacauuacaggaagugugccaugaucuccgcccacuauggccucagcgauguguuugacaaucucaucaucucucugugcaaauucacagcucuaaguagugaggugaguuggaacaggaacugugcuuagaggagagugagccucagcuguggaaguuacauccaccacauccacccucuugaggaagcuuaggccaguucucucuuaaaggucuggaaugagaauagugucaccucauguaaugggaugggggaggagauaccauaggaaagaucuucaucaaguuuaccuuccccacucagauuguacgggauuugaagcaaauccuacagaaagauucucgggaaccguaagccgagagcucugaaagacuuuucuuuccagacaugagccaacccugacucuuuuaaaaccucuuuuccagucuauugagaaccuucccaguguauuuggaagcaacccuaaagcccacauagcagccaagacaguauuccauuuggcccaucgucauggugacauccuucgggagggcuggaagaauaucauggaggccauguugcagcuuuuccgagcccaacuuuuacccaaggcuaugguggagguaauucuugauagaacguucagcauuaacaagucaaaggccuagccuucugugccguguguguauaggauagcacuauaccugaugcuugccagcgcucacuaagagaaccucaaauguaaugcuacagagagaagcuauaaaggaaggcugguagaagccagccacagucagucaccucuuagaggggacacaguaguacaugaacugucuacaggaagaaaugcagagaaguuuacuuggccaggaagcacaggaauggaaaugauacacacaaaagaaaugauuuuuuuuuuuugagacaagguuucacuaaguugaaagguuggccuugaacuugcucuuagcuccugucucagccuccucaguauugagacuccaggccuauuccaccauagccagauaauuucuuauaauuauuuuuagauauauuuguauaugggcauuaugccugaauguguguguguguguguguguguguguguguguguguguguguguguacauaauaugcauacuuagugccaauggaggauagaggagggcauccgauucccugaaacuagaguuacagaugauuguaauccaccauguaggugcugggaacuaaacacaggcccucugcaguaguaacaagugcucuuaacuacugagccaucugccaaacccuagaaauaaaugacucuugcuuuacuuuuuuccagguagaagauuuuguggaucccaauggcaagaucucucuacagcgggaggagacaccauccaaccgguaagggcagaccaguggcugagagccuagagaaaaguaguagucagaauguuagcacucagcaggacacguauccuuuuccuacagaggagagucaacaguucuuagcuuuguaagcuggcugacauugagugguccugagcaguccaguguacgggguccaucuacagagaaccaagaggccaagagaguggccuuggacuguaucaagguaacugccugcucucucaugagaacuccuaaagagaugugacccuaugagcugaagaguguaaucaucuagggauuguaucaaggacagcucugcccucucucccuggcuuuucuuccuuuguuauagaucccucuuucuuguguccccucuagcaaugugacccagaaaaaaugaucacagaaagcaaguuccuccagcuggaaucacugcaggagcucaugaagguacaagaugaagagaccugagaaaggcaacaggguggucaugcagccuucagugucuguuaugacagagcccguggcuucucuuccauuccuaauuucccugcuggugucuucuaggcucuggucucagugacaccagaugaagagacauaugacgaagaagaugcugcuuucugucuagagaugcugcuaaggaucguguuagagaacagguaggagaggacaggucagaguagucuuuaggcagaccccauacugagcuugugcaaaaggcugacagccaucuugcugagcaggagcaagaaacaagugacgcugugagcaguuaggggagcuugggcuugacugccuaaggauaauacccaccagcugugaaaggccuggcagacugcugccucaguggcuucuccaguugagacuguccuuaaccuuuaugauuuuagggaccgugugggcuguguauggcagacuguucgagaucaucuauaccaccuguguguucaggcacaagauuucugcuuccuuguggagcgagcagugguagggcugcuacgccuagccauccggcuacuccggagagaagagauuaguggccagguaagcaagugcaugaaggaaggugggcaaguaugcaaggggcuaaggccacaguagcagcuauggacauagccugaggcagaaaggauacuugguguaauguaacuuuagcccugugacuaacucaaggcuaguacaaucucacagguggcacugaagugagcauggaauggucuuagacuuuaagcugguagcaccuaccuaggcucuuugaagucugcauauaggguugggcugcugcuuauucuuaacauuuaggacccucaggauaagaucuugggguucaaguauggaaaaaucaauacugaacaacaauuagguucaaaagucacaagacuuaagacauacacaaaagccauauuucuaaaugauauuacgaacauaugaaaguugacauuaacaaauguaauuucagugcugaagagauggcucaaacauaauacucaguucucuuacaaaggaccuagguuugguucccagcacccacaugguggcuccaacuguccacacucuuguuccagaggauccagugcccucuucugaccucugcagcuuccaggcaugcacauacaugugggcuaacauaaaagaaggacacugggcagugguggcaggcacacaacuuuaauccuaacacuccaaaggcagaggcaggcggagcucugugaguuuaaggccagccugauuuacagagcaagucucaggacagccaggacugaacaaagaaaucguguuuggagauuaaaaaaaaaaaaaaaaagacaaggaggaggaugaagauacagguuuagccagacaugguggugcaucccagcaccaaagaggcagagacagccagaucucuggauaugaggcuagcuagagucacauagugagacucugucuuuaaaaagagcaauuccaggcuguacaagguagcacacaccuuuaaucccagcagucaggaggcagaggcaggugguucucugugauuucaaagccagucuggucuacaaaucaaguucuaggacagucagggucagggcuguuauacaaaaaaaaacccugucucaaaaauguguuuguguguguguguguguguguguguguguguauguuuuccaccuagcauugugauacacaacuuuaauugcaaagcaggacagcaagaaccauguacagcuauucugccacaauaaguaaauaauaaauaaauagagcugcaauuucacacuagaaaucaggcauggugacucacuuaucuaauaagagccuuuaggagauagagacagacagaucacuaggugaucaugaccaaccuggacuacuucgugaguucuaaggagcuacagaggagacccugucucaaaaacagaaaagaccaggcguggugacacagguuuauuucuuuguuguuuuguuuguuuguuucaagacagggucucacuauguuccuuuggcuuagaacucacuauguagacaaggccagccucaaacuuacagaaauccuggcagcagagguuuuaacccuuacaguugggagguggaagcagagucaaauuaggaguugaagguuauccucagcuccacagucaacucaagggcaaacuaagacccugucucaucagauguggugaugaacaccuuuaaccccagcacucaggagggagaggaaggaucucugugaguucaaggccagccuggucuacugagugaguuccaggacagccagggcuacacagagaaacccugucucgaaaaaccaaaaaaaaaaaaaaaaaaaaaaaaaaaaaaaaaaaaaaagaaagaaagaaagaaagaaagaaagaaagaaagaaagcuagcuagcuagguauggugacaagggccuuuaaucccaggacucaggaagcagggauaagcagaucucugcaaauuccaggccagcuaaggcuacauagugagacccuggcuuacaaauauauaacaaaauguuaaucaaagaccccuaaaucaagagaccauaccauagauuagaagacucaacccaauuaaaaugucaauucuuccuucaaucaauauauaaauguaaugcagcuuucuauaaauaucucagcaaagauuuugguggacauagagagcuuauucuaaaauaggguggaagaugggaggcagaggcagguggauuucugaguucaaggccagcuggucuacagagugaguuccaggacagccagggcuacacagagaaaccaacccugucuugaaaaaaaaaaaaaaaggguagaaggcauagacauagacccuacaauagccaaacauuuugacaaagaaugaaaugggaauaauauucuaccuuguuucuuguguuguauuuuuaauauuuuugcauggaugaaaaguagccaugugccauaagugugcauguggaaggcagaaaacaaccugcaauucuggaguuugaauucaaguuacuaagcuuggcaacaagugcccuaaccugcuuagccaucucaccauccugggguuguuguugguuagauuugcuguugguuuggaaacagucuacuauguagcccuggccugauugauuguuuugacugagggucuauuguguaucucaagauagcuucauaaucuuccugucuuugccucccuaaacugggauuacaguuguacaccucauacucuaccacucuagacaauauuaaacuucauguagucacaauuauguaggauuggaggcaagagagauuucuccaagguugagagcacuggcuccucuaccaaugggcucuaguuggaccuccagcacucaugcaguagcuaucaacccucuggaacucccagugccaggcaucuggugcccucuucuggucuccaggaauauagcacuggugcacagacaaauacagucaaugcauacugcaaaacacccacacauauaauaaauaauuuuaaaaauuauguaguauagauagauagauagauagauagauagauagauagauagauagauagauaggacagauaggacuaugaacaaauagaugauccaaaaauagacucacacaaauauguucaacugaaugguuuuugguuguuguuuuacuuuggguguggugcuuugaauaggaacgacccccauagucucauguguuugaaugcuuggcagauagggaguggcaccauuaggagguguggccuugacggaauauguuagaagaggugugucacuaggggaugguuuggaggucucagaagcucaggccaguucacuuccugcugccugccuaucucgauguagaacucucagcuccuuuccagcaccacgucugccugcaugcugccgugcuuucugccaugaugauaauggaacaaaccucugaaacuguaagccagccccaaagaaauguuugccuuuauaagaguuggcaugguuauaguaucuuuucacagcaauaaaaacauuaagacaguugguuguuuuuuugagacaaggucuuuuuuuuguaguccaagugguucauuuucuugucucagucacccaagugaacuuugacucaaaccuuuauuuugcagaaaaauuaaaguuaugauaaauuuaaauacauaaugaaggggcuggagagauggcucaauagaagagaacacuggcugucuugcaaaggacauggguuugguucccagcaccacauaguggcucacaacaucuguaacuccagguccagaggauacagugccuuuuucugaccucuguggccacaagcauguacaugguacauauaacauacaugcaggcaaaacacucauacacauaaaaaucuaaaagaaguaaauauauauuauaaaaccuuuauacacauaagagaaaaccuuaggauuuaaaacuuaagauuguuaaugugguuuauuaguuuauuacauacuucauuuucuuuucuuuucuuuuuuuuuuuuuuuuuuuuuuuuuuggguuuucgagacaggguuucucuguauaguccuggcuguccuggaacucgcucuauagaucaggcuggccucgaacucagaaauccaccugccucugccucccaagugcugggauuaaaggcgugcgccaccacgccuggcuccuucauuuucuuuuuaaaaaaucacaagcugggcuggagagauggcucagugguuaagaguacugacugcucuuccaaagguccugaauucaaaucccagcaaccacaugguggcucacaaccauccguaaugagaucugaugcccucuucuggugugucugaagacagcuacaguguacuuagauauaauaauaaauaaaucuuaaaaaaaaaaaucaaaagcuaccaggcagugguggcacauacuugggagcacuugggaggcagaggcaguuaaauuucugaguuccaagccaaccuggucuacagagugaguaccaggacagucagggcuacagagagaaacccuaacucaaaaaaagaaagagagggaaaaaauaaaaccaauaacaacaacaagaacaaaaaaaaaucaaaagccugaacaugcucagcacagauaccccaccagcagggagggacuggagcucaaaucucucacuuuagaccugaucacagucuauuacaggcuuauugggggguggggggaagacauggcucaugguuaagagcacuggguucucuucuugagguccugaguucaauucucuccacccacauggugacuuauaacucucuauaaugagaucugacucccucucucuuggcaugcaugaagacugaguacucauauguuaaauaaacagaucuuuaaaaaaaauaaaacaggcagauuuugcuucugugcaugauccuaaauuauucuuuucccucaaguguuugcacaccagcuacagagugaagcagcuaaagguauagaaagauaaaugagcucuucugcucucuguacaagcaucugaagugacuacagagccuugacaguaacaggaagcaaagaugaggaugccugcuccaccagcaagugcugguuacuguuuguugugauuggcacauccccuacagaauaggucuacaaggucuacaugaacugacuaaagacuuaguuaguuagguuuuagguucuauuauuauuauuauuauuauuauuauuauuauuauuauuauuauuauuuugaaacagggucuuacuagauagcccuggcuggccuagacucacuauguaaucaggcuggauucaaauucauauagagauuugccucucugccucccaagugccugauuuaaagguaugugcucucacucaccgugcccaauccaauacauuuuuuuaacuugauauuaaaagcacaguccauaagaggaaggaaugauaaauuagacuucuuuaaugcucagaauagucaauguguaaagcuuguuccagauagauaaaaagauagagcaauagaaaauguuugcaagucauauauuuaagaaaaaucuaguauaaaaaugcaaaaucagauaaaagaaacagauauuucacagauaauauccaaauggccaauaagcacaugaaauaacauuagcuauuagggaaaugcaaaaacacaccagaauagcuaaaauuaaaagugaugaugccaaaugcuggcaaggauacagagaaacuagaucauccauauauuucuagugggaauaaaaaaaugcagucgcucuaaugguacuucauuauaaaacugaauauucacauaccguacaacccagcaaauauacuuuugggcauuuaucccagaaaaauaauugaggucuauuuuagcuuuaaaauguguauaaauauucauugaagcuguauucaucaaagccaaaagcuggagucagcccugaugacuuccaauaagagacuaaacuguuguacacauguaccaugcaauccuguucagccacuuaugcaacagacccaauguauaaagacauggguagaucuccagguagggaauccagucucaaaagauagauaauuccaucuagauaacauuuugggauucacagaauuuuagaaguuaaggagaaauugcuaagggcuaggaauggggcaggaggacaggacugggaaagcggcugucaaguggcaacgugugucccaggggaaagaacuuauggacaaccacacaccgcugauaaaguuguguagaacucuauacacacauauacacauaugaauucacauagaauuggggaacaccuaugaaaacgaguggguuauagugaagucuguuuuuguugccauguuauacuuaguacugcaucauauugccccugggauaaacugggcaaaguacauaaggcaccucuuuauguguugucauaacuauaccgauacgaaaaagugaagcaugcccaaggaugaaguuagcuguagagugcuuaccuaacacacacaaggcccuggguucaauucccaguacuccaaaacaggagagccaaggccagaccaaggccagaccagggacaacugaguccgagucaaacuccucacuagucuaaauggcuacuggagaggauuagggaggaaacuguaucucuguccacccacuuccuacucccaucccuccccagguccugcucucucugcgcaucuuguuacugaugaagcccagcgugcuguccagagucagccaccagguugcauaugggcugcaugaacuccucaagaccaaugcugccaacauccacucgggugaugacugggccacccucuucacauugcuggagugcauuggcucaggcgugaagccuccagaugcucuucaagccacagccagggcugaugcuccugaugcggguaugcccuuucccagggaaauaagcaguuaggacccagcagcugcuaugggaaaacaaaacacagguuauuaccacucagcaaauuaaacacaccugguuucugccaucugcuucuagaucuuccugugccuguuagcuaccccaugggcuagauagcauaaaggcaaguaggcacugcaaggagacuaucaagccaaguuucuacugucaggaagaccauguuacagaaccauuuguccuuacgccaccaccuuucccuaauaacugcuacuaguugcuauuagaagcccaaauuagcuucuugccuuauuuagucaggaaagauguuguccagaccucuaccuuuuggugauugggccaaaguaagccagacaugagagaagacgcuaggccucagcaccucuccucugagucuguuguccuguuccauggcccaucucagcucuuacucugccuuuucccugccuggcucaggagcacagucggacagugagcucccauccuaccaucaaaaugaugucagccuggaccgaggguacacuuccgacucagaagucuacacagaccauggcaggccuggcaagauacaccgaucggccacagaugcugacauggucaacagugguugguuagugguaagucuacuaccauccuaggcuuaaaacaaaagggucuuaguucucagagaggaugucuggcuuggaauggggccccagcuuauaucauguguauuuuauagguggggaaggaugacauugauaacuccaaaccaggagcagggcucagcaggccaggcccuucaccccuggucaaccaguacagccuuacagugggccuggaucugggcccacacgacacuaagucccugcuuaaguguguggagucacuguccuucauuguccgagaugcugcucacaucaccccugacaacuuugaacucugcgucaagacucuccgcaucuuuguagaagccagucugaauggugguaaguuaccuaugcaaggggccguuagggagugggucaagugaagaggggagaagggcugggugucuuugcccuaaggcugugggaaugugaccuuagucuggcucugcucagggugcaagucccaggauaaacgcagcaagagucauaaguaugacagcaaagggaaccgcuucaagaaaaaacccaaggagggcucgaugcuucggcggccccggggauccaaccagcaugcuacucggggcgggcacagugaugaagaggaggaugaaggugugccugccagcuaccauacggugucuuuacaggucagucaggacguaaguauggcacccuuuauuuuuucucuuguaccugagacucagaacuuggguggaaccagggaaagucagaacucagaagaaauauccauuguguucugcccauccccucaaccaccaccuaccuccacaggguucccucaucugaaaccagcucuaagucuuugcuuaucguguguuuauuuggugacagggucucacuauguggcuuuagaucaccuggaacucccuguguaaagcaggcuggccucaaacucacagagaucuacuugccucugccuccugaguagcagaauuaaaggugugcaccauugugucuggcauuaaauuaauuuacugggcucaggauuuaucucaguggugagcucuugcuuagcaugugcaagacccugaguucaauuccuagcacuaacauauuuauauauuaaaagacuuauucacuuauuuuaucuguaauauauguacaggauacaaaauucaaaagauauaaaaggauagacugaguuuccauugaguuuccauucauuccuauaauccagccacugaguuccuuuacaagaggcagcuacaucucaagcauuuugucuguccuuccauaguuauuaaguguguguucaggcugacuuucucuaacuagauaaguggagaagugguugccuuucagaauagccuuaggaagaugaugaaagggcaggagagcuagcacagcaguuaggagugcuuacuacucuugcagagguuguaugacccagcuucaguuuccuagcaaccauaucaggugacuauagcugcuuauaacuccaguuccagggacucuaaugccuguggccugaccucugcaggcaccuguguauacaugguauaccugaagucacaugggugcacgcagauacacauacauuucuaagaguaaguuacccugggcgcuggagagaugucucugcaguuaagagcacugacugcuuugcagaggaccuagguucuauucccaucauccacauggcaacucacagccaucuguaacuccagguucagggacccugacaccuucugcuggccccuguaggcgcuccugcacauggugcacagacaugcaugcaggggaaauacccuuacaguguaaaguaaaaauauuaagucuuuuuaaaaauagaauaaguacacuuggcaggcagaggcaggcagaucccugaguucaaggccaaccugaucuauagagcgaguuccaggacagccagggcuacacggagaaagaagcccugucuugaaaaacauuaacuaaauuuuuuuuaaauagaaaacugauuaagaaaaaaaguauugaaucuggccagacacuguuguccguggaagccuuugguuuguuuuuuauuuuauuuaucaugguaugugagcacgugcacacucaggugcacaggaagugugaaggucagaggacggacggcuuugugagucuguucuguccuaccuagggcccaggauugagcuugggcugccaggcuugcguggcgguugcuuaccugcuaagcaucucacuaacccugcuugcuuuguuguaaagaugagguuuaacaaggcagcugccaugacucggaggcugacuccaaggguaaagaugcuugugcaagccugcuguccugaagucacacaggaaccacagugagaggagaaaaccacuuccuacacauuguccccacacacagguggcacauacacaaaacaaaauaaguauuuugguuuuaguuacaacgggauuaacaaaauaacuguaucagcaggugugaaauaggcuucagagucucuuucucagagcagagagauggcuccgugguuagggugguuaagagcaaugguugcuuucccagaccuggauucuacucccaggacacacauggcagcucacaacauccccgcagucccaggggauccagugcccucuucuggccuccacaggcacaacaugcucauggugcacaaacaaaauacccgugcacauugaacaaaaguuaucuuuuuuuuuuuuuaaauagaaagugccuuucuuacugugaucuccugguauugucucaguguacaugucuuuuaaagaggucucugcuguaaguaacucuuggugucuuugagaaacugcuaggacagaacugugagcuccaguugaagagaggaguuccugaaggguggguacagcauagcuccugcugagggccuugaagacucaggcagggauagcgggggagggaggaaaaggacugaacagccuuauucacauccugcacacuuucucaucccaguugcuagaccugaugcauacccugcacacacgggcagccucuaucuacagcucaugggcagaggagcaacgccaccuggagggagguggccagaagauugaagcugacucacgcacccucugggcccacugcuggugcccuuuauuacaagguaaacaaaucugggggugccuacaggggcagacggagcaccagaccaaauuccuggaagauccugacacucacacacacucacacacacucacacacacacacacucucucucucucucccucucucucucaggaaucgccugcuuaugcugugacgcccggcgccagguacggaugcaggcccugacauaucugcagcgagcccuucuggugcaugaccuacagaagcuagaugcccuggagugggaguccuguuuuaacaagguaggacuucuuacaccucuuaagagaaaguucagaucacaaggcaggaagagugagaaaaccuagggagcucuugccauccaccugcaucagauccucucugcugcccugugccaucuuccccgggcccaacugacugggcuaaugugacauuggcuauuuaccuacuaggugcuguuuccucuccugaccaagcuuuuggaaaauaucagcccugcagaugugggcgggauggaggagacccggaugcgggcuuccacacugcucucaaagguacuacucaccacucugccuccaccuguuugccccaaacccgccuuuucccacagagagaaacccaggucaucucguggggcccaaagaugagauguaagugcucauuucaugaaccccuagcuauggagacagcccagggauucaggagggcucuggacucgagaguaaccucugauuaaauacuuacaagaugggaccagcuucucucaucuucggagacagcuauagaagguuccucuacuacccuuggcuaacagcugcugccugguggguuuuaggucuuccugcagcaucugucuccacugcugucacuguccaccuuugcugcccuguggcucacuauccuagacuucauggacaaguacaugcaugcagguuccagugauuugcugguauguucugccuugggccaguucccauugaccacuuccucuugcacacacugggcggacucgccauuugccccuugguggcagccucugucuuagcucugcuccucucgugguuccauuacugcuuguagucagaagcuauccccgagucucugaagaacaugcugcuggugauggacacagcggagauuuuccacagugcagaugcaagaggaggaggccccucugcucucugggagauuaccugggagcgcaucgacugcuucuugccacacuugcgugacgagcucuucaagcagacugucauccaggguaggggcccaucuaaucucaacuccucuguucacuggagggugcucagagugaugauuucucauucaucaugguaguacaugccuauaguccccagugcuuaggagguaaauaguacagacuuaggcuaucucuagguacacugugaaugugaggcuagccuucacuacucugagacagagucucagaaagggggaaaaaggaagccucguggguagccaggauccugcaggaaagaaacacugagaguugccaucugaauucucugccucagaccccaugccugcggaaccgcacagucaaaaaccucuggccucuacucaccugacuucugcugcuggugaccccaggaugccuggccauccaccucucccagagauacccucagaaauggggguuuguggugaguuucucagagcuggccaucuggaaaaagccuaagcaaugcccaaugcaguuuaggaucacugccaagaggaggcugggagaccaggaaggagucacagugagaguucuguuugccugcucuuccugugggaaauagcaagaccaggcacacuaggaugaggugccugcuuaagguuugcaggcgggggagagggcugcgucaggggccuguagugacuaugcagaggcugccugucuggggugcaggaaacauccagacccaaaccaacugaugaaggagaacugcgaaggagguaaagacagacacaagguagcgaagcacuacaaugaguuugcucucauacugacagaugaaugcauuuuguuauuccuuuaucaugugguagccaauuauacgauuuuuaaaagauuuaucuauuauauguaaguacacuguagcugucuucagacacaccagaauagggcauggaaucccauuucagaugguugugagccaccaugugguugcugggaauugaacucaggaccucuggaagaucagucagugcccuuaacugcugagccaucucuuuaagccccugguaaccaauucuauagagagaguuuguauuuagaggcaaaauaaaaacuuaagcuuuauuuuuuuauuuauguuuuaauuuauuuuuccacauggcaugaauuuuaagaggaagcuuccaacauuauagccugggagaggacuagggaggaacauagguuuaguaaguccacuaagaagcuugagaguugucucaugccaaucagaagccugacuacagccacuguugcucucuuuacagacucagagaagcccgagaguacccgagcucccagcagcagcucccccggaucgcccauggccucuagccccagcaaacugaguccugcccaagagggaccucccccacugacccagcccccacugauccugcagcccuugaccuccccacugcaggugggggucccgcccaugacucugcccaucauccucaacccugcacucauugaggccaccuccccagugccucuccuagccacaccccgcccuacagaccccauccccacuucugaagucaacuaaggcagguccccucagagaucaggaccauuccuuccuaucaggcguucaagacucugcuucagucucaggggcugcagaaaucuucaggccuaaagcaagcugcuguugcuacuauuugauggggaaaugacaacuuuuauagucccugcugggauccacuccaggcugcgagacucuuccucugccauucauuccugagcuuccaaacugagaguggaugcaggcagaaccuguagccucugccuccagccuggcaucccugggaaggcauagagccaacccugccgugccaacccugcagugccugccaugugcccccugccagguugggcauuagagccaagcccagccacucugcacuuuguuccucucuauccaguccccucaguccugggccgccgccuccaauucuucuuccuucauuaaauaguuggucagcuuggaguugcuuggcaccacggaggguggacagauaggacucgaugggggccugcccacaggagcauguacauauggaaaaugauaacgguggacuuuuuaugguauaauaaaugucuuaguaccaacucauu

SEQ ID NO: 9312 - RNA, 3140 nt, Mus musculus
auaagacuaggguaggcuuuauagacaacacauuuuuaaaaggacaguagacaacuucuuugagacuggaaauaggaaugagagccuuaugggagacaaagcggggaauauauuacugagaaggggcucuuucgguaucucccaauacaugccuccugagugggcuuuugccuccuguuugguguuguuccuauccaauuuucuguugccgucuuuccucaaccaaauggcugucgcuggauugcuguugacagauguacaucaaaaagcucauggagaucaucacuguugaaaaccccaagaugccuuaugagaugaaggagauggcgcuggaggccguuguucagcucuggcguauccccagcuucgucacugagcucuacaucaacuaugauugugacuacuauugcuccaaccucuuugaagaccucaccaagcugcuguccaaggugcugagcacuauugcuaccucuaggaacugugaagaaaucucuauugauaguagagaaaguggggcgcuucagcggugggaacaggacugaggaaggcauuuguaagggcgaugagaaaucauuaguguuuggguuuggggggaaaauaaucaggugaaguauauuccuaccucaagucuaauggcucuguuuucuuuccagaaugccuuuccugugucuggucagcuuuauacaacacaccugcugucucuugaugcccuuuugacaguuauugacagcacugagucucauugucaggccaaaguccucaacacccucaaccagcaagagaagaaagagacagccagaccuggcuuugaggcaguggauggcaacccagaaacuaacaagugugagaagcgucuuauauuguucuuuuucucuuuuucuuuuuugucuuuccucccaccccuucacuugcccuccuuacucucucuugaauuuuuccuaucagagcuagcuaguguccuauauaagaacaugcagcucuuuuuuggcuugggacucaaccucuuugacaauacugcuugacuuccugcccauaagucuucauaucuuucccuguuaccagcugagagagcaaccagugaugggaaauccacagguguggccuuagaugcccgaggccuucauuuuccaaguggaggaugguugucaacagaacauggaaagccagggugcagagaucuggaggaagcuggugacucuggggguagguacccaguguccaugacucuaaacuuccucaacaagagggcuuagagagaaggaacaugggagguuugggaauacagaguggccuaaggccauaccuggcagagcccuagcacuucaccuugucuuaaaccccagagaaaggaaagaaaacaauuagagcccuagaagguaggauuuccagcagguaggaggucaaaggcaagaacauguaugagauuacuugguuuugcuggggagagcaucaguaacuguacaaaggucuuguguguuuauccucuuccuuccauccuagcugacaaaaaguucaccaggaagccaccucgauuuuccugucuucugccagauccacgggaacuaauugaaauuaaaaacaaaaaaaagguacaugaauccauacacucccccaguguguuuagcaacugcccacccuuauguagguguccucuguagaacuuauuugucucagcgaaugcacauggggugauuuuaacagcuccuuauauagcuuccaagacuagccucuagguuuuucugggacugcacaacuucucccucuccuugaaaagcauuuccuuacaccugaccugugcuguuguuggccccugagcaaagcuacuucagccaacagccagaaccuaguaguggugacagaaguucuggaagcugcugucauuugggucagcaaagguuauugaucaucuccagguccagcauagugacugguaagaaaggguauugauauuuauucugguacuuuaguaaagcucaaauaaugguuaguuuauguauuuuuccuucaguuggaaagucaggggaagucagaccaucauagaccuccccacauucuucccuugucuuccuuuccuuuucucggcaggagcagguaucaaugucagguaaauagcuuccugacuaggacagggauauuuuugguuuucuuaacauaaaaacuuguaguuaacccuuucuuauugucagagauacgcauuugauugcaagucugugacuagggagcaaagagaucaguuuauucugcuuuguccuucaaacccaagcaggaccugaaaagcaagaccuucugaaaagggagggcaucucaccccagccuggcacggugcugggccugacaugguguuggcuggcuguagacgcccuggguggcuauagaauugaagagaacucacuaaucuguuuccuccaucuuccccaucauucacuagaggaggggagguugcccuguacaucuguagcccucaaaaaggagugggaaggcacucccauucacugccagugagaugggaagacaggaaaagcuuaggccaguacaaccuagucuuagccauggaauuaauuagaaccacguucagagaacucauuaggugaauagcuauaggcuacgauagacuguggccugucuugucugacuuaagagcauagcaacuuuugauaccucuaguuuuugucuucuagcugcugaucacugguacagagcaguucaaccaaaaaccaaagaaggggauccaauuucugcaggagaaaggccuccucaccaucccaauggauaacacggagguagcccaauggcuccgagaaaacccucgguuagacaaaaaaaugauuggagaguuugugagugaccgcaaaaacauggaccuguuggagaguuuugugaggugaggaagaaguaagcgguguggggacugagaugucacucagugauggugugcucccuuagcaugcaugagugucacacucauggaugucacucagugaugguugcucccuuagcaugcgugagugucacaaaaaaagaaagagauaugggggagugcagggaaagaagagaggaagaaggagauguccggggacagaggaaguccccagucccugcugcugaccagcucacauagcggacgcucuugccucucucuu

SEQ ID NO: 9313 - RNA, 8068 nt, Mus musculus
uccuuccucuuccccuucccagcuaggaggucccucucugggaggguuacuggaguguugggacugacccgguuuccugugucucagagauagccaaccucugggcacagcaagagccaaguggcccacuggacuccguaacggucccgggcaagccuggaagagugcagagaucugagccgcgcccugcgcuggguccgucgucccgccucgcuggucccuagcagaacuggagcugggugacaccccgcggccaguccugggcgagccuuccccgaaaggggcgcgccugcguugcuccggguuggcuacaagaguccuggaguuaaacuuucaaccaauaaaaaagggcauggggagugacgcacgggaucgucacgggaauucccccccucggggggccgaaaggggcuuucccggcuggagcccuuuggcuggagaggagcaacgaccgguccggggaagggcucggaaagaagucggaaccagagccgccaccacggugaguggccggguucagaucccugagugucuagggaauggagagggagggaaggaggacuuuagaugacaggcuggggcuggacgccaccuccagugagcgcgcacaggaacaggacacuuugcuacacaucagcgacacgucugccugcccuuagcuugccugugcacagccggccggugugagccccgcacacgcacucacagcgcacccgugcaccggcgccugcgcacggacauccagacgugcacggacgugugcccacacugggcaguacaaggacucaccuguguggaugaacguucacuugcacgugccaugaugccaccacucacccggcacacaagacauuagggcugaaacgcauauuccugcaacggacacaugcgcguuacacuggcuuugggauuggagucgccagggagggcgggaugcucccguuugaccggccaccgggagcaggugcagcgggagaauccgggaagcuaagacggaaucgcuagagaccguggagggggaaacuccucccccccacacacacccugaggcccgaaucauauucucuggucagagccccggaggccccacuggaagaacccccgccuacgggccauucggaaaaggggccuccgacggcaggaauguccccacaaaagccccugggugaaucagccguguccuccacgcuggcugaaaaucccaaguuugcuccaggcugcggagagggggcgaggcggcuaggccccgacugagccccaggggcuacagaggcugcccgggaaccaggaaccgccugggccucccgccccucccgcugcgggggcguggccccggcgucauuuccaggcccgcccccuccggcuccgccucccccugguauuuucgggacuuuccuaagcagcacuaacuuucugccccuuucccgggccagccccgcuccggaucucgaccuccaccggaucuuacccgccacgcccggacgggcggcuggaggagaucggacccucccccagaucugagccccccuccccuacccaucccucucccccugcccaccccuauccugauaucuuucacucuucccccucccacgccucucuucaccuuaggcgggcguccgaaacucuggaaagcugaaccggggcccgaagccgcaagacacagcagggccuagcccagagauauggacaauugcuacgauccagugagucacacugccugacccugagggcggcgggugcccucugugucugcuugucaauuggacgcuccuccacuccccuacuucugcacugucuucaaauugucuuagucugccagucugugcugucugcaaacccugcccagaaaugagcuuccucauagcuugaggaggaguccagggagugacugcagagggcuugggagggggugguuggggggacccuugauucagcugccaccuucucugucuauaacgcagggccuggauggcauccccgaauaugaugauuuugaauucagccccuccaucguggagccuaaggauccagccccugagacaggucaguaagucuuuggccucgcaguaucucagaaccuagaggagagugagcauguccccuggaggccccacugagggauggucucagagauccuggcucagcaaggccccucuauuuccagcugauggccccuaucuggugauuguggaacagcccaaacaggugagugagugacagagagugguggcuucaccuuuggggaaaagguggggcggggggggggaggguaguuauaccuacugaucagauuaaauagcuugcugcugauauguugggggcuuaugagaaggagguacacuuuuggucacuguggucagugauggcuagugguugccuuguggggaugacgggggggggggggggguugccucuccugaucacaaugucucugcuauggaaccuucagcgaggcuucagauuucgauauggcugugaaggccccucccauggagguuugccaggugccuccagugagaagggccggaagaccuauccuacugucaaggugagcucagaugacaccggaggguagggaugguguauggggcaacuacugacuauccuuugccauucucagaucuguaacuaugagggaccggccaagauugagguggaccuggugacacacagugacccaccucgugcgcaugcccacagucuggugggcaagcaguguucagaguugggagugugcgcugugucuguaggacccaaggacaugacugcucaguagguggcccuggccccuggcccccagugggaugcucauugccugccagccuuaggucucaucucaggccaccugugugacuagcacacaaagugggaagauuuacuuuggcccaggaaccucagagcucaacuauaaagagcaguuuccuuggagaacagagccaggaugagccugaccaugggggguggagcguggggguggaggugccucaggaggaaagagccucauggucaaagaggacaaagccuccuccuuguccucuccagauuuaauaaucuggguguccugcauguaaccaagaagaacaugauggagauuaugauccagaaacuucagaggcagcgucuccgcuccaagccucagggccuuacagguaugguaacaaaagguguuccgagagguguuccuagaggagccgggaagagcagcccagagcucacaccacccacauuguccauccagaggcugagcggcgggagcuagagcaggaggccaaggagcugaagaaagucauggaucugagcauuguacggcugcgcuucucagcuuuccuucgagcuagcgauggcuccuucuccuugccccugaagccugugaucucccagcccauccaugacagcagugaguauucugcagggggccaagcaugcauucccaaaagagcgcuugagauaccuuccagcuaugggucugaaccuggcccugccacgugugggguggugagugcucgguagucagaacaucugaguguugcuucugagugguaaaugugaauacugcauuuccugaaguuugauaaugaccccaccgagccuccgaucccaucaaugugucccuaacccaucccccaccuuauagagucuccaggggccucgaaccugaagaucucccgaauggacaagacagcggguuccgugcgcgguggagacgaaguuuauuugcucugugauaaggugcaaaaaggugaggcagaagcccucugggagcuggaaacgcuggcuguaaggguaauuucgggauccaugcagcggggcugcaggcucucccuguggcuaagccgcacuuuucucuguagacgacauugagguucgguucuaugaggaugaugagaauggauggcaagccuuuggggacuucucucccacagacguucauaaacagguacugagggacuagggccuguccuggagacagaacuacgaagaaaccuuacugacaccauguugcucucccauccuccaccccaguaugccauuguguuccggacaccgcccuaucacaagaugaagaucgagaggccuguaacgguguuccugcagcugaaacgcaagcgugggggcgaugucucggacuccaaacaguucacauauuacccucugguggaaggugagucgggcuucagcauucccaaaggcuggacggagcgaggcgggccaggagguggccuagaguugacucccaggagccagcuugaggaaucuagggucugacccauauuagguuuuaacaccccguuucucuuuccuccuagacaaggaggaagugcagaggaagcggagaaaggccuugcccaccuucucccagcccuucgggggcggaucccacauggguggagguucugggggcuccgcuggggguuauggaggcgcuggaggaggugaggaggugcaaguggcagggagaaggauggaggagauaagggaaguuaggagaggaaucugggagaguccuggcuggcaccucacacugccuuccccaugcccacagguggcagccucggcuuuuucuccuccuccuuggccuacaaccccuaccaauccggugcagccccaaugggcugcuauccgggugggggagguggagcgcagauggccgguucuagacgggacaccgaugcuggcgagggggcagaggagcccaggacgcccccggaggcuccccagggcgaaccacaggcccuugacacacugcagcgagguacaucucaggaacgcugggggugggcgcgcgccaagcuggggaucuggcccgcacccacgcccccugucgcccccuagcucgcgaguacaacgcgcgccuguucggucuggcgcagcgcagcgcccgagcguugcuggacuacggcgucaccgcagacgcgcgugcucugcuagcgggacagcgccaccugcugauggcacaggacgagaacggagacacguaagcaaccagaggacgggcuuccgugggaccuccaguggcuggggucuucugcuaccaggucuagauguucggguagaggaaucuacaaagagcugaacccuaggcuuggacagaucuggucucagguccucgcuguuuucuacuucuguucaagauauuuacucuccccgaccuucaauuuuauuagcugugaagggguacaaauagcaaggugugacaaaagauuaagaugaugacauuuagguuucaaggggccucgguaaaggagaccgcggaaguguggaguuuugagggcagaugugcugcucuggguggcuggguuucugaagacaaagucucaaucuccaacccucaggccacugcaccuggccaucauccaugggcagacuggugucauugagcagauagcccacgucauuuaucacgcucaguaccucggcgucaucaaccucaccaaccaccugcaccagguaaggggaagccuuugguaagagguugaaggcagggaguccaaagcuggccuaacgcugccucucuccucagacgccucugcaccuggcgguaaucacugggcagacaaggguggugagcuuccugcugcaggugggugcagaccccacgcugcuggaucggcacggagacuccgcccuccacuuggcucuccgggcaggugcugcagccccagagcuguugcaggcacuguugcgcagcggagcccaugcugugccccaaauauugcacaugccugauuuugaggguaaguuuccaaccuacuccuguccugggaacaaggguggggaccgaggaguguauaugaucaauaaacacgagcggagguugccuggucagagugcauccggaggccauuuugagggucaaagcugcaggcgcgugugcuauuucucuaggacuauacccuguacaccuggcaguccaugcccgaagcccugagugccuggaucuguuaguugacuguggagcugaaguggaggccccagagaggcaagggggccgaacugcccugcaucuagccacagagauggaggaguuggggcuggucacccaucuagucaccaagguaggaaugaggacuauggaagggauggggcugcggacugugggaggacccggaaugaugaucugcguggcaagggcuuggcuggcuggacuaugcugcucucugcuugcacccuacagcuccaugcuaaugugaaugcccggaccuuugcuggaaacacaccccuccaccuggcagcuggacucggguccccaacucuuacucgccuccuucuaaaggcuggucaguuucaccauugguguaugaagggcaagggggggaagggggaacccccagcuccccaugguucaguccucaauguaggagccuccacuagucucuccugaggacugccucccucccccaggugcugacauccaugcagagaaugaggagccucugugcccgcugcccucacccucgaccucugggagcgacuccgacucugaagggccugagagggauacccaaagaaacuuccgaggccauaccccucuugaccucacuugcaguaccaaggugaggccacccuugcaauagaaguacugagguggggacuggggaccuucuggacuugggggugugucccagaugauggaccuagggaaagcugggcuuaagguccggaugacagucaacaccaucuccccaggugaagacucugcugcuaaaugcugcucagaacaccacggagccaccccuggccccacccagcccugcaggugagguugcaguggucucaggcaccuccuuccagaggugauauccuuagggacucuggcgagggcuuccuuugucuagcuccucuuccaugccccguugaucuguccaccaugucugucagguuacaagggagagaagcugucuggguacgugucccugcacaccuauuagcuaacucacagguccguauuuguccccuaagggccagggcugucccugggggaugcagcccugcagaaccuggagcaacugcuggauggucccgaagcccagggcagcugggcagagcuggcagagcgacugggguugagaagccugguggacacauacaggaagaccccgucucccagcggcagucuccuucguaguuacaaggugaggcagccuguacccugcccugaagccugaaaccuuggccucucagaguucccucccccaccaagacucucuaaccccacacccuaagcaucacucagaccuccugucgccuuuucucggcagcuggcugguggggacuuggugggucuauuggaggccuugucugacaugggucuccaugagggagucaggcugcugaaagguccugagacccgcgacaagcugcccagcacagguaaggacaaccaccuuggaaggugugucugggcugaggggagaaggcaugaggcuugacucuccccuguucccuagcagaggugaaagaagacagugccuaugggagccagucaguggagcaggaggcagagaagcuguguccacccccugagccuccaggagggcucugccacgggcacccccagccucaggugcacugaauggccccggucaacuuccacccagaucccucuguacagcaucccugucuaaucgaaaucuuauuuaaaccucaagcccacaucucggugggucaaauaaaggggaagaccccuccccaacuuacgguacagcaaccccaaugugcugcccaucccagucccugagcgagaauagaggaggaggcccagccagcaauucagagcaguuuuaaugaggguggaggcuguacaaaggguagggcccaccaaagaagggaagcaggccgugccaccccagccuguggauggggccucaaaguggaugcccuuccucugucucugcaaagagagaggugagcccuuggggaggaauagggggaccagcucagccccaacuccuggcuucugucugagccaggccccaggauggagggguguugcugguguaagggugagguggucucagcagaaagcagaaacuugaucaggccucccccacgaaaaaaaaaagga

SEQ ID NO: 9314 - RNA, 15543 nt, Mus musculus
gcgcuugcgcauuacgacaaaucuggcgcuguccccuucagcaccucgcggaacucgcgccaccccuccccgcggugagccccgcgcacccccgcuucgaacguccucgcacccucuggccacccgaaucgacccucucuuucuucccaggucauaacuugccggucuuggccuuccaaaggagaauaguuaccauaguaacucguguggcguuuuccuaaaagagccagacccuuuuccacccuggccaagggcacaagguuugccugugcuucuugucccagucucggggucaucccuucuaaacucucgucccugaaaaggcgggacgauuaaccuaggcaguaaggaaguuccuccuggagucugauuuauccuuccucugcacuccggguugggguucaggacaggacuccugggucugagguucagaaccccaaaguguuuaugacugcauucgcuuaaugucccuuccauaguugggucuucugguuuuagggggcggguccgaucuacuccguaccgugugcuuugcguggccgcgugcuugugggggcgggagcgcguguggcauguaacaggucauguggcagccuccuagggacacgcguggggucuggagcaggacaggcguaugcaucuggacccuacgugugguucagaugauggacgagagagaacugaacacgagugggguggggcauaugaggguuuagggaacagaauggggucuuccacauucucccuuuccucuggugugagucuuagguagugacuagguggugacauucuuugggacuuagggcccugggaauggagggagguugggggggggggauuagcguugcuugagcagagcguggggagggguggaggagggacugagaggcgggcgggcgggccuggagcgagcgggagccuugcugcuuuuacagcugagcggggcccagccucucugccucucuucgauuccagcuccugacgagcagcggugaguacuggggugccuuggaggagggccuucacaggggagguccaggcuccuguugagcuuuaagaaccugucuggcuggggugcugcuccugacagcuuucucuaugcugcugcuuugccaucagaggcccgguuuuccuuuauggucucuucugggcugggcaagauauuucauaucccuggaguugagggagagggauguggugcagcccccucacccacccagacuugguuacugguguggggaggagagaaugugugucucugauucugugagcaaauaugcauuuguguuuaugauugugacgaggaggucucugauacaccuguuucugugugcaucagagaacgagagccugaauuuugggaaccucuuugugugcuauuauuuggugauguguguguguguguguguguguguguguguguaagauaagcaugugcuuuuccaucauacacauauuuguuaugacugugauuguaugagggugugucuaugagcaguacugcguguguacuggaggguguugccuaugaauguguuaacuacugauacuuuguccuucugcauguguguauaugaauucuuguguguguuuauacaugggugugugugugugugugugcauguacugguauggagaauagaauaucuauuccccacucagcaaucuauggaccgauguuaaggccucuucagacccuuccuucucuccucuucccucucaacacuccaucacccccaugcaacccccuuuuucuucccucuccuucaaagaagcaugguuucuccuauucuaagugagggucccccauaaguggaacuguagaggauacauggccucuaucauccagaagauaagauuccagccuccacccaagagagaguucccggcugccccagaacacaacuccaugagcugaauuagcuugcucuuucaccauaaagugaugcucagggcucccagacagaagaagaggagccccuggaagcuuuccaaagcaggagucccccggauggcugaucccacauucccaggauaggucucuggacuuuagaaggcccaacccaccuucccaucucugucucugcugccccgccugucugacuccaaagcacuccacccauguucuccuuccucucuugcaggccugucugaagagcaugcagcccccuuacucccugccuggccucgccaucccugcccccccagccugaccccccggcuccagcauggcccagggugccaugcgcuucugcucagaaggcgacugugccaucuccccaccacgauguccucgucgcuggcuccccgaaggcccagugccccaaagucccccagccagcauguauggcagcacaggaucccuuauacgacgaguggugggcccagguccucgaggccgggaucugggacgugugacagcaccuuguaccccucugcgagccccucccucaccccauauagcucccucacccuggggacccucuucacccacugggcagccuccaccaggggcacagaguucuguggucaucuuccguuuuguggagaaggccagugugaggccacugaauggccuaccugcuucuggaggccugagucggagcugggaccugggcgggauuucugcccccaggcccaccccagcccuuggaccuggcugcaaccggaaguugcggcuagaggcauccacaucagacccacucccagcuggaggaggcucuguucuuccuggcagcagggaccccucacguggaccauuggucccaccccagaucggggcagaugggcuuuacuccucccuccccaaugggcugggggggaccccugagcaccuggccaugcacuuccgaggaccugcagacaccggauuccuaaaccagguaugaaaucugccuugggcugccuggggcccuaguaccucagcuaagggacaaaucucagccccuguuggacugagguuugucuuacagucacccaaauccuuuaauguccuaaaugagcuuuuauugcccucugucacuguaucccugcaccuucaucucugucccgugugguuuucuuucuggaacuccauauucuugugucugucugucugguucucauugggguccugugccuuucacucccucuuuggcucagggggacaccugguccuccccccgggaagucuccucucaugcccagagaaucgcucgagccaagugggaauucuucuauggcuccuuggacgcccccagcucagguaaggcuugaacuuagcccaggggaggagggcaggaccuucucuacagcagcugaggccuggcaaagaggcaucccuucaaaccucccuccuguuuggcuucccugggcuccuaagucagccaaaagucucuccaggcuccagucuuucaucuguguccugaggguugggcugggcucuggaggaagcuggauaguagaggaggggagguccagauaucagggguuacuccuaggacuagaaaauagucugguuucuucauaguuauuugauaggggcuugauuuaagaugagucccgccggcauuuggaucaaguaaaggguguggcagauagacaguaguaaaugaugaagaguuuccagcccauguaagaccguggggaagcuauccaacaugacuuaccuccugaccuugcuaucuaugcauacaggugcuaagcccccagagcagguccucccaucacguggggugggcuccaagcaaggcucugggguggcuguggggcgagcagccaaguacuccgagacagaccuggacaaggugccccugaggugcuaccgagagacugacaucgaugaggugcuggcugagcgggaggaggccgacucugccauugagagucagcccagcucugagggcccccauggcacugcccaaccaccugccucacgaccuagcccaugcccuggcccuucuuccagucugggcaguggcaacgaagaugaugaggcaggaggugaagaggauguggaugaugagguguucgaggccucggagggggcccggugagugggacuacuuuggugaaaguggcuugcucuuuuuuacugcccccagcaaggaccagggguggggaagacagauggugaggaccaggacaguguggaaaggggauuccagacagagcccugaggccugggagaacauuagcaauguaugggcauugguggcauuggcaaggccgggaguccgggcagccacauggaccaggcaggguucuguauuaucagggccaaaagccagaggccaaacugggggcaugggagcuagccugaggacagggacgcaugggcuggauccuggguccuggcaggagaacguggaaaugugggggcuuuuccuuucugucucacgccccacugcagcuuggagcugcaucuccuaagauguugccagaaauagaaaagggauggcaggagggaagcggaucagggagaggaggggagagagagauuacuggggaggggggaggggacugggugcugccgaugggcagggccgggacacugaacuucaugagguuuuggaucugugggaagggggugaucacccuugugccagucagcaagaguucaaugagauccugccaaagccugauucugaggagcugaucggacauucucccugccucugcaggccaggggaccacaugccucacucugggcuucucaagucaccaguacccuuccugcuugggaccagccccucagcggaugggccugacuccuucaguuguguguuugaagcuaucuuggagucacaccgggccaagggcaccuccuauaguagccuugccucccuggaggcacuggccucaccuggcccaacccagagccccuucuucaccuuugagaugccuccccagcccccagcucccaggccugacccaccugcaccugccccacuugccccucuugaaccugauucuggcaccagcucugcugcugaugguccuuggacccagagaagggagguggaagagucagaugcuggggccacgcuggccccaaggaaggagcuuccuagucccucccacucugaggauagcuuugggcugggggcagcaccccuaggcaggugaguauuuucuuugacuggucugccccaaucccugcccccccccccccgaacugcugauuaagggacagagucccagaaugaggaagucauuuauauauuccugaccaagagcgggugguuaacagaugucuguuuucccauuuggaggccuccugccauuggcccccugcaguucccucccugggcucagauccagugacuggagaaaccaugauucaggacggaagaauccccagagaacauccucucucucuccuggagggcccucuccuucccagacacucucacccccacccagcuagaccuacagccagcagccccucccucugccucccuccacccuccuccaagaggcugagucucacccugcucuaggaauguccuuucauagccuaaccuuucugcucuccccucugcugcuacccucccagucauggaagccauggcaacaggagggggguggccagggagacaggguugccuagcaaccaggaguuuccggccucugucucuggggugacagguggcuuugugaguagagcagcuggggugaggaaggaagaagaggaagaagaugaguacaaucugacccccccccaaacuguaaccccagagacugcuucucuauggguagcagggcgcaucaaggagaguucccuguaaggcgggaaaugaagggagcaggaugcucucagaucuuugaccuugcuuuuccccagcaccccauuuauaccuggcugccuguguccaggaguaugugcagagagaagacugucuugaggagggcagguguggagauggagacucuauuaaagagugaacuuaggccccugguagcuuuggggagcagccaggauucccacagcagcuaagacugacauggguuagauuugaagcagaacuuccauggagaaaagugggaagcggagagaaugcaaucuccuuccaaaacaaaacacaaaaacaaaaaaccaagaccucuccuguuucucuagccauuccccagcuucuggguguagagcaaggggagggucuagaugacucccaaggucugugcuccaacucuuagccaccgaucuaccccagcagugaaccaccccuaagucagcugguauccgacucagacucagagcuggacagcacagagcggcuggcccugggaagcacagacaccuuguccaauggacagaaagcagauuuggaggcugcacagcgccuagccaagaggcuauaccgacucgauggcuucaggaaggccgauguggcacggcaucugggcaagaaguaaugccccugggcugggacuagggcuagggucaaggaaugcacccaggggcagccccucacccucuccaguuaaugcccauagucucuaggccaugccuagagacugucuaggccacugaagugaccuugugaccccuaccuaucugcccugcccacagcaaugacuucagcaaauugguggcuggcgaguaucugaaguuuuuugucuucacgggcaugacucuggaccaagcucucagguggguguugagcccucuaaaggauaguccugccugccagccuuggcauuuaggguuccagcuauguguguucuaaguugucuugauaucacucuucagagaccaggacuuccugguaaggagaucucgaguggaagaugacaucuucuuccuccuaccuuaggguauuucuaaaggagcuggccuuaaugggugagacccaggagcgggagcguguacuggcccacuucucccagcgauauuuccaguguaauccugaagcccuguccucagagggugagcagguugggagcaggguugucccaucuggucauagaggcacacauauacaggagucuuugugcaagaggcauguacccacgccccaguguaaaaugcagcuacaugugcauguggagcuguccauguagcaggcauguugcuaggucaaggguguuuugagaggcagauggagaugugauugcaugaaguuguuccauauguaugugcuggaccaggcuuggcuucagugcugacuggcugugcucugcauacgcgugaugucuaccagcuugcuuuuguuuaguacauggggcauguugaguguuggggacagguugggagcaacugccccagccacuuggggaaccagggaggggagccagagaucagaggggagguccuuguggaggaaaugggcuggaggagagacagaaugguuucauggaguucggguaguaagaaagggaggguugcaaaagaagguaggugaugacuguggugggaagaaccccugaagguggcugaagcugccaauccauucuccccuagacggugcucacacgcugaccugugcccucaugcuccucaacacagaucuccauggccaugugaguugggggcauggcaagugggaggccagaaaacgagaaacuuagaggcuuugggaaguuagccucacagaccucuguuuuccucccuuagaacauugggaagcgcaugaccuguggggacuucaucggaaaccuggagggccucaaugaugguggcgacuuccccagggagcugcucaagguuggggcggggggcgggggcgggggcaacucagacgguagccguuacuggaaggguagaacaggguaccugcucaggagcagaguuguaggaaaggaagagcuuggaauugagacuuguugaguagcucaggcagcaggaaccuuggcuguagugacucagcuuggggaccgcccccucgcccagcccccauaggcaggcucucucagcacaugcgcacaugcaugcaauccugagguaaagagaggaaagggggaccggcucuggaaagcaugugagcaggcguuccuggacucugcaauugcucucuuugguucccuuccaguguucacagaggguggaagggaggugucucugcuggcgcgcggugguggggugggcaugggaacauugcucuucaauuuaguguauaagagccacaaagcuccuccuggcaccacuacucaggagggagccuaagguagagagagggucacagcaggcgcaaagguuucccccagguuuuugcauccagagcacaagacugggacuagcuacugcucuucuggcucccuuggaagcaaguccugcucccaggugccaggaaggagauaggugccagagggagggggcccucugacccugccucccauuuaccuccuccccaugguagagugauuuaccucgggaggccuggacuaacuuaaagaagggggucucugggccauucuauacaugugacgacccaggacagauccuagguugggguguacuggacacucgaguuugaggaugcaugugagugggcgcguccacugugaguugagguguuaaagaauugaaguguuugcguucguuauguguguuguguguuugucugugaaucaagggaccuaugugacuugagguguuugugcuuuggguguagucuggguauuugugugugaugcgguguggucugugucuuccagugggcugucugcuuuaacaguagaggguguuuaugagcuguagaugguaccuuuugagguguacaucuguaacucggggugaaugggaaucggugcgucuagaaguugguaugucugaccucgguggcauaugggcuuggcuuggacauccggagaucugcccaaggguuggacgaggucaucaugacuguucgaaggccggccagcgagucucagacagggccacaggagugggggugaggagagcaggggagcgagccggccgacuggucccuuuagcccucaauucugacaagcugaagggugcucuggacgccucccacagccgccucccgagagcgcgagcucggcccccuggcgagaccccacgcaugcgcccccgcuggccgccggcccuccccacggcgccgggcucgcgccgugcugcuccgucgcgcgacguccccgccccagcccgcgcccuccccucccgccggcgcccccuccuucugcggagcugcggagcccucggcgccgccgccgccgagcgcucggugcgucggugggagccggcgggcucgggccaagcgcucgcgcuggcugucggggagccguccgcggccguccgggcgggccggggccgagggcgggcgggggcauggccgggggccgcggcgcggcgggcgggccagcaugaucggcgucaacagcauccacagcagcgcggggcggcugcguucgcgcucgcucugcuccgugcgcuacgggcgcacccaccgcggcgcggagacccuaugcuacggcuggccgcagcgcucgcgcagucucaagcccgugcucuacaccgaccugguggucagccgccugcagagccgcaagaagaaaaaggcggugagggcguggggcccacgccaggccgggcggcgagcgagggggcggcuugagggaggugcggagggcagcagagcgagcgagcgagcgagcguucgaggagggcaugggugaggaugaagguggcuggagagcccaacaaggauggaacuccugggcagcuagagauggguaugggcugugggggagggccaagguggaccugccucaccaaccacaguauucuggguacggaggguuuucuggauggaaacaggauauuggguucugugauaggguucaggaccuucagaggaaggaaggugugguuguaggcagaggcaguguugaagagggcaaaaugaagaacuggaaggcuggagacaaggguugcagguuggaccuuaacaguuacuccagccuccuggcuggaucagugggaagugagaggguucggggucugcgcccugcuggcuuaggcacaguuguuugggagcuguguguugauuagccuuguuuguguuguguggcguggaggcuuuggggugcaccuaccugcagacgggauguggggaugugcaggaauggagugccuagcuuguggcugggcaugacuaugggcagaaggagucggagccugugguguguugggagaaugagggggugcugugucccagcaucgggaaggcgccgacgucaccacugcacccaacucacgcgcaggcagcaucacggccccacagcaaaacacgcacaugcuggggacacacccacucacagacaggcuggcagaagcgcccccacaguuggaguugcugguauauucuaagcuauccccaaguacaggggucucguacaccacgccuaaaggccauucucucuuuugucacugcauggcccucagauguuccuaggccaacuuugcagagggaaaguggucguuucagggcccgguuugagguggacaguaauuggaagcuggaacuaugguuucaaucgcugguuguugacacaccagcuguaugaagaauggcugagcacugagccccuugguaucuggcuugauggcauugggggaaggcucauucuguccucaaguugggagccaaagagggugaaaggaugaauauucuaucguggcgccucaguuuccccauuugcucuguguggguuuaugcugugaaaucuggccagaacacaugguugggggaaggaggauuucuuuggcuuccucucauauucuauuuaggguugcacuucuccuaccaggcucugagcaggagagucccuugaugacaggcaacagcaccuggcaguuacuauguaccagcuguggcucaggguuccgugugcugacuggccgauugccccuacacacgcucugcugguucucccuguagaaaccggucggagucaggcagcuucaaucggccugggucuugguguuuuauuccagagugggggauugccgucuuugucccccucuuugaguuccauuuccucuccuaaguuagcaggagggcucugagcucugacacuggugugcaugaguaccucucacaggguuaauccacaucccuugcuuugucucucuccaggccuuguacagcuccaucaagaaugaaaaauugcaaugggccaugugagugccggggcuguuugcuaaggguugggguuggagcaugagguaggaggagccaggggaugccagagaacuggggcuguggguacauugaugggcugggaggccccacgaagcagcaaggcuaccauauuuccuucuuuggaaaugccugcccagacuuggggucugucuugugucuagcucuguuguuaugacaagcugggcugaggcagucggggggggggggauggggaguuugaaacauaaaaggaagucccuggcagcccaagaagagagcagauuaacucuggggguacacaagguuaccuuggaguggcacagaacaaguuuucucauuguguuggaagaguucucucugaaggagaaggucccguuuagucuuuggggccucaggcuggaagaguccuucuaaacaccaguagauacaguagucucugcuaucuguugagccagacucagugcccuucgagggaggggaucaagaacggcuuucuggaggccagccuugaagucuagugucuuguaggagauaaggggaagcugguauuaaggggaaacaagguugugacugaaguuaguguggaagaggaggucacaggcgugucuggggugacuggaaagagaggguugggaaagaagucacauaggucccauguaggaggcaaugguuuauuggaaauuguugagcaaggcaaugagagagucuugaguuuucuaucuucacaggauuuacaaaggaacacaucagggggaggcauucuaagaugucaccuuuagcuuuuagauuucugagacagggucucaagacagguuggcuuggaugugacugcccugcugucacaucuccaguggugggguuauaggcacgagccuguucacuacuuccuucuggcuccacauaaccaacugcgagcagagcggagccgagccggguguuaggugugguuaggagagagcugagucacacgugucuguccaggagaaaagugugagggcugggugugugcagaaacagagacacagcaggcauccacgcggugcggggaggggagccccagguagcucucaugccagggaggacacagaccuggagccuguggagcccuacucggagauagcagagccuccaggugaagggaguuccuggcagcuccuagucacuaaagaggcauucuaggguuguguggcaguguggccagcacucucugaaacagucacaucugcagagacgaggaggagcugcgacggucucuguccgaguuggccgauccuaaccccaaggucaucaagcgggucagcggaggcaguggcagcaguuccagccccuuccuggaccugacuccugagcccggggcagcugucuacaagcacggggcccuggugcgaaaggugcacgcagacccugacugcaggaagaguauguggcugugcggggacugggggauggaugggagcgggccuuccucaggccacccugaccugccuucccucccuagcaccucguggcaagcggggcuggaagagcuuccacgggauccucaagggcaugauccucuaccugcagaaggugcggggccaggagugggcggggccaggagugggcggggccaggagugggcuggcuugccagaggggauuagguagcuggagauggccaggccaggacuggagcaggacgagaugggcacccccauaggaggaguaucagccugggaaggcucuuuccgaggcagagcugaagaaugcuaucagcauccaccacgcccuggcuacccgcgccagcgauuauagcaagagaccacacgucuucuaccugcgcacagcugacuggcgggucuuccucuuccaggcuccgugagugcuuuuccuucuuacccauuccagacccugcucccuggauuccucucuccuuguaagaccccgcuccauggacuggagacauagcuuauuugguagagagauugguagcaugcagaagguccuggguucgauccccagcccucccuguacaugccagacucggugguacacaccuauaguuccagcacuuaggaggcggaggcaaaagagucauaaauucaaggucuucuuugacaacauagccaguuugagccuagucuggcauacuugagauccuaccucaaaacaaacaaccaacgaccaagaccaggcuccaggucgggacuggcacuccuggaaaggaaccuggggucccugugcugucucccuaggagccuggagcaaaugcaguccuggaucacucgcaucaaugugguggcugccauguuuucugcaccccccuucccagcugcuguuagcucccagaagaaauucagccgcccucugcugcccagugcugccacccgccucucccagguaguuccaaguggcucagucccccugugggaugacagugggauggaaguggggggggcaguaagccauaguccaggcugcaugugugguuagacauuugugcaggaguccugcgugggucacaagagggaggcagccccuugauaaaauuugcacgaaggaccuauauauagacuggugacacugaccgggccuaguuggcuguuaggaggagcaggugaggacccaugaggccaagcugaaggccauggccagcgagcugagagagcaccgggcugcacaucugggaaagaaggcccgaggcaaggaggcggaugagcagcggcagaaggaggccuaccuggaguuugaggugagccuccuugacuggggccuugguaucucccacacaggacgaggcuagggauaagggucugauagcuaagccuggaacccagcuaggugacuggcagaucucuaagucuucauuuucuuugugggggauggaggcuaaauuccauacccacuagggucaggugacacgucuguuauguagucugucucaagcccuaguaaaagcuacaaaaaugucugcugucacuacaggugguucagagagcucggagagggccaguaaccucucaaaaaugucuucugggacccagcaucuauguguuugcuggguggugggguggaaagggccagaggaggggcaggucuuuauugcuccggccuucugucucagaaaucccgcuacggcaccuaugcagcacugcuucgagucaagaugaaggcagccagcgaggagcuggacaccauagaggcagcccuggcccaggcugggagcacggaggauggaugcccuccgccucacuccaguccuucccugcggcccaagcccaccagccagccccgggcucagcguccuggcucagaaacccgggcuggagcaggcaguacaaggccaaagcccugagcagggcauaggagcgaugggggcagugcccgcugggcaccugcaugaugacauacacgguccugccugagcucagcuagccucgggccagccacgagggccuccugguccagggcccgaccgcgccggacgcgguguccggggcagggcagggcugagccgggccucagagccuaggcugagggccucucagagacccccuuuuugugauaauguuuugcacuuuuucguacaggaagggugggaggggcccaugccccuaauuuuugauggggguuuccuuuccuuuccuucuuucuuuuuuuuuuuucuuccuuuuuuuuuucgugggggaggccugaucaaguuucugcuuucugcugagaccaccucacccuuacaccagcaacaccccuccauccuggggccuggcucagacagaagccaggaguuggggcugagcuggucccccuauuccuccccaagggcucaccucucucuuugcagagacagaggaagggcauccacuuugaggccccauccacaggcugggguggcacggccugcuucccuucuuuggugggcccuacccuuuguacagccuccacccucauuaaaacugcucugaauugcuggcugggccuccuccucuauucucgcucagggacugggaugggcagcacauugggguugcuguaccguaaguuggggaggggucuuccccuuuauuugacccaccgagaugugggcuugagguuuaaauaagauuucgauuagacagggaugcuguacagagggaucuggguggaaguugaccggggccauucagugcaccugaggcugggggugcccguggcagagcccuccuggaggcucaggggguggacacagcuucucugccuccugcuccacugacuggcucccauaggcacugucuucuuucaccucugcuagggaacaggggagagucaagccucaugccuucuccccucagcccagacacaccuuccaaggugguuguccuuaccugugcugggcagcuugucgcgggucucaggaccuuucagcagccugacucccucauggagacccaugucagacaagg

SEQ ID NO: 9315 - RNA, 2688 nt, Mus musculus
ucaccacucagaggcggcuacuggcccgcaacggagaccgaaagcaguguucgcucgccgcuacuccagccucgggcuucaagcccuguagcugagaagacaucuaaugguacaucacugguccguucugccucaguuucgggauccauccgaaaagcuuccugacaaggauucucagugagaccgcacucgauuaaaucggucugucucuuccgaccaaggaggcgggcucgccgcagccgcuucaaggccaaagcgaguggagcuuacugcgcacgcgcaguagacagcgauggagccaccaauggagcaguccggaggggagcaagaaccaggagcugucagguaccgagcacuggaggggccuagggagggagggcagccgagucugggccggacgcggaucccucuugccagccgggacucucggguauaacagaaggacucgcacguaacagcggcccggggacgucaacgccguuuucccccucaggcuccuggaccugcccugggaagacgugcugcucccgcacguccugaacugggucccgcugcgccagcugcuccggcugcagcgcgucagucgcgccuuccgggcgcucguucagcugcacuuggcgaggcugcgccgcuucgacgccgcucaggugagccggggcccggagccacgcccacgccacgcccccgcguggguaccaccgucgccccgccuccaggccagccccugcugcgcgguaaacccuucccgaccccgggugagacguggagaauuccagagggcagcggcucggagggagcucggugucccuucugggagggcagggggcaaagucccgaaguuaggcggcugccaggcaguggcccgccccggggacagacuugagucuccgugucucccgcccguagguggguccacagauuccacgggcggcacuagcccggcuacugcgggaugcugaggggcugcaggagcuggcgcuggcuccgugucacgaauggcugucggacgaggaccuggugccggugcuggcacggaauccacagcuccggagcguagcgcuggccggcugcggccaacugagucgccgagcccugggggcgcuggcugagggcugcccgcgucugcagcgccuuucccucgcucacugugacuggguggacgggcuggcacugcguggccucgcugaccgcugcccggcucuggaggagcuagaccucaccgccugucgucaacucaaggacgaggccaucguguaccuggcgcagagacgcggcgcgggccuccgcagccucucauuagcagucaacgccaauguuggggacacugcgguucaagaguuggcucgaaacugcccgcagcucgagcaccuagaccucaccggcugccuucgggucggaagcgacggugucaggugccugggcaugggggcgguacuguaggaagugggcagucacuuuggggauagggagguggguuguacuugucaaagacccauuagaaagaccucuggcauuuuuuaggcuagaaaguguacaauuaaaaacaaaacaaaaccaaaaaccaaaaccaaaacaacccccccaaaaaaaaaacaaaaacaaaaaauaaacagacuugggagccaagauugacacacugagaaaugucacauaaaguugauuucuggcauuucugcaacaagguggguaaucuagaaacacuggaaggaacuauggauugguacucucuaagaaccagaaaccccaaaugagccuggagucuguaauuccuuccuggccccuuccuuuagguacaguaaaaaagagcagacccugagcuggagggaaagcuagaacuugcuggagccagcugcggguuuagagggcuggcccuccagaccgugagauucagcaccuagcaucaccauacuccucccucaggacacuggccgaguacugcccggcgcugcgcucucugcgggugcggcacugccaccauguggcugaaccgagccugagccgcuugcggaagcgugguguggacaucgacguggaaccaccccugcaccaggcucuggugcuacuccaggacauggcaggcuucgcacccuuugucaaccuacaggucugacuaacuuuccuuggggugggagcacagcuggacuguguagcccgggcuugacccugagccauagggaaacugaacugugggggccugugguugacaggccugugaaauccccugucccacccuggaauuucaaauaaagagcuuuuuaccccuucuugcguggugcauaggggacgggaagcugggaacuagucagagagacagguuuuuucccugcccugggggcagaaaugagcagaaugagcauauaccuuccuuggaccacuuuuacugugcucuugaaggaagccccaagaauagaacacuagagcaagggccuccagaagggacaggguggaugggagggugucugcaucccucugggaucagcagugcucggcaggauccagcacugucucaguggaagcgguacuuucuggccggcuugagguugauguauguggccuucaucuccucggccucaggguuccggacaucuuugaaucgcucucccuuggugcucacuacuugguugucgauguaucggaucagcuucuugggggccugucaggcaaucaagcaaugaaugacgaaaacca

SEQ ID NO: 9316 - RNA, 1672 nt, Mus musculus
uggugucaaggauuaaauguaggagcuagacuaauaggcaaccgcagagcuacagaccccagccuggaaugaguuauucguuuuaugguuauugaaggugucagagagcuggcuggagaguuagcucucucugacccuuguugcucacuggcuucuucuuccccagagacgaggauggucggacaggcaaugucugugaguccuccgcagugccccuggggcugaggcuccaccagcagccauggggcuggacuggccccaagccuggcuauugggccugcccauagcugugguguacggcucguuggcccucuucaccuccauccugcacaauguguuccugcuguacuacguggacaccuucgucucaguguauaagaucaauaaaguguccuucuggguuggagagguaggccauggggcagcuagcacaaugggagacugggcaucggguucccagguagacagaaggugcuggguccugucccaguguuaggcuuuugggcagacugugcuguuuagcaaaacucagccagaaaagcugguaggguuauuuauuuauuuguuuguuuguuuauuuauuuauaugagcauacugcagcuuguuuguuuguuuguuuauaugaguacacugcagcucucuucagacacaccagaagagggcaucagaucccauuacagaugguugugagccaccaugugguugcugggaacugaacuugggaccucuggaagagcagucagugcucuuaaccucuuagccaucucuccagcccuuaaggacucuucaggaggauucuagaagcacuccuggccacugccuugacgcuccgcuguuuguauguucauauauaauauacucacgggcaucaauuggcuggauacacuuagcggcugccgugggucgcuggaguccgauguguguaccagccaccagagggguuuuggcagaggaacaugcacaaaagcuugccggcaggacgaacugccaucuuuggggaaggugcauggacugguguuggggagcccuguacaccccaccugcccaucucucucuucuugcagacuguauuucuccucuggaacagcuucaaugacccccucuucggcuggcucagugaucgucagcuccucagcucccagccccggugugucuuaggggaugguacaucacugcccccgucugacucugaugaucccccaaaugaaggacugcugcucauauuugggggaggggagggaggggccccaguugugguaggggcauggcccagccaggggaagggguugacccuagugugacauggggcucacggcuccauaccacauauaucccuugcuucuuagacauucccuucccuuucccuuuuugguccccggcccugagaaucgguaucccauagcccuuuggguagggcaguaggacugaggagaggguaagcugucucaggucagggguuggagacuugggguguaucuaagugugaauuccuccaucagccaggggaaccagggccugcccugguguaaagguuaccuccuaacaccuuccucucccugacaggucaggagcagggcucuccuccagagacguggugcugacccggguccgggcucugggcuggcaugggccgcugcuggcacuguccuuccuggcauucugggugcccug
